United States Patent 11,001,841 (CCCTC-BINDING FACTOR (CTCF) RNA INTERACTOME) - sequence listing, part 16

SEQ ID NO: 39984 - DNA, 1034 bp, Homo sapiens
agtggtggtgggtccctgtaatcccagctactccggaagctgaggcaggaggattgcttgaacctgggaggcagaggttgcaagtgagccgagatcgcaccactgcactcccgcctgggcaacaaaagcaagactctgtctcaaaaaaaaaaaaaaaaaaattaacaaccagatctgcctgtgttctctgctatctcatactaccttctgcttgtctaaggtaaataaaatatatgggcttatatcaactctatgtgtgcacatgtgtatacatgtgtatatacgattgcaaatgcatagaaaaggacacattccagtatttaagactgtttatttcagggtaatagaacttggtgaaagaattctatattcctctctactttttggatttaaaaaaggttctgaagagaagtaatggtacaagataaattgtgactgagggtgaaaggtgggactcatacagtacatgacatatgagtgggcagttggaagagggtgagctgaaatgggtaaagaagacttcagagaggatgtgagatttgaatcaagctgcagagattgggtaaggttcgaataagggaagaaggcaagaccaagctcatggcgcagggatgagaaacgcctgattagaataatgagaagaaaaacctgactggagctgagagtttttgcttgtggaatagaggaaaccaagagtggagccagacaacagaagctaaaggtctgactggttttaaactgtgcttgagagtttgggaattcatccaattagtgaggagccatagatggtgtcagcggaggtgagggtcgtgggatatatgatgataaaggcacatttgtattacatgctgcttagtcttcacctacgtgcatgtccttggttaacagcatccttccatgaggatgatggtagatttgggggtgttcagcttgctgaggctctaggaggaaccaactttaaaatgcagatgtattttttaaggtaagacttattatgctaattatatacctggcatatacattgaggttgtgat

SEQ ID NO: 39985 - DNA, 1058 bp, Homo sapiens
gatactccgcaccaaatacaaactggtcctcgccctgaactttaaaaactaaggtcatgaacacattcagctaaaaaagcaggtctgtttgcatagttctttccacctctttcacaagagggaatcacgcacagacacataaaccaagacgcgagttccgggtggatggggatgacagctcctctgttttctggttgcaaacatcaaaaataacatcttgctccagacccccaaacgcagctgacaaactggagactcgatctcagagtcctcagagtccccgtgctgcgtcggcctaggcgtgggatttctaatcatgttcttaagaaccgattctcttgggatttgttggatattaggtactggcttcctgtccctttactctcaggtattagaaacagcatgggagacaaatgcaaatctcagctgcaggacaaaggactgggactaggaacctatttgtagattttatcggtagttgagaccgctacggaatcatttgtgtagaaatgctctgagaaaaaaaaatagtaagacgcagaataatcttgtgtcttttaaatcattaagatgagtcctaatactggactagcgtggtagcgtggccgagtggtctaagacgctggattaaggctccagtctcttcgggggcgtgggtttgaatcccaccgctgccaggtttattgcaaaattagtagggatatctaaagctcattgagatttgcaagaaaaacattttccactgcgagcacaaggtaggtatttaatcctgataatggtaggttgaaaaccaaatagcagctgcaaaatcagactgccatcagttatttctaagacctcctctccaagggagtatgttcctttttatgttttaaaaatgctcatacaaaaagtacaactcacatgattcaaaattacaaaaattcaagaatacatacataatgacagtctatttgtgcccccaccccatcctgccggacacccaattctggaccctcaggcaaccaaccatattaaaatctggagttctattaaaggcatattctttgcatatagtt

SEQ ID NO: 39986 - DNA, 1145 bp, Homo sapiens
cagtttaggggcttaagtttaagatttaaattcgtttttagttgacttttgtgcattaacatcttgtcttgtctcctcacctggatctacgtttcctctgcagcactcacagaactcgtctttatattctctggcactatcgcgcgcgcgtgtgtgtgtgtgtgtgtgtgtgttggcagctccatagaggaggtttttttaaaaaggagagaatctgaagacataccagaagattcaatcttggaacttcgctccaggtggacggaaactgacaaagaaagttggctaacagcagtccttgaaatagatgacggctgtgagaggatccaagggtctttcggtccagaatgcctttctcctcttgacacagcgtcaagacaagattccattcagaagtttcagaaacaggagttaaaacatagcggactttaacctatcatgccttaagccctcacctttagataatagcatataataaatcagtaagaaaacggcattgtaagtgggggtgtagctcagtggtagagcgtatgcttaacattcatgaggctctgggttcgatccccagcacttccacaagtacatttccttatatctatcgttgaacatttcgtttcagtctttgaatacttagttccagtcttttcttttttctttgtgcatacactagcttgtgtttttcctactcacagcgaaggtaagccatttggtactcattcatttgtactatgggtcctaacactccttcagcctcccaacctgactgcttcagcacagctttatagttatttactgaaatagagaagctgcttattcaagatcccctgagagtgaagcaacaggcatgccggtcatagaagactcgttctcctagaccatcctggctaacatggtgaaaccccatctctactaaaaatacaaaaaaaaaaaaaaattagccgggcgtggtggcgggcacctgtagtcccagctactccagaggctgagacaggagaattgcataaacccgggaggctgagcttgcagtgagccgagatcgcgccactgcactccagcctgggcgactgagcaagactccatcacaaaaaaaaaaaaaaaaaaaaaaaagactcgttctcctttgctgccgtttctcattactatta

SEQ ID NO: 39987 - DNA, 1033 bp, Homo sapiens
cctttgatattccgactgagcaaacaacaattatgaagcgttttaggcaggaaaaggctgaatttcaatggctttgtgttatatctggaagaaatcaaaagaaacgaaaatcagaacttgattcttgccaagcataatagaagcagaccctaagaactcaacgtcttcaggccacaaaggaaacttcttgtggttattatctgacacttttctaatctttcgtttttcgtttcaagtcctacacagtattctaaagaatctgtatcccccattagtaccaagtatctcctgctcagagtagctctccacgctctatggtactgaccactattaccagcatgctcacggagtctcagaaaatgaaagttacctcctgaaaattattacaaatgggtgttatagtaagggggtgtagctcagtggtagagcgcatgctttgcatgtatgaggcctcggttcgatccccgacacctccaagtgatggtttccctctggcagttctcaagcgacagacctctgcctcctcacatttttctattctatttctgcacatatagtaagtaaaaatgtactccaatgcattgccttgaactatctccaacctctatgctgtgagcctcaacatcacataaggcgattgcgacagcagaaggaagacaaaaaagtaacgagggggaaagaacaggatcgcaacagtggtctcctgacccaaacaaaagcatgaacattcacaggcggcttgcgttcgctcccattttgttttgttttgttttgtttttgtttgtttgttttgttttttgagacggagttttgctctcgttgcccaggctagagtgcagtcgcaccacctcggctcactgcaacctccgccttccggtttcaagagattctcctgcctcagcctcccaagtagctgggattacaggcgcccgccaccacgcccagctaatttttttgtatttttagtagagacggggtttcaccatgttagtcaggctggtcttgaactgccgacctcgtgagccacccgcct

SEQ ID NO: 39988 - DNA, 1050 bp, Homo sapiens
taagaaaacctcaattcagcgtatctgccaggcacagtggctcatgcctgaaatcccattgctttgggaagttgaggtgggaggattgcttgaggccaagagttcgagaccatcctgagcaacatagtaagacctcatctctacaaaaaattttttaaaattagggtggtagtgcacacctatggtcccagctacttgggtgtcttaggcgggagaatcacctgagcccaggagtttggggttacaatgaactatgaccacaccactgcgctccagcctaggcaacagagcaagaccctatctcttaaaatcagttcatgatggatattgtggcttcagatgtgaaagaaaagatacggggctaaaattctgtattttcagagtattctggtaaccagctaatccaagcagtaatttttgaaatgtgaagtttagaatatattctaaataaaatacgtgcaacctccagtgggaacctcttattattggggaggtagtagaaaggcgctgggtgttctaaaataggctctcctggcccacggctgactgtcttccttgtgtctctacagtggacgtgactctggacccagacacggcctaccccagcctgatcctctctgataatctgcggcaagtgcggtacagttacctccaacaggacctgcctgacaaccccgagaggttcaatctgtttccctgtgtcttgggctctccatgcttcatcgccgggagacattattgggaggtagaggtgggagataaagccaagtggaccataggtgtctgtgaagactcagtgtgcagaaaaggtggagtaacctcagccccccagaatggattctgggcagtgtctttgtggtatgggaaagaatattgggctcttacctccccaatgactgccctacccctgcggaccccgctccagcgggtggggattttcttggactatgatgctggtgaggtctccttctacaacgtgacagagaggtgtcacaccttcactttctctcatgctaccttttgtgggcctgtccggccctacttcagtct

SEQ ID NO: 39989 - DNA, 1046 bp, Homo sapiens
cttttctcaggagcaaatccagaaccagctcgaccatttaaaaagagtgaaagatttaaagaagagacgtcgggcccagggggaacaggcacgagctgaactcttggtaagggttgttggaattcacagttggttctgctggtgctctcctcttctgtagagctgatgttacttcccttaaacttgtccagcatgtcacccagaacttgtaggtagaggtggatcaaccgcacatggcagtgggaactcacccggagaactaagattcccttacttttggggaaagcatggagaagccaagtttggaacccttggaaatcagacctgtcagtttactttaacctgctaactgcgtagaccagggttgatccttggcaaagctgagataggtaaaattattggatacagttagcttgcgttggtaccattctgcagacaattgctaatagtggatttgtgtaatccccactgttgcttctctttggcttattctcctttcttaacaatgccttaattctgaattttttactctgccctcttcctccagtctcaaggccttaacaagtggctgatgtgttaatttatattaggggtatatgggaatttttttttttttttttaagacagggtctcactgtcatccaggctggagtgcaatggtgaggttttggctcgctgcaacctctgcctcccagttcaagcgattctcccacctcagcctcccaggtagctgaggctacaggcgtacgccaacagactcagctaatttttgtatttttagtagagatggtgtttctccatgttggttaggctggtctcgaactcccgacctcaggtgatccgcccacctcagcctcccaaagtgctgggattacagacgtgagccaccgcgcccagcctggctccttgtttagaacaaaagtttataatagagtcctgttggtggtgggggttgggtgaagaacgaaggacagtaaattatggcaaacaaatgagcgccaagagggaatcgtggggagagcacctctccccctcctacccaaagc

SEQ ID NO: 39990 - DNA, 1072 bp, Homo sapiens
attgagggcttagcagaatgaagcaggacatgattaagtctgagattagtgagtgaggacactactggttaaaagtgtgggctctggagtcagactgccagggtatcagatccaaccacatgcaaacattttcttagtctctattccccatgtcctcatttatgaaaatgagaataacagtaatacattcctccataggttgggtacaaagactattataaattgtgcattcaggtgcctaggttggcccttgggccatggtatatgttgcgtgaatgttagcctctgtccctgctgtttaatgagttccttgacagtagtgggcatgtattgggagcctggagcaagtgcctaagcatcccctctagggacgctccttcccaggaactaagaagagtaaaagaatgatgactgctagaaggtaatggatgagatggctgctgagtgcttccaaccttaaacatctttgtttaggaactctgagcatcttggaaataatttgctatcaaactgaaaaaaaatcttgaatggacaagggcaaaaacatttgcctgagactttaaacattttttgtgtcatcttggagagtgcttttttgaagctcaaattttcttttattttggcactgatttttaaagtgattctcagatttttgtaagacagctgcaagggttggatgggccctgtcattcactgacctgttaagagccaatttctgaacttccactaaagcatgggctggttgaatcttagaccagtacttgaaaaactttccactgtgattatccaccttggaccagttggacttaatttgagtctctcttcttcccacagtgaaatatccgctaggaaaagagaagaagtctatggagtagataagcctgcagtttggaaaatgaatagttggcatcagaacagcagcaggaggctgggtgtggtggctcacgcctgtaatcccagcactttgggaggctgaggtgggtggatcacgaggtcaggagttcaagaccagcctggccaagatggcgaaaccctgtctctactaaaaatacaaaaattagctgggcgtgat

SEQ ID NO: 39991 - DNA, 1072 bp, Homo sapiens
cccaggctggagtgtagtggcgtcatctcagctcactgtaacctccacctcctgggttgaagtgattttctcacctcagccctcagcctcctgagtagttgggactgcaagtgcacaccaccatgcccagctaattttttgtattttagtagagatggggtttcaccatgttgcccagctggtctttaactcctgagctcaggcagtctgcttaccttggcctcccaaagtgctaggattaaaggtgtgagccactgtgcctggccttttttttttttttttttttttgagcagttttagtttcccagcagaattgagatgaaggtacagaaacttcccatatgcttcccacatgcatagccttctacattatcgacatcctccgccagagtggtacatttgttacaactgatgaacctacattgatacatcataatcacccaaagtccatagtttacattagagttcacccttggtgttatatattctatgggtttggacaaatgtataatgagacgtatctactattaaatactttacagagtattttcactggcctaatccaatggacatttattgttacttcattatggttgggcacagtgctagatgctgatgattaagagagggcatgggatttggtcttgtcctcaagggtagaacctaggcccattgcatcttcaaagcccaggctccttcaaagcccagtgtagtagcaactgctgtaccttgcctgtgccctttgcgtatctcactcctctatctctctagaaagttggagagaaaagtgagcaaggcatgaggaacaaagttatttatttattcttcattcatctatttattctttcattaccgtttgtgttaaaacattccaaacccaaacaattatttgtatggtcccctgtgtattacttgtggtttcccaagaagtagttgctaagcttttccttgtatggtttctgtgaggtaaggaaggaatgatgtgattttctccagtatgtagaatgcagttccaagaggttaagtaatttacttacagttatttagccaaacaaggttactgcaaggtata

SEQ ID NO: 39992 - DNA, 1995 bp, Homo sapiens
ggacggagcccgggtggatttccggtgtgaccccgacttccatctggtgggcagctcccggagcatctgtagtcagggccagtggagcacccccaagccccactgccagggtgaggggaacagctgcctgcatgcagctgatgaggacgcttgtgtgaggatgggagtggggtgggaatggataatgggaaagaatggagagctataaaaatgtgggggaggacactggaaaggggagatgaaagtccctttttcctccatcacctgcctcaaacttcctcttgcagtccccggtatcctctgtaggttgggggcttccttcctttaccttttaaaaaaatcttcctgctcccgattcttagacctcacgttttctcttttcctttatgaatctcacctctctcaccttcttcaggtttaaatactccaattttccctttctctaaacttagaaatttccatgcatcaccctcttctagaattcatccctcaccattccttatataattgatttattgtaaagactcagaaataaatcaaacattctactaagaaaaattgagaaggggagctctgggggtggaaacatattagggtaaaagacttaaaattggaggcagcattatcagaagatgaagaacaactcagggatggggtgggaagaagacaggtccttttctgtacttcctagacaacctccattattccctaagggaatcagtgttgtgtctgtctacttttttttttttttttttgccacgtaattttacaaactctcccttttctaggcacccgaactctctgccatcttctctcctgggatgcagtcatcccatttgtatgcctcatacttcctctaccctggtagattctttcaagatccttgggctttactttcctcacataactcagttattctgcttctagtttaccattttattctggaaattgagagtcccatccaggggtggacttatgacactactgaaacttagacttcaaggttcctcacctacagggccctcttcctgtgctctaataatatagagggctcgatggatatgtgttcatatggtaacaggcttttgtaaaaattgcagaaataagattttaacagcaattgcttaaagccaattgtatgtgtaattttttttcttaaagactcccaattttgtaatattcaggcaccacagaaccaagatctgccccaaacttagctattggcattcccgtctcaaattctgttgtcctatgaaaaatcgaagaagaaaataagtcctgacccccttacccccagacccaccttgttcttatccccaggcaccctcccctcagaaacgcaggcttctgctctccccggtcttcagcatggacaggtgtgggagggggctggggatcaggccagggaagctgggcgccagtggtaactcttctctgatccccgtctttcctgctgccagtgaatcgaacgccacactcaggtgagatgagaaacccttaccgcgcgcactgcaatgccctccccttcactctgcaccctccacccccctgaaattctgcccttaggctacggggcgtcgtcctttcgcaccttccccaacccaccccagtttgcggccacccccttccctccctacctgtttcctgcctccagtcccggttttccacgaggctgcggtctctccttgtccctgcttggctacacttccctgggctccacctcctcccagactgagcctcgccggtgtcaggcagagcccagcagagggcggcagggtgctgggagaccctgagctcccaccacgttttcccctgtggggttccttgcgaccttcgctggaaccttttccagcctgctgcctcctaggatttcacctaatggactttctcagcctgtcccacccatcccaaccctggccaggcctctcgcgctcttccccacatcttttccttccgtgtaccccttccctcgtcttttctcaattccatgtcctg

SEQ ID NO: 39993 - DNA, 1046 bp, Homo sapiens
tctgcatcactggaggttcccaccacatggccctgcctccctgagtttctgtgcagatgttatggaggagtatataagcagacatccctgggccatttgggaagcaggaaccagctccttgtcagggcagctgtggtccctattttcatcatatgtccaagtgttaccttgtctagcccccaggaacacagtccccaggaccatgttttttggggcacccacagcaggggcagtgcaggtctggttgctcctgctctcacctgcagcatctcccgtagaggaattgtcagttctggttccctgtgggcagtaaaggtttccttgtaggtcactggggcattggccagaaaaaggttgtgaaaatcacatgctaatttctcaaaattcctgctttcaatgttgatgtccaataaagatgttcataatttcagctggatattcttaataggatttcctccaataccgatgctgtaaagcatattgaatggaacaggaattcaaatttgaaactctctctctagaagggtccatgtgggagatggtggctgtggctgtggcaatccccaggtgcagagtgggcggaggcagcctcaggctgaggggtctcaagaaatcccttattccatagggagaagaagaagatcctctgtgggtgtgagggcagtggcctgggtggaatccctgctaggaaccagacaggaaggccttgcagcctcaccaagcagcagccctggggtggagctggatttccagggatgagtggaccaggcaggagcagggcatcccaagtgcaggtcatggacctgggtgtcaagggaagcagagccttcttgagcaagggggtctccagggtcaggtcaggtgcagaccccatggcagccacgtgtttccatcctgggcctgacaggcctgctgggcttcctggtgggctctccaggtaggagctgcctgctcaggactggaaggggaggaacactgagctgtaggtggagggcggaacccacagtgggcagggcctgccctggtgtgcaggtgcttctgcagga

SEQ ID NO: 39994 - DNA, 1082 bp, Homo sapiens
gttatctgtgaatagaattgtatgttttcctttttatctggatgcctttaatttttaattttctgccttattgcactggctacaatctccagtataatattaaataaaagtggtgggattggacatccttgcattgatccccatcttaggagaaaagcattcagtcttcagtctttcttcattaagtttgattttagctgtgggttttttatagacgccctttatcagagtgaagaaggtctcctccattcctattttgttgaaacttatgaacatgagtgatgttaacatttttgtcaactgtttctcctgcatcttttgagataattatgtctttttttccattaatacagtgcattccatgaactgattttcaaatgttaatccaaccatatgttcctgggatgaatcccattggtcatggagtgtaatccttttttatgtggctttgtattatctgccaatgtttgttaaggatgttttcatttatgtttattggtgacactggtgtatggcactcttttcctgtgagtcttgctgtgactttgatatgagggtaatgccagttctgtaaatgggctggaaagtcttccctcctctcttcttgtctgaaagagctttcaaaatatttgatagaattcaccagtgaagatatctgggctttggcatttctttttgagaaggtttttcaatttctgacttagttcacagttctcttcaggttttccagttaatttgggtcagttttggcaatttctatctctgcacgaattggtcctttttatccaagtggtctaacttattggcttcaggtttttcagagtattcacttataatgttttttaacttcctaagggtcattagtgataatctctcttttgttcacaattttggtaatttatcttatttctcataatctcttttttcactgttggtcaagaaaacagacagaggcagcagatggagatgtgacagattctctagtgggaaggctttgatcataatacctggcaagccagaatgatgccagcaaccccaaaggagctgccaatggatcttgacaggaaaatcactgactctgg

SEQ ID NO: 39995 - DNA, 1048 bp, Homo sapiens
tgaaaacacagtgccagcactgtaagaagagctgagcagccgccacagttcccacccagccctgcagccctcctttttattatttgctggccctgtagtcatttgagtttacagccctagtactgattttccttatgtagcgaccccagcccttctgctgccttactgacagctaactgcccctggtggccttccagcctctcactaaaacaacaacaaaaccttaatgttatcttattcatttactcttccataacttgaatccttttgaccacctcctgataaacagccatctagtttttgctgtaggcaacccattacacctcaggcagcctgatcctaaactctcctccacatccctttctcacttgcatccatcccccagttcccgggttttgtcgttcctcagtggccacgcactgcatgcacccttcccctgcacctccttgttgcttaagtccccagaaacttcccccagccctgccaacctctcagcattctctcactttgtcttgtactcttttttccttttacattatttgtctccccagttttaccttctgtgtttctctttgatctctgtctcttttagtctctcttgctaattttcctcttctattctctctctgccatcccatttcctttctgtctcacactcagcttcttcctctttctctgggcatgagccgagccgtgctgtgccctggctccccttgtctgtctgcaaaaacaggcagctctgcggaaatgactcagcagtaacctttatcaacagcttttagaagccagctgccacacacagctgtgccgctggctctctcttccttcaggtatagcagcttaactctctctctctctctttctctcacacacacacacaaactttctgagcttccctcagtatttccttaattggttttttattccatccgttaatcttttgcagtttcttagtaatattacatcagcttttagttacaaaattaacctttaaaaggccttgccctactgggtcctctggatttaatcctgaatattttttcacttg

SEQ ID NO: 39996 - DNA, 1034 bp, Homo sapiens
ttgagatttcttcagatctgaaagtcagcctgagtttttagacttgcttctgagttttagactttggccctgggaaaaaggaaatcagtactccaggaacaagattttcctcgactttgtctcaacccaaagacgctatagcagcgcagttttcaaacgtgctttgaaaataaatgggacagtgtgtccacactggattttgcctttccctttttattacagcccgccccttttgtaaaattgttacacatctctctactgcactaaaaacggctctatcaaagatactttgagaaagatttaatgacatgaaaatatgaagcccccttaaaagagagtttctggagttgggttttaattaacactttggtttttaaaatcctgtaactatttgggtgtgtggcttatctttataatattttcaaacaaatattttttcttaaccaccacacaaatccaagtttattatttttatttttaaattttatttatttatttctgagacaagatctcttgctgtcacccaggctggagtgtagtggtgagatcatagctcactgcagcctcgaactcctgggctcaagctatccttcagcttccagagctgggattacaggcctgagccaccgcgcctggccaaaatccaagtttattctgtaatataaaattccaacatttcagagaaggtgaaagtcacaacgttatcccagtccctggggtccctgtcaaaattttggggaataatcctccatgttttcccctacttaaaatatatattatgtaagtggtattactggtattataattccatatatcctcgtccttttaaaaatggataaaagtaggctgggcacagatcttctcataacaatacttacaaatttatcctcctctttttaaggactgcgtggaattttatcgcgtggctattctttaggggactatggaaatgttatttctttatcttcattgtggtagtggatatgtgggtgtgtaaaacagccaagcagtacaactcaatgagctgtgcattt

SEQ ID NO: 39997 - DNA, 1016 bp, Homo sapiens
ttgaagacacagtaaggaatagggaggaactaagggtttcatgaaatcagcactcactgtggaggagacgtctgtctcagcaggtagctcctaacactgaacttaaagtgatgctgcccatcactgaggatcctggcacaattctcatccgacacaagccctgttccaaaccagcctgctctagtcacctggaaggagacagaggttaggactagaagaccccaaagagggaagacagccagagggaggaatgaagaagtgaagtgtgaaaagatacagaaaataagtgggtgggagagtgggtgtccctctgtgtatggagcttacctgattcacgtaggtctcagaatcttcaggcatgtcacaggtaaaggcagtgttcacctgctccatgtccatgcctgggcaaaatagggttggtagccaaagaattggcctttaaaaatcttttggggtcattctcagacaagtacagaagagcaaaaactgttagtcacctgaggtgcattctccttctcaggttcagaaatgaactacatgtaaaaggaaccaaaggctgtaattctcatggcacccagaaaactggactagggacctggagagtcatgtgcctgtcattgctccaccactcacgagctgtgtgacttcaggagaagctctctactcatagggcctctgattcatctgtgaatcatggacaaatgcctccattctagcaaccttactgaaatgcagggaggaccaagtgatcaatgcggaggaaaaaagcaaagtgatgacatttactcctagacaagactctttaggaaaatgcactttaaaaggaggagaaaacatagtacctgccatcccctgccaaaaagcctctttggtttagtaattatgattgttcatcatctttctataaaattagggcaaaactagctcactcaatgtctcaaataaattaaacacagtttgtgattctatgtccacaacttttgcactgtgtgaaactgaaaagaaatgggaacaca

SEQ ID NO: 39998 - DNA, 1077 bp, Homo sapiens
ccaccgcgcccgcgtcttcatcctcagactcacggcgtcactgtcgacccgcacgaactgcgtgtcgtccacgtagcccacggcaatgaagctgggctccccgcggcccggccaggaaacggcggtgctgaaatacctcatggagtgggagcctgggggcgaggaggggctgagacccgcccgaccctcctcccggcgcggctccccgggtcctgcgccccagccaggtggacctttcgctcctcacggcagaggccgtttccctcctgaccccgcactcacccgcccaggtctcggccagggccagggtccccgagagcagcaggaggagggttcggggcgccatgaccccatcgtcggcgtctggggagactccgagtcccggtgggtgcgtggggactttagaaccggggccgcgcgacgctgattggcttccctagaaacccgacactcagtgggagtgagaactgggtccgcgtcgtgagtgtccaggaagaaggacccgtcgcaggctgggagagggagaagagaaactctgcggagatggggaatccccaatgctgcacctccccagcccatgcaccgccttcggggcctgagaccctgagagccatgcctggggctctgggacttcgccctgaccccgctcctcctgtgacaaacgctctgtctcaatgttccctgagtcttggtccaggagctgtccgagaaaccaggaagaaaccctcagcttgggccccgtccctctcctttcacttttcatccgggaattcctgtccctgaaatggactccctgcttccccgctgcttacctgttcccctggactcttcaaaaagaaaactcaccccagggagcttggtgccagagagggagctctccctgggaatggaggtgtagagacagaggtttttttcttttatttcttttttctttttctttaaatctggaaaagttgtgcctgggtgcatgagatagtatagagaccagtttgctttttgtgtattaactacagtgggtagcagaatcttggtaacccctgaatgatcaggaatctaatcggtaaaaacatgtgactt

SEQ ID NO: 39999 - DNA, 1227 bp, Homo sapiens
gcccttctccccttcctgccccctgcagaagaagctccaggaccagaggcagtacattgtggctgagtttgagcagggtcatcagttcctgagggagcgggaggaacacctgctggaacagctggcgaagctggagcaggagctcacggagggcagggagaagttcaagagccggggcgtcggggagcttgcccggctggccctggtcatctccgaactggagggcaaggcgcagcagccagctgcagagctcatgcaggtgagaggccgtccctgggcagggcgccagggaccaggacggtgggtcccagccctgccattcacttgcaggaccttagaagacttgggggctcagttttgtcatctgaaacatggagatgataatccttactgctgccaattagtctgtagattgcatgagcataaaatgaaataactggcatgctgtcacttcaaaaaataaactttttacacaaaactgttcaaaaaactaaatggtatagtagaaaatggaagggaagattattaatatcatttaccatcctccatcctcatcactgccatcacaagccctcttaacaagtcattggcagacacttagcagctggtggaagctttttatggtgttgtggttgggggtggctgagggagggctgaccagcagctcctctcaaagacccagaggatctggaagagatagggtaactggggaagggagacagagatggccaggttttctttggcccatgggattaccacacagagaacaagatggaaagcagacaagggggcctcggggcacctcctagaggagggggctttgatagtgagaaagggagggtttggggctgaagaactggctgtgaagctgaaatggcaccacatctcctcccccccgggagcctctggggatcacacttaccctgaagagggcccagtcccctttggaggggtagagggctcaaccttcctgctctcataggctgggaggggaggggctctctgatggtattcccccacttgcactgtttagggtggctgggtctgtctgtcagcagcagagccacccaggatctctaggaaggtggagtcccaggctaatggcagggcaatagctaggagggagagatagcaaggcagactctgcagtatgtgcactgggacagactgcagaaggaggcggccacctgctcctcattgttgtgaattcagatgtacagaatgagg

SEQ ID NO: 40000 - DNA, 1026 bp, Homo sapiens
agattacggggcggggacgagctgtcgcgctggttgctcgtgcaggagcgggacccggaacagaccgccgtgagagaggaggggtgccggccgggattcgcggcccggagctcgggaccggtgagtagggggtgcacatgagacatacagcgaagcaacagtctcgtacgctcaccgggtttggggcgacccaacgcagccgccgggcccgggttcaaaacggggccaggcccccgggcgggctcaggagggggtcaagttcgctgcgtcctccctgccagccagatccctcctgtttgcttgtccttacattctccccctcctcttgggtctttctcgctttctggtatcctactcagactcccatccattctagtctgcggaaccagaagtaagcggggcctggatgaccgtccggttgcttggagcctggtagataggcgactaatccagctccctgaccaaagtgtcatgctttctttctctttcttttttttttttttttttttgttcggagtaaaccggtttagccacaaatacttggagctgtgctttcactccttccagctcattagcatttttcttactgattttctccctatttggccttagaaaaaaagtgtaaatttaactctgtggagtaaatgggagggacacacttccaaatctccagtagatttcaaattttgacccacgatttgtgtgtacttcaaaagaggggagaatgacattcgtttatgcatgccttaacctcctgtttttaactcttagctgaaatcataatccctaacatgtttttccccaagttcaaaaaaatcacctttaaaaaaaataggctttttatgtttcaaaaattgcaattttattgtttaagtagactttatttcttacaacacttttagatttacagaagaattgagaagatagtacaaacttcccacatgctccaaaccggatcccctgttattaacatcttacctcagtgtggtacatttgttgcagttaaccaatatcaatacattatta

SEQ ID NO: 40001 - DNA, 1094 bp, Homo sapiens
ctacgctttctgttcaaaacccagtagttaatgctattagcattcaaaatgcctttttttccttttaaaaaggacagttaaacctgttattttttatcctgcagccagttcttagcacaaaagcaggcagattttagtagcacaaaattatttattagcttatgcctctaccagaaaacagaaatgttggcttaaaattgtttcattgatgtaacttttaccttttcctttacagatattcatttattcattctggccctaataccaaggtatccttcacacaaaagattcaaacagattctttgcatctttaccaatgggagtttcatgttttcaagtttttgtttgtttgtttgtttgttttttgtttggaggcctctttccaagcactctagtattcttaaaatcctgagattctgaatggtatgatttagctcaatatgtttatactaaacttaggggaaaaaaactaatatattttccttacccatcacaaggtttatgctgagacttcaataacaaaaaacagactaacaagagaaaagcatgcacatttattttatccaagttttacatgacatgggaactttcagaaacgaaaacccaaagaaatggggacatttgtgtagttgtatagacagtcaggcagatgtatgattgcaaggacaaaagtgtatgagctaacggtgataaactgagaagttggaaaggcctgtctattcagtttcttcttggcatacctgtgtggcagtccctccctcagggcataggagaggatgcctgttatataaggggcctcagatgaaggagggagaaggagggagcaggtcagagagtgaccttcctagattttgtggcctgcttcagggaagaaggggcgaggggaactctagtttctatggcctgcttcagggcagaaaggagcaagaggtcagagaaaccttcctgtttctgctattttctcaatttccaaggtgccatattttggggtggcatttcctgtaccctgtcatatacaaactcatttttagacagcggcctttagttcctcctgaggttaaaccagagctgctcaaggaatatacctactaaat

SEQ ID NO: 40002 - DNA, 1059 bp, Homo sapiens
agatttagcaatgtccagataatcctgacacctggagaacaaaggcacttctaattttgctttaaagataataatattgattcttgcaaaacatagtaattaaggaaattaatcctttatcacaaactcttgtagcagagcacatcttcccatgatcttcttttatcatatatatatatgatatatatataaagatatatatataagcattgtacctagggtggacgcgttcctcctcttactttctggaatgccctactctgtctatgggttagctcttctttcaccactgaacttgcttttgctgtgcactccagcagacttgccctgaattctttcttgcacgagatccaagaaccctctcttggggtctggattgggacctctttcctgtaacaggaccaccttccacaaatggacccaggttcagtgtccactctgattcactgtcccatgctgccttccctaaagcaggcactttgccactggtttcacacgtctggggtgaagaactcttcttggtttgtccggaacctttctggttttgcgtggaaagtcctgtgtcctgggaaactccacagtcccaggcatcctataccatgcttcatttgccaaaaactgtgacccaaaaaaattgtgaacaatgattttactgcaaaatgttggaaactctgtagaaagtagttgtatggtatgctgtgaaaatagggaattttttttgggtatttgattttgtaacacttttctgattataaaagcattaaatacacatttggaggtacttggagagacaaaggaaagcttaaagcaatgcttttcaagctttgttatgtgtaagaatatcttgcttgaaatgtagagtcccaggctgcaacgcaagagtgtgcatcaggaagagtggagtgttgcccagaaatctggaaggtaagagaaaaggctagccactaatagtagtttaaatgagtcgagagtctggtctacattttgcatgtctaatagacatctcaaaattagcatatccaaaatcagatccaaatcctctcccctggtctgtccctg

SEQ ID NO: 40003 - DNA, 1067 bp, Homo sapiens
gtgagttgagatcgcgccactgcactccagcctgggtgacagagggagatgccatctcaaataaataaataaatataaaataaaataaatctttacgtttccttcaaggccaacatcaaaagcctcttctttgaaggcttctctgactaaacactagctgtttccagaattcttgtggcatccaatctgactggaagatttaacatcagattatttgttgtaattataaatgtacagatcttaatattccattatatggtctgtgcatattatagacccctgcccactgcactttggggcttaaaacctattggttggctaattcagttattaaagaattcagtaaatgagaataacaccttgtctctcttgactcttggtccaaatctcttgcaaataggccacaccgtagtcatagagcaagaggactcagatacagtttggttggtcctttaccttcaaaagttcaagtgctggctgccgagacttctccaactcagtgatcagggtcccaagctggaccacctcctcagaacccttgatgacacggctgttcctccttttggtgagttcttgctctagccctaccagctgctccaacaggtactgttccctttctctcaaaaaccgatggccctattcaaacactgatacaatgtcttgcctgtggttctgaaatgttgtctacagtaaatgcagaaagagaaaagtgacctttttgagaggctagggaacaccagaacatgtgtgagatcttctgaggatgagttcagaacagaaatctctttgatcactctccccctccccattcctcaatacttcccccacacacataccccttcctctccttaacctatgccccgctactacctacacacacacccctgccctacacacatacacacattcatacagaacatttactagagacctctcttaccaccagggcctgaatctcatcttctcccatagattgagaattctgaatgctatccttgtatcccttcagaatcttccgatggtttagaattttgccctatgaaaataaacaaggatagtctcgggct

SEQ ID NO: 40004 - DNA, 1073 bp, Homo sapiens
cccacctgtgagtgagaccatgcgttgtttggttttttgtccttgggatagtttgctgagaataatggtttccagcttcatctgtgtccctacaaaggacatgaactcatccttttttatggctgcgtagtattccatggtgtatatgtgccacattttcttgatccagtctatcattgatggacatttgggtcggttccaagtctttgctattgtgaatagcgccacaataaacatacgtgtgcatgtgtctttatagcagcatgacttataatcctttgggtatatacccagtaatgggatggctgggtcatatggtattcctagttctagatccctgaggaatcgccacactgtcttccacaatgtttgaactagtttacagtcccaccaacagtgtaagtgttcctatttctccacatcctctccagcacctgttgtttcctgactttttaatgatcatgattctaactggtgtgagatggtatctcattgtggttttgatttccttttctctgatggccagtgatgatgagcatgttttcatgtgtctgttggctgcataaatgtcttcttttgagaagtgcctgttgatatctttgcccatttgttgatggggttgtttgttttttcttgtaaatttgtttgagttccttgtagattctggatattagccctttgtcagatgagtagattgaaaaaattttctcccattctgtaggttgcctgttcactctgatggtagtttcttttgctgtgcagaagctcttcagtttaattagatcccatttgtcaattttggcttttgttgccattgcttttggtgttttagtcatgaagtccttgcccatgccaatgtcctgaatggtattgcctaggttttcttctagggtttttatggtttcaggtctaacatttaagtctttaatccgtcttgaattaatttttgtataaggtgtaaggaagggatccagtttcagctttctacatatggctagccagttttcccagcaccatttattaaatagggaatcctttcctcatttcttgtttttgtcaggtttgtcaaagat

SEQ ID NO: 40005 - DNA, 1049 bp, Homo sapiens
aagtccttaaggaaacagcaaatcctggaccccaggaaaatttccagaactgtgactgcagacccagggcaggatcaggaaacatgaggaaagcaggtgtggtgactggaccaactgccctcctgaggtctgtcctcagtagggatcttcccttgtgacctgtgactgctgggaggtccccatcaccacaatcatcaaggtgataaatttgtccttcgttttcacatgtgcttcacaaaagagcaagtgttggcacacagggccccaggctaggtcggcctgtgtgtcgacggtgcttcccagtgatgaagcaagtcacaattctacctgtggcttgaaacccacagtggaacaagaaaacccagaccccacctctcaccccttccctacctgagcttttcttcctccacatcgcagcagcaaccacagctccagtgaccacagctccaaggagaaacaggccagcaacgatgcccacgatggggatggtgggctgagaagacggctctgggaaaggagagggaggtgaggggttctgacccccaggcctcagccctgccctgctgaaggtctcctgctttccctgagaggagacaacttacacccctccttaccccatctcagggtgaggggctctggcagcccctcatgctgcacatggcacatgtatctctgctcctctccggaaggcaccactacagccacccacttctggaaggttccgtcccctgcaggcctggtctccacaagctccgtgtcctgggtctggtcctccccatcctgctgccaggtcagtgtgatctccgcagggtagaggcccagggcccagcacctcagggtggcctcatggtcagagatggggtgctgggtcacatgtgcctttgggggatctgaggggaagagtcagaaaattcaggcactttgcattcctcataggacactccagcagcatacatgtgaccatcctgagaatggacaggacacctgggatggggaagggagcacagaacccagacaccagcctggacacaggaatctgggataatctc

SEQ ID NO: 40006 - DNA, 1970 bp, Homo sapiens
atgggttacaaaatagtatttgtaatccttatggtaacctcaaacctaaaaacatacactggatacataaaaaataaaaagcaaaaacctaaatcatatcaccagagcaaactaccttccctaaaggaagacaggaagaaaagaaagaagaagaccacaaaacaaccagaaaacaaataaataacaaggcaggagtaagtctttacttatcgataatacattgaatggaaatatggactaaactctccaatcaaaagacatagactggctgaatgaatggagaaaacaagacccattgatctgttgcctacaagaaacacacttaaactataaagacacacataggctgaaagtaaagagttggaaagagttattccatgccaatggaaaccaggaaaaagagaaggagtattgattttgatacaaaaactatgagacaaataaagtcactatacaatgataaaggggttaatatggtttccatttgtgccccacccaaatttcgtgttctattgtaatcctcaatgttggaggtggggcctggtgggacgtgattagatcatgggggtggatctttcatgactaattcagcaccatcttcttagtgctgttctcatgatagtgagttcttctgaaatctggttgcttaaaagtgtgtagcacctctccacaccacccgcttgccttggtctactcctgctatgtagatgcttgctcccactttgcattattccatgagtaaaagctccctcaggccttcccagaatcagatgccgctatgcttcctgaacagcctgtggaactatgagccaattcaacctcttttcttcataaattaacaagtcttgggtatttctttatagcagtgtgagaacagaataatacagaaaattggtaaagaggagtgaggcattgctagaaagatacctgaaaatgtggaaacagcagtggaactgggaaatagacagaggttggaagagtgtggagggctccgaagataggaagatgaggggaagtttggaatttcttagagatttgttaaattgttttgaccaaaatactgatggtgatatggacaatgaagtccaggctgaggaggtctcagatggagatgagggacttattgggacctggagtgaaggtcacttttgttaggacattgtggttggagacattgtgcccctgccctaggaatctgtggaactttgaacttgagagcgaagatttagggtatctggcagaagaaatttctaagcagcaaagcgttcaagacgtggcctggctgcttctggtagtctgtgctcatatttgtgagcaaagacatgacaagaaactggaacttatatttaaaaaggaagcagagtgtaaaagtttggagaatttgcagcctggccatgttgtagaaaagaaaaaaaccattttctggagaggaattcaagctagctgcagaaaattgcaagtaacaaggagcaaaatgttgatagccaagatagtgggaaaaacaccttgaaggcatttcagataccttgggggcagcctctcccatcacaggcccaaaggcctaggagggaaggatggtttcctgggccaggctcagggtcctgctgccctgcacaacctcaggaaactgctctccaaatcccagctgctccagctccagcttcagctcaaagggccccaggtatagctcaggctgctgctccataggatgcaagttataagccttagtggctcccgtgtggtgttaaattaagcctgtaggtgcacagagtgcaagaattgaggcttgggagcctccaactagatttcagagtatgtgtgggaaagcctggatgtccaggcagaagccagctgcagggacagagccctcatggagaacctctactagggtagtgtggaggggaaatttggggttggagttcccacacagcttcccctctggtgtactgcctagtggagctgtgagaaga

SEQ ID NO: 40007 - DNA, 1033 bp, Homo sapiens
attagttcaatcactgtggacagcagtgtggtgattcctcagagagctaaaaacaactaccatttgactcaccaatcccattactggatatttacctaaaggaatataaatcattccaccataaagacacatgcaagtgtatgttcattgcagcactattaacagtaacaaagctgggcacagtggctcacctcacgactgtaatcccagcactttgggaggctgaggtaggcggatcacctgaggtcggcagtttgagaccagcctgaccaacatggagagaccccatctctactaaaaatacaaaattagccaggtgtggtggctcatgcctgtaatcccagctacttgggaggccaaggcaggagaattgcttgaacccaggaggcagaggttgcagtgagccgagatcacaccattgcactctagcctggtgaaggagcaagactccatctcaaaaaaaaaaaaaaaaaagaaagaaagaaaaatacacattcagaggagacaaaaaataaaaaacaatgatgcatgcccacaggatctagaaaataacttcttaagggcaaatctaggagttattggccttaaagaagagatagagaaagagataggaatagaaagtttgttgaaagggataataacatagaacttcctaaacctacagaaagatatttatatccaagtacaagaaggttatagaacaccaggccaatttaacccaaagattacctcaaggcatttaataatcaaactcccacaggacaagggtaaagaaaggatcctaaaagcagcaagagaaaagaaacagataacatacaatggagctccaatacatctggcagtatatttttcagtggaaaccttacaagccaggagagagtgacatgacatatgttaaagtgctgaagggaaaaaaccttttaccctagaatagtatatccagcaaaaatatccttcaaacatgaagaataaacaaagacttccccagacaaacaaaagctgagggatttcatcaacactagactggtcccat

SEQ ID NO: 40008 - DNA, 1049 bp, Homo sapiens
tcaagtttttttctttgaattttgctaatgttttccttgaattatgagcactgacagaatgtgcttagcacttttggctattcacacagcttttgagcatgatttgcatccaatatttacattgctagcaataataagccatctgtgagttttgtcaaaagttattggggattttttaaattttagaaatgcaaattattgtttctttgaactaactcttatgcagttgcaaaggcatttccagttgttatagtttgtgtacaatatcaggtgttccagattatgattcattattaatatcattgcttccttgttccctctgaggtccagaagattcatgtttacaatatttagaaacaatgttaaaaaggtatccaaagtttgtcactttattattagtttgttcttaatattctgtttaagtttttgaattcatagatatcaaaacgctgcacaattatgatttccacaggaataacaacacactaacaataagaaccaaaaacagcaaataggctgcctacaagttttgacaatattaggataatgataatgacagtttttctaaatctcacagtaaagaatgcagcaacccagcaacactgctacctgtggcctcaggctgcagtgtcagctcttccctgggtctccagcctgccagtctaacctgaaaattatgtacttgccagcccccacagtcacgtgagtgaactggcccaggctggtcaccagggtcagtttctctgtgtgtcattaattcattcagtcttcagcagtctctttggagctgagatgtacctaccatctgccttttgggtgcttagggtggagaaccagaaaagtataacctagtgtgtatcctcaaagagctaacaatatggggtggtacctataggtctggaaacactttactgactctgtgaggcataccaggagacgtcagagaacagtccctcctcaaatgccaaatgagatgcagaagaaatagtttgctcaagttcatgggccagatatcccagtggtcagggagtttcatgaatgagatggaa

SEQ ID NO: 40009 - DNA, 1032 bp, Homo sapiens
catagtactggaagttctatttggagcagtcaagtgagagaaagaaagaaaaggcatccaaataggaagagaggaagtcaaattatctctcttcatagataatgattctatacctagaaaactccatggtctcttcctgagggcttctagatctgaaaaagaacttcagcagagtttcaggatacaaaataagtttacaaaaatcagtagcatttctatacaccaataacatctaaaccgagaaccaagtgaagaatgcagtttcattcacagtagcctcaagaagaataaaatacctaggaatacagctagccaaagaggtaaacaatctctgcaatgagaattttacaagacactgcccaaagaaatcagattacaccaatgggaaaacattccatgctcctggataggaagaattaatattgttgttaaaactgccatactagtcaaagcaatttacagattcagtgtcaaactaccaatgacatttttcacagagttaggaaaaaaaattcaaaaattcatatggaaccaagaaggagcccaaatagccaaagcaatcctaagcaaaaagaacaaagctggaggcatcacactacctgtcttcaaattatgaggttacagtaactaagacagcatggcactggtacaaaaacagacacatagactaatggagcagattagagaactcagaaataaagccacatacctaaaaccatctgatctttgacaaaattgacaataacaagcaatggggaaagaactccctattcaataaatggtgctgggataactggatagccataggcagaagaatgacactgaacccctatctttcgccatatataaaaatcaactcaaagtggattaaagacttaaatgtaaaacctaaaactatgaaaatactagaagaaaacctaggaaataccattttgagcatcagccctggcaaagacttcatgatgaagactccaaaagcaactgcaacaaaaccaaaaattgccaaataagccttaattaaactaaagaact

SEQ ID NO: 40010 - DNA, 1048 bp, Homo sapiens
aatattggagaagacaccacattttaactgagttccagtgatatgacaggctttcaattctctaatctcacagaagttagaaaaaaagtagataatcaaaatccacagaaaatatagaagattccattaactctgagaatgattctcaggtatccttaggacctcaagaaagctgttctctcctgggcctgtagagagttcaagtgccaggaatctaccacaaagtagccgggaggtgcagggcagcagggggcacagtgaagtgctgaagggcttctcagtcttctttaattagagtgagaagaaaagagcacctcctcattttagagtacatggtgtgaactcactctcagctgccaagtgagcttcaccttgggctgttttgcatgctttctcctagtgctttaagccaccctgagatgtacagaccaatactggccatcacaaaaatatactcgagtacatagaccattgacactataaagcaagtaaacaatgaagtctacataacagccaaataacaacatgatgataggatcaaatctgcacatatcaatattaaccttgaatgtaaatgagctaaatgcctcaattaataggcagagagtggcaagttggacagagaagcaagacccaactgtatgtcttcaagagacccatctcatatgcagggacaccaatagcctcaaagtaagggatggagaaagatctatcaagcaaatggaaaacaaaaaacagcactctctgtccaacaaaaacagaatatacattcttttcagctgcacatggtacatactcttaaaatcgaccacaattgctttattggccagaaagcaattctcaacaaattcaagaaacctgaaataccggccaggtgtagtggctcacacctgtaatcccaacactttggaaggctgaggtgggcaaatcacttgaggtcaagagtttgagaccagcctggccaacatggcaaaaacccatctcttctaaaaaatataaaaattagccgtgcatggtggcatgcgcctgtaatcccagctacttcgga

SEQ ID NO: 40011 - DNA, 1051 bp, Homo sapiens
cctgggcaacaagagtgaaactgtctaaaaaacaaacaacaacaacaacaacaaaaacacttattggtgggcaggttctcataagaggccatgggaaagccatgtcctatctcagggacacagggtcatctgggcctctggctaatagaggccaaataatgggactattttccctgtgaaatcctgaaaaccaaaaatggtggcgtctttatctgcattagcagaggtaatttgctccttcttgaaatccaaggtcacgtctactgtctggggattttgatccagggtcagtgtggtttctcctttacaggagagccgagtctcagaaaggtgaggtggtttgtgttggtcattggctacctcagattttagagcagctctaccttgattgtggggttgacctaattttttttgctgtcttctttcttctccaggtgaggaaagaggacttcctgtatatctctatccttttgtttccattactcactttctgtggctgctgctgcagaagccactgctgactgatgtggatacctcaatctttggtttacaaaaagcctaggtgtcttttggcctctctccaggttgatagccatggctcctgaaagaaataaaagatgatcatctttctaaaaagtcttaagtctgaattattagtaacttaactggagaatctcacttttcctactctcgtattttaaccacagttgctctaacacagacctttgaggatcttttcatgacttcattcacaaatacctatttatgctgtacagatgctactaggaaggaaatagggatgtctgttttgactgtggaacttaacttggtctcgtctcttcgtgcatgcaaccctgtccttgggatagctttcttgagcatatctacttatgttcaagaggtaaattgtcctgaaacccccattgctataagtatttattttattactcataatacttaatgctcctaaagttggggtatttttttttttggatacctaaacttcattgagatactttgaactatttatagagaaaacggaaccttctaa

SEQ ID NO: 40012 - DNA, 1052 bp, Homo sapiens
tggagtgcagtggcatgatctcggctcactgcaacctccgcatcataggttcaagtgattcttctgcctcagcctcccagtagctgggactacaggcacatgccaccatgcccagctaatttttgtatttttagtagagacagggtttcaccacgttggccaggatggtctcaatctcgacctcgtgatctgcctgcctcggccttccaaagtgctgggattacaagcgtgagccaccttgccctgcctcctgtggctgtcttgttgagtcatttgtctctgcttttcttgttgctctggtctcagtcttgtgatttactcctagaggtgctggcaagcctgagctcagatttaggaataatggggttgggacaggagaaggatgagatagggactagcagctgatgaaaaggaagggtggacatattcatcgtaggggtttcaggaactccattatctcacactcagcccctttgtcatctctgggatcaacacagtgttatcatcgatcagcccccagattcacttcagtgaatctgtaaagaacaagcatgtcctcctcatcccacgaattctgctgcttagaaagccacctgaaagtgatagcccttaaagtcctcagtctgcccctttagagcaccacagaaagatccctgaatggagatcctgacccttaagtatggaactgctgggaagagctatttggagattatcattacatggagggttagtaacatcactttctcttccctttatcctcatttttttcccttaaaaaaaaacacacacacccacacaaccatttctttgctatttgctgttggtatccagtatgccattgctttcttaattaatgagatacattttcccttcctgtatgcctattttaatggtcaatttctgatatctctaaacatgtctttgttgtcccctccctccatttccacttccactgtcctatttcagttctggactataacaattgcctccctacctttatctgagcatttggtctcactctcttgccacactcccagtctttcccctgtatg

SEQ ID NO: 40013 - DNA, 1040 bp, Homo sapiens
tgtcctcttgaaattcttgaacaagggaccccacgtttttgttttgcacagggattcacaaattctgtagccagatcttggtctaagggaatataaatggtacagcagtagcttctgttacaaaacctatttgtcattcctgtgaatttctaagcagggaccatttttatgcctgctgtctggtactatgcttaccattgaaggtactcaatgaatgtttgtttcaaatgattaaattttcttttccattttaatttttttgacaggtaaaagtcttgcagtgaaaaacccgaggacccttaccgcaagtgtcttttgctcccagctactgatactggattccactcgtgattctccctttcttagcgcattcatgatatagacatcagtctctgagctggaggaggacaaaggcagcggtcctgtgaattctatgctctagcttgggttaagggatttggaattgcacttgtttcagaggtatgttagaggcaggaagaaatcacatagcgggtgtcttgtaggcaggaagagtacttactaggacttgaagactatgttaaaggttcttatgttaattatctattgccctgtttttctccaaagattaatggttgaaaacaataaacttgtattgtctcacagtttgcgtggttaggaatctggaaatggcatagctgagtggctctggctcagagtctaatgtggttccagtcgatatcagctggggctgcagttctgaaagtgtgagcagggctggaggatcctcttccaaggtagctcactcatgtgcctggcagggtgtgctgggtgtgcctgaggcagaaggtgtgtttcctgtcacataagtctccttttagagtgtcttcatggcatggctgctagcatcccccagagcaagtgatttgagagcgagagcagggagaaagctacattgtttttaatggcctaatttcagaagtcacatctgtcacttctgtttgttaaaagcaagtcatcgagcactgaccacactcaaagggaggggaattaggctctgc

SEQ ID NO: 40014 - DNA, 1081 bp, Homo sapiens
attaagtgattttctgtaaagcagtggtttagttaatgccttatttgtaatgtgaaatttacttataaatagcttgataatacgttttacgattaaaaaaatcactgtcactcatgattagtatattttatttcatttaggctaactgcagcatccaagatgcatggtgatgaaattacaattggattatgtctgtatttcgtctggaaaacaggacttgaatgcaaaggcagcaccaagcatatctagagtgaagagtctcaacaagtagcttaacaagatagtttcaggccaaagatgatgtatttagtggaatttagagaatacccctttatttgaagttttcctatattgttgtactggaaatgcttcactgtattcagtcaactagagtgggtacatggaattttgatattgcacctgattttgtcccgtagaacaatttattcctccaacacctccctcaggtgaaaattcaagaatttgcatgggtagtcattctgatgcatatctccaagcttgtatcttcttcccgctgacaatgatgcgttacagtctctggctctatctacatgtgatgtgcaagatgtctgacaaaagtcagagaagcccgttgttgagttttgtctccagatctaaggatcggtacttttgccagattgggctgcttctgtttgaaaaagacaagcgtgggggtgggagagattgctggttatcttccagtacctgtcttcctcttcttcctgaataaaaaattttagctgggcacatggctggctgaatacaagttacatttttcagcatcttatgcaaccaggtatggccatgtgactggccagtaagggtgagcagagatggtgtgtgcagcttctggttcatgccccttgctttgtcccactgtttggagtgcagtacaggtatggcggtaagccctgtcagaccctgtggtgggcccagttccttagggtagtcacctccaaactttgctgcacattagaattagctggggaacttttaaaaatcccggttcccaggtcacaccatgtgtaccaatcaaatgagaatgtctcagggtggaagc

SEQ ID NO: 40015 - DNA, 1035 bp, Homo sapiens
agtcatcaatctttttcttatgaaggagttttttgtttattttttagaaaaaaaataacattcatttctgacagttccagaggctgggaagtccaaggtcaaggggatgcatctggtcagagcctccttactcatgggaactctgcagaatcctgaggtggtatggggcatcacatggcaaaggagcagagcatgctagctgaagcctcttttcctcttataaagccactagtctaactcccatgataacccattaatccatgaacatctcttaaaggccccacctgtcaatactgccacattgaaggttaagtttcaacatgagttttggaggggacaaacattcaaaccattgcattctgcctgtggtcccccaaacccatgttcttctcacatacaactatacttaatccccatatccccaaggtcctaacttgtttcagcatcaactcagaagtccaaaattccatctgtgaaatcaaaacaagttatctacttctaaggtacaacggcaggacgggcataggatagacattcccatttgaaaagggaaaagtaggccaaaagaaagggttaataagccccaagcaagtccaaagcctaagagggcagacattaaatctcaaagctggggaataatcacccttgactctatattcagcatcccccgtacctggaggaattcctttttttttttttttttttctgttgtagagacagagtcttactgtgttgcccaggccggtctcaaactcctggcctcaagcactcttcccaccttggcctcccagagccctgggattacaggcatgagccactacgcctggactggaggggttctttatacagtctgtgatatggatttgtgtcccttcccaaatctcatgtcgaatgaaaatccccaatgttggaagtggggcctggtgggaggtgattgagtcctgggggtggatttccccctggatgctgttcttatggtagtgagttcttgtgagatctggttgtttaaatgtatagcacctccccactctctct

SEQ ID NO: 40016 - DNA, 1066 bp, Homo sapiens
ggatttgcatcatccctttgcccagtatccacagtgtatatgcagcctgcctattagtcacttaatagccttcttatcaattttactgcctaagtatcacagtgcttatattcatggaacccttattttacatgacagtggccccaaagtgcaggagtactaatgatggcaacttggatatacaaaagagaagccataaagtgcttcttttaagtgaaaaggtaaaagttcttgacttaaggaaattttttaaatgctgagtttgctaagatccatggtcagaacaaatcttctatccctgaaattataaaggaggaaaaagaaatttttgctagttttactgtcacacttcaaaatggaaaagttgcagccacagtgcatgttaagcacttggttaagatagaaaagtcattaaaattgtgggtgggaaacatcaccaaaaaaaacttcctattaacagcaatcgggttcagtactatcagtggtttcagacatccaccggggatcttggaacatatctcccaagaataagagggaactactgtagtctgttttcctacagtggtgccattcctgatattttcatatttttaaaaatttgctgatatttttatttataatccttaataattccataacaggtcttgttttgcaggtaatgtttttaaccttttgtcagtagataggcatttacttcatttcctattgatacttagtttcctctttttttctgctacacagtattacaataataactttctgaacacatgtcatgtgctggtagatttttgtgagaaaggtttctgggtcgaaggatatggcatgtttctaatttgatggatgttgccatattgctttctcagtaggctgttaacctttacatttccttacaacaatgtatgatcctgctcccttcccacttgcccagcaaagatacatattatttatgtttttatttttttcccagccaataaagagaagtcttagttacttttaattttctcttcctttagtaattttgattatgttactgtttgccattcagattttctgtgcattttcaatt

SEQ ID NO: 40017 - DNA, 1295 bp, Homo sapiens
ttgatttataccaaaggattttcaacacaggaatatgcaaaaatgaactgtaataatgggatgtaattaaacaaattttaaatatacatttttaatatttttatatcaataagggaaaacagaagcaatcttgaaatgactgagtcatatagagcaaatgggcatataagcagtgtaggtaggaaactggttgaggtcagatatgatgagatgggagggatgaaggcggggtttaattgtccaagacttgtgagattcttactcatgaaaaggcaatatatctaatccccctccatttttttcattttttattatgaaaaatttcaaacatagagacagtcttcagcttgctttttatactttatagtggcttttattgttccagtttggtgacatagagctacctcactctttttaaagtctgcattattcattttgtagacatgtgatttattcaacaattttgagtagacatttaaggttctttccacatcttattaaataaaggctgtcgagaacatccttgtacatatctctttagatcgtcgtgccattatattagtaggataaatttctggaagtttggctgctgggttcgaaggcatggaaatttaaaattctattagatttttacaattatctttccgtaagtgcctggcaaggtgtcagagccctggcaccgggaagtggtcaactcgcaggttggtaaaatgaatttaccatacctacaaacagtataggtttgaaaaaaggaaagtttattagaaaggaagaactgaaacagcctttgcaaaatgatgactgagacagtgaaagaaatctaacgtaaccgactccatcttgcttctaagctccaagctgttcttgttcattcctgggcgtaggctgaactaactttgggagaaacttagtttataaacaaagagggtaacagccctttcccaaagcagacttccttcttgtctgaggactagactaacattagccacaggattagaatttttggtttagtagtcatgcagctggaggctgcaagattctgaccctccctaaactgctcctgtgatcagtgcttgaggtattttgcagaccccgtacttgatgggtcagctggcactacccacatcaataaactggctctttttttttttttttttttttttggagacggagtcttgctcttgtcgcccaggctggagtgcaaatggcacgatctcggctcactgcaacctccgcctcccggattcaagtgattctcctgtctcagcctctcgagtagctgggattacaggcac

SEQ ID NO: 40018 - DNA, 1061 bp, Homo sapiens
ttatctggccctttgttcacttcttacaatcattgatacagtcaacaaaaattggttaaaaacaatatatgccagacatatatccctgagttctgggacaataaccaaaattgaataaggcaatatcctactctcaagcaatagagggtaggaatagaataataataatataatacaatagctctatagcagtatgtaaactataaaagcattattttacgtgtttctattgaactgtcataactaaataagatggttagtactataattatcccaaggattcattcactcatagaacatttgttgagcaattactacctgccagtcacttccaagtggtaagtgagatagaaatggttctttgtggcgctcacaatttattggagaatggaaacacaattacaaaaaaaaagtgtgataagttctgggagaagggtggtacaggatcctgtggggtagtggtggctccatataggagggacattgggatactgatcaggaaggagtgggggacagggctagaagctgcattagtataaagttatgtcagactgccaaaacaaaacaaacacaaaaaatcagtagtctgtggtaaagaattgctataggaacagccagtaggggcagttaagctggtcttggtgaatcaggggaagcgtcctagaggaacagatgtccatgctgaggccaaatgctggacaggagttagccagacagggaaattgcattctgggcagaggagacagcaaaggtcaagaaacatgacaactttggaagactgtaacttgttcagaggcagagggtgcaaaggagaaatgaggaaaggtgaagctggagaggtgggcttggtccagctcttgctgggccttttcagccgtgttaaagatttagactgtatccagagggatgttgaactttaagcctaagactgaaaaggtgagaattgtgccttagatcactatggttgcagtgtggagactggtttggaaaggggagaaatcagaggcttttacagccatcccagggagagagaatgaacaccagaattagggtaatggaag

SEQ ID NO: 40019 - DNA, 1052 bp, Homo sapiens
cgagtatttgaggtacataggggcgggcacagaaccagcctcctgaattccatttactctggtttgggggtggaacaaagatgatccagtgcagggtctgagctagaacctagcaggtggccagaaccattttagggtttcacctcagcatttcggcagaaatcagctctctcgtgagtcagggcaccttaggctttgctgtatatccctttgttaagccagcagctagactcctagattgaattcttttagaaatgggagaatgagcttttttattgactgccagtgttgtctgtattggatgatagcaaaaagtgtagttggacaggttgcccactagatggagtgagaagtaccagactccttttttctctaaagcagatcctttcaggatctgagtcactgggcagtttctctaatgcgagcagacagaccctgttaaccaaggagcaaaggaaagtatatttaaagaggctaaggtgtttggccacatattgctttaggttcatctccattggtctcagtgtggacataactcctggaattcactccagtgcaaagtttaaataataccagcatgagaatgtacttgaaggtttcccaaaatgtgctagacaagaaagagaaaaggtcccagctgagagaaaaatccacctgtctcccatctggggctctttggcctcactgatagaaaaggaaaaggggcccaagctaagcttactttgagggttcatgatgttcagagatgctcaggggacttctccgctgcaggaggtggggtgaggacattggattcatttcctcaaaatatggagagaaaggagaaaaatcagaattctatttgtacctctgcttcctgtgctgtttatctttgcttgtctttatctttttccacctcaggggtttcatcaggggtatttgggagagtctaggggtggggatgaagaattgactgggagctgaggaggggggatttttatgctgaagacctggcaggaggcaactcctgacacccccacagggttagactgtaaaacctcttccatgacttg

SEQ ID NO: 40020 - DNA, 1130 bp, Homo sapiens
accttattagcccctagccccttgcccggacgggcttgacaggcatgtgcacatccctcccagacccctcaccgatgggactcccatcctcctcatctccagtctcttcccgctcgggcagcgggggctgctgctgtgtcggtggctggtgatgattctgcttctttcgtttcggcatcgtgtctgcggcaatggctgcagcgggatttggagggtagtgaggaaggggcacgcggggattctgtttccgcttccggggggtcggtgggcagcaatgctgaggctcccgccattccacttccggaaggttgcggagaacatctgcggcggccgcattccggagccaactgcctccctccgtctctgccaggcatggcggcaacctcacaccttccctttgctgcgtttctataaatgctttgaaaaaattactcttttcttccctcgctggaaaacaccacaaccagctcctcagagtgtgtcacagagtcaacaggctctcgggccagagggcctgagaagaggactgtcgcaccgtaagatcgccacatccggtcctcggttactatggtaacagctgcaggcacaacttcgtgccctttgacctccccccaaaagtccttgtcccgcttgggtttcccttctcgcccgcttttgcacttatgatctgtaaacctgctccttatcatcgttcccacaaggaatttgggtcccaacaggtcggcacccaggactctcagaccgccgccctcccctaaagacctctgaccgtgcccccggtgtagtccagcaacctggacgcagtctcggctttccactaaggtcaagcccggggctttgtagtatagcctcagcgtgtccacgccccctctcccctaggtagtaggccccgccctccgctccgccgccccctccaggtgagtggtaggttctcccgggagcgcaaggtagtgatgacacgcgccccccctcctccgaacgcgagttggtagcgtccgtgacggagttagcctggtcctcccacgcgcgcctccttcctcgccgccggggcgccctctcggtgccactggctctcacgtgccagtagcccaccccgcatcatcctctcgcctcgctcctggagggaagtg

SEQ ID NO: 40021 - DNA, 1069 bp, Homo sapiens
gtcacccaggctggagtgcagtggcacggtcttggctcactgcaagctccgcctcccgggttcacgccattctcctgcctcagcctcccgagtagctgggactactggtgcccgccaccacgcccggctaattttttgtatttttagtagagatggggtttcaccatgttagccaggatggtcttgatttcctgacctcgtgatccacccacctcagcttcccaaagtgctgggattacaggcatgagccaccgcacctggccaggagcaaactcttatgggaatgaatgtccctgggaacgagaagttttttcccttctcttttattatttccctccattttcctttgatttcttggtatcccttactttttgtacctctggaactcccgtttcaggggtcacttaggagtaattttagagataagatagggacgtgtgccattctgtgactggtcaggggcacctggtaaggtgatctgtcatgttcacaagggctcacttcgtcagctacctgagctataattcacatccaaagctatggcttgcctgccatgagaaacctagaataacaacaagaatatcctgtgtgaatcctcctgcatgtgcttcctggtcctcttgagcttatcgtgtcctaagttgaggcagggtcttcactggctcattttatgcctggactgtgtttgcaggtgtaggattatgaaggaggtctgatgatgccatttggtgctctttctttttgtagctatggagggcctgggctttctggatgctcttaattcagcccctgttccaggcatcaaaattaagaagaaaaaaaaagtactgtcacctacggctgccaaggtatgggctcccagaagtaggtttcagtgacagagtataaaaggtaaagtagaagaaagggcacagcagctaggagttgtcggggaggacaacaagaggcgttttgccttggatatagactggtgcaggtgagacattgtggagacagagtcttcctttatataggaactgttgggggactgtgcctgggaccctggactaattgccttgcccttggcttt

SEQ ID NO: 40022 - DNA, 1064 bp, Homo sapiens
cagaggtttttctaatatacccagtctctattttttttttaacattaacataaactaaacaggatccctgtccttaaacagtcaagtgaggataggtcaagggttgtctgggagactagatcatctgtaatctcagcactttgggaagctaaggcaggtggatcacctaaggtgaggagttcgagaccagcctggccaacatggtgaaaccctctgtctactaaaaatacaaaaattagccgggtgtgatggtgtgcctgtaattccagctacccaggaggctgaggctggagaattgctggaagccgggaggcagaggctgcagtgagctgagatcacgccactgcactccatcctgggtgacagagtgagactccgtctcaaaaaaaaaaaaaaaaggaactgattatagtttgggtcctttctcatttctctcttaccggtaatgctcgtctttgtcacgcttgtagaaccgcaaaaagagcaagtggacgggcagccccacaagccgccaccgggcttgcagggtccagttctcagggtggcgggtcagctgtaaaacctccaaacgaaggtgtgcaaaataattccaggccaggaaacggcagagggtcagtgaaagaatgtaccatgtccggcccctgtgaagaagggatgggaaagaaatctcatgatggcagaattagaaaaccaaactggcttctaaggaatggggaacagctgtgagaagcagtctaggaacttctctgggaagtgaaaagggtcatgtatatacctttgggtgcttttcctccccagtgccctacctgtgccccaattctcacttggtacgtatgttgaggatctcattgatgaattccacatccaaggaatacagactgtagtcgtgggactgaaggaagagcttgggaagctaggtggaagaagatggcatcaacccagtgggaaagaaaagataatcctatttttcagttttctaatttttttttttttttgagacggagtctagctctgtcgcccaggctggagtacagaggtacaatctcagctcactgcaacctccg

SEQ ID NO: 40023 - DNA, 1023 bp, Homo sapiens
ggtatactaccatgtgctggggctgggcgagcctctggccctgaagtctccccgggctctcagactcttctcccacctgcgccacccagtgtgtgtggagctgctgacagtgctgtgggtggtgcctaccctgggcacggaccgtctcctccttgctttcctccttaccctctacctgggcctggctcacgggcttgatcagcaagacctccgctacctccgggcccagctacaaagaaaactccacctgctctctcggccccaggatggggaggcagagtgaggagctcactctggttacaagccctgttcttcctctcccactgaattctaaatccttaacatccaggccctggctgcttcatgccagaggcccaaatccatggactgaaggagatgccccttctactacttgagactttattctctgggtccagctccataccctaaattctgagtttcagccactgaactccaaggtccacttctcaccagcaaggaagagtggggtatggaagtcatctgtcccttcactgtttagagcatgacactctccccctcaacagcctcctgagaaggaaaggatctgccctgaccactcccctggcactgttacttgcctctgcgcctcaggggtccccttctgcaccgctggcttccactccaagaaggtggaccagggtctgcaagttcaacggtcatagctgtccctccaggccccaaccttgcctcaccactcccggccctagtctctgcacctccttaggccctgcctctgggctcagaccccaacctagtcaaggggattctcctgctcttaactcgatgacttggggctccctgctctcccgaggaagatgctctgcaggaaaataaaagtcagcctttttctacatatggcatgcagtctgtcagtgtctcccaagctacagggctgagtttgggaaagaaagccagagggagcctgggagcaccgaactggagtctgggcagccaccacgccctctggcaaccgctggggtt

SEQ ID NO: 40024 - DNA, 1035 bp, Homo sapiens
cccagaccacgaattagaagatatgtggaagaaagaactcagggcgttagaaaggattggggtatattgatacaacttgtcctggaacatgggtgggaccagaaatctttatgaataaatgaaaagataagggatttggaagccacaggttgttttttgtttgtttgtttgtttttttaatggccattttattttatttgtatttatagttttttatttgtatagatttaggggatacaagatttcttacatgcatgtattaaatggccattttaaaattagctagtttcatgctcagatgtcataagtggcagctatctttagccagactgttgcagttattgctcgatgccactcatggtgtcctacctcctatttggaaaccatctctatttttttcttactgagattcttactttggggtcaggaacttgaagggatgcttggagtgagtagatttgagggtccagttatggagtgctactaaaacattttcttctctcctggcctctggaagcatctttagctttgactttgggcaagtctctgtacttttctggccagcttttccaggatttataaaattagagcttcggcttgacctctgtgataaataaatattcactctgtgccttatggtgtagtgtagttttttaaaatgtctaggtctcaagacacaaacttaaaaaaaaaaaagtcatagacttgtatttaattcatcattatcttctatttaggacaatttgtatgacatttcttaagatttttttttttttcttgagacagggtctcatctctgtcacctaggctggagtgcagtggcaccatcttggctcactgcaacctccacctcccagttcaagcaatagtcccacctcagcctcctgagtagctaggactgcaggcacacaccaccatgcctggctaattttcttttttttattgtttagtagagacggggctctactaaatttttgtatttttggtagagatgaggttttgtcatgttgcccaggctggtctctaacttctgac

SEQ ID NO: 40025 - DNA, 1051 bp, Homo sapiens
ctacgtctcaggctactaggggaagaacagatagatcctctgtcaagactcctgaaacagttgtccccacagcccctgagctacaggcttccgcctccacagaccagcctgtcacctctgagcccacatctcggaccactaggggaagaaaaaatcggtcctctgtcaagacccctgaaacagttgtgcccgcagcccctgagctccagccttccacctccacagaccaacctgtcacccctgagcccacatctcgggccactaggggcaggacaaataggtcctctgtcaagacccctgaatcaattgtccctatagcccctgagcttcagccttccacctccagaaaccagcttgtcacccctgagcccacatctcgggccactaggtgcaggacaaataggtcctctgtcaagacccctgagccagttgtccccacagcccctgagccccatcctaccacctccacagaccagcctgtcacccccaagctcacatctagggccactaggagaaagacaaataggtcctctgtcaagactcccaaaccagttgaaccagcagcctctgatcttgagccttttacccccacagaccagtccgtcacccctgaggccatagctcagggtggtcagagcaaaacactgaggtcttccacagtaagagctatgccggttcctaccacccctgaattccaatctcctgtcaccacagaccagcctatttcccctgagcctattactcaacccagttgcatcaagaggcagagagccgctgggaaccctggctccctcgcagctcccattgaccataagccttgctctgcacccttggaacctaaatcccaggcctcaaggaaccaaagatggggagcagtgagagcagctgaatcccttacagccattcctgagcctgcctctccccagcttcttgagacaccaattcatgcctcccagatccaaaaggtggaaccagcaggtagatctaggttcaccccggagctccagcctaaggcctctcaaagccgcaagaggtctttagctaccatgga

SEQ ID NO: 40026 - DNA, 1027 bp, Homo sapiens
gatagaggcttgtccaaaggtagtgagttatctcaattgattgttcagtcagttacagattgaactccttgttctactctttacctacttctcactattgcacttgattagtctttctttcttcctttctttccttctcttctcttctttcttctctcctctcctctttgagaccgggtcttactcggtcccccaggctagagtgcagcggtacaatctcagctcactacagcttcaactgcctgggctcaagcaatactcccacctcagcttcctgagtagcttggtctacaaacatatgccaccacgcctggctaatttttgtatgttttgtagagacggaatttcaccatgttgcccaggctggtctcaaactcctgggctcaaaggatccttcccgcctcagcctcccaaaatgctaggattacaggcgtgagccaccatgcccagctgactaggctttaaaaaaaaaaaagatggagaaaataggaacggaaaccagagcatcattttggaaactggaagtcagtagtaattgactaagcaggtatgacacagctgagcttgaaacctgcaaaagggaaaacaatgaaatgatctgaggctcaggagctggcagcacccagtgcttctccagctgtggtagactggttaaataagaggaacatgtgaaaagcaccttctcagagcccctcactgcctctgggtaatggttcctgccctgctccaacagacatctggaggtttattatcttatttatctattttatttatgttttttttgagacagggtctctcactctgttgtccaggctggagtgcaggtgcagtggcgcagtctcggctcactgcaacctctgcctcctgggttcaaatgattctcgtgcctcaccctcccaagtaatcctcaactgggattacaagtgcccaccaccacgcccaggtaatttttgtatttttttttttttttttagtagagaggggtttcaccatgtcggccaggctggtctcgaactgctagcctcaa

SEQ ID NO: 40027 - DNA, 1025 bp, Homo sapiens
catcaagatgtctcagagaggcggctagacacccagagacctcaagtgaccatgtgggaacgggatgtttccagtgacaggcaggagccagggcggagaggcaggtagggatccatccacgccgttttctcaggcttgcttgctagtgacccttcctcactggaataaactccttaccctatttcggccctagtttccagaacgtactcatttttatgtaagcaattagttcctacagtgcataaataataaagcagtgtgctaagtgctagggatgaggataacaatagtgaataagacaaatcctgacttaaatttgtaattaataaggaatctaaaatcctaagaggggagatagattgaccaccagctgatggtaaagcatggtatgaggcaagatgaagaagtgcaaactagaggtagagacccagcactgtggcagtgtgggttcattctgatggaagaaagcctttacagaggacatgctgtgggagctggccatgctgtcgtattatctgtaaacattcttattcttgtttcatgtgtcttttcccagatgtactgggatatcattctgccattttgctccagaataggattacattagaagaagcagcatgatgaagaaggaatactagactgggtgtcaggagacagagactctatttctagtttggctaccagctagaggacatttggcaagtcacttaatttccctagcctacagatcgctgctactaaagaaagaaagaaagagcgagccagatatggcggctcacacctataatcctagcactttgggagctgaggcaggaggatcacttgagcccaggagttcatgaccagcgtgggcaacaaagcgagactccgtctccacagaaaataattagctggctgtggtggcatgcatttgtagtcctagctactcaggaggctaaggtggtaggaccccttgagctcagaagttgaagactgcagtgacctatgatccagccactgcattgaggcctgggtgacacagtgat

SEQ ID NO: 40028 - DNA, 1141 bp, Homo sapiens
ctaccccaggcagcaacagtgcccagggctctgatgagtctctcatcacttgtaaaggtgagattctggggagctgaagtggtcgggggtggggcagagggaaaaggcctgggtaatggggattctttgattgggacgtttcgagtgtgtggtgggccgttcagagtgtcatcgcttaccatgactgacctgaatttgttcatgactattgtgttctgtagcctgagacagctgcctgtgtgggactgagatgcaggatttcttcacacctctcctttgtgacttcaagagcctctggcatctctttctgcaaaggcacctgaatgtgtctgcgttcctgttagcataatgtgaggaggtggagagacagcccacccccgtgtccaccgtgacccctgtccccacactgacctgtgttccctccccgatcatctttcctgttccagagaggtggggctggatgtctccatctctgtctcaaattcatggtgcactgagctgcaacttcttacttccctaatgaagttaagaacctgaatataaatttgtgttctcaaatatttgctatgaagcgttgatggattaattaaataagtcaattcctagaagttgagagagcaaataaagacctgagaaccttccagaatttgcatgttcgctgtgctgagtctgttgcaggtgggggtggggaaggctgtgaggagccgagtgtggacggggcctgtgcctagttgctgttcagttcttcatgggctttatgtggtcagtcctcagctgggtcaccttcactgctccattgtccttgtcccttcagtggaaacttgtccagcggaagctgtgaccacagaggctcacccatcgcccagggcagcccctgcacacgggagtccctgtgctttctgagacaaattttcagacccattcagctcctgccctccttctagggctcctcttctgctttggtctcctgccctctctcccttccctgattccagtgatcttcgtgctgactccaatcccaactcatgaatctaaagcagagcctaatttagatttgtatttgtttgtaaaattgggtccatagtctagaattgttccttcctgaagagagaaacctgatcgtgtgctgcagtgtgcaggg

SEQ ID NO: 40029 - DNA, 1030 bp, Homo sapiens
ggcatgagttttcctgagtttcctctgagggccccctctgctctctaggacaattaagggatgaagtctctgaggaaatggaggggaagacagtccctggaatactgatcaggggtctcctttgaccactttgaccactgcagcagctgtggtcaggctgctgacctttctctcaggccttgttctctgcctcacactcaatgtgtctgaaggtttgattccagcttttctgagtcctgcagcctccactcaggtcaggaccagaagtcgctgttcctccctcagagactagaactttccaatgaataggagattatcccaggtgcctgtgtccaggctggcgtctgggttctctgccgccttccccaccccaggtgtcctgtccattctcaggatggtcacatgggcgctgctggagtgtcccaagagagatgcaaagtgtctgaattttctgactcttcccgtcagaacccccaaagacacacgtgacccaccaccccctctctgaccatgaggccaccctgaggtgctgggccctgggcttctaccctgcggagatcacactgacctggcagcgggatggggaggaccagacccaggacaccgagcttgtggagaccaggccagcaggagatggaaccttccagaagtgggcagctgtggtggtgccttctggacaagagcagagatacacgtgccatatgcagcacgaggggctgcaagagcccctcaccctgagctggggtaaggaggggaatggggggtcacatctcttatcagagaaagcagaagtccttctggagcccttcagccgggtcagggctgaggcttgggggtcagggcccctcaccttctcctcctttcccagagccatcttcccagcccaccatccccatcatgggcatcgttgctggcctggctgtcctggttgtcctagctgtccttggagctgtggtcaccgctatgatgtgtaggaggaagagctcaggtagggaaggggtgaagagcggggtctgggttttcttgtccc

SEQ ID NO: 40030 - DNA, 1154 bp, Homo sapiens
ctcccacgagaagaggaggaaaatgggatcagcgctagaatgtcgccctccgttgaatggagaatggcatgagttttcctgagtttcctctgagggccccctcttctctctagacaattaaggaatgacgtctctgaggaaatggaggggaagacagtccctagaatactgatcaggggtcccctttgacccctgcagcagccttgggaaccgtgacttttcctctcaggccttgttctctgcctcacactcagtgtgtttggggctctgattccagcacttctgagtcactttacctccactcagatcaggagcagaagtccctgttccccgctcagagactcgaactttccaatgaataggagattatcccaggtgcctgcgtccaggctggtgtctgggttctgtgccccttccccaccccaggtgtcctgtccattctcaggctggtcacatgggtggtcctagggtgtcccatgaaagatgcaaagcgcctgaattttctgactcttcccatcagaccccccaaagacacacgtgacccaccaccccatctctgaccatgaggccaccctgaggtgctgggccctgggtttctaccctgcggagatcacactgacctggcagcgggatggcgaggaccaaactcaggacactgagcttgtggagaccagaccagcaggagatagaaccttccagaagtgggcagctgtggtggtgccttctggagaagagcagagatacacatgccatgtacagcatgaggggctgccgaagcccctcaccctgagatggggtaaggagggggatgaggggtcatatctcttctcagggaaagcaggagcccttcagcagggtcagggcccctcatcttcccctcctttcccagagccgtcttcccagtccaccgtccccatcgtgggcattgttgctggcctggctgtcctagcagttgtggtcatcggagctgtggtcgctgctgtgatgtgtaggaggaagagttcaggtagggaaggggtgaggggtggggtctgggttttcttgtcccactgggggtttcaagccccaggtagaagtgttccctgcctcattactgggaagcagcatgcacacaggggctaacgcagcctgggaccctgtgtgccagcacttac

SEQ ID NO: 40031 - DNA, 2389 bp, Homo sapiens
acgtggaggtggcagtaagctgtaattgtgccactgtactccagcctgggtgatagagagagaccctgtatcaaaacaaaacaaaaaacaaaacctgccttctgggattgggcttctggtttttttcccatgacacacgcatcctttcctattttgtcctctgggtcttcatattaactatcttcccccaggatagtataaaaagtgttaggaaagttgggctttggagttgtggtaatttctgtctttgttactttcctccccttcagggggttttttaattttaaagatgaatgcagtgaggtataatggtgtgtgcctgtagtcccagctattcaggagactgaagcaggaggatcacttgagcccaggaatttgaggctatagtgtgctatgattgtgccagtgaatagccactgcactccagcctgggcaacatggtgagatcctgtcccttaaaagtgtatctgctgctctgaatttggtattttaacaccacttactgatacctttcctgtaaacctgtagatggtttaattcttagtcaagagaccagtctcatctaaaactatcctgttgtggtctgacggcaagtaactcatcttgagtaatttttgtttctccttaagtggcattttgactgtccattgcagcattctgatcttaaaagacatccactttgctaatgcacacgagattctcttagttgaagtaggagaatcaaatggagcagttgtcctccccccaccccatgttcttagaagcacctctgatggagttattctgaccttgagtcactgcctcccatcatttcccagatgtttggtccttgctctccctttgagaatcatctcccattttctttcctctcccacctctatttgaggtaatggcatctgtgccattgggtggtttcactgctccttgacttcatttgcagtttctttcccatgatagtttttagttgggcagtcttaaaactcatctgataggaaggaaattagatgtaatgtgagagagaccacagtaaaatgtgggtatttttgggagtggggtggggttttcaatcttctctttcctccccatccccccatggggtgtattggagatcaacttcctccacccccccaggtttaacccccccactctgccctcctcccgttccccacccccttcctcccccccagccaatggagatcttcgtggatgatgagacgaagttgacgctgcatgggttgcagcagtactacgtgaaactgaaggacaacgagaagaaccggaagctctttgaccttctggatgtccttgagttcaaccaggtcagttagacgtccagtagggggatgagcattggagcactccagctgtagcagaaacctggatattaagtacacttttattgaggaaatcacatgtgtgatgtgggagagaataatgagggtataaatatcttaggggctgagcatgagtaaggtgggagctgcttttctattctatggctggcacgggtatgtcctcaataacctcaaggaaaataaacttcaaaaattaagatccttggccaggcacggtggcttatgtgtgtaatcccagcacttggggaggctgagggaggtggatcacttgagtccaggagtttgagaccagtcggggcaacatggcgaaacttcatcactaccaaagaagaaaaaaattagccaggtgtggtggtgtatgcctgtagtcccagatactctggtggctgaggtgagaggatagcttgagcccaggaaattgaggctgcagtgaactatgattgcactactgtgctccagcttgggcaacagagtgagatcttgtctccaaaagtccttgaaggattttaggaagttgttaaaagtcttgaaacgatgtttgggggcatgttagggttcttgaatgtttaattcctctaataactgcttattcaagagaagcatttctgactgggtgcagggcagtggctcatgcccataatcccagtactttgggaggctgaggcaggagcattgcttgagcccaggacttcaagaccagcctgggtaacatagggagacgcccgtctctacaaatagtaaaaataaaaaataaaaaaagtagctgggcgtggtggtgtgcacctgtggtcccagctgcttgggatgctgaggtggaaggatctcttaaacccaggagggtggaggctgcagtgacttgcgattgcaccactgcactccagtctgggggacagagtgagaccccatctcaaaaaagtgtttaattaatatacttgtgagtggtctatttgcatttaaaactgctttctagaattaggatagctcccttaggtttaatgttttggtgagcaggaatatcagttacccctccagat

SEQ ID NO: 40032 - DNA, 1953 bp, Homo sapiens
gctttattttatttttatttattttatttctttttgagatggagtatcactcttgttgcccaggctggagtacaacggtgggatcttggctcaccacaacctctgcctcccaggttctcgtgcctcagcctcctgagtagctggaattataggcgtgtgccaccacacctggctcctttattttttaaatgaagcctggcctcataaatgaaggaagttggttagattaagtcagtagaactgaattattgtcctgactgctccgactagccatgtaactttaggcaatcaccctcagtgtttggtgggggggacataaaatttttaaattaggtgccctctaaagttagttttagtttggaaacatgctaaaaattggtttagctcaaacagagtgggaaccctggggggattggactctttccttcctctgttttgagactctttgcttctggctcggcaggttgctgttttttttggtggtctgtctatcaagaaggatgaagaggtgctgaagaagaactgcccgcatatcgtcgtggggactccaggccgtatcctagccctggctcgaaataagagcctcaacctcaaacacattaaacactttattttggatgaatgtgataagatgcttgaacagctcggtgagtggcagtgctggggcttggctaatgctggggagttgttctttggagccaaatgatgtttatttgaaacaggagcacctcagtgcaaggacgactcttatctatcacccatgactgatggctctgggttccctggttggtctttattatgcttttaagcacagtaaagggtgtcatctatcatctttctatgatttttgtttttaacctttgagaataggggactttgataattttaggcataagtcatcaccaccaccaccgttttcattatagattcatatactgggagtcatagcggagattctaaactgaaagagaagacagtacccttctggcatctccagcacagcatttacagtcagaatttatagctgaataagtgtctagactcaggtctgggattaatgtagagagtgtttgtagcagtttgtgtgatgtggtattctagtgtgccaggtggggttaatggaagatttttctgtaagaattgaatcttggtgaatgagagtggggttggacataggccccataagtcattacaaatgatctttggcaattctatatggtgagctataaaggtgggctccaggtagggatgtcatatttgcctgacttgatagaaaagtaatccagagagtcatagatggactctgatatctggaatataatatgtgcttgatatttgtagtctgctgaaggctggctggggcttgggcaggaaagggttgggagaaggtcccataaagcatgttttgaaggccttgagagcctctgcactgggctttatccccatttcatagttgggaactttggggttttaccttatttcttgcttggttaaaacaaacagctggaatctgatcccacttcttgattccaagtccattgctctttccattgtgttgttactatttccagcaatcttcacctcactgggaagtctacctctaatctttgtttatcatacctgcttattttctcctacaatttttttccttgttcttgtagacatgcgtcgggatgtccaggaaatttttcgcatgaccccccacgagaagcaggtcatgatgttcagtgctaccttgagcaaagagatccgtccagtctgccgcaagttcatgcaagatgtaaatacccttctaccttctctccctccactccccgcccgctgcctcctccccttcctcgccctcttcctcagactcccttgtcattcaagtgccaagaaggcggcttgtgcccaactgggagtaatgactccttgaagagacatacagaagcagagacagctagtgttagg

SEQ ID NO: 40033 - DNA, 1021 bp, Homo sapiens
tgagtggtaagaaatgggcttggcatggtgaaaaaggtagagttatctggagactgaagtctaatttatcttcctccccccccaacttttagtccagcatgagtgcatccctcaggccattctgggaatggatgtcctgtgccaggccaagtcgggcatgggaaagacagcagtgtttgtcttggccacactgcaacagctggagccagttactgggcaggtatatttggggagagtgctggggaggggattttggttaggactataagggaagggtgtttttgtcctagctacatgatgcttgcagagccatgagcacatgacctctgttacccttgacaacctgacagctgtgggggatgttctgtcgcaagcgtggggttcatgatttagatcacataattgaagtcatttattatcggcccaggtgtgtttttgtgacagtcacttccctagaggggataatgaagagctacatttaccatatgtctccgtctacttcctgcctaaggtgtctgtactggtgatgtgtcacactcgggagttggcttttcagatcagcaaggaatatgagcgcttctctaaatacatgcccaatgtcaaggtaagccaaggtaaagagacctgagagtgagggtgtggcaagttggagggataagaaacttgtaggccaatagtctctttaattttggagaagctttagtttgctgtggtgtaacagagtgttgagttcctatgtaacaggaggattcgtaattgggctatggatgatgcttaacacaagaccacccttttcttactactttatactgactttgaatcatatcagtttaataattttggggtatgtggcagagaaagccggaaactttaaaacagctccagtggtgtgtgaatattgaggattctggccaagtgcacaatggcttacacctgtaatctcagcagtttgggaggccaaggcgtgtggattatttgaggtcaggagtttaagaccaatgtggccaacaggatgaaaccc

SEQ ID NO: 40034 - DNA, 1904 bp, Homo sapiens
tcagcatcaatgagaggcggcgctcggcgtcccttggtcttggtatttgcggagggcggggctcttctcaccttccttgtcctttcttgagctctttctcggccctcggtgggactgggaggaggagctggtttctgggcccagttggatttttctcaccttgacttgcccaacttaatttggagtgccttccaagtgtttacgatacgattggtgtcattgtatgtttctccaaaaggagtctcaccttcgtagcgtaacagtgatgtgagaccacttggtaaagatcctgttaaagcctgggcggggattgcctttctctgtcacctattagctttcttattgtagggtggagacatgaattttgtttttttgtggccgagccatttgtcttgcaccgcccctcccccccatgctaattacacaaggcttgcttaaacagcggaagggaggatactgagaagtgggaggctgagagctatgggaggtggacggcggccatatgatgttttcttttcgaaaggtgagcgctttgcgcagtgatgaccctcatctatcacccttgactgatggctgctgagttaggcatccataacggtgggattataatagggaaagcggagtcttcctttgaggacttttcaggactctacttgtcatctccattttccactttactaagttattagtcgtattttaccttttattatctattctatttcctcactgttactttcagatcaagaatttataagttggtcttccccttccaacttttctggtttccgctactgtgattgctaatcttgttgggaacctctgtcctaaccactttccctggtactgctttttctgttctgttatatttgcttttcgtttttatgttttgtatctgtttttctttccaggtaaaagtttcctggtttagggaaagtgggaactggggatggaaaagaggtggtgaaggctgtgctcgtgattaagtcttgcttttttttttcccccctccagctcttctgttagaaatagtatctttgttttcctttgctgttcctcaatcccctactcttcaccccttgttttcacctattttgcgagaacccatccagatcccccttcccttcttcccctgccggcccagttatggcagagaacgatgtggacaatgagctcttggactatgaagatgatgaggtggagacagcagctgggggagatggggctgaggcccctgccaagaaggatgtcaagggctcctatgtctccatccacagctctggctttcgtgacttcctgctcaagccagagttgctccgggccattgtcgactgtggctttgagcatccgtcagaaggtaaattttctcttgggcatgtagtgctcattgggctctttaagggtacaatacaaagatgtgtttgtcgttgctcaggtggtggtaagggtttatacttaaggctagatcagggccaggtgcagtggctcacgcctgtaatcccagcactttgggaggccgaggcaggagggtggccacttgagctcaaaagtgcaagagaagcctgggcaacacagcgagactcctgtctctacaaaacgttcagaaattaagcaggtgaaggttgaggcttcagtgagccgtgattgcaccactgtgcaccagccggggcgacagtgaggaagaaaaaatcaggggataagtatcaaaaacaattttggatagaggaggcttatacaggcttattctttctttcgtgatagcaccaaagtgctaatgatccaaaagtgacttccaggtctgccattcattcttgtgactggcttttcttgtctgcttatttttaattttgtcacttgacttctaattttaaatttccagaaaggtcctgcttggacctgtagtctcc

SEQ ID NO: 40035 - DNA, 1046 bp, Homo sapiens
aggatggagcttcagctgagacagaaccttgggcagctgcagtccccccagtaagtgtcaggaagtaatccagtgggtcatggcagctgaaagtcaaggacattactattttctcttttcctccccaggaatgggtccctattatccagcaggacattcagagccagcggaaggtgaaaccgcagccccctctgagtgatgcctacctcagtggtatgcctgccaagagacgcaaggttggttttcctcttccctaagcctctctctctatccaggtttccccgtcatgcctggaatcaaactatgtagagatggtgggagctcttgttattcagtctcccctcccctcgtttaatgaggaaactttttctgggattcagacttgctcttggttgttgcataaccatacaggacttgaccttagtctgtttgctagcagtcctgtattagttgctcagctgcctaatccccatgtgcttagatcccattttcctttaaggtgggtttcctcttgtggattacctagctctgaatcccggatggcttgaccccttctgcctttcgttttgaagagcacgttcaagcacattcactttagttttggctagtgccaaagagaattaggaaggcatttctgctgtaaaaaccacatcctggactcttaatttcccctctctccactagcatggagactcagtggagtggttgactcatggaaagggtgagccggatggtggcactggatctgacgttgatcctcttttccctcccaaccccctgtcccccagacgatgcagggtgagggcccccagctgcttctctcagaggctgtgagccgggcagctaaggcagccggagctcggcccctgacgagccccgagagcctgagccgggacctggaggcaccagaggttcaggagagctacaggcagcaggtgccaccttgaagcagaatagggatggtctagtgggaggggttgggctagggtccctcttccctggatcccttcagcgatgaactggtcagcctggtgctaccatttgtt

SEQ ID NO: 40036 - DNA, 1050 bp, Homo sapiens
ggctggtgtttattgttggtgaggatgggggtgggggccggacgcaggacctctggacaacagtctcatggagttttattaatctttactaaggagcaaagtcggtattgtagggttccatgtttttacgcaaagtctctctcccttaggccctgcagagtcctaagttgtggggttactttagtggcaggaaagtgtttttgactactttttctcatcccagcaggtctctgaggctgtggttgctacagggtcaccacgagcttggcttacttgtctcatccttcccttgcctggtatcattttctcagttctcccaaaagccatgtcccggcccttgctcatcaccttcaccccagccactgaccccagcgacctctggaaggatgggcagcagcagccacagcccgagaagccagagtccaccctggatggggctgcagcccgagctttctatgaggccctgattggggatgagagcagcgctcctgactcccagagatctcagactgaacctgccagagaaagaaagagaaagaaaagaagaataatgaaggcaccagcagcagaagcagtggcagaaggagcatcaggaagacatggacaagggagatcccttgaggctgaggataagatgactcaccggatactgagggcagcccaggagggggacctgccagaacttaggagactgctggaaccgcatgaggcaggaggagctggggggaatatcaacgcccgggatgccttctggtggaccccactgatgtgtgctgctcgagcgggccagggggcagctgtgagctatctcctgggccgtggggctgcctgggtgggggtctgtgagctgagtggcagggatgcggctcagctcgctgaagaagctggcttccctgaggtagcccgcatggtcagggagagccatggagagacaaggagcccggaaaaccggtaaggggaaactttagctcagacccatgtctcattgtgttctgcctctcccagccacaccacaccagacgccccagcacagtgctgaagagttctttc

SEQ ID NO: 40037 - DNA, 1023 bp, Homo sapiens
gatttcagtaagtgagaaggaaggctaacgacagtacaagacagtgaggagttgagctggttttatcatgtcggcctggggagaagggaaagccaaggtggcttccctgggtctaacatgttggtccctctcctctccccatcctcaggtggtgtgtaagaagtaccggggattcaccatccccgaggccttccggggagtgcatcggtacttgagcaatgcctacgcccgggaagaattcgcttccacctgtccagatgatgaggagatcgagctcgcctatgagcaagtggcaaaggccctcaaataagcccctcctgggactccctcaaccccctccattttctccacaaaggccctggtggtttccacattgctacccaatggacacactccaaaatggccagtgggcagggaatcctggagcacttgttccgggatggtgtggtggaagaggggatgagggaaagaaatggggggcctgggtcagatttttattgtggggtgggatgagtaggacaacatatttcagtaataaaatacagaataaaaatcaagtgtttttacgcaatggggatttaaagtgtgggcgacatggaatgaggggtgggtcagtgatcttgagctcagggcagaagccaggaattaagaagggaaatgtttgtggtggggctgctatgtttcgtgccggtccgccggtccgccgttgcgctgttctgaggtctacgaagcgtttgcagccccgtcgccagggccggccagatctgggtgggcctgggcagcgctcgctgggcggtgccgatttctggcaaggggggcgcagtctggatgtaatgggcgaggcttagcagggcggaatgggcgtggcccgaagaagccccgccccgtcccgcttagacaatgccccggagccgccagaccgtcgcgcccctgccccatcgtagtatatgagctcgcctacacaaggacccgcgctaaaagccagagctcccagtccccgaggcttgaagacggggactccct

SEQ ID NO: 40038 - DNA, 1060 bp, Homo sapiens
ctggaagaaatgcagaatgattaaacgaccacctttccatttgaagtccccatccctgaatcttcacgggtgtgcccaagctgttagtgtcaagttttttatatgagggtcagtcgggttgtactcagattaatgaagcagggaaactgaggcagaaaagagtcctgtgttcaggagaggtcggagaaacaaggaggttttcaggactcctccttaacacccccatccccatcctgtgggagatccgaggattccccttccggactcactccctacatcgtcgagtcccgcccccctccagtcccctccccaggttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtccccgacgcaaccatggctgaagaacaaccgcaggtcgaattgttcgtgaaggtaagaacacttctctcctcagccacccaaattcctggaagccaactctcacctttcccccggtccagccttaactccccaatcccttccctccttgactcccacccccaatcccacgtgcactctttggttgaggggtggttttgagaggggaagacattaacttgttagcaagtaatgagaattctaggatcaaccctgaaaagtttgtaaaagtgcaagtttctagcagactaaaggaagggaagtggagaaaaaggagaattcccaaaagtgagactggggtggggttagagggcgagctggtgaagggacagtgggggcccagcagggtttagaagggacagaggggaacctcagttaggacatgtgtccctacaagatctgagggtgagtagtgcagtaggagaggtgtgtgtgtgtgtgtgtgtgtgtgtgtgtgtg

SEQ ID NO: 40039 - DNA, 1024 bp, Homo sapiens
ggagggctcagctgcaaatgccacttcccacccctcgccatggccctttccatatcatggcccttcatgttccctgtcttggctctgggagctccagattcctccagatggcacatgatcaggaccccgtctcccatggagcctgaactcccagtgtcctctgcaccagtacttgtccccagctgattgtcttcctcgccatctgcagcattacaaggcttgttgcctgctcttgtgttcccttagtcctctctccccctcaaggaaagaaggaaagtactcccctcagaggggtctttgtgctggccagtgggactctgtatgggcaaggcctcactggagccctgggtgtctgcctgggcctccaggcacaaggcccatctctctgacttctccctcctccaccccagaaactctcagcagctgtgacagaggcctttgtccggcttcacgaggaaggcatcatctatcgcagtacccgccttgttaactggtcctgcaccctcaactccgccatctctgacattgaggtgcgccccccaacctggcctgtctccatctccaatctaccctggccctggccctggcccctgggccacgcctctaaatacccattttacaggtggataagaaggagctgacaggtcgcaccctgctctccgtgcctggctacaaggagaaggtggagttcggggtcctcgtgtcctttgcctataaggtccaaggctcaggtaggagccaggggcaccaggatcctgggctgggagtggcaggaaggggccaaggccaagaccacaaggccttctgtcaccccagatagcgacgaggaggtggtggtggcaacaactcggatcgagacaatgctgggagatgtggctgtagctgtgcaccccaaagataccagataccaggtgggggactgtccacagttagggaaggagttctggccaaaaagggctcccatccttatggggtggaggggttggacttaggcccctggctgaggagaggaaactgggttaga

SEQ ID NO: 40040 - DNA, 1049 bp, Homo sapiens
atccgctagccgcgcaggcgtggaggccaggaggctggggcccctgggctgcgtggaaaaagggctctttggcccaggagaattggggggtggggggtctggggcagaaaggtaagagtgggaggctgagcagatgcacacatcctgagagagggaagatgattccttggagagacttgctcttgagagtgcaagaatctggagctgggaaaagggttcttggaggccaggggaatacggggtcccagagaaagatttccttctcttagaagtgcatgtatatgtggagggagggaaaagggtcctatagaatgagggaagacaaaaatgttttattcctggctaaggctgcccaggggaaggttctgacatttctcgagataagaagggttggggggtgggtgggaacagggagggaatttggcaggaggacatgctcctgcttagaatagacctggggtgagggagtggtaaggggaaaagattactgagtcccagaaaaggaagtgggagacagttcttgcatgctggggaaatgagactgcgagtatgaggcttgctgaaatttgagggagaacaaagtaagacgccaggtaagagaacgtggggtgcgcatcctgggtagatattgggaagtgggggtacaatagcaagaaacaatggatagtcatgggggtgggggggatagggcacttagaaaagaaagaacacaagaagggctgttgggagggagggagaggagtagagacatacagtattttttaagaaaaaacatattttttaggattttttctggagtttggggttttagtttttctgcttttgttttccacaaaataaaaaacaaaaaaaaacttttttttttcctttacactctggcaactgcgtgtacatgactatcctgccctagacagcctctccctgtgatgctgcgttcttaatacctagaggtcacaactctgcatatcccttgcctgaaggagcccagccctaaacatgggagaggagtgtgacaagtgagctcctctggtcagggactcccccaagtc

SEQ ID NO: 40041 - DNA, 1049 bp, Homo sapiens
tcagggataggaggattccaccttctcaattaagttgactagacactttttggctcctgtgaagttgctggccccaatgctgtctgatccatctagcaccaggtagatgttcatggagcctgaagggtccaggacgatcttccgcttctgttgttcccctgggtgccaggagagtggctcaggctccagcattaacagttctgtcccttctccattttcccccagttccctgccctgcctcccttctctgtcttcaaacctgggccgtgcccatcctcagcatcgactccttctatggtctctgtcagggaagacaggaaagcttcggccacctcttgaggggtgtcgtacatgaaggagtctgggagagtcagaaatgaggtcaaatgtctgggagtgtcagggatacagtgaccaaagagacgggggatcatgggtttccagggtataaaaggctcagaagtgagatagttgtacagggaggtttaaacaaagtgaggaaagagcagggttgaggtggggagagaagacagtaggatggaagaccaggatctgacctgggggtacaggtcaaaggtcaccttggcaggaaggctccgtcccgctccaagagccaccttcctgacacgttcgccgctgggagccacgcagggtaagcccccggctgcagtggtaggtgacgctgtcttcaaggcggtactggctgcccaccttccttgtgccaatggggatgcccgggttggagcagtaccccgctgcagaggtatgagacatcgaggtaagcactgaagcctgaggccccgtgagcaaggtagagagcaagagttacagtgtccggagccgagtgcccactcctcgggctgggcgccgtcagggagacagcaatgtagggggaggggatgcttctcacctccgttgtcacagatcgctgtctgcccactccatcggccattcacttggcaggtgcgattggcagagccccggagagtgtaaccgtcatagcagtggaaagagatctcatcactcacattgtagtagggagaccgggg

SEQ ID NO: 40042 - DNA, 1026 bp, Homo sapiens
ggcctgccatggttgcttgtggtaatcggtacccttcctgtgttcccaaaccatgccacagagactcagagactggctttcatctggcagagaaggagaatgtgctgaaaactcggaacacttcattcccaaatggcagcagccttttgggtaggagtctatggggagcaaaggcccaaaaggagaaagggaaagaccacgggtatttgtttcctcgtgttaggagaaaactgctatggtggactgaaaagggaaagaacttgggatcaagctgtcagaggcctggctgttttcaagcccacccttgttgctaacttgctgtcccttgacctcctttggcttctgtttccacgtgtcaaatgtaggactatagaaagatctctgaagtgctcagagctctgtgattctaaggttaagtgaacagtgccaggaaacaagaatagtgacactgaggtagagaaggaggaatgaagaaggctttccaggcaactagagcttcaggtgtagaggaagaatgaattacttcaggggaacctgaggagagttgtgttctttattcccttgtatctccctaccgatcatttggtagaaaacatcttccaggttttccatatccttgactttgaacacatgttgctcattgtctttcttggaagccaaagcattgatgttcacttggttcaccaaaggcccgaccccaaacacatagacatctgagggataaaaaggaaggatgagggtccaagccctgaggaagtggggtgctgggtcctaggcaggttactcacccagataatcctcccttgggtttttgcgatccttgccaatgtatagcaagtcccggatctcatcaatgacagtaattgggtccccgcccatgttgtgcaatcctgcagaagagacaggaccatgagggtaggagataaggaagataaactggctaaaggcagggatacacatggcagggtgagcaagttgaggaagggttagagatagttgatcacagggcttaggaagaattcctta

SEQ ID NO: 40043 - DNA, 1064 bp, Homo sapiens
ccacttcacagtctcccttaggctgggggagccccctcactacaaccccaccacttcatggtctccctcaggctggaggaaactcccagaccactgcccctccctgcctctacgtgcccctctggaggagaagggcctccctagcatctctgacttgaattttggctgctgcctcttgctgaagtcctccaagatcttctccccattcacccggagcaccttggtggtgatggcagccatatctcctggctggagcttgaccacggtgtggtcacaaggccctgtgaaaaggggagagcagggcagacattgccatggacccaggcatcctgcttatactgctggcagaaaacagacatctgccacactctcaccttcaggcaggaacagcttgaatcccacgaggtcatctggatagggcacctctgcagtggctggccccctgtcctgtgggtcctgggacaagggcttatcacacaagaccagggttgtgaatactctgctggtggagttcgaggagacctgggggtggtcagagaggccaggagaggggggtgtgatgagtagacatcaaaggcagagaccagatacccacccttgggcaggaatcaggaagcaaccatgcagagctcaccagtagagaggggcaaccaagtcaagcgatcagagcagacttcttggggtggtgggaggaaggagtgagcatgatgtggtgatgggaagggagagggtgaaaaggagggcaagaggggaaaatgagggccctatgatgacgcaacctgccctggccaagtggggaaaatggagagagggcttgctccctcccaccctctggagtccaaattcccatcaccctcacctgtaggatcactcccaatgcgttgtgatgctcctgattcttcacaaccaccacccttcctgctgagagagacttcagcccgttcacagactccatgatgcgtcgctgaagagcaaaggacagatgggaggaggcatcacagggacagacacttggactaagtttagtagcacctagagtaacacgatcttctcttcccttctcc

SEQ ID NO: 40044 - DNA, 1049 bp, Homo sapiens
ctgaaccttggaaggaaagtgcttgcggaatcccaaatgtcgggctagagcagctgagcccaggctctgggggctccaggctccaggaggtgccagagggtgcttctttgggcatccaaatggggactccctaggtggcagcgtgagagttgcagggagggaggtctgggagatctctttaggaaatactgaaatgggacagtcaggactcgggtctgggacgtgcacagagcctgcagagaggatcctaaaacttgttcttggccagagctctgcactcatgactcacggttcagcagggctgggatggctgagagatgcctctgggggcacaggggctccgtcttcactctgtgccccttccaggctccccttgcctctgtctgtctgaacccgcactctccctcacctcgccgcccccgccccccaccaccagtacacgtgacacgccccgggtgggaagggcgggccccttatctcgcctggaaagaatttaatggcatagaaacaactggaagtggaactgagaggaactactgggaagcaactcggaaacaccacagctgctgcctgccctgcccctgcttcccgcatctccagcccctcctcttttccctgaccctgccttcaagtccctggggacccagcacctcaattcctcaaacttcctttgctcactccagacctagccactaggtgcaggaccagaaactgccttcctgtctctcattgcacccctaaccattttcagctggggcctggaaatcctttctcttaatttttccattcccaggccgattagctccccagaataaggggtatctggattccccaacctacccctccctgacacctccttcctacctggttccagcccaatatctgagacccccacattccctttttagtctcactcctagaatccttctaccttcacctctcattgccagattcaactgagggtgtagcaggagggtcagagggaggcatgggggcaggaccagaacccccatctgtggaacatcttttatggaagccagcccctctcc

SEQ ID NO: 40045 - DNA, 1046 bp, Homo sapiens
gccgtggggcgaagggacagctctggagactcgtgattccggaacccggtgggcattcaagtgatactggagcacgcagttttcggggacattaagctcgccccaggggtccacaggaaccctctgacccaacggtctctctggacaggatgatccagaacagacggtgaagagacaaaacagcgtgaaagggagcggcgatacctaaactgacctccggagggcagcatgatcaagggaaggagctgttctcgctccgctcaaacccccgcgcagcctctgcagcttactcctgcttcggaaggcggcgaggttccacccccaccaccccggtccccgccgccctcttcgcgctgaagctgcggagggtctttttcttcagcccccaaatcctctgctctgtggcttaagattcccaggcttaaacccataactgctagggtcatcactcctcaaacttctccctcacttgttttgctgatgacggacacaggggcctcacagactcagaagcatctggagtcatttcgaaggacagaactgtggcaatatcctctttccccctcctaatctctgagaacagtgtctgtatatggcacgggggtccctagtgtcatatagaaggactcggagatgtcctcatgggctgtaacggcccccggtgctattcagggatctctgttctttaaagaaatatcatttccccttatttctctacctttgtgccctcacctcgccctgaattgtttcttaaactgggctttctgggaaacgtttacttcgtgttcaacagcaaagtctcggcataaggcgagggcggcagggggtggggggcgggcgtttgctcgccttggcattaatttcagagctgctgaacgtggacaaaagagagggaacatcctcctttcttccattcctgtaaatatggacccacccaccctccacttaagatgggtggcttttctgattttaagatatcaagcagcctggcgaggtggctgacacctgggatcccagaactttgggaagccgaggcgggaagatcc

SEQ ID NO: 40046 - DNA, 1091 bp, Homo sapiens
cgctatgagcaggtgttctgggagggtggtgaaactcatggtgagtggtgcactgtgggtaggagggactgaaggtagagtcacatcacatggaggtgggttggctaaggaagttgggaggttgtgttggttgggccaggaggtgggtgtgattttccttcccactctctcctagatcacacgccgctatgcagagttctcctccgctcttgtcagtatcaaccagacaattcctaatgaacggaccatgcaattgctgggacagctgcaggtgagggtcggacaggagacacttcccagcagcagggctgcttccagtgggtggagtctgaggaggagccagatggggcccagatgaccttgctttctggtgtcacctcttcctctctgccttttcaggtggaggtggagaattttgtcctccgagtggcagctgagttctcctcaaggaaggagcagcttgtgtttctgatcaacaactatgacatgatgctgggtgtgctgatggtaataggtgctccttctccttgccttcctacccagaaaattcggtttcccccactgctgttagctctgtgagggcagagatgatgcctgtcttgttcagtgttttactcttggagtctggcacagtgtccagcttagtacaataagtgtggaatgaaggggacatcctgaagtgaaggactgctttccccaaactagacatttccctttgtcttcccttaggagcgggctgcagatgacagcaaagaggttgagagcttccagcagctgctcaatgctcggacacaggtaggggtgtggggaaaagggaagagacagccttctgtgctgttttcagctctctctctctctctctctgtgtgtgtgtgtgtgtgtgtgtgtgtgtgtagggagtggcataatggatctcaggtatgcggaattactgtaactcttgattcacaacatactgtcattattggtctattttattttattttgtctttggtttttttttttttttttttttgaggcaaagtgtcactctgtcacccaggctggagtgcagtggcatgaacatggctcactgcagcctcaacagcctg

SEQ ID NO: 40047 - DNA, 1061 bp, Homo sapiens
ggcaacatggtgaaaccccatctctaccaaaaatacaaaaattagctgggcacggttgtggacgcctgtaatcccagctactcaggaggctgaggcaggagactcacttgaacctgggaggcagaggttgcagtgagccaagatcacaccactatactctagcctaggtgacgagcaaaactctatctcaaaaaaaaaaaaaaaaaaaaaaaaaagaagcagggctagaaattgaacccaggccatatagcttcagcctatgcctttatcagctgacttcctaggtatttgggatttttattttatttatttatttagttttgagacggagtctcactctgttgcccaggctggagtgtagtggcatgatttcagcttacggcaacctctacctcccaggttcaagtgattcttctgcctcagcctcccaagtagctaggactacaggtgcctgcccccacacctggctaatttttgtatttttagtagagacagggttttgccatgttggccaggctggtcttgaactcctgacctcaggtaatccacccgcctcaggctaccaaagtgttgggattacaggtgtgagccaccacgcctggccgtatttgggatttttttttttttttttgaaacggggtttccctcttattgcccaggctggagtgcaatggcacaatctcggctcaccgcaacctctgcttcccgggttcaagcaattctactgcctcggtctcccgagtagctgggattacaggcatgtgccaccacaccaggctaattttgtatttttagtagagacggggtttcaccatgttggtcaggctggtttcaaactcccgaactcaggtgatccacccgcctcgtcctcccaaagtgctgggattataggcatgaaccactgcgtctggcccatatttgggatttttaaacaggtaggtgatgggatcagacttgtagtcactttgtttggctacagtgtgaagaaggagttgaaggagagactgagaatagggagaccagacaggagggctgttgtaattgtctaaacgtacattgat

SEQ ID NO: 40048 - DNA, 1182 bp, Homo sapiens
agggtcgggattggctggctctggaggcgcaggtggtccttcttctactgtcacatggtgcgcgctgttttctaatcacgtggctgccacccaggtaagaagaggccgctcttcctggggttgtttctccgtgtgacgtgtggcctttgagatcaactctcctgtaccagcgtaggccgcatgagtggggggcgggctcccgcggtcctgctcggcggagtggtgagtgaccggccccgccccgccccttccggtcctcgaagcctcgaccgctacccgcaccctaaatcccagaggttggccccctgaggtgtgagtgaaatgagcttttgctttattttccaagtttctctctcaccttcaggggcattcttcgggggtgcatcagagggagggcagagcctgaggatctaagcgaaggcttccccgggtgtaatttcctgggctgtttgtgaggagagatcgaattcgcctcctgctctcaggcctctctgctcctgtcttttgtttggatgccggcgctgctgcctgtggcctcccgccttttgttgctaccccgagtcttgctgaccatggcctctggaagccctccgacccagccctcgccggcctcggattccggctctggctacgttccgggctcggtctctgcagcctttgttacttgccccaacgagaaggtcgccaaggagatcgccaggtagggacctcgatgtgcagcgagaaaggatgatcatgaagggacagttgggggtggggcagaagagtgctgctttctcctttctccagctctggaagcctgtctctgggctgccagtacaaaaactggggttatggggtactctgaatgggactgtctcttcactccagggccgtggtggagaagcgcctagcagcctgcgtcaacctcatccctcagattacatccatgtgagtcataggagttggggggttaacctaactgtaggagctgactgggaacctctttcctgggggaaattctttgctccccacaactctccccctctgacctttcagctatgagtggaaagggaagatcgaggaagacagtgaggtgctgatggtgagaaacatttcccccacccaacaaaatatccccaatccctgacccctttagcccttacccctcttctgagaaactgaactcaatcccactccttg

SEQ ID NO: 40049 - DNA, 1042 bp, Homo sapiens
aagaccagcctgaccaacatggagaaaccctgtctctactaaaaatacaaaattagctgggcgtagtagcgcatgcctgtaatcccagctatgcgggaggctgaggcaggagaatcgcttgaacccgggaggcggaggttgcggtgagccaagactgtgccattgcactccagcctgggcaacaaagcctggagcgaaactccatctcaaaaaaaaaaagaaagaaaaaaaaaactttgaaaagtaacttaatacattcttccttacttctgctttcttcagctcttctgtgtttataaaaccaacttcagtccaggtgcggtggctcacgcctgtaatcccaacacttagggaggccaaggtgggtggatcacccgaggtcaggagttcgagaccagcctggccaacatggtgaaaccccgtctctactaaaaatacaaaaattagctggacatggtggcacacacctataattccagctacttaggaggctgaggcaggagagtcgcctgaacttcgcttgaacccaggagacagaggttgcagtgaaccgagatcacgccactgcactctggcctgggtgacagagtaagactccatctcaaaaaaaaaaggcaacatcttctgctgagctcatggaacatttattctattttacggaatgaagtgttgcctgattctagaatcgaaaataatgccaactgagatctttaagctaaatttgttataatgttgtcctttgacatggcttaagttgtgggacctgtgtataagttcaagtctgcctcttaaatagttttagggccaattcctctaatatgaaatcaaatgagaattctggctttctttcattcattcagcaaacatttattgagtgccttgaagcctcaataaacaaactcaaatagaatggggagagtattaggatttagctccggtatttgtacttgtcatgtgcagtatatgacttgagggcacaatctctgagtgtatctgttgtgtgtgtttttgtttttgacagagtttgctcttgttgcatagg

SEQ ID NO: 40050 - DNA, 1062 bp, Homo sapiens
aaggcagatcagcttgtggactcctttcctaagagcttggttgggaaggtggtggggatggtggcaggacgggaaggtccagataagcggccatcaggtgaagaccaggtacagcaaacagctgctctctcggcagaccatggagagctcagtgactgctgagagccaccagggtcagtcaggagtgaagcctcagcagtttttcatccttcctcacttccgtttccagcgccaccctcggcagtgcacaccagccatgctgatccactggtaacatgctgacccattccctgggcacgggctccacctggtcctgtgcctggagcaccccactcccttgccggtacatgcgcccatcctcagccactcattgtccagcacttcctgcctggccccataggcccatagcaccttgtacatgccccttcattccactcccaccagggtggttctgaactgttctgtcctttcccctcttattttatgagacaggggcctgtgtttactacaactctttactactaataactgtgagaaaaactaatcgctcacatttatcggcgttccaggcccggaattcagagcagcccaagcgtcacctcatttatcctcacaccaccggggacgtaggggctattattatattttcttttaaaagaaaggttaagttggccagtatgctttaaaaatgttcagtgcatgaaagacaaaggccgaggaacggtcccggattaaaggagactaaaagatacatgactgttaaatgcagcaggacatcctgtttttccatagattattattgagacaattgacagaattggaatatggactgtgcattagataatagtgttgtatcggtgttaagtggcctgaatttgatcattgaactgtggttatataagagaatgttcttgttcttaggaaatgcacactgaaatattatggggtgaaggggcattatgctcctactttcaagtggatcagaagaaggatatgtatgtacagatacagagaaagataaactgtggcaactttttttttttttaagtgtatttcatgggg

SEQ ID NO: 40051 - DNA, 1090 bp, Homo sapiens
tctcctgggtgcctggcctttcctcagctgctgttccaagttattgttagaacaacctcttattccatgaacgtcaaaccacttccttcccctggttgcccgttcaaacctttttgggccatagatagtttgggcagcaaatggaactccctgtgtttacccacctattctttgccccagccactaccagtccagatgggaagaaagatggtcctgggtgggacaccaggcggagaaaagctgggttaactaaagggcaaatcaataattcatacacaaaaccagagtacaaaaaccactgcctccatttattccacctcaaattgccctctggggagtcttgtggtccaccctaaacccaccaagtggggaggtggtggtgggagcgggaacacatgtaactcctcttacaccccatatcctattgtgtagttttaaaaagtcagtgtttatgggctttgccaattttgaatacagtttgtctaagaacacgtgtttcctacagcgctgagagcttaataaaagaattgcaacgtgggggaaggtggcacaacaaatgtaattgttgacctaacaacagagaaaggagcagatctttctaatgagttcattaggtgcttcctaaaagatcccggactgcacaccagcacccacttatgtagcacaaggtgcaactccgaggggcgtcctagaagagctgctgctcttcgcccaccagggagttctaactgtattgtatgcaagtttaagtataataatattggcccagtttgaaagaagttaaactttttcttgggtttctaataaggtaaatggtatttccaccttctcagaggagaattcaaaggtttttttgattctgttttctcagtcatccatttgaggcctggtccttggcattcctcagtgtggcagggagctagctcccaagccacctggcatatgctggccacggtgaagccatctcaacgttgctcacccccacttgtgggccccctgaagttatgcttttgaagagtgtcctaagaacagattatcctatttttaattatgtattgagcccatcgaaaacctggagttgtaaggagaa

SEQ ID NO: 40052 - DNA, 1045 bp, Homo sapiens
actgagctaatccccagttaactctgcaggtccccgctaagcgtttgcgttcttcctgagcccctgtaagcctgtgcagcaggtttgggtcctcagctcacgcagctgtgtgtgagtagtaggcctatgttcttgctttcctccaggttggcgctgcagctctgggattcattcattcatatagctcgtatttattgagcacctaccatatgcctggaacggtgctagggaaacagcagtgttaaacaggtgaagtcctgcccgcatgaagttttacattgtagttcaggacacaataagcaggtaagtgtacgtaagacagataagtactgtgatcgatagaaaatagggtagcgtgataaaagggtaatgttattagtggggcctttctgaggagatgacacataggtgagacctaaggcaagaggatgagccagccatgtacacttggcgggaaggacattccagacactgcacatgtccagaggcaggaggcagattgacatgtttgaggacagaaagaaagccagaatggctgcagggtagtaagtaaggtggagtttgctaaggtgaaggtccggagccaggcacagtaggatattatctgttctgattagctttagacctcattataaggccagtgagaagtcactggggatgtttagtgaggggactgatgtgccctaatttactttttaaaagactattctggttgtatgtggtgagtgggctatagggggcaataacaaaaaaagaggctggagagaagccgattatggtactataagcgacagatggtggggggttggatgaggacggcagcacagaagatggaagtggttggattcaggttatgcgcaggttgagtcagcaggacttgctgatatatgggatgtgggataaaggaaaagagaggaaccaaagatagcacctagatattttttggcctgggcatctaggtctaagatggtgccatttactgaggtaggaataggtgaagtgtaggaagaatatctcgagttcggtgttaagcaggttaaacctg

SEQ ID NO: 40053 - DNA, 1132 bp, Homo sapiens
gaagacttaaaacaaaaacaggaaaaaataactttctgtaagacttctcagtgctgttagttttgtcttttaattagaaaaaagttccatggtttctatttcttggtccttcacatctctaaatgaatcagacccacaagtgaatggcacatttgttccctggccttctctgatctggacacactcaggctccacttgagtgagcccagacaggtaccctccaggtcctagctacagatgcgctccgtgggcagacggcattcagcacctgccagcgagggcttcagacgcagatatccctatttgtaaccattcagaccttcatcagagcatcagaaagcaggggctgggccatctcaatgcaggctttgtggagctaagatttcatggggcacccttggcctttctggagggtggacacaggaacaagcaggtggggacgtgtttcttggctttggtgaggctcttgctgaaagtcttattctttgcatggctccaggcttaccgagatcacagacgggcatttgaatttcagattcatgttctttcccttttcggtcgttgaagacggtgacactttgtgtttttctttctgcctttgtgctgctgaaaacgtggggacaggctgggagtgggtgtgttgtcttaatcaggccgtctcgttgtctggtaccgtctgtcctcctgtttcctttaggtggtagcagcctctgctgagtggtttgtgtgagttcgcactgaatcctaccacaatccttactcagatgagggctctgagattccacctaacgggagacgagatggcagctgctgacattctgccctgtctgcaagctctcctagctcttccagctctcccatctctgcaaactccgacagcagttgctcttcctctgaggaagctgagcgactgcatcatcccccgaccacgtcgcctctgctcagccctcttaatggccgtcattccaagggaaaggcaggagccaggagcctctgggatgcagccccttggttacagtgtctgctttcagctttgcctctgcttctccagggtctttctcaggcagttaacccaatatttatcaactctctccctaggcccagcacttggcagaatttttttctattttgt

SEQ ID NO: 40054 - DNA, 1070 bp, Homo sapiens
tggtctcagtgaagttattgccagtggactgtgagagaaaaacagatgaggtgagtttgagtttctctggtttttattattcttcctgaggatattagcctccatcaggaggtaaacttccccagaaaaagaataggatcattttcagggagtgcttcctgtaatgtaccagagtcacattgtgttctgtgatgttcttgtcaggctcaattgtggcagtgaaggaatacttgaaatagaattgacctcccaaaatccaaccctgggcttgttatggacactttcccatcaaatgtagcatcggggactttgatctgcctgagtcaatctagggggatgcagtaggttgttgttgaaggaccctcaagctccctggcactgggaggaagggccggcgtttctaagcatcaggaggccaagttctcaattccacattctctgtctccagtggtgcagctgtggctctgaaaatgctgttctgatttgaaacatagggagtttgtttggaacacatcttaagtggaattagccctcttagtctacatttagatttgttttatgaagctctaatatggcgagcagccccatccatttatgaatcatgaaagcagcattatcaaggagctgggatgctgcttctggtgacagtctggagaagatatggggcagtaaattttcaggtcttaaattgtaccaggaggagtcttgtgctgccagagggcatgacttagtagtctaattaagtgtgcaatgcctggcctcccaagtccttagttaacatctctagtagcccaggggctgggaaagaaaatgacgcatggtcctctggccagccctgcattgactgtcttactcatgtaaatgagggggcatcctggtgcagataacggcttttatttctctttggcttcgggtgtgtcatagttgggggtgttttattacatccatttattggattcatccaccaaatatctttgcttcccaattgttttgtaaaaacagattcatagtaagtttaatctgccttctatcataaaaactgtagttgatgatgagaggaagtggcccag

SEQ ID NO: 40055 - DNA, 1732 bp, Homo sapiens
tttaggtatttgcgtcttctctctctttttcttagtctaaagttttaatttttcttgggtcttttcaaagaaccaactttggttttactgattctacttttttttttgacggagtctcactctgtcgcccagggtggagtgcagtggtacgatctcggctcactgcaacctccgcctcccaggttcaagcagttctcctgtctcagcctccagagtagctgggactacaggcgcgtgccaccacacccagctaacttctttgtatctttagtagagacagggtttcaccatattggtcaggctggtctcgaactgctgacctcaggtaatctacctgcctcagcctcccaaagtgctgggattacaggcgtgagccattgagcttggccaattctacttttaaaaattctctacatcatttatctgttatctaatctttattgtttctatccttctgctgggtttaggttttgtttgctcttctttttctaattccttaaggtgtaaagctaggttgttgatttgagatctttaggcatttacagctataaattttcctctgagtactgcctttactacatcccatcagttttggtatgttttcattggtctaaaaatatcttatatttccctagtggtttcttctttgacttgctggtttaagagtgtgtggtttactttccacatatttgcaaattttccagtttttcttccacatttgatttctagcttcattccactgtggtcagagaaagtactttgtatgagtttagtcctttgaaattaattgagaattcttccatgggctaacacctatgttagtaagggattttggcctgtagttttcttttgcacctttgtctgcttttgatatcagggaaaaactgagtcagaatgagttagaaaatattctctcctctcaattttttggaagagtttaggaaagattggtattaattctcctttagatgtttggttacaaaaaaaaattgaccagtgaagccatctaattctgggcttttctttgttggaaggtttttacgtttattaagatctgttttgtggcctaacatatcgtctatctgggagtgtgttccatgtgcccttgaggatactgtatagtctgctgttgctgagtggagggttttgtatatgtctgttaggtctagttggtttatactggttttcttttctttctttttttttttttttaagacagtttcactctcgttgcccaggctggagcgatctcagctcactgcaacctccgcctcccaggttcaagcgattctcctgcctcagtctcccgagtagctgggattacaggcatgtaccaccatgcccggctaattttgtatttagagacgaggtttctccatgttggtccagctggtctcgaactcccgacctcaggagatcacctgcctctgcctcccaaagtgctgggattggaggcatgagccaccacacccggcatggtttatactggttttcaagtcctatgtttccttattgatcatctctgtaggaatgtattccacccattgagagtaggggattgaagtctccaactactattgaactatttctaaacaaatacctcatgttcctatgtatgtggaaaataaaacaatcaaactcatagaagtgaagagtatattggccaggcgcagtggctcacgcctgtaatcccagcactttgggaggccgaggcggctggatcacgaggtca

SEQ ID NO: 40056 - DNA, 1025 bp, Homo sapiens
gccacctctaattgggatttgagtgttctggaaacttcccactcgcccatgtcagatcattatggaccattctaaagctgatccatcatcacatttactacatgatgagggtaaatggcaaagttcaggattacctttctgcagcctagtcttccaatggcctgcaggacttgtggctagagagaaagaactctaaagagacgccccaaaacttcggacgtgggtggagagaggaaatcagcccaaaggacaccattgcagctcatatcattgcggggagcagcactgcacttcctccatcctttgttgacatgccaggtggtagcactgaccgtctaagccagtttgagttggtgaagtaactgctcatccccagtcagggtggcttccatctctgggcacctgataactgttccaagaaagcctggtgttaacaagctatggccttgcttgctttctggtttccaacagatttaggctgtgaagggtttatttatgtccttgatcttgtgacacccagctaacatctcagcatctgaggatgtagccatgaggttccatgttctgtgttctgaataccagcagtgtgctaaacctaggacacacagtcctcacagaggcacctgcttgggtgacagatggcatgaaatgggagaggtgacagcctgggaaaagtaagccacgtggggggtgaagtaggaaggagcaatatcagagagagcttgggtgggaggaccatggaaggatgagacggagataagaaattcagaaaagggaagaaggacagtcattcatccgaaggctgcctggtgtaatagaagatacgaatgttgggaattagcccaggtctctgctccgctgctgacaagctctttgatcttgaacaaattaccatccctgctccctcctgttcagtgggggagaagtctactttgcaggattagtgtgttaaataagtgaaagagtgtgtgtgacaccaaagtcagtgtgtgattatcaaatggtggcacctctttggaaatgcc

SEQ ID NO: 40057 - DNA, 1025 bp, Homo sapiens; identical to SEQ ID NO: 40056

SEQ ID NO: 40058 - DNA, 1029 bp, Homo sapiens
attgcaggaaatacctggagaaatcacagtggaatgaatttttgctttaagagaaatgagagttggctgtctctgtaattgataatacagcttcatcctagtcccatctgcatttcagaaaataaccctcatctttacaaaacacaggacacttgtgggacagttaactcaagcagctatggggagggaggagattattgaatggtgattaaataatgcaaatggctcttctgtttcttaaagactgtggaagaggtcagactgcccagttgaggtgggcagttcatactgctcagttgaggtggcagtcatttattctgagtcctgttggatagagcctatctcctcaaggctacagaggcttccaggatatggagctgtgcatgttaatggctcagccttgcctccatcagggcacctgcctaacttggagcaagtgggagagcaccctagagtcatcctctgtgctgtttcgtgagttttgcagcggagacttcaccatccggaggagctgtgtttctgtgtcacttgggatatcacctaaaaatgaaacatttgatattttaaggtataaaaaaaaagtaaattggggaacattggctgcagtccctaaaagatactgttgtctgtgcatcaggttagcttgaggtcaccacaggtcctgggagcccagagagtttaggcatactctcctttggaggccagcagcctttcacaaaccctgcctctaaaagggcggtttcacatttgaccatgtttttgcattagcctcagaaactcttgtctttagctgataacctttgagggatgtgagaagcctagttggagcatctgagaaaatgatacctctcaccttcaaattaatcaaatagtttgtccttctagtccccttataaattaataaatggagggctggtcatggtggctcacgcctgtaatcccagcactttgggaggccgaggcgggtggatcacaaggtcaggagttcaagaccagcctgaccaatatggtgaaaccccatctctacta

SEQ ID NO: 40059 - DNA, 1029 bp, Homo sapiens; identical to SEQ ID NO: 40058

SEQ ID NO: 40060 - DNA, 2724 bp, Homo sapiens
tcccaagtggctgggattacagttgtgtaccatcacacccaatgtttcagaattatatctcttttttctcctttgacttgaaaataatgatataaatgtttttgcttctctaagatactgcacaggagtatcttgcttttaatagactcctcttcacaaattgcgcataggccacattgttgtaaatacactcatttctgtgtataatttatctcaaaagctagtagcgtttaaaaaagaattgctccttagtcgaggaactgatattttaaattgactaatttaaaggtattttgctgttagcacacttttagtacaaataactactctaaattactttttaaccactttttaacaactggaattaaagatatctttttactcagtttagtggtctgtgttataatacattgaatggtacccattgacaaatattaagtttagtggctaagtgtacagattagaatatgccctgttagagagaatatagtactgtatttgagctggtttgtgttggaaccctgaatagaggtggaattactgggacaggagccagtcgccttctgcgaaatgaaatgagtccagaagagtcttccaaaacagttgtgtttgcttttccatccagctccacattccaggaaaggatttttagtcattaggaaatatatccacagcttactttccattgacttcaatataattaacagtggtttcagcaaacactaaatgcaacccttgcctctggagattccacaatcgttaaactaccaacagctgctggatttagacaaatgtaacttatccggccttgttgccacttaacagctttctcttaattccatggacttatgaatacaagctgcttatcacaaagcttgctacacaggaagtaaatgtaaggactgccaagacagtatggtagtcatgaacttaatgtacacctagtaaacctccatcaatataaagtaaaaattatcagagttacggggaaagtcaactcaatagccatattgaagacttcaaaacatctcattttgtgcttgatagtccctatgaagaacaataaaatctcatttagaaagtgattgaaaagtggcaaacagaaaaatagaggttaaataacaccattaacaagattgagcacatagatatgttgagagagaagcttccacccaacaaagaatacgtaattttttcaagcatgcatggaaggataagaacataaccacatgttaagttgtacaggaatggttaaaaattccagagcatcatcagtattatagactgtatatactctgatagaatgcagtagaattagaaaccaacaacagagccagcttgaaagagagagaaacacaggtttggaaacaaaaaaatgttctaaataatccatgagttaaagcacaaatcatcatagaaataagcaaatagagcagaagagctgtgaaagcacttcacatcatgacttacgggatacagctcagtcagttctttgatgcttagatgcttatattagaaagttaaatggacgttaagtaaattgagcaatcaactcaagaagctggaaaaaacaagagcaagcccaaaggaagtaaagggacagaaataacaaggaaaggggtagaaattaatagaaaaatagaaatgaccaacaaaaccaaaagtgggttatttttatttgtctaataaaatagataaacttctggcaagactgataaataggaagacagaaataaatgaagaacaaaaaagggaaataaccacagatttataatagaggtttttaaattataagaatgttacaaagagctacaaacagaaagatctgaaaactttcatagaaattttccagaaaatcctacccaaatttacttttaaaataattcaggctgggcgtggtggctcacacgcctataatcccagcactttgggaggccaaggcgagtggatcacttgaagtcaggagttcgagaccagcctgccaacatggtaaaaccccatctctactaaaaattaaaaaattagccaggcatggtggcacgtgcctgtagtcccagctactagggagactgaggcaggagaactgattgaacctggaagatggaggttgcagtgagccagtatcacgccattgctctcctgcctgggtgacagagcaagactctgtctcaaaaaaaaaaaaaaaaaaaaaaaaattcagaccgggcacagtggctcatgcctataatcccagcactttgggaggcgagggcaggaggatcacttgagcccaggagttcaagaccaacctgggcaatatagtgagacctcatctctaccaaaaaaaaaaaaaaaaagtttttaattagctgggcatgatggtgcaccctgttgtcccagctactcaggaggctgaggtgggaggattgcttcagcctgggtagtcaaggctgcagtgagccatgatctgcgccactgcactccagactgggagacagagtaagagcctttctccaaaaaaacaaaaaaaaaaaggaaaaagaaaaatttgaaaacctacacatagatcattagtccttaaattaagtagtaatcaccttccttcctgccaaaaaataccaagatcagactagattaattttactaaaattttaaaatatgtatattcttgaagactatttagaggaggatagttacataccttttgtaagactggtaagatcttgattaatgattagcaaactc

SEQ ID NO: 40061 - DNA, 2724 bp, Homo sapiens; identical to SEQ ID NO: 40060

SEQ ID NO: 40062 - DNA, 2724 bp, Homo sapiens; identical to SEQ ID NO: 40060

SEQ ID NO: 40063 - DNA, 2724 bp, Homo sapiens; identical to SEQ ID NO: 40060

SEQ ID NO: 40064 - DNA, 1035 bp, Homo sapiens
tcattggcaggtttggggtttgccgagggattatatgtctgtgagcccaaagctgaggggtgggggtggggtgtcttcggaagatttagggcgttgtgcataagccatagccagctgtttattttacagtgcgctgggtagcctttatggtgtagtctgagaagaaaagacatttgatataataatctttgtgtgctgaaaatgtttcatgttaattgggaagaccaaaagcggtatttaacatttttgccctgacgttcctccactgccttgtgggaagactcttaggattaaattagctaggaaaataatgttttagaatcagtttctttttataataggtagggtactttaaaaaaaaatctcggcttcccaaagccgtttctgtggtgatgaagggaattcagagaagcacatgttttgtaaatccacaaaagagtagctgctttggaaattcataagatgcctgtgggaatgcatttctcgtgtgcatggtggtaaaatggcagttaaactggaaacaatgaaggacagtgaaatccaatatgttatattggattcagcagtgggctatggtggcagggccgcagtacagtgcagtgtcgaaatggggaaaggaacttgacccgttagttatgaaaagaagctgtggcgaaagagacagatggattgccaggagttgctgtccagaggtatttaggaggaagtgggaatttgaattactgcctgaagaaaattagttagtgaattgtgttgttaagggatcccatgtgtgctccctttcagcaaaacagaacgaaaggagatttggaaacgtatgctttgtatcctaccatatattgtaaaagtccccaaaacagatgcattgtaatagctaaccagggccatgctgtaaattatatactgttttggaatgcatatttgagtaaagtaaaattattggtggtgcttattgctccagagcctttattctcctcattatcatatcatgttatgggaaatcagatgggatcacaggctcttaactgaagggaa

SEQ ID NO: 40065 - DNA, 1021 bp, Homo sapiens
tgggaagaggcactcctcacttcctagatgggatggcggccgggcggagatgctcctcactttccagactgggcagccaggcagaggggctcctcacatcccagacgatgggcggccaggcagagacactcctcacttcccagacggggtggcggccgggcagaggctgcaatttcggcactttgggaggccaaggcaggcggctgctccttgccctcgggccccgcggggcccgtccgctcctccagccgctgcctcccgggcggcgctcgccggcgcggcggcaaagactgagacagctccgctgccagctgaactccatcctcccggcggtcgggcggcggcggctgccctgatttttccttagggaatcactctttccttgtcattagtccatgtggttctggagggattatttcacctctgactccagagggtgccataggactcaggagtggcccatgagatcagtgccttctatttatttttcatgtcttatttcactagctaggatctctaatacaatacttaataatagcagtgagaggagatattcttgccttgcttttgatcttaatgggaaaacatttattctttcaccatttcacctgttgttcataggtgtcctttatcaggtggtgaatgtttgcttctattcctagcttgctgagagtattgactgtgaaataataattttatttaaaagtcaagtgcttttctaggatcaagacaatcatatagttgttctcttttatgatgttgatgtggtttatttcactgatttttgtaaagttaaactaactttatattcttgtattaaatttttggtcataatatatttcactgtatatattgctggattctatttattgatatgttcttcatgatttgtgtgtgtgtgtgtgtgtgtgtgttcatgaaggatacaggtctgtaacttttttcttgtaattatcagattttcatatcataattatttcagcttcataaaataagtttaaagtattctttcctcctctgt

SEQ ID NO: 40066 - DNA, 1090 bp, Homo sapiens
ctgggtggggctcagcccttgatgatgacaaaatgaccaggaaagattcttggtttcactctgcagagcatcagaacagctggagtcctttgtgcttctttcttcatgcagtgatttcatagatgagaattaggaggaggctgggattttttaaaaaacaaaactcaggccgggctcagtggctcatgtctgtaatcccagcactttggttggagggggggggtcgaagtgggcagattacttgaggtcaggagttcgagaccagcctggccaacatgacgaaaccctgtctctattaaaaatacaaaaattagggcggtgtggtggtgggcgtctgtagtcccagctacttaggaggctgaggcatgagaattgcttgaacctgggaggcagaggccgcagtgagccgagatcatgccattgtattagatctatggctcacactgggcacgaggatagggggaggaaagcaaatgccaataacaaatatggtttcagtaattgttaaagttgtcactccagcctgggtgacagagcaagactgtctcaaaaaaaaaaaaaaacctcttcggtaaaatgtggagcttttgttagtatttttgcaaaggaataataggattcaacttttttttttttttaattttctttcatttttgagacagtctcgctctgtcacccaggctggagtgcagtggcaagatcttagctcactgcaagctctgcctcctgggttcacgccactctcctgcctcagcctcccgagtagctgggactacaggcgaccgccgccatgcccagctaattttttttgtatttttagtagagatggggtttcaccgtgttagccaggatggtctggatatcctgacctcatgatccgcccgcctcagcctgccaaagtgctgggattacagatgtgagccaccgcgcccacccggataaagtcactcgttgttgattgtaatacaaaagcaaggtgtacaagaagagtttttactaacttctaccactcttagcttttttctgtcatcttttggagaagtgaccacttgacctgagtaccatacagggtagtagaaggaatgaattt

SEQ ID NO: 40067 - DNA, 1090 bp, Homo sapiens; identical to SEQ ID NO: 40066

SEQ ID NO: 40068 - DNA, 1090 bp, Homo sapiens; identical to SEQ ID NO: 40066

SEQ ID NO: 40069 - DNA, 1090 bp, Homo sapiens; identical to SEQ ID NO: 40066

SEQ ID NO: 40070 - DNA, 1544 bp, Homo sapiens
acatttctactggtaccttaccaatgagggtatccagtatctccgtgattaccttcatctgcccccggagattgtgcctgccaccctacgccgtagccgtccagagactggcaggcctcggcctaaaggtatggttcccacacaaatcccttcagctatttgaagatagtttcttttgtgtaagggacaaaagcattcttagctgatgtcagctttagagggctctggcctgcaggcatttggtcaagtgctagaacctttgtcccatggcttgggacttggaatagaactagactcagttcttcaggccatccatgagatggccttaagcacagatagtctgtcactttcttcacccacacctgtacaaacatccagatacatgtggtatagaatattgagtaacttttcccgcagagtgcgttgtactattcccgagaagtccaaagcaaagccatttaccacctcgaaagaaacaagagtgttgtagttttcttgccaacaggagaagaaattagaaactggagtggagaacggatggtgtataccacgatgtgaaaggatatgcatgcatgtgtggtgtgaggagaattatcttctgattcttgggatcattgctagctcacagttgcttttttttttttttttttttttttaacggagtcttgctctgttgcccagcctggagtgcggtggtaagccaccgtgcttggcctgtattttatctaggttatggttctttgttacaaaactctgtaggagctgcagagagcataggttgaggtgaaaaaatgcgcagattcctaaatgtgatcatcagagggcccaggttcccctggagagttaccttatggagctcaggaattcgttatgaaagctccccaagggattctggtgattaggtagacataattttttgagacagagtctcactctgttgccgaggctggagtgcagtggtgcgatctcagcttactgcaacttccacctctgaggttcaatcaattctgtctcagcctcccgagactgggattataggcgcccagagcgacacccagctaatttttgtatttttagtggagatggggtttcactctgttggccaggctgggctcgaactcctgacctcaggtgatccaccacctcagcctcccaaagtgctgggattacaggcgttagccaccgcgcccagcccataatacgtctttttagcaaaagttgtctactacatcttggaatctcctgggagaaaaaaataccagtgcctatctgtgcttgatatattctgatttagttgggcctgacatttgtttttgccactcattacatgattaatttatttctgctctaaaaggagttcattctgcctgagtgcagtgactcattcctgtaatcccagcactttaggaggccaaggcaggaagactacttgagtccaggagtttgagaccagctaaggcagtatagtgagactccgtctacaaaaaaataaattagccaggcatggtggtgcacacctgtggttaagcccaggaactccaggc

SEQ ID NO: 40071 - DNA, 1027 bp, Homo sapiens
ctcactcctgagcaaagatgtcttgctagttcctctctaagcagattttcttttagaattcatagctacttttgagtatttgacaatgaatagacacctaacagcagcacatattttgtcaaccgtgcccttctgagggtgcatattggttcataaaggatcagcaaggtctgtgagctcaggggttgcagctcctgtcctggggcagcgggtacaggacacgacgggcacacacagcacagtgtgtccacggggatgggttatacgttcaaggacacttctgcactagaagaagccactcaagcattttcattgtgcccttcacctgtggtaacactattggcgaaggttgatactcatttatttgttctgttaataaatatatattgcggacttaacctaccttgtgcccagcagtgccctaggtgctggggatacagcagtgaaacagacaaaaacacaaatccctgcagcatggaactgatgttcagtaaaacatatggcaaatcaggtgatgaaagatgatagggagaaacaagagaagataagaaaaggggagttgggagtgcaactttaatcgtttattttacctttttaagaaatagagtcgggctggtggtggtggctcatgcctgtaatcccaggactttgggaggccgaggtgggcagatcatttgaggtcaagagttcgagaccagcctggccaacatgatgaaaccccatccctactaaaaatacaaaaattagctgagcgtgatggcacgcgcctgtaattccagctactcgggagtctgaggcaggagaatcgcttgaacccgggaggcggaggttgcagtgaggtgagatcataccactgcactccagcctgggcattagagtgagactccatctcaaaaaataataaaatttaaaaaataaaaacagagttggggtctcactgtgttggccagattgctcttgaactcttagcctcaagcaatcctcccacctcggcttcccaaagtgctgagattacaggagtgagcca

SEQ ID NO: 40072 - DNA, 1066 bp, Homo sapiens
tggggcttccttgtgactcactgggaaccatagatcttgcacttggtttggttgtcaagttgcactgctatgtgtaccatcactgactatcttcactctcttccaggggctccatgggccttaccccttcggccagtcttaaacgggtgtcagcaagaagaaaaattaacaaaagacagaaggcctgactttggggggttagggcaaggggttcctctggattgcagaccacatcgcacagacccctggctctgaccccctctcatcccggaagaagaggaagaagcagaacagactagttttgagtaaactcagtatgcatgtgtgaatgctgaatcacaggaatggtgttgaggctaccaagaagaaatccatgcagccactttgggttttgttataggcatcagtctaacaagtcattaggtcactcgggaagggggaaaaagtttaaaatgggggaaaaaaagccatctttttaaacaaaaattattttgcctacagaaaggttgtagttttgagcacatgttaatttttttccctctttccccacttttatttttttaaataagggataacatattctttatagaatagtgcttgttctggaagagattcaggtgaaaagttggcgtggcatgtttgaggactctgcggatcagtgctacaggagtacatctgccctgccacatgactccagaagtctctgaccccatttgtttttaatggcatcagccaatgagttatcacccttttcctcctcttttctctttaatcttctgttgatttacacctttgacatttgtattcgtcaaccctgtggcttgttagcatcagaacctctctgaagaccaaacttccctgtgtggccagcagaggaagccttgaggatagatctcgggtgacgtgggattttctaagcctgagaggtgtccttctgcacacccttgtaacaattaaaattgcttttcttccatgtttctcttggcagagagaaatgccatcatgcttactgctcttttggattcttcatgcagtggcttcccatttgctctgggaacagtgcctc

SEQ ID NO: 40073 - DNA, 1074 bp, Homo sapiens
atggtttttaaaaaatatgtaaggggagtagggggtgagtgaaggctgtgggagttgccttttggaatgggggactttggatggacaggaggatggttgacagggaggatgtatggagggaggagggatggaagtatggatgatagaggaaggatggagggatgaatgatgaagggttggatgaatgggtgaagggaggataaatgggtagatgagaagttcctcaacaggactgtagaggttagttaagagcaacagaaaaactattacagaggcagatacaacaagttgtttttacagagctttaaaaatacattcagcacactaataactgagttaaatgttttggcacaatcagaaggcctggttgaactgagcttgccctgtcatcagcccttgagtgtagaagtagggttttttcctattctttggctggttctcacgctcattctcagccagtgcatcaaatacatctttgaattttgggaaactgtcacatgaaagagacttgaacaggccaagtgcggtggctcacacctgtaatcccagcacttttgggaggctgaggtgggtggatcacctgaggtcaggagttctagaccagcctggccaacgtggtgaaatcccatctctactaaaaatacaaaaactacctgggcatgatggtgcctgtagtcctggctacttgggaggctgaggcaggagaattgcttgaacccaggaggtagaggttacagtgagtcaagatcacgcctctgcaggagaatcgcttgaacccaggaggtggaggttgcaatgagtcgagatcgcacctgtgcactccagcctgggcgacagagtgagaccaatgttaaatcatcttacagaagtccttctctcatgctgacgggtcctgctgtgccaccagcaagcctcccggagtagtcagaaggcattaaggaaagggcgctggtttgcacattactgagagagtgcccattgccctgctcattactccagtacagacttaattttatttctagttaatgagagactaatgggtttgatcaggtcctagtcagtttctggcccctg

SEQ ID NO: 40074 - DNA, 1052 bp, Homo sapiens
gaggaaagacgtttcacatcttaacactctaataaataaaatattttcttctaagctcctatttctctagtattttttcttgaatttaaccctccagagtctgtgactgttcagggtggtaaatgggccagccctgggctaagcatgctttgttagaatgagaacttcagtctgttgggtttaatgggaagatgaacattaaggcaaaacaaccaattgctcctgtgctttctctaatggaagctgcctcacccacctatgagctttctggcttggccatcgctgcagttttaggagagggctgctgttcttggccagggcactgtacttgtcttcctgaattgagagcccattaattgttttcctctcctttagggactgatgctttttaaccacctctgtgatggttgcacacagtcatcacagacggttgggaatggtgggctggtattttctgccagctttaattaaggtcctaccagggtttgcttcttttggaagggctggactatggtgaggttattgacttatttattggagttgatgaactagtattaatatgttatctaatttttttcctggactttgtaggatcatttagaagtagcatttgcaagaactgtagagaaaagcttcccattagagatagactgttgactataatgcgttgaaaatgtgaaacttagatgccaaagagaaattggggtctcctttttttcttaatctaagcagaatcttagaaagcaatttatatgaagcatcgagcaggttccctgaaggcatttctggctaaagttgagtcagctccactctagctcttagggctccttagaatagggtgtaggaagtagtcatcagtaaatattcatacatctgtgcactgttcagagcagtgtacatcgtacattaggagacttgaggaataaaaggatccctacccactaggagcccgcagtacagtaggggaaatgaaacatgcacaaagcaattagagagcagttcagtcaaaatgaagtatgaatttgctcaatagagagcaatacagtcctaat

SEQ ID NO: 40075 - DNA, 1051 bp, Homo sapiens
aaagctgggtgttctcagtctgctttaacttaaattatgaccttgagctcatcacttttacctctagacttcagattttttaaatctagaaaacgaagcagtttcattggatgatctcttccacttgtggttttattataacagatggtaaagtatctggctagcagctagttcttatctcagtgatcaaggcattctggtaagaattgggaatggtcattgtctatgaaacaagcttattaggccatctttaccttttctttactttttcatttgtttgattaaagtaatacagtaggcagggggtgaacgcattctggaatataaggtctagaagtggtacaagatgattgagattgtaccacgtagaagttgtattttgctgttcatgatgacccattgcagcagtaacttaggagggtcagaactgatatttattgttggtgtttataaatcagtggcttctcaaatgactttccttttatagctactatgtagaatctatgtacagagctgagcaatagccaacgcaaagagatggggaggtggcttaagtatgataagttctggtgagtcatactaaggacatttttggccagtgcagtggcttatgcctgtaatcccaatacttggagaggctgaaccaggaggatcgcttgagcccaggagtttgccaacctgggcaacatagtgagacctcatctctactaaaaatttaattaaaaaaaaaaaaaaagacatcagaaagaaagaaagaaaggaaaggagagggaaggagagggggagggggagggggaaagaagtctcactgtgttgcccagaatggtctcaaactcctgggctcaagtgatcctcgttcctcaaccacccagagtgctggaattacaggtgctagccactgcacccagcctaaagatgctttagttctaaagggagaaaaggggtggtggtaggttattagtcttatttatggataacagctttcagaatagctttctcataagcatttagtttcctgagctaagaatgaagcatatgacctgtagcttag

SEQ ID NO: 40076 - DNA, 1037 bp, Homo sapiens
gccaggaggcagaggttgcagtgaggcgaaatcgcgccattgcattgtagcctgggcaacagagcaagactgtgtctcaaaaaaaaaaaaaaaaaaaagctttctaagagtttcttttcctccctccctccctccctccctcccttccttccttccttccttcctttctttctttttttcagacagggtctcactctggttgcccaggctggaggagtgcagtggcacgatcctggctcactgtagccttgacatcccaggctcaggtgattctcccacctcaacctctcaagtagctgggattacaggcacgcgtcattacaccccgctaatgtgcattttgattagagacggggttttgctatgttgcccagggtggtctcaaactcctagactcatgcagtccacctgcctcggcctcccagagtgctgggattacagacgtgagccactgtgcccagccagatttctaagagttttgcttatagtttgttttgacatgatcttgaaagcaatttaattctaaagtgggtttggttttggctcagtagatttcagtcatttttacgttttattttcatgatttctcttatatatttagaaatcagaagtgattgtgaaagtgaattttatttctgacagccttatttgaggactttaaaaaatatttaataatacattttatttaactgaatatagccaaaatattttttcaacatgtgactctagctacatcccaagtactcaatagccaccatatggctggtggccaccagctcttttggacagtgcagctctgtggatgctgtctgatacgttgtaccattttttttctgtaagaaattttatagaattggtgttattcttctactaaagaatttccagcaaaaccattcaaacctggaggtgtttaggttttcaattactagttcaacttattttcatagttataggtctattaaggtaatctatttcatcttgagtgatgtgggaaaatttcaaggagttggtccttttcatctaagttgaatttatgt

SEQ ID NO: 40077 - DNA, 1017 bp, Homo sapiens
tactaaaactgcaaaaaaattagccaggcatggtggcaggcgcctgtaatcccacgtattcgggaggctgaggcagaagaattgcatgaacctgggaggtggaggttgcagtgagctgagaccgcgccactgcactccagcctgggcggcagagactccgactcataaataaataaataaataaataaataaataaataaataaataaaaataaataaataaaattaagctcctaatattttttaagtccttagatttagatttgcagaagcagaactgagatatctaataacatagatgcaaaattctaggattcagacttctgtcactgtggaagcattggaagcttagtaaacctgagcaggaaactttgggagttaaaatgaaaatttaaaactgtccctctaaaaatatgagtagacagaattctctttaccagcacctagagcttctcagttgttatactaccatgctctgttgtacaattgtagtgaatattaagctgtgcatgttatgataaccctagtgtttctctgactttggtgaaatttttgtgattgtcatatgagagggtatcttgggcatattgatacagagtcgtctttattttttgaacttcatagaagtgaatataaagggatgggaaaagaacttgagaaagaacaattatttcccccatttttcttctagtgcattaaaatagttagctttctacctttctcttcagtatgattctagagaagataattttgcttctttcattcaacacattttattatgttccagtcactttattaggtacaagggaggaatggtcacaagattgatgaaggtttctgctttcatggagcttaatatgaaatgcagtgtccacacttataagggttaaaaaggagatcatcattaaggtttgtcttctgtattgctatttggatattccttactgtctccagactatttctataattgtatatacttactaagtcccctgggactgttggacttttgatttttgtg

SEQ ID NO: 40078 - DNA, 1054 bp, Homo sapiens
tgtgtatgttgaggaaaaaagagaacatgattttctgtattatgtgcacatattaactttattttaaaaagtgaagcttctggctgggctcagtggctcatgcctataatcctagcactttgggaggctgagatggatggatcgcttgagctcaggagttcaagactagcctgggcaacatggctgtctctctctcttttttttaatattaacaaataataataatacaaaataaaaagtagtgcttctttgaatgccgtagttatagaactctcttttaattgatttctttacccattcttgttttcctgtgggtaataagggagatttcctcatactgttgctgatggtactaatgtttgttactttctgtgtgggaagaaagtgatacacaaatttgttggtcctggtgtttttcctattgttcctcagccagaatagaaggctttaaagacgtgtataccaggagcctcaggttctgtgacaaaccctaagaaacaggctttttccttttgtttaacaattaggataatatctggacagtactgaagtctgttgccttttctctttttctataggaacctacaagcagcaattggcgcctattatgactttgagagcccaaacatcagtgtgccctctatgtcctttgttgaagatgtcaccataggagaaggggagtcaatacctccggatactcagtttgtaaaaacatggcggatccagaattctggtaagtacataatgggcaatcctcccttgcctagttttcattttcttaatagttaaataagaaggaaatgttttagcttatgtatgtgattgtgtaactgcgagctttctcttacacatgatatgtagtattttcttgtactggtgtgatgaccaaacattagtgaaatatctcctgctctaaagtaggaagaagaatttatgtctcatgcttttaagccacctataacttaatggcatctaaacacaatccaatattggttttgttactaggaactagacttctatatgatggggtattggctccacctgtacagtttta

SEQ ID NO: 40079 - DNA, 1043 bp, Homo sapiens
catgcactatgcccagctaatttttgtattttttgtagagacgaggtttcaccacgttggccaggctggtctcaaactcctgacctcaagtgatctgcctgcctctgcctcccaaagtgttgggattacaggcgtgagtcacagcatccagcaccagcatccatcttaatctgtgctttttatcactgttaacgttgcctctgtttgttcttcagggtacttttaaccatctgaaattagatttaaaacttttttgagcagaaaaactgaaggaatctggaggtttaaactttcagactgcactgaatgctgggtcaatgttttccctttcccatcaccttagccagctccatttcatgaagaattacttgttggctaataatagctgagtatgttgttttgaacaggaatacctgctatcatgtctactttctgacactgaattggagctgtttggtctatgcctgctgttgctcagcctagtgggccagtaatttaaattctctgaactctgagaagctgtgtaccccacatttgtagctgtgtacctgcttgatgggttagatcactcgggctaaagtccactttctgccttgtacttgggaaatgaatttgctttgtcatcctctccagcttcctgccaggattccagttcgctgctttcagtttcagtttggggtttaaaaatgtttcttaatctttctctggctgaattacctgtataatacacatacaaataagctttgactgtgggataagttggaaaggtgtgaaaggagatttgaggataggaatggatctgcctaagttgggtagcttgactttcccacttactagtgttcctactgcagtggtcttaaagtcctatcctgatggcagagccaaagggtgaaatatgacacaagctggggatgagaattggcaattgtcctgagtgcacaaatagtttcttccctccaaaacatattttgcagccaagtgaacagaaaacaattcagcaggctacttactgaagacctgctgcaaaaaaattctgttttcaa

SEQ ID NO: 40080 - DNA, 1034 bp, Homo sapiens
aaaaaaaaaaaaaaaattagccaggcattaatttttttaaatagtagtcccagctacttgggaggctgagatgagaggattgcttgagcccaggagttttaggctgcagagagctataatcctgctactgcactccagcctcagcgacagagtgagactgtctccaaaaaaagaaaagaaggtttcagagttctcacaggtagcctctgaaggcgtcttggataaggctgagtcttgactgtttttgtgatcttttgtagatgggcctattattattattttagccactttttactttttatcagtttattttaggtcttgggtggcaccacgtaacaagaaaagtaggtgttatcatctcagtctgttatgcatgtgtttatcgatttgaggggtgaacatcactgtgggctgaatgttacttgatgtgagggactattttgagacattaggatcacagatcattatatcaatatataagttgatgtacatttgaatttttacttactggctatattatgaataaagctgctgtgaacatttcacttgtgagactatgtggacatatttttaaatttatcttgggtagatacataggaagggaattgttaatttgtatggtaaggttatatgtagctttttaagaatctgctaaactgttttccaaagtaattaccattctacattcttagcagcattgtatgagagttctctcaagcttttatactttttttttcctgaaccatttgagataacttgcaaggattgtgagatttcacctttaagcccttcagcaaatatatcctgggagaacaagagcatcattctacatgactacagtactattgtcactctgaaggaatttaacatggaaacaaaagtattatctaatatatagcccatctctaaatttgttcccagaattgccctttacaaccttcctttttttaatgcaggatcttctcagggatcttatgttatctttggttatcatgtctctttagacttctatctagaacagttccttcgccttt

SEQ ID NO: 40081 - DNA, 1118 bp, Homo sapiens
ctgggattacaggtgtgagccaccatgcccggcccgcattttaatcagtttaaggtgtacagttcagtgttacattaggtgttcattgtaagttgtttagcattagtaacaagagtcaaataactcttctagatttttatacattaacttaggagttaatattggccttatttctcagtatagcagtagataaaatatcttttaatagcatatagacaatgtttctctacctcctattaggctactgctgtgcagttgtggtattgcaacatcctaggttgcctgcaggtatcttcagggagcagtgtgtatgttttggaattctacttgcatccaccatggatggaacagatgttttctagaaaagtaacttgggaaaaatatttctgtaaaatatgatgtcctattaattttctcaacattgtcagaaacaccctactagataaagatataaccacaaatcaatgaaatgaaattagaatctagatatgaaaatcagttgtacctcttacctgatcacgtattaccttctttgcctgttaatccatttctcagtcacccgtgctaaatgagtttctcatctatgctgtggtttatatgtataaatctaggaaaaagttcctttatgatagagataatacttctattaatattggtttccttaaataaatgtgtgtcaaatagtagttttaggaagagggtaaggaagggctacataacagtgatagagtattatgtactctattacattttttaaaaggtttttatttttgatttggaatattgttgatttttaaagtaagattgtgaaattgataccatgtaaaattaactattttattttcatttatttaattttaatttttttagagacgtctcactatgttgcccaggctggagtgcaatggctgtttacaggcatgatcatgtagcacactacggccttgaactctgaggctcaagtgattctcccacctcagccacctgagtacttgggattacgtgtgtgcagtactgtgcctggcaaaattaactgttttaaagtgaacagttcagtggtgtttagcgcattcacagtgttgtgcaaccaccaccactctcttgtttctaaacttttt

SEQ ID NO: 40082 - DNA, 1045 bp, Homo sapiens
ctatgataaagcctgttatgagacgttatactaatattctcttaaaaaggaaaaatgtctgtttatttccttagcaagcttaagaaaagttaacaagaattacaggactcaaaaggattatgtgattagtaaattattgtgtgataatcagactttctccttaccctctgtttagcactggatgtgtgtgagaagtggggagaaatgccaccactacaacccaaacatatgagggaagccgttagaaggttaaagtcaaaaggacagatccctaactcgaagcacaaaaaaatcatcttcttctagaccaaagtctagaaaggcctatgttactgacggaagaagtattggttccagacttcctataagactgtctgcattggtgctttagtatctcaggcctccaaggattccatgatgattttaatgtctttctcaaaactctgatatttgtcacacctagaaagtatgtagcctgattgatacttgccttgactaaattttgggacctcttggggcattttgaagtatttaactgtcttgaccagttggaagaagatacgtgggccataagcatcttctggacaggggaactgctttcagagagaaaacctttccaagagagttttgttttgttttggtttcgttttgtttgagatagggtcttgctctatcacctaggctggagtgcagcggcatgactgcagccttgaactcctgggcttaagtgaccctcccacctcagtctcctgagtagctaggactacaggcacacactactgtgcccagctaacttatttttattttttatggagatggggtcttgctttgttgcccaggctggtcgtgaactcctggcttcaagcagtcctcctgcctcagcctcctaaagtgctgagggctttaatggtttcacattgaagcctgaagttgctaagacttaggttgtttcttatatctggttttaagtagatgaaacaaccagaaacttttacttgtgatactctaccatgaaggatgcggtaatggcaggaatagcagaata

SEQ ID NO: 40083 - DNA, 1089 bp, Homo sapiens
attaggagtattaactgtttccacatattttgcagatatttcccctaaatctgttaatgttgaaaactactggtttgattataaatttgtatattaaatttttaccatcagtgtgaaattcaataagatagagttatggagatagtgtctaatgctgcaaacagtctgtgtagtacgatacagtgacccagtgttgttctttttgttaacaggtaagaaaagaagtttttgttttacgttttctcaaattcctttggagtagaagtgttttatcttcattcctcaaggcaccaagcctaatgccattgacccctttaagaattcgtttttgaattgtctgaaacttttattgacttcataatatcttgagtattcgttcttataagttaacttagttacctggatctttgtttagaatcctggtttcttctttttctgaggagcagctgaaccgttatgaaatgtatcgccgctcagctttccctaaggcagccatcaaaagggtaaggatggaccaccacacttcatctccatcacgttttagaactgaactcaagagccatgtccattggcatttgaagtgaggtgttagacaagtcaggggattatttaggtgggaaaaaaaatgcacttcagttatcttacctttttctgtgaattacttggtactgtgttccaaagccagtctttgactattgtgatcacggagtctttgtgcttctttcaagctgatccagtccatcactggcacctctgtgtctcagaatgttgttattgctatgtctggtatttccaaggttttcgtcggggaggtggtagaagaaggtgagtagtgttggttacaaatactggattgtacctgtggtggtcttatttttaagaatatctacacaaaggagcttattaaagcacctatgggagttctcatttgcacttgaagttgaccaagtggggagccctttatttaggagaacatgactgttattccttgcaagtttcaataacagatggtaaggaaccatctgggaaatcccctccctgattcctttcctcagcccagggtgaaagaagtagactttgtattttctg

SEQ ID NO: 40084 - DNA, 1037 bp, Homo sapiens
gattatttcatcacccaggtattaagcctagtgtcccttagttatttttcctgatcctttccctcctgccacccttcatccttccatatacccttcacccttccatataccccagtgtgtgttcccctctatgtgtccgtgtgctgtcatcatttagttcccacttattagtgagaacatgcagtatttggttttctgttcctacattagtttgctaaagataatggtctccagctccatccatgtccctgcaaaggacatgatctccttttttatggctgtatagtatttcatggtgtatactggaaaatacattttctttatccagtctaccattgatgggcatttaggttgattccatgtctttgctattgtgaatagcactgcaatgaacataagtgtggatgtgtctttataatagaacaatttatattcctttgggtatatacccagtaatgggattgctgggtcaaatggtaattctgtctttaggtctttgaggaattgtcacactgccttcctcaatggtgaactgatttatactccaaccaagagtttaaaagctttcctttgcctccacaaccttgccagtatctgttattttttgacttttgaataatagccattctgactgatatgagatggtatctcattatggttttgatttgcatttctctaatcagtgaagctgacctttttttcacatgattgttggccacaggtatgtcttgttttgagaagtgtctttgcctacttttaagtggggtttgaacaggcatttattaaacatccagcataagtaaaattgcattaaatgctgatgggggggagatataaataataagagacaaacctatcttcaaaaagactagtaatgtgaaataaacatttgcatgaaacagtaggattgaagaataagaacaaaagagcactacgtgtgagaagctcacttgaaagtcccaaattgaaataaacactgttttgatgagaaggggcctcctttttaatattctttccatgtggaatcatcagcagta

SEQ ID NO: 40085 - DNA, 1065 bp, Homo sapiens
ggttttttgtttgttttttgttttttgttttttgttttgagaccgagtctcgctctgttgcccaggctggagtgtgcagtggcgtgatcttggctcactgcaagctcctttaaggcagtttttgtttgttgagacaaggtctcactctgtcacccagcctggagtgcagtggcacagtctctgcctcctgggctcaagcaatcctcttatcccagcctccccagtaactgggactgcaggcatgctgcaccacgctcatctaaagtttttgttttgttttgtttcgtttttgagacagagtctcgctctgccgcccaggctggagtgcaatggcgcaatctcggctcactgcaacctccgcctctcaggctcaagcgattctcctgcctcagcctccccagtagctgggattacagacacgtgccaccgcgcccagctaatttttgtatttttagtagagctgaggtttcacaagtttcacaagttgcccagcctggtcttgaactcctgacctcatgatccatccgcctcggcctcccaaagtgctgggattataggcatgagccaccgcacccggccagctaaaggttttttaaatattgttttggtagagacaaggtcttattatgttgcccagtctggtctccaactcgttgggctcaagcaatcctcctgcctcagcttcccaaagtgctaagattacaggtggcagccaccatgcctggccaagaaggaaactttaaaacaggtgtcaaggacagcaaggatttgaataattagcttagtacacagagggctcactacatatctaaatttgcaccgaacagaggataaaattatgttgtttctgaaacacttttaaaaatcgatcatgtaccagaccacaaagaaaaatatgaactcttaaaagtagaaatcataacaggccacatcttgttaatgtaatgcattaaacttgaaattaactacaaaaagcttctcccccaccaaaaaagaactaaccccctggaaattttaaactattttttaaatagcctttagactaaagaaattaatagaacactt

SEQ ID NO: 40086 - DNA, 1057 bp, Homo sapiens
accaaaactaggaacaggccctcagggaattacctagaggaggggcaggtgggcatttgacctaacaggctagcccttagtctccagctgatggccattccctgaaaggttggtgggtaagggttatctctttcctgtccctcaggacggggggttgggggggtgcggggcaaggagaggtggagggtctaaagggactcactgaaaacgggcagccctttagggaggaggaggagctgggaaagaggccaggcagggaggacctccaggagagccagtgaggctgggtagctgatgggggagggctgggggccaggcaaggggctggactgggagagatctggagagactcaggcctgaggcagctttcagcactagtaagggaaaggggggctggtgaatggcttccttcctgaggtcaagttccccaagctggtggcagacaggacccaggctactcacccctggttgggggaaggggcagggagggcagcctttcacttcactcttagcatacctgtcaacagttcttcccagcaggaaacctctcaactctggctggctgacctgctgccctagcctcccccctcctctcgcagctgttgggccaaaagacacaaagaacgagcccagtcctcctcgtccccactccttgtgaccaggggatatggacctaatgaatcatcattttcagtatggctaccctgcctttttcctccaccctttccccccattctccctcagacctggctaattaaaaggaagggaaacagaatgcataatgtgggtaactatactgtaataacagttaacacaaagtgtttccatttgccaagcactgttctaagtactttttatgtaatcactcttttaatcacaacacagtatgaggcgagcactatggaaaactgaggcacagagacattaagtgacttgtccaggatcacagagctagtaggagacagggctgggatctgaacccagcttcagtcctcctaactagtatcctactctccctttgaccagtacagcctttcgaggggtagacatcatttcc

SEQ ID NO: 40087 - DNA, 1073 bp, Homo sapiens
taaaaaggcattctaggcactgtaagatgactactggcctgagaagagctcaaacctcctccaattatctctgtccccaaaggaatgatcgagaaggggccaagccaacaagctttttaaagccttccactcctcccaaccagtgagactgtcatttgggagctgagagtgggggttcagggacagttataggaatgggagataggaattttggaggcaggatgctgtttccgcagtctcccagttcttcaaaagctgtcttaattcctcctattttgtcacagcggatgcagacatggtgcatgcatccagggattgcccatagccacaagccaacacaaggacctgttcaattggagggtgaagaggtgagggggccagggtggctgggggtgcaagcttactagcttacccccacagtgggtgataccatacaacaggtagccacgatggcagagacactggaagcttcctggtgtgttgacacatatgtggtcacaggttcgatcaaaggaacactcgtctatatctggaagagcaaagattcaagccactgaatctgtcttggagcacttgacccttgctcaggtgaaggacccaagtgaggggccttggctttcccccttgaactgaagagttcctattcatgtcctagctctaggaccagtgatttaacaatgccattccatcttctctgccccctctatttgaagtccttggaattaggaactgcaagatctggtgcctttaggtcagggcccaccatgtgtggttaggtacgtcctactctgccaaggatatgaattggggtgaaatccatccctcagtccttgccaggctgaatgctttgatatggagctagtccgctgaggggaaagagtaccatttgctaatttgcaggatgacactgcctctagagactctgtgtgatatctattgagtttctaagactttagccctctggcctccttgaagctctcccacaagaacctctcctaaggctttcacctttggctgagtctgctcaccctggcagttcctctcattgatgagaagcttatagcctttcttgc

SEQ ID NO: 40088 - DNA, 1041 bp, Homo sapiens
ctatgtacttcaaccaaaattgcaacagatgaatgcagaaataggagaatctggttgtctcgtgttacaagtcaaacacatttccacatgtataacattctaaaacaatgacactcgtctcactaattttttttttattttggaaaatacaaaatatacaaatactttgtacaaaattaaattacttatattaacatggggttattctaaaatgaattattaaataactacttttttactaaatctcagtagatatgtcaaataaacaagttctttggagtcctcaatttttaagatgttaaggggtcctgaggaaaaaaggttgagaactactattttcaagtattaagtatgatttttactaaattattttcaaatgccttttttttttgagacagggtctcgatctgtcacccgggccggctcactgtagcctcaacctctcaggctcaagtgatcctcccaactcagccccgcaaatagctgggaatacaggtgcatgccaccatgtctggctcgctctgttgcccaggctggagtgtagtagcaccatctcggcccactgcagcctccacttccgaggttcaagcaagattatcatgcctaagccccccaagtagctgggactacaggcgtacaccaccacgcctggctaatttttgtgttttttgtagagatggggctttgccatgttggccaggctagccatgaactcctcacctcaagtgatccgcccacctcagcccacccaaacacctgggattacaggcatgagccaccatgcccagcctaattttttttttttttttttttttgtagagacagggtttcaccatgttgcccaggctagtcttgaactcctgggctcaagcaatctgcccgcctcagcctcccaaagtgctaggattataggcatgagccaccacacctggcctcaaatgctgttaaatgtctttagttcatttaatgttcttattttttaatcttgtaggaataatagcccatacatcaaattaaactttgtagaacatgtggcttatt

SEQ ID NO: 40089 - DNA, 1029 bp, Homo sapiens
agagaagttaaggtagccaacatcaaacagcttgtaaggagcagaggaagaacacccccaaattccattacaaattccttgcactttttgtcttaccattctcaaaggtagaggcattctagggaatctaaatatgaacaaagcatggaccttgctctgaaggatcttttaaacctaacaggcgcatagtcttatgaatctcttacagacaacaaatcgagagaagagctaaggaagtacgtaaaagggcaaaatggcctacaaatagagggtcaaggttggtatgacagaagtaggatttgagagaggtggatgttttggaaacaagaaagggagtgaccagaagaatgactatgggaaagcactgggtttgttgtagaggtggaattggcctagtttggctggagcatgagctgcatgaaagaaagtaaaataaaataatggcagctagaactcaaagatagattagggccagattgtgaagggccttgaatgccacatggaagaacattctgtaggtattttgggcaggagatgaaaaatgaccctacagaaggcccaataatgatgataaatggttaaatatgtttaagttaccaatctatgctaatcttttaagaaatgttatctcactgtaactatgaatagtgtactgtgtccattttgcagatgaaaaatgaaggctcagcaagattaaggaaactggaaatgtcaagagctgcagctaggacccagacttgggtctgttggattctaaatcctgttctgtgtctcactgtgattgatatattgtcacttcttttattaagaactgataaggtcttaatcctctgtcaagaatatggctgtagaaaaaggatgttttcaaagttgtgaagggactgcttctcaccatgttatgttaaggaatgtaatcactacccaacttgacttgtactgttctctgttttgagaccagagctagatgggaaattaaagaattggatgatgttttatttacatgcctgatgacatcaatacatgctcata

SEQ ID NO: 40090 - DNA, 1027 bp, Homo sapiens
ggagaaggaaagagggagaaattatgccacttttaatttcagctactacctctattaggatttgggagttatactaatagaggtaatagttgaaattaagagtggatgagttctggtatgaagtggttgatggggacaactgttgattgacaactgcattttaaggagaggatactgatagtaatgggagatgggatgaaagaatgcccaggcagagaggaaatttaataatttcaggagtggggaaagaataaagacaaatgttactgcagcctacctttcattcttttactgtgcatgagatactgtatttgctggatgttttcctgtagataccacattgttcttcctccgggagtggcatgtcagaaaatttgatgattattttaaagatgttgagttttattcctgaaattgaatatggtaacggaaaaagggtcttgggtagtttttggtgtcatatgctgtgttccttttagttcataaaatctttcatcttgtttgaatatctgtgggtctaaaaaaaaaacagctaatttttggataggtaaaagtccagatactttgtacattttaattgattatttaaaaaatattccctggcttttaaaacttggctaatacaaattgtaagaatcaccatctttttagaagaacatactgtgaattcagaatttttgctggcttagtgcttgtcagcatggagcctgttcacaggaaatgctttagaatcagagtcagagacctgtgacacttctggggagtcagtatgtaaaatagttagagtgcaggctccagagtcagtctccctggttccactgttcactagaagtatatccttggatagattacttagctcgtccattagatttgctgtctggacgtgtcagtagtaacaatctcaatgtcacacggttattgaagagatccatcatagagcttacattctagtaaggagagacaggcagtatacaaatactataaatacactggaggaaaacatagtggggctgattatagtcgattt

SEQ ID NO: 40091 - DNA, 1855 bp, Homo sapiens
gctgttcctagttaatgatttttcaggggctgtttctcatacatacttttctgtttccgatagcggttaggagaagaaataattaaaggtgtcagcgtttctaaagtggatttagatttatttatgtttctccactgaatttatcctggacccttactttcaccttctattaatatttgtatccactctcctgcttttcttgccttttctttttctatttgctttacactatgacgtcaaatccctctttttctcttcttgctgctgcttttgtccagctgtccttcattacccatatttcattatgactgtggaatttatcaaataggcccttgagtctaagctattactgatttaaattcagatgtcccaatagttgttaggattaataggacccttctactctgttatacagcaactggagagaggagtcctagggttagagggggtgggcaagcctgagggtagaaggaatggtgtagaagagaattccaaggattgttttgattttgcccctaaaatataagttaaaatcctaagtttcgatgatgatgacttttgcactgataaaagtttgatcctgaagtcataatggactgtgagagtttcttgaaggcagagctgaacttctaattctgaatccacagcattcagtaatgctgaagtattgctgctgctaagtgcaagttgaattaaattgttaggattgatgctttcttccctcaaggtgttttgtggtaggctggggattaagagtatggtatagacttgtttttttgagacggagtgtttctctgtcacccaggctggagtgcagtggcgtgatctcggctcactgcaacctctgtctcccaggttcaagcgattctcttgcctcagcctcctgagtagctgggattacaggcatgtgccaccacgcccagctaatgtttgcatttttagtagagacggggtttcaccatgttggtcaggctggtctcaaactcctgactttgtgatccacccgcctcggcctcccaaaatgctatatctgtagaatccgtagaatccgggattacaggcgtgagccaccacacccagcctagagtatggtatagactcgtgtaagacttcagtgaatcttatcactaccactttgtggtatgggataagatacttattttctgtaagtctcagtttcctcaactataacatgcgagagggacaaaatgagcacttacctcaaggttgttgtgaggattaaatgagacaatacatgtaaagcacttagctcagcgcctagtatgtcttcactaaatattaaatactagtgtagtttcattaataagtactgctgtgttccagatatttattaagttctgctaggttctaagtagggttaacaaaatgaacaggacatgatcctgctctcagaaaggacagaacatatgcacaaaagataattaacaacctagatccaatggtaagtggcaaaggagtggtttacttaagggctcaagaggctaagcaaatgagaacttcaggaaggtgacagaacttgatctcagctttgaaggactaattagcaagttgacagtctccttggagccagactgcttgtgtttgaatcctagttctgctactgtgtcatcttaagcaagtgacgtgatctctcgcctaggattgttgagagaattaaatgagttaatacatgtaaaacacttagaatggttccgcaaacattgttagagcttgataaattattattaataagttgagagaagggagaatgcatttcagatagaacattgagtgataatgaaggggagatactctaggtttgtttgaagtgatgaagccaaattggttagaggga

SEQ ID NO: 40092 - DNA, 1028 bp, Homo sapiens
gaatcacttgagcccaggagttcagtgctgcagtgagccaccatactccagcctgggggacagagcaagacccagtctcaaatacacacacacacacacacacacacacacacacacacacacacacacacacacacacatatacgtatatatatacacacacacttttttttttaaagaaagagcttgggatatatatttctatactttttttaagaaaaagattggaagagacatatatatacacacagacacatacatacattttaaagagattgacgtatgtttttaacctttttttaaaaaagaaatgggatatatatatatatacttttttttctttttttttttttttaaaagagattgtttcttgctctgtcaccgaggctgaagtgtggtggctaactgcagcctcgacacaaactcctgggctcaagcaatcctcttgtctcagcctcccaaagtgctgggatcccaggcccaagccaccatgcctggcttaaaaatgtagtacatttgaattgtatccttttgaaattgttcgttttttggaaagaagaataagagatgaagaaaaatcagactggaagagggttgttttttcccttttgtagttgcaaatcctaagtgggcagtggtaaatttctagaatcatttgtagcattctgttttaaacttggcaatttaaagatgttataaatgaggagtccccagaaaatggtcatttcattatcaaaagcagggttgcaaatttcagattgatcttttcaaaagttagatttgtacttgttctcagtgttcctatctctggaaactaaagaacctcctccattgttagctgaaaattgcacagtgaatttgaaagtcaagatgtcccagtcatggacataatgctgcgataggttactttttggaatggagaaaacatcttagagattgagtctgcatcagaatatattctgaatgagcatggaatgttctttacccatgttagatattaattaattaagtttttccatgtttaactt

SEQ ID NO: 40093 - DNA, 1508 bp, Homo sapiens
aattgagaatatgccccaactaagtcctggactctacagttcttgaggttgtttggactgcttagtaccattgatttaatcaaaattgacctatgactagcgcttattttataactgtgcttccctatcaataaggtcattttttaaaactgctgttggccaggcgtggtggctcacacctgtgatcccagcactttgggaggccgaggcaggcggatcacgaggtcaggagatcgagaccatcctggctaacatggtgaaaccctgtcctactaaaaatacaaaaaattagccgggcttggtggcgggcacctgtagtcccacctactggggaggctgaggcaggagaatgacatgaacctgggaggcggagcttgcagtgagccgagattgtgccactgcactccagcctgggcgacagagcgagactccatccaaaaaaaaaaaaaaaaaactgctgttgtgtactaatttttaaaactccatttgtaatcagtgaggatttatgtagccctgcttttcattctgcatggcacttattcccaaggatatcatttcctaagacactctcgagcactgtaagaggtttttctattaaaggagacaggcttttcttttcctaattagggagtgctgacttgccagtcacataggctaggctcctgactccctttacacttaatcttctgattttctaaagacctacgaattggccaggcatggtggctcacgcctgtaatcccagcactttgggaggcagaggcgggtggatcatgaggtcaagagattgagaccatcctggccaacatggtaaaaccccatctctactaaaaatacaaaaattagctgggcgtggtggcatgcacctgtagtcccagctactccggaggctgaggcaggagaatcacttgaacccaggaggcagaagttgcagtgagctgagatcatgccagtgcactccagtctggccggcagagcaagattccatctcaaaaacaaaggacctaggaatcaggaacttcccatctgggacaatctagggagtacttcctatgcaaaagttaatgatgtacttgtcaaacactaaagagtcataagtagaagtctgaatttttttttttttttgattttttttgtttggtacagaatctcaatttctagccatgtgtgattataatgtaagaaagacctgggctgggcgtggtggctcacacctgtaatcccagcactttgggaggccaaggttggcagatcacgaggtcaggagattgagaacatcctggctaacgcagtgaaaccccatctctactaaaaatacaaaaaattagctgggcgtggtggtgggcacctgtagtcccagctactcgggaggctgaggcaggagaatggtgtgaacccaggaggcggagcttgcagtgagccgagaccgtgccactgcactccagcctaagcaacagagtgagactccgtctcaaaaaaaaaaaaaaaagacctgttcttctcatgaa

SEQ ID NO: 40094 - DNA, 1049 bp, Homo sapiens
gtttccccctgtttcttctggtagtttttcagtttcaggtcttattaagtctttcatccatttcgatttttgtattcggagtgagatgagggtggtccagtttcattctttttatatccagtttttccaacaccatttattgaagagactatccttttcccattctgtattcttggcaattttgtcaaagatcacttgaccatacatgcgtgggttcatttctgggctctctatattgttcctttggtctatgcgtctgctttttttgccaggaccatgctgttttaattactgtagctttgtagtatagtttgaaatcaggtggtttgatgcctccagctttgttcttgttttgagacagagtctcatactgtcactcaggctggagtgcagtggcgcaatcacagctctcttcagcctccgcttcctgggctgaagtgatcctcccatctcagcctcccaaatagctgggactacaggtgtgccccaccacatccaactatttttgtattttttgtagaggtggggtctccctgtgttgcccaggctggtctcaaaactcctgagctccagtgatctgcccacttcagcctcccaaagtgctgggattacaggcgtgagccaccatgcccagcccagctttcttctttgtgctcatgattgccttggctatttgggatgttttgtgattccatgtgaattttaggatgttttttctatttctatgaaaaataatattggaattgtgataggaattgcattgaatctgatagatcactttgagtagtacggacattttaacaatagtaaggccgggcacagtggctcatacctgtagtcccagcattttgggaggccaaggcagatggattgtgtgagaccagcctgggcaacatggcaaaatcccatctctacaaataatttaaaaattagccaagtgtggtggtgcatgctacttgggaggctgaggtgggagaatcacctgaggctgggaggcagaggttacagtaagccgagattacaccactacagtccagcctggatcacag

SEQ ID NO: 40095 - DNA, 1044 bp, Homo sapiens
gatggggtcttgctctgttgcccaggctggagtgcagtggtgtgatcataactcaatataaccccaaactcctgggttcaagggatcctcccacctcagtgccctgccccttccccccgccaacgagtatatgggcacatgcctaggactataggcatgtgccacccactcggctcatttttaaatttttttgtagagaccaggtcttgctatgttgcacagactggtctcaaactcctagcttcaaacgatcatcctacctcagcctcccaaagcactggaattacaggcatgagtcactgtgcctgtcctttacttgtatttttattgtgctgttgttgttgctgtttctgaatattttcaatctacagtcagttgaatctgagcatgtggaacctgcagacacccagggctgactaacttaattcttggtcaggtgtttcagtaagggagtgaatctttcagaaatgggatccaaaggggtttatccataactgtcttgtctgtctagaactcttaaggctactaaaatccttaaactatcaaaatccaaagtgtagtaatttgacccaagagctctttctccatcatcaccaattcccaatctgagctgcccgaatgaaacggcagaaatgtctgcaggtggttataacttctagcactatgcacaatagctctttagatttcaccaaagattgtcacctttattcaacagcagtaagtcactggaggctggattttgaatgccattttagtaagtaatattttgagttctttttgtacaatttccttatcctatacaatgaaagctataggtttgcttttgtttacttgtttttgctgccagtgttccgctaaacagaggtaatacaaacaccaaaaaaacagagtataatctcatctctttcacagttctgtaataaaatcactaggacctgtgtctttacagtagatccctgcagttggtatgtgcagaatcccaggcattgctctcagtgaaggtaaaggagagctgggtatttgctgtattcaagagatgggagt

SEQ ID NO: 40096 - DNA, 1050 bp, Homo sapiens
tgcctttatgtttggaacaccttcatgtgtgttttcttacctatgtggcacactttattccggtggagtcttctgttacttacatcacaacagaattaatctctcttcaacttttataacaagcctactctgttaattcattcacaccctgtgataacccattaatccattcatgaaggcagaccccctcatgacccagtcacctcttaaaggctaaaaggtctcacctcttagtactgttaacattggacattaagtttcaatattagtttcaaaggggacaaacattcaaaccatagcagtgtctctgcatttaaaatgactgcgttcttggctcgcccctgtaatcccagcactttgggaggccgaggcaggcggatcacgaggtcaggagatcaagaccatcctagctaacacagtgaaaccccgtctctactaaaaatacaaaaaaaaaatattagccaggcgttgtggcaggcacctgtagtcccagctacttgggaggcagaggcaggagaatgacgtgaacccaggaggcagagcttgcagtgagccaagatcgcaccactgcactccagcctgggtgacagagcgagactccatctcaaaaaaaaaaaaaaagactacgttcttttcagccattcactcattcagcaaacatgctggcacatactctgatgtaggcattaggacacagcggtgaacaatacatgtgtgttgcaccccattgaattcagattggatctcacttcttgatctcttcagcacatcagcatctggcattcagtaatggaattttacataatttttaacgagctgtattattaaacatacagtcaacttttgaacaacataggtttgaactacacaagtccacttatgcacagatttttttaaccaaacaaggatcgaaaacaatattcaagggatgtgaaatgcacatatatgaagggctggctttttgtatatttgagttctgggccaactgtgaaacttgagtatgcacagattttatactcgggggattctgaaactaatccctgaagtaca

SEQ ID NO: 40097 - DNA, 1044 bp, Homo sapiens
tcccaagtagctgtgattacaggcgtgcgccagcatgccctggctaatttttgtatttttagtagaggaggggtttcaccatgttggccaggccagcctcaaactccggacctcaagtgatctgcccgtctcggcctcccaaagtgttgggactacaggcatgagccaccatacctgaccaaggttatttttaatggacatctttttaaaatttataatagaatgattcacacataaatgacagtactcaaagagccatatgcttttaaatgggacatggttcagacctcagaaggatcttacttcccatattgattgtagaatattgtgataaccttttagaaaaaacaaagccagcttagcactgactaataagaatgtggagcagctttccaagtaattagaattactccactacgctatcatctggtccaggtcaccctggatgacttcagtagtgactgcaatagcttcttcactttctcccttctgctgcccttgctccccgtagactattggcaacacatctatcagagtgatacttttttttttaatttgtatatgttcatgaggtataagtgcagttttgctaggttgatatattgcattgtggtgaagtcagggccttcaatggatccatcactggaacagtgcacattgtaaccaccaagtaacatcccttcatccaccctttcaccccaccctctgagtcttcattgtcgatcattccacactatacctccatgtgtacacattatgcagctcccacttataagtgagaacatgtggtatttacctttctttgagttgtttcaattaagataatggcatccagttccatccatgttgctgcaaaacacatgatttcattcttttttatggctgaatagtattgtgttcattccataccacattttctttatctactcctagacacttgggttgattccgtagttgtaattatgaatagtgctgtgataaacatacaagtataggtatatttttgatatgatttattttcctttgtgcagatacccagcagtg

SEQ ID NO: 40098 - DNA, 1303 bp, Homo sapiens
aaacttggtataaatagaacatcacgaaaattactgtacaacacactttaacgttaatttatcattgctatataatacagtggtttcatacatacaacacatctctgggggtatctttataagaatatggatcttgtcataaatgttaggcaggtaatatttaaatgtaatttgtaacttttctcaggaaatggaacatagatttcatttaacaattgggtaaaagtaagatcttggcccttccggaaataggttttagatgtttagtcatgtttttatgtcactcagtataagttctagaaaatgttttaatcttgtgagaaatgtttctgttctttcactcacacacatatgcatatatctttttttgttcgtttgttccttagaagagtcaagtaccattggccaggatcaaacgcttatggaacgtgatacagagggtggtgcagcagaaattaattgcaatggagtgattgaagtcattaattatactcagaacagtaataatgaaacattgagacataaagaggatctacataatgctaatgactgtgatgtccaaaatttgaatcaggaatctagtttcctaagctcccaaaatggagacagcagcacatctcaagaaacagactcttgtacacctataacatctgaggtgtcagacaccatggtgtgccagtcttcctcaactgtaggtcagtcattcagtgaacaacacattagccaacttcaagaaagcattcgggcagagataccctgtgaagatgaacaagagcaagaacataacggaccactggacaacaaaggtacctatgcagctatacttcctcaacactccttccctgcacaacacattcacagatttctagactaaaagtatgattgtttttgtaactatagctttacaacaggtgtgtctaagttacgtttaaattgtaatctgtagctaactttatccatcatgtactgagtacacagcacttcatttgttgctgtgagggcagaggtttttaattctggaaactcaaggcgttgctgtgctctttttgtctcagaaaatgtaagttgtcacttgggtattgctgactgtattactcttaccttggagagctttattactcattgagtatttctctgttcattgaacagtcttattgatgatgcctgttgtctgtaggaaaatccacggctggaaattttcttgttaatccccttgagccaaaaaatgcagaaaagctcaaggtgaagattgctgaccttggaaatgcttgttgggtggtaagttaaacttgccttaatggtg

SEQ ID NO: 40099 - DNA, 1055 bp, Homo sapiens
gcgaattattgggattaaatggtaaagcagttagtagtgtgccacacaatattatataccaaataaattgcgggaccaggcacagtggctcatgcctgtaacgcaacactttgggaggttgaggtgggtggatgatttgggcccagaagtttgagaccagcctaggcaacacagtaagaccctgtctctacaaaaattaaaaaaattagccaggcatagtgatgcgtgcctgtagtccatttactcaggaggctggggcaggatgattgcttgagcctaggaagtcaaggctgccacgagttgtgatagtaccactgcactcgagcataggcaacaaagtgagaccctgtctaagacataaaattaaataaataaataaaggctgctttatgattttttttcttttgagatacagattttagttttagtagtgtgtcattttttaggaacttgcttgatcctcaagttgagttattagttatacacttctttaaaaaggaagactaaagaagggggaaatggggagttggttgttaaatggatgtagtttctgttttacaagatgaaaacattctacagatcctgttatacaacagtgtgaatagtgttaaaaccactgaatgtacacttatctagagtataaatttttattatgtgttttttgttaaccacagttattatactaatattttaaaaagaggaagactgaagatcctaccttccagctaagctacactgttatccatgacatgctgtagagcaaattactatagctcttgatgtcacctagactccccttttaaaactgacagattctgggtagcatttgaggtgaagaggttgttgcttgtcccattctattttaagcagtgcatgggaatggaaaataggtgatttttagcaactttagtttacctggggaggaagaattttatttatcccttttttttaagtttggcaatttctattcattattttctttaaaaatggtaataatatagcttctacttaagtcatttaaaaacaatagttttctctgcaatgtagactacata

SEQ ID NO: 40100 - DNA, 1044 bp, Homo sapiens
cagtggctcacgcttgtaatcccagcactttgggaggccaaggcaggtagattatgaggtcaggagttcaagaccagcctggccaatatggtgaaaccccatctgtactaaaaatacaaaaattagcccagcgtggtggtacacacctgtagtgccgagaggcagaggttgcagtgagctgagatagtgccactgcactccagcctgggcaacagagccaagactctgtctcaaaaaaaaaaaaaaaaaagaagtctccatgttggctggtgacatccttttcaagatggttcctgtttcttcctgacaggttcttttatttgttagaacagcaaggtgttccaagtttaccctgttatttttcctaccttggatttggccatttttccaaggagctcaggctttcctttaatggagaatgttaaagtctgagcactagaccattactatatatgtatgtcttaacttgcatgtagaagccagtgggggtggaagacatcaagatactactaaaatctctgtagtgccctgcacaattttagactcagagtattcctgctgtgtggtgtcatcaggttgttcatacataaggacaacacatggtggcactggaatcaagattagttttgtaaaatacagagcattaagcaagtttcctatttaaaaaaaaatgttggcatttacgtttttgaggtttaagtctttcttgtacattcatctcttctatagttaaggaataatttgtttttccttgctttgaagctgtgagagtgggaatttttaccctggacaccaattttgatattagggaagaaactaatttacctgaagctaatcaacagcttgaggcttgagcctactgctttctttcactatttgcatatgtaggtttcactttttcttttaccattgagtattttaatgtacataataatattgatgaagccagccgcccacaatttaatgtttcatgaatgctttcattgactatagcattagactttgaaattttagaatattaacagctacatatttattcattca

SEQ ID NO: 40101 - DNA, 1088 bp, Homo sapiens
cctgttactccatcttggctaaagcagaaaacttgataggtgctggggttttttgtttgttgtttttgtgacggggtgtcactgtgtcactcaggctggagtgccgtggcatgatctctgctcactgcagccttgacctcctgggctcaggtgatcctctcacctcagcctcctaagtagctgggactacaggcacacgccaccacacttggctaatttttggatttttcttgtagagacagggtttcaccttgttgcccaggctggtcttcttgaactcctgggctcaagggatctatctgtctcggcctcccaaagtgctaggattacaggcatgagccaccatgcccgacctgtcataggttttatatttaagaatttgccaagcagttttccaaagtgcttgtaccattttagacttctactagcataatacaagagttctaattgttccacaacctcacctacatttggtgatgtttagtttttttattttagtcatttattagtttgagatgctatcttactgtaattttgatctgtgtttgtggttgtcatgtgcttttaatcttacgtagtttggaacatttatgacattgccttttttttttttttttttttttaatttaagaatccaggctagttgttttatgccaccttagtttggatttgtttgattgtttcctcatgattaaattcaggttaaccgtgtttgtcaagcatagtacatggattattgcattagaatatgcattcgaatgcatattagtatattgcattagaaggcacatggtgtgaatttgtgcttatcattggtggtagtaagtttgatcacttggttaaggcagtgccttccagatttcccagttgtaaaggtactttgttctttttgtaattaataagcaatctgtggaatgatattttgacactgtgacaatcctttttcccgacagtctttcacatagttgttttagtattcactgattcttacctgaatcagtaatagtatactatagtgattgtaaaaatggtgattttctatttctgtaatcccttatgtatttattatttggctttcttctctaaag

SEQ ID NO: 40102 - DNA, 1043 bp, Homo sapiens
tctttattgtggtaaaatacacataacataaaattgtgcagtcattaccatcatccatcttcataacttttcatcttgtaaaactgaagctctatacctgttaaatggctattagatctcattggtttattgtgttaagtcctctattgccttgcttatcttctgtctgcttgttctatacattattgagagtgtggcattaaaatctccaactattattgtagaactatttctccctttaattctgtcagtttttgttttatatagtttggtggtcttttaataagtatgtaaatgtctataattgttatatcttcttggtggtatgttgaaccttttattaatatagataatgtccttctttatctcttataactttttctgattgaaaatctattttgtctgatattagtatagccacccctgatttcgtttggttactatttgcatggaatcttttcttcagcctttcactttaatctgtttgtgtctttggatctaaagtgagtctcttgtagacagcatatagttggatctatatctatatctatatctatatctatatctatatctatatctatatctatatgtgtattctaccaaaccaaagttataatcatactagcttttagactaattattttttgacatattggttttttaaatcatgtagaaaacaaaaagaggagttataaaccattattacaatattagcttttataattgctcaagtatttaccttcattgataatctttatttcttcatatggatgcctggctttgtgttattgtttagtgtcttttcatttcaccttataggactcccttgaccatttccagggcacatctggtaatgaactcgttcagcttctgtttacatgggatgtcttaatttttctctcacttttgaaatactgtttttcttaatataggattcttggttgacattatttttcttttagtatttcaaatatattggcccactgctttctggcctccaaaaatttttgatgagaaacttgctgataatcttagtgaggatc

SEQ ID NO: 40103 - DNA, 2077 bp, Homo sapiens
agtcattattgtctgcttatatgacctcctatgtctttaggatactttttttttcatgctgtattctgtctgttttgctagctcctcttattcataatgtgccctaaatgtgcttactcaataacataagccttttattttcagccttttgttattttctttacactgtctccccattagatttttttaaaaatataaccttgtgggccgggtgcagtggctcacacctgtaatctcagcactttgggaggccgaggtgggcggatcacgaggtcaggagaccgagaccatcttggctaacacggtgaaacctcatctctactaaaaatacaaaaaaaagctgggcgtggtggcaggcgcctgtagtcccagctactcagaaggctgaggcaggagaatggcgtgaacctgggaggaggagattgcagtgagccaagatagcgccaactgcactccagcctgggcgacagagcaagactccgcctcaaaaaaaaaaaaaataaccttgtgatttcaattactagtgcttctgattgctactcattagctttctttcactcaaattatttggctcttcctttttgccacttgattatgatgttctgtcaagtttttttttaagctactatatgtttggtcattttaatatcactgcttacaaattaaaacattttcaaattgtaatacttctctcaacaaataaaaattaagcagatggaagctagaaacataagagaatagctttacaatcctattttatgtttagtctttttaagtaatctgcattttaaataatcttgttttgataattttttttatttaattgcttttttatttttatttattttgagacagagtttcgttcttgttggccaggctggagtgcaatggcgcaatctcggctcactgcaacctccgcctcccaggttcaagcgattctccttcctcaccctcccgagtagctgagattacagatgcacaccaccacgcccagctagtttttgtatttttagcagagacggggttttgccatgttggcgatccacctgccacagcctcccaaagtgctgggattgaaggcatgagccaccatgcccagcctatttaattgcttgtttaaaaaaatttcctggccaggtgcagtggctcacgcctataatcccagcactttgggaggccaaagcgggcggatcacgaggtcaggagttcaagaccagactggccaacatggcgaaaccccatctctactaaaaatacaaaaattagcgaggcgtggtggcacgtgcctgtaatcccagctacttgggaggctgaggtaggagaatggtttgaacctgggaggcggaggttgcagtgacctgagatcatgccactgcactccagcctgggtgacagagcaagactccatctcgggtggggaaattttttttctcagcagaatcattggtaaatttcaaatgtaaagaagtagaaatagtttaatgaatccccacagatccattacccatttcaggagttatcaacttatagccaatcttgttttgtctgtacctcctgataattctgtagccaatcttaaacattttatctgtaattgttttagaatgtatttctaaatgacaaggactcttaaaatataacctagccaggcactgtggctcatgcctataatcccagcaccttgcaaagctgaggtgttcaagaccagcctgggtaacatagcaagaccctgtctctacaaaaataaaaaaatactagccaggcatggtagctcatgcctgtagtcccagctacttgggaggctgaagcagcagggtcactcgagcctgggagtttgaggctgcagtgagctatgatagtgccactgtactccagtgtgggtggcacaacaagatgcattctctgacaaaaagatttgttaaataaaaagataacctgaatgcaattattataccaaaaaaaaaaaaattgtgaccagtttcttagtcacaagtttctctagtcagtgtttcaatctcaccaaatgtcttgtgctttattttctttttgtcttcttcttcttctgctgctgctgcta

SEQ ID NO: 40104 - DNA, 1028 bp, Homo sapiens
atatacagatatatacacagaacacttggaatttggtaatatctttccccttatttatcctcattttgcagttttgcttgtaactcagggagatattcaaaagaaggattttaactcagagaaaatgttcaacaactgagattatctgagaacagattttttattcttcctataaatgaaatctggccagttagtgtcattaacaagtataaatgttcccatagaagtagcttgtttgggctacagggaaacgtgaaatcaatatttgtcctttttaaccatcttatagctaaatcttagcttcctaaagtaagggtaggctatgtagtcttaattgcctgtgtttgtttcttagggggaagaaatttgtggcaatgaaagtagttaaaagtgctgaacattacactgaaacagcactagatgaaatccggttgctgaagtcagtgagtattagattatatgtatgaatgtgaagaattataaataaatcaagtttcattgaataaaaacacaccaagtggaggctctttagcatggataattttctctataaagttctagtaaccttaaagaggtaaaggaagacaacaatatttacacataccatgcatgtagtagggaactggtggcaaatgctatgatgagaattcttcttacacgcatgaaccaaaaaaaaacctttcaaatgaataaaaatattcactgagcatgttttacaggccaggtagctactgtcataatgtttttttttcctactatggttaaaaggaaagttgtgtaaataaatgtatagcatcttttttgttgtttttcaaatatgttatagaatacataatataaaaatactgtatttactgattccatttatacctggaaactgagataaattctatcaaaaatgtatttttagttctgttttaaattaggaatatgccagtgtggtagaaggaacttaaattcagaattagaaaacctgggtttaggtcgcctttaccccggtatgtcctccatgttaccatttttttctt

SEQ ID NO: 40105 - DNA, 1010 bp, Homo sapiens
caaattttttgtttccttagtagagatggggtttcaccatattggccagactggtttcgaactcctgacctcaggtgatccacccacctcggcctcccaaagtgctgggattacagatgtgagccaccatccatgcctggcctccatgttaagatttaagagatttcatagaaatgaaaaaagtttgtaatagaaaaagccagatgcaaatttgtttatgtagtatgtgattacagataaatatttttatgaagatacagcaacataatggaagaagagtcagtagtttatcagtgattatgtttggatattgagattcaagtaatttttctcctttgtactttttaatatttttcagattttatttattatgtactgaagtttttaaaaagtatttttctaacatgaggtaaaactacagctaatattttcctaggctgccacttggtaatactctgttcatattatctgaaagtttagttttttgtggggagggcagcatttgataatgtcttattttcttctgtccaaatggaatgggcatttttgtatcatttcttagatctgaaactcagcaccgaggctctgctccccactctgagagtgatctaccagagcaggaagaggagattctgggatctgatgatgatgagcaagaagatcctaatgattattgtaaaggtaagttcataaagaggtatgaagtgagacatgagccatctatttgcaatttctcgtttggatgtttgatctatcagcataaacacagttttattgctgtttacttgtatccttttctctaaaacataggaaatagtatttgttcttagtctgacttaatttatcaaagcctaattttatattaaatgtttttacctttttcctctttaaaaattataatacatatttaccttagaaaatttcagagctgtgttaaacagaaaagaaagtaaaagacttctgcaatgctatcagccacatataaccagtgataacattttggcatatag

SEQ ID NO: 40106 - DNA, 1107 bp, Homo sapiens
ttctctatagttgtgctcttggaacttcctttttggctcttctgtttttgatctgtaaaacagaatcctgtggatcctatgtcttctttctcagttttactgctttgttttcttgactttaagtaacttcttcagagaagatgaatgggagataagtttcaatgttggtccatatttgaaaaactttattctgctctcaaatgttgttgatacttagactaggttaaaaaaaaaatcctcagaatttagaagtcattgcctcattgtcttttagtgtattggctttctgatgagatagatgatgacagtctaattactgcccttctagctttttttacctagaagcctttagagtcttcttaacactgggatttaaaaatttccctaataaaaaattaagtagagcttccgttcaatctccagaaatttcttgaatttctttaataattttatctcttctattttcataagtttctctttctgcaactctattattcagatgtgggaacttctggtttgattgtgtttgtctcatctctttttgagcattattatcttgagtagagatattacgggataatgggcgattatgagataagtgggcatttttcccccctacatttagggaatggtcaagtttattttctagaacttctttctgactttactcatcttttagactagagcatcatagtctgtatggaaatcggcatcatttaacatttctctattcatattaactagtttttaagtttggtctttctcctgaatgcatatctctcttgtagggtcagttttccaattgcttatcttggtctctgtctttggggccgtgggctttcctcaaatgttcgatgatccttagtcaccttttatttttatggatgaggcattagagacctgattgatagccctacgtccctagcaaggctttttctttcttttctttttttttcttttatttgagacagagtctcgctctgtcgcccaggctggagcacagtggcatgatctcggctcattgcaacctctgtctcccggattcaagcaattctcacacctcagcctcccgagtagctgcgattacaggcgcatgccactgtgcct

SEQ ID NO: 40107 - DNA, 1039 bp, Homo sapiens
tctttactagaaagaagaatgcagtgggataaattaggtaattcatgctaatatttctaggtagaaggataatacagtacatgctcaatatgctgtttatcaaaaagagcttgtccttttgaattacacagtcccggatttcagcctgcctccaacaccattgttaggtgaacatggacagtttcttttgacttttcagttcaagttgccttatctgtagatggcaaggttataaggatgaaattgcattgagtgcctagcccagtactgaggtgaaataagtttttggatgactgctttctttctcatgcttcgttctttaccttagatgggtttatctttgtcttttatgtgacttttttttggatttttattttattattattttttattttttagaaacagggtctcactttgttacccaggctctggagtgcagtggcgtgatcatagcttacagctgcatcacactgctgggctcaagggatcctcctgcctctgctcccttagtagctgcgactacaggcacatgccaccaagactggctaatcttttttttcttttttttttttttttttttgtagagacggagtctcgccatctggcccaggctgggctcaagcattcctcccgccttggtctcccaaagtgctgggattacagacatggggccactgtgccaagcctatgtgacatttcttaatactattagtgtatcaaactaatagttttagctcatgtgttggtgtttcattttcatgtatatttatatatatgtgtgtgtatatatggtagagtttggagtatagtcacctgaggatcaaggttgaattatatttatttgtatgtaacacctgataaacttaggcactcagatttttatttttatattgttagaccctagttccagcttaagatttctgagttgagaaacttagactacttgtgagtatgtctcagaagttaagtttggataaaattagatatgtaaaggattatgtcaatttgcaaaagaaaaaaatctttcaggaaaaatata

SEQ ID NO: 40108 - DNA, 1014 bp, Homo sapiens
ctcaccttcaaccttaggcagccactaatctactttctgtgcctatggaatttcctgttctggacatttcatataaatggaatcataacatatgttatctttagtgactggcttcttttacttaatgtttttaatattcgtgcatggctcacatctgtaatctcagcactttgggaggccaaggccggtggatcgtttgaggccaggagtttgacaccagcctggccaacatggcctaaccctgtctctactaaaaatacaaaaatcagctgggcgtgatggtgcacgcctgtaatcccagctactcaggaggctgaggcatgagaatcacttgaacctgggaggtggaggttgcagtaagccgagatcatgccactgaactccagaccaggtgacagagtgagactctgtctcaaaaaaaaaataataaaattcgtgcatgttgtatcatgtgtggttatttttattgcttgtccactgttggctaattggagttttttttcatggtatctcctgagttcattttactcaacctgagatgtctttgattgctttttttaatctggtgtgacagtatgtctaaggcttatcttgtacattttctgcccccggctaggaaatagctgtctctccaagaagccttttagtgggaaatggtatttggagaccataatctgagcgcttaaggagcttattactagtgagtgagttagtcattgtttctatgctttttctgtgactagagcttaggaaataagttgtgttttttcatttaaaaaaatcatgagttcatgttatacttaaacatggaatcataggacccaaggatttttgtttgattttatatttcactcttctttctcccacgctgaaaatcccagttctcaacagcatcatgattgctcattttctttttcctacaatatatacacaacagtcttagaattacaattccagcactaccccaacaatatgattactaaagaagatcacaatttttgttattgttcttag

SEQ ID NO: 40109 - DNA, 1026 bp, Homo sapiens
tattttttgagacggagttttgttctcattgcccaggctggagtgcaatggtgcaatctcggctcactgcaacccccgcctcccgggttcaagtgattctcctgcctcagcctcccaagtagctgggattacagacatgtgccaccacactcagctaattttgtgtttttagtagaaatggagtttcactatgttggtcaggctggtcttgaactcctgatctcaggtgatccacccacctcagcctctcaaagtgctgggattacaggtgtgagccatcgcgcccagcctcactccatcttattttaaagcaaatcccaggcatcatattattttataaattatagactcttaatttttttaaagcatagctacggtagtataattgccctaaatttttttaaacaagtctttaatgtcaagtattcaatctgtgttcaaattttcctaattttctttggatcaggatccacaaagtctttccattgcctttgtttgaaaagtttctagtcttttactctgtaagttctctgtggttcttttccttgcagatttgtttttggcaaactacctatgggtggtggtgtaaactttcatcaggaaacatcaattctggttgtctctctttttgtggtgttagtggctattgatccttgcttagatccattaatttatttagggtttcaaaaatggtaatattctatttcttaatttattaattgtaatacttctataaagagaaactttatctcataactttggttacccagagagagagttgacagatccctagcatgctccaaaatgaccaataaacatttgataataactcacaaatttgaacgtatttgtggtttagtccattagagtgggtttttttttcctacagttttatggaggtataattaaaactcattttaactgtgcaattcagtggtttttagtatgttcatagagttgcacaaacatcactgcagtgtaaatttaggttgttttcatcaactccaaaagaaacctggacctatt

SEQ ID NO: 40110 - DNA, 1053 bp, Homo sapiens
gctgtcgccaagatctctgacatgccctgacgacattttctctattgtcttggtgattagcagccagcttgaatttctccccagaaaatgtttttttcttttctatcccattgtcaggctacacatttcccaaacttttattctttgtttcacttttaaacataagtcccaatttcaaatgatttctttctgaatgcataaaactgaatgctttcagaataacccaggtcatgtcttgaatgctttgctgcttagaaatttcttctgccaaataccctaaatgatctctgtcaagttcaaacttccacagatctctagggcaggggcagaatgctgccagtctctgctaaagcatagcatgagtgacctttactttagtcccaataagttctttgtctccgtctgagaccacttcagcctggacttcattgttcacctcactatcagcattttggtcaaaatagtgcaagtctctaggaagctccaaactttgctacatcttactgttttcttctgagccctcctccaaactgttccaacctctgcccactacccagttccaaagttgcttccacattttcaagtatctttatagcagtaccccactctctgtggtaccaatttactgtattagtccatttcacactgctataaagaatactacctgagaccgggtatataaaggaaagaagtttgattcacagttccacaggcttaacaggaagcataacgagggctcaggaaacttacaatcatggtggaaggtgaaggggaagcaggcaccttcttcacaaggtggcaggagggaatgtctgcgagaacgaggaagtgccacactttaaaaccatcagctctcgtgagaactcacaaactatcagaacagcgtgggtgaaccacccccatgacccagtgacctcccacctcatccctctgctgatgtggggattacaatttgacatgagatttgtgtagagacacagagccaaactatatcaaggctgttcctctttcttgttattcatgtgttcactccatcttacttattttttattt

SEQ ID NO: 40111 - DNA, 1057 bp, Homo sapiens
gtgctactgttttataaattaagattatgttatattctaagtcccttgttgtcatttcaacaatgttcacagcatctttaccaatagtagattccatctcaagaaaccgctttctgctgggtgtggtggcatgcacctgtggtcctagctacttcggaggccgagatgggaggattgcttgggcccaggagttcaaggccagcctgggcaacatagtgagaccttagctcttaaaaacaaaaaagaaagaaacttattttttaaaaaaattaattaataaactaatcagttattttgagacagggtctcaccatgttgcccatgctggtcttgaactcctgggctcaagccatcctcccaccttggcctcccaaagtgctgggattacaggcgtgagccaccacgcccggccaagtaaccactttctcatcataagaagcagctcctcatctgttcaagttttattatgagattggagcaatttagtcacatcttcaggatccatgtctaattctagtcctcttgctgtttctaccacatctgtagttacttcctccacagaagtcttgaacatttcagtcatgcatgagggttggaatcaacttcttccaaactcctgttaatgttgatatttttacctctccccatgactgttcttaatggcatatagaatcgtgaatcctttccagaaggttttcaatagatttttcccagacccatcagaggaatcactatggtagctattgccttatcaaatgtatttcttaaataataagacttgaaagttgaaatgactccttgatccatgggctgcagaatacatgttatgtcagtaggcatggaaacaacattaatctctttgtacattcccatcagagctcttgggtgactaggtacattgcaaatgagcagtaatattttcaaaggaatctatttttctgagcagaaggtctcaatagtggccttaaaatattcagtaaactatgcagtaaacagatgttctgtcatctaggctttgttgttccatttatagagcacaggcagagtagatttagca

SEQ ID NO: 40112 - DNA, 1038 bp, Homo sapiens
tccacctgccttggcctctcatagtgctggtattacaggtgtgagctaccgtgcctgacctatatgtctgtttttgaagttgtttctatggaacataattccagaatggatttcatacttactgattttattacttaccttaggaagctggtttggacagtaattttcactttatttgcagttaaataattatggatttagtatacatttggtagtaaaattaattcagctctaacactgatttgtggagtcatttgggagatatattgaaaatttacttgaatttggccacaaattaaaaaaaaaatttacaagagaaaatacttaaatatctaacatttttattcagtaggaagtagagccagtaaatttgaaacaatttaaaaaatgaaatagtatttgatgctttttacacttagcagtgcaccttggaaattggttctatattccatatagtgcagccttactattttttttagggtctgcctttttcactgagtcttagaaatagttccatgtcaggacagaaagagaacctcatctagcattccattaagttgatatgccataatttaattaattaattaattaatttatttatttatttatttgaggcagagtcttcgctcttgtcatccagtctggagtgcagtggtgagatctcagctcactgcaacctcagcctcctgggttcaagcgattctcctgtctcagtttctcgagtagctgggattacaggcacataccactgtgtccagccaaccataatttattttaatttttattaataaacgtgtgtgtgtgtgtgtgtgtgtgtgtgtgtgtgtgtgtgtgtgtgtatatatttttttttttttttgtttttgagacagagtctcgttctgtcgcccaggctggagttcagtggtgcaatctcggctctctgcaacctccgcctcctgggttcaagtgattctcctgcctcagcctccagagtagctgggactacaggtgtgtgccaccacgccccactaattttttgtatttttagtagagacg

SEQ ID NO: 40113 - DNA, 2552 bp, Homo sapiens
aaaggatcttggaaatcagctcttacacactttgtattcagagagagcttgtatgcctagttattaatacatcttaattttagatgtattatctttatagttttacatttatttgatgttttgtggcatcgtatgcggtctaattccctctgagctgatacaacacatttcaaaggccttcctaggtcaccccactgaatgacaataccagattaggggggtgtaggggtgtgtgttgtttttggaggctacctactgtttggggagagcacataatgacttctctctttcaatagaactaaagtggtaggtgacctcacctcttgctccattttctcttctgtcttatgaaatgtattttgtaagtgcttggtgacgaagtcttgtaaatgagagtttgtgtgtgtctgtttacctttggattatccatatatgggattattcaaaaccagtttttaatcctagatcgtttaatagaaacagcaaggtgctaacttggttctagtgtgcagtaggacttgaaatgttacttttctgtgcctagtttagttattctttgtggaattgatgagaatgtgttaaaacgttcttttctattgatacaaggaagttgcagtttttattatattactctgtattttttagaaatcctggtctctcagactatttgtccagatctctcttaccacttagaaattaatttgagattagcccaaatcaagctgtaatttgaggggtaaatgtatatagatgatatactttaagcaccagaaatctgttactttcgattatctatttagaccatatgctttatttctaaagtcagatgtgtatctgttaccccattcactactatggataacttagagttatttgtgttaattgtttgcaagtatggattatagataatctagcagtcattttactgaatatttcatcttgaacaactttgaatcctgaaaatatgcgtgaatgaactgcccccatttccttgtaacttcagaggtgttttatttttggatttgtttccaattaataagttttttttgtttgtttgtttttgaatttacctaccttttttttctttttctttttgaggcaaaaagaaagcctgttgcccaggctgcagtgcaatggtgcgatctcggctcactgcaacctccacctaccagattcaagcaattctcttgcctcagccccccaagtagctgggactacaggcgtgtgccactacgcctggttaatttttgtattttttgtagagagagagtttcgccatgttgcccaggctggtctcgaactcctgagctcaggtaatccgcctgcctcagcctcccaaagtgctgggattacaggcatgagccactgcaccttgctctttttctttcttcctttttgtctttctttctgtctttcttttcttttgtttgtatcccagcctccttttaagtagctgaaatgtctaattaagttggttagagtactgtgttagaagttcaagcctcaactaaggtaacttgactctgttccatgacttctgactgcactcctgatgacttccatttactttgctaaggcaagctgctagttacaggaggtgagtcaggaagaagatttgaggaagaagcatgccatagagtttggtctttggagatagatgtggttttgaattctgattttgctactttttagcaatctgaccttagacaagttagttaaggaaacagtcttatgtatatatcctgactggcagttcagtcatagtgaaaactgatcaggacctaaagatataaaaacaaagcgtttaaatgaaaattttagaaagttttggaactgttacagtaaatagcatccttagtaatttagtcgtgttgtgtcacaggcagaagggattttcagtcccctggtactgcagatcttaaacccagggtcttgaagctggtgacagaagaaccaaaacttggaattcagggtccctttccagctctgtgtttgttagagtggatttcctttgggttcttttcactgtgctggagtatttgactttgggattttaaattttcttatttagacaattcttcattttacttttgtggacgctgtgcttttatttactaacattaactagttggtgatgatctccattttactttacagataagagaattgaggtttgtcagattactcccctagaaaattgcaaagctgggatttgaacccaggtctgacatacccaaagccctggctaccaatcatgtgtttctaagtgacagtgcttttggtgtgtcttacaacaggtaaggtagaagctgagttgaaagaggcttctgaatgagagacctctggatgcttgggggtttgggtgccctttcatgacatactgtcctgtgtctatgaaacagcacaatcatctatctccctctgaacatttgttttcagtgtttataccaatagctgtgagcctttatttgtttgtcataagcttttataatttaacagtgtgtgtctgtttttgttttgttttgttttgttttttgagacagagtctcact

SEQ ID NO: 40114 - DNA, 1020 bp, Homo sapiens
acagtgaggatctgcccgatgaactctggggtcttgcaagtgtacagtcctggagaaccaggcccagtcccaactcaacccccagagacctcactcagccactcggtgagaaaagggagatggccgctgggtggccccggggagggcgctgggccttgaggtccgcggtcaaggtggcgctggcgaggggccagcccagggcgggctgggcggaaaggggagagcctggcgcccgccccccgccccccagcggcccaggggtctcaccacacggagccataggccccgctgccgacgtgcgtcggggacacgtaggtcttgggcagctcccaggctgtcttgttgacgtcctgcttgtagaagccctttttccggatgaggctcatcccgggcacccgatctcggcggccccagcgtggcggctgcgttcgcggcccaacgggctcccagcgccccgacccccgctgcgcccgccccgcgccgcccgctcctcccccgcgcgagggcgggggccccgggctgctacgctcccacctgccggctcgcccaggtgcgccggggccgccacgcccgggcctgtccagccctgcgctcccgcgcttccgcccggcccgacggagccactgcggcaggtgcggcccaggcacggggtcggggctgcccagcgggaccccggtgcctcccagccgagcgcgggccagcggcggggctggtgggtccaagcaggagcggggaggcagtgcttcccagttccctccagccccggtctccgtaggaagagctccctgtgactgtgaacacacaggaaagcagaacaaaaccccacaacctcttcattatggaaaatgtcaaacatgcaggaaagaattgaacagagtaagccagcgcttctcacacttcagtgtgctcaggaatcccctgggcattttatttgattaaaatacagatcctgactcagtaggtttggggtggagccgagattctgcatttctagccagctcccaggtctgaggcttctga

SEQ ID NO: 40115 - DNA, 1057 bp, Homo sapiens
tagctgggaccacaagcatgcaccactacacgtggctaatgttattttttgtagaaatggaagtctcactgtgttgcccaggctaggcttctgtatactttaagtcatttctagatcacttataatacctaatacaatatataaatgttatgtaaatagatgttatactgtatttttaaattttgtatttttttaattgttctattgttattttttattgtttattgttttgtttattgttgtttattttgtttattgtgttgtttattgttttattgttgtttattgtttattgtttttattgttgtttggaatatttttgatcccagttggttgaatccatggatgtggaacccatagatatggcgggccaactatatttattatttagatcaagatatatttcaatatataaatttaaaaatcttttctgaaataaaagaagattgactcttcttttcaagtcaaagaacataccatgtgccaggcaaaattgattcaaacgtatcttcgtaaaactattggacaagggatcttctcttgctacctgaataaatagtgtgaaaaatatggttgttgaagagacaaagtaatagtatctgtcaattcattttgataaacttcagttttgtaagagattatatatattttgtatatattttgcattatttgtatatatgcatattttatattatatattttatatatgtgtgtgtgtttatatgtatgtgtgtatatatatatttgactctttatatccatgggttcatctaattacctctgcttctatttaacattgtactgggctgttttgtagtgatgttcagggaatacaatcaggacagtgcagttctgctctgtagaggagtttcatgggtggatgttgaagagcctcaagtcaccttcccaaccctcctaccaatatagcttctccctgactggttgagatgaagacttaacctgaagattggtttgatgttactggttttctggtgcccaggttatatggtttggctgtgtccccacccaaatctcatcttgaattgtagttatcata

SEQ ID NO: 40116 - DNA, 1135 bp, Homo sapiens
acagcctgtacatgcatgtggtcacctgtacatgcatgtggtcatctacatttccgggaaatctgattaagctttccaaacacacttataaacttcttaatccagctgggcaaggtggctcatgcttgtaatctcagcactttgggaagccgaggtgggcggataatttgaggccaggagttcgagaccagcctggtcaacatggtgaaaccccatctctactaaaaatacagtaattagccgggcatggtgctacatgcctgtaatcatagctactcaggaggctgaggcaggagaatcacttgaacccaggaggcagaggtttgcagtgagccagggtcgtgccactgcactccagcctgggcaacagagcaagactccatgtcaaaaaaaaaatcttattcctcagtttttccttataatctttttttcccccaaatgttatcacctcaggcacctgagatgttaaacaattgccactaattgttttccataaatactccaaagaaaaggctgttcacagtaaatgaaccctgagtcagttccaataaagaccaaccctgagagcccctgtggtttccaggaaactgccagacaagtcaaagaataactaatggaagatgagcatttaggggaactccaagcccattctgcctgcttcagtgactgctaggttgctggttttcagggttaccatgattgaaggttgttggtttccaaggctactatggaactacagaaagagggatggcaataggacaagttaaaatgccaccagtcttgctcttcttatgagatttagccatgtgtgtgtgtgtgtgtgtgtgtgtgtgtgtgtgaaaatgctcctcagacttttgtgagcctttggttaattttcagagttctaaaaatgttgattttaacaattttttgccagtgctctcattgcttttctgaagaaatcaatttttggcgatttttactccaccattctgaatgcagttccaatcatattgacattaatacagtcaagatacagaacaattccatcaccacaaggatctcttgtgttgttcttttacagccacgtgcatttccttcctattactgtcttaggccctggcaaccactaatctgttctctatttctataa

SEQ ID NO: 40117 - DNA, 1112 bp, Homo sapiens
accagtccctgtcccatgctttcccagccccagtcacctacatgttcatttccttcctggtcagattagtaggtcttgtccctagaagggactaatctgagaagtaacaagaattctatcccttctaatggaaagaggagagaagcctcttaccagttcaggaacctgttgttgctggcaacaataccatagaagaaaagtcctgccaaagcatggctaccctagtcctcttaattctattgcttagagggcatactatatgagaaacagttaaggaaatgtggaatgtttagcctaaagaaaaaacagagatgctgcctaaaatatgtgaaaggttgtcacatggaaatgggaaaaatagtcaaagtagcttcagaggctattaactggaaggcaggcaggagagggaggccgttatctattaaatatgtatggcagaatgttctaatggtaaaacagtttgatgggttgttctgggaaatgcacctaacagacaagggaaagaccgagtaggaggagatttaatagataatctcaaaaatgtcttccaaggctggacactgtcgctcacacctgtaatcctagcactttgggaggccaaggcaggaggatcgcttgagtccaggagttcaaaaccagcctgggccagagggagacctcatctcttagaaaaaaggttaaaaaaaaatagtggagcatagtggtgcatgcctgtggtctctgctacttggaaggctgaggcaggaggaccacttgagcccaggaaggtaaggctgcagtgagccatgattgtgtcactgtactccagtgtaagcagaagagtgagaccctgtctcttaaaaaaaaaagtcctccaactttaaattcaacttaagtcagacacagtgaagctttgatgggttctgtgggcagaaatgaggcaacaagagtagcaaagcacaagagtcaaacaaagatccacatagggggccaggcgccgtggctcacatctgtaatcccagcacttagggaggccgaggcggcggatcacgaggtcaggagattgagaccatcctggctaacaaagtgaaacaccgtctctactaaaaatacaagaaattagccgggcatgg

SEQ ID NO: 40118 - DNA, 1054 bp, Homo sapiens
gcagttctcctgcctcagcctcccaagtagctgggactacaggcacttgccaccacaccgggctaatttttttgtatttttagtagagacggggtttcaccatgttggccaggctggtctcgaactcctgaccttaggtgatttgccggcctcggcctcccaaagtgctgggattacaggcgtgagccaccacgcctggccaaaaacccttgctttttaacttcgattgacacttaacaaaaatcctccacatcccactttttgacagtttacattaaagcctgtggtctgaatatttgttttacttagagggggaccctttgggcaacttatttgcaaacacatctaaccttcctgggcttattccacagtattttcatagacctgtatatattagacatcacactgttctcttgggatttaaagtagtactgggtactgcatattgtgcagtaaatctggcttgctttcttaacctttttgctgccattctttcaaatatttttccagggcttaggggaaaccattaaatgatctgacttaacactgtcgtcttgccctccctccaactcctcagtggcaaatgtttcctcatcaaaacagcatgatatgatgcagatgcaaactcaagattctaaacttcagattcgggttaatcttggcttgccgatttctctggctaaaatatcaacagcctggcttgcttatttaggcacttagaagaaaacaccaaacccaagtttcacatttttaaaattacaaatgcctcttacccatctggccaggaaccaactctgaagggggtgacctcaacccagcccttgtttctgtgaggtcctgcttttgcagaatggcctgcccctgggactggagcaggcttgggtgagctctaggtggagggtggtgggaggggcatagaaataaaccttcctctccatcagaaggaacctgtgatcccagcttttccttcagtcaccaccacctcgtgacactagaaagcctaccgtcacagatttccagcttactcaaaccccacaggttggggtcaaatgca

SEQ ID NO: 40119 - DNA, 1035 bp, Homo sapiens
agttctgcggtctcaggcaaagccattttgagcatcaaattgtatctgcaaagttaagctaataaggtcctccttggaaaagttttgtcaggattaaatggactcatgtatatgaagttatatatatatataaaactcatgtaatatatatattaagtacagagcctagtacttaatgggtgctcagtaaattgtaataccagttattatgacacagatgccttcgccctagtgactcatagttaagggtctcctgcctcatgaacaaagctttattgttcattttggaaagtgctttgggaaatcgagcttgccattaagctactgggcagtcctgcttatttagcttgggggtagcttctgatgttactcatagcctttggtttctagaacagaactctgggcacctcctgcctggctgggcctcgctgatgtgtggtccatgtttcaggccttctccacagtaggcactcctgactacattgctcctgaggtgttcatgcagaccgggtacaacaagctctgtgattggtggtcgcttggggtgatcatgtatgagatgctcatcggtaagttgcatggtttcagaggactttttctgtgcatccatgacagacttttacattgataccagcctctgtttcaattggcagtgatctaagtgatttccctacttgtctttcaaagtgaattgttttagacagatgacacctctttcagtaagatgtatcccactccattcttgggcttactggcatcctgcaattgctttgctgatcattttttatgtttttctttctcttataccttcatcttctccatctagaagctcttttagtcactagcatttattaaatatccgttgtatgcagagcacttcaactgggcattgcctcactttcctaatttgccgcccccttcctctgtcaaagccttcaaatcatgggaccctctggcctctctccctcttattgtattggtgtgtctctgtatttatgggacgcatctgtgggggtggtcatatgccagtgagca

SEQ ID NO: 40120 - DNA, 1097 bp, Homo sapiens
tactgtatcctctgccacttgatccacatgggagtgccttttacaactctgtgtgagtcttttaagttaatgctttacagcctctgatttgggtttactgtaaacgtactaggatatgtatcatctggagcttttgatgtatgagtagaagaaaagcaagactttagggtctcatgtgacttgaaagagcctactaaaaaaagtagtaaacattttggtctgaactttgactgcagcttgtattctttactttcagctttccagaacatgaattccaaaaggaaagcagaaacctggaaaagaaatagacgtcagctagtaagtaatatctgtggcttctgaaatgctacaaaccaagtatgaataagttcaaaagattttcacataaatttgcatttgacaaatatttgcaacatatcccttgcttttaagattacctaaagagagtgctgttgttaggttggtaggaccgaaaggaatcttttgaaggaggacaggtaatattaggttgttttgattgtgacattttccgtgggcgacctcattctgaccttttagcttggtaacaatacctttccttcctgccccaccttttctccattttcatagtggtaaaggggttatatttaagctggagatctgtcagaactaagtacaaatacctacttagagttttcaggcatcaattctcaaactttttaaaaattttgatccactcgggcaagggcaagtcaagactcctcaattcatttgcctcacactttctgactttgtgatgtaaaaaagaacttacttataaagattggagagaaatataaagggaatgcttattactttatatgcatttgactttgtgcctatataaaattatgtcctacaggctgaaaaataagaaacatcgtgtttaccttgatagtatgttggaagtacaaatttaccagtgaaatattgctgtctaagcagaatttattttttgccaatagctgataaattggttcatgtttgaagttcagtgtacatgttccagtgtccagttactggaaagttattggccagataatagaaatgcgtatcactacattcttaagctttgcaag

SEQ ID NO: 40121 - DNA, 1095 bp, Homo sapiens
tgggcctaagtgatcctcctgcctcggccttccaaaatgttgggattacaggcatgagccatcatgcctggctgccttctcatttttgaatatggttttggagaatactgaggccagatttactccttcctttacatcagggttaattttttgatttctatttctgaatattttctctgttatacttactggattttctatttcaggaaatatagttatttgtttcatcacctttgccttccatatctatcatatttcttttgattgtgtgataggatttttttttcttttttccctgcattcactaaaataatctcagacctttactctgtgccttactcaattttcagtcatttttattctgttctttactgctctaatttatctactagctcattactgatgccatttgaatctaaatttgtttccttcactctgcaatcttttcatcttattctgtggtgtattatcttgtctttgagcttttgttatattatatttttacttctcttgaatcatccatagcttgagatagccatggagaagccactttctcccaggctgagttcctgggttttcttttcctttctcccctcctcctttctgtccttctgttggttgtggtatgtttgcctagtttccatgccatttgttttcatcttatccatgcttgatgtcaacacctacattatccccaccttttacttgctcagatacagtgtaagtggagtctccttgtcattctccccacttatgtggaactggttgtcttccccacttcaaatgttaggttgctttctctctattctattctagcctgaagaggtgtgggagagaactggagctcagctcatgctgagcgagccccttgtgggagggctagcctctgttctatcttcccagactcccttaaagtcttgtcccagagccccctccaccagccagtggtgtccctctgtcaccactccaggctctgggtagtccccaagtatggcccagcaccctggaaggtggccagccctgcgtgcctgccctgccactcccgagcccctgtgatatgtgtgggcttctgccctcaagggctttgttttcaga

SEQ ID NO: 40122 - DNA, 1070 bp, Homo sapiens
ccaggtacctgaggggttgactggttctgcctgaaccaagataagaggtagggagcagcgatggctgggaattgcagtgtccagacattctcacagtggggatcaccttcaagaaggatggcattccttcttgaagtggctttccctcccaggaggctaggagggcctggggacgtgtctgccagaatcacctgggtgggaagggggtcatgttcagcatgtgtgtgtgtgtggtacatgtctgttctgtgtggtgaggagtgccccatcccagatgggagcctctgcttgcagggagactggccacttgacctgggcaggtgagtcttcactggcctttcgatgtaagcaaattaaagtggctccatagagacccaccccatctgcaatcacagtggtacattcctgcagttctgccccttctcggggggccttgtgggtgggtaagctgctgctgtcacatacagagcaagggtggccaggagtgcaccgctaagtggtttctcatctaggtgggcagctgtctgaccagaggctgccgtgcttacatcagcaacaacagcagtcaacagatttgtctaaagtgtttttcgagtgcttttctgtatgtggcttaaaggccgaggtgaggctgccgggctgtcaaagccactcaagcagacatctgagcaaatctctgaccaagaacccaggccatcgatctggtgggatggccgctccacaggaagctgagggtgggggagtcacctttcctcactaggagctgtttgcttcagcaaagcaggatttgaggagttggggtctgaagggggaaaagcttgctgaggtggaggtggcgataagcctggacttgccctcacctcaccccacaggccaggattcgtctttgggtttcagggtgcatgtctgtcttagcactgactgcgtgccaagccctggatgttgatcaggcagacacgggctcagcccttgaggctcacagtccggtgggttgcacaggcagcggcagctgatccctcttaccgggtctccttctcgggactcccttcagtccacttaccccgtttctg

SEQ ID NO: 40123 - DNA, 1043 bp, Homo sapiens
actttgggagaatgaggcaggaggattgcctgagttcaggagttcgagaccagcctgggcaacaaggcgaaacctcatctctacaaaaactacaaaatgggcctggcgcggtggctcacgcctgtaatcccagcactttgggaggccgaagtgggcagatcacctacatcgggagtttgagaccagcctgaccaacatggagaaaccccatctctactaaaagtacaaaattggccgggcatggtgatgcatgcctgtaatcccagatactcgggaggctgaggcaggagaatcacttgaacctgggaggcagaggttgcagtgagctgcgattatgccattgcactccagcctgggcaacaagagcaaaactccatctcaaacaaaaaacaaaaatcaaaaatcaaaacttagccgggtgtgatagcatgcatcctgaccctggagttcgaggctacagtgagccaagattgtgccactgcactccagcctgagtgtcacagtgagaccctgcctcaaaaaaaaaaaaaaaaaaaaaaaaaaaaaaatatatatatatatatatatatatatatatatcttacaaaaggttccctgatttccttccttgtcatttcttgctcttcccccacccctcactttgtgataatgctacatcaaatttggacgggccaggcacagtggctgatggggcacagtggctcatacccataatcccagcactttgggaggccgaggcaggcagatcacttgaggtcagcagttcgagatcagcctggccaatatggcaaaaccccatctctactaaaaatacaaaaattagctgggcatagtggtgcacgcctgtaattccaactactttggaggctgaggcatgagagttgcttgaacccagtaggcagaggttgcagtgagccaagatcacgccactgcactacagcctgggtgaaaaacaaaacaatgataataataatttgtacatctctttttacttttcttttcttttctttttttttttgagacggagttttgctcttgttgcc

SEQ ID NO: 40124 - DNA, 1077 bp, Homo sapiens
tttctggggtgaggcttgacttggagaaaggcagaagagacgtcccgcttctgtgatttggtgcccccatatcagacaatgaatttggaagtggagaggggccttcatttcttatctacttggcatgaaagggtgccctggataggagggtgtgtacagggcaaaatgccaaaaagcactgtctagttgaaagttcccttctccacccaggggcagtgaaggaggaggggcttatagagctgggattggtggagggagcaggtgccagtcccctcactctctgggagctgtgaaagggatccctgtccttgggtcctgggttaggcacctgagattgacatgatgggatctagatctttcctccttgacatcacctgagcccccacctagccatccatgggagagagaaggcccagccccttctagaatgactctttaggcatgcgtgcatatgtgtgtatgtgtttgtgcccgtctgtgtctaggtaccaccgtgggtacattgttgggcaggagtgtgtgcaaacacaggtctgtgtgtgcaatctcacatatctgcctgtgagactggattgagacccattcgtttctatgaatgtccgtgtacgtcagcgtgtgtgtccaccttcctgagtgatgtgttcgcttgtagggtgctggctgaatagactctgtccagccctgttctgtagtctcaagctgcctgcgatggcctgaaattccacctttcatcccctatggatgacggagagcttacagatgaccctattgaatgcaagcacctttggtgaggagcatcacagggctccttctggagcatttggtggggacagctgcagagaagaggcctggaactcgggcagcactgcagtgccaggaggcaggcggggaaccgaggcaaaggctgcccatctccccctgccaggcctgtgtgatcattatcaccaacagctggtgggtggccgggccaggatgcagcggggccttctgatgcccaatcagcacggctgccttcctgacccagtcaaggcctctgtctgaaatgagtcgctccaggttctcagcatacacttccat

SEQ ID NO: 40125 - DNA, 1040 bp, Homo sapiens
aaaggcctggaagctaaggaacccgagtgtgtgaggagttcgtgagctgttcagttgggctggagcataagctgaaagggaactggggccgttagggctggaacagtaaaggatttttttttttttttttgaggtggagtctcggttacccaggctggagtgcagtggcacaatcttggctcaccgcaacctttgcctcctaggttcaagcaattctcctgcctcagcctcccgagtaactaggactacaggcacactccaccacacccagctaatttttatatttttagtagagacggggtttcaccatgttagccaggatggtctcaatctcctgaccttgtgatctgcctgcctcagcctcccaaagtgctgggattacaggcgtgagccactgtgcctggccaggaataatattaaacattgctaacattgactgtccagcctgtgatcataagtatgcattatcttcagtctcatcacaactccttgagaaagtcatttatcagtcccttgtccaagtggcagacctggacttgaacccagaactgctcattgcaaagctgtaaggaggatgtcaaacagggagctgggttgatgcaagccatattatgggccaggtagccatgccgctgtgtgtgggaggaggccgtgctggagagactgtcaggaggctttgcagttgtccaggggagtcctagggagctttgtgggcatctgcaggaggtgtgttccaggcagaggaatagccgctgcaaaggccctggcctgttggagcaacagtgaggagtccaatgtggctggagcagaatgagccagggggagtgcagtagaaggtggggccagagagttagtaggtccaatcatttggagccttgaaggctatgaaaggattctggattttgttctgcatgagataggggaccatggcagggttttgagcagagaagggacatgaactgacacctttttaatagaacctctctggctgtcatgtagagaatagatggtaggggtttgagggtggaggaaggaaacca

SEQ ID NO: 40126 - DNA, 1060 bp, Homo sapiens
gaatgggcctccatagagtgttcattctgctggaatacattgccctggcaactaaatgattttttatttgttttagttattctccactcagtgaatcataggtgttccggatctatttgaaatgctcaaacagcaaatcactagttttaatcccttttgatgctataattttccttccttggttttgaacggttcagcttgcggggacagagacccatcgtgcatgtctcctaaatgagacacggatgcagctcatcctggcacttgggccacagaggaagtgccacaaatgcacacaagcaaatcaacctgtggacactggagttaatagtcactcgtgtggctgagttactcacctgtcattcctgacatggatccagcctttaagcttgggaggctgacaaggaaatagttactatgcccgctgctaattcactgttccgaagtccatgtagataaacatataccgagttctggcgtggccaaacctgccggggactgccgtggcttagctgcccctccagttgtgtttatcgaagcattggagaggcagccacctgcccatcagcgtcaggaacgcagaactgggactccgtgcttcccccacaccacagtactcaactggggactgaaaaatagcagttccaagaagcttttctcctaatcctcatcaaaaggacctcatttgacgatggtggcttgatgtggctccgtctcctacttagtgatttccattccagtgctgcctgccctgggtaactgcgcacaacattgcctgcccctccgctgtccccagagctccggcctctgtcgccatcagcatcagcctgggagtctccccaggacggcatggcacgtgagcagcactgcagtccttgggtcttcggcgccaacctgcaaccctgatcaaaggagggtgagggcgtgggagtttcctttcaggtgtgtcaaagacatatcagctgcgctctagaaagagccaacgggtcagccgcttcctcctagtttaacttgattttgagtgatttgtccatatggaaatagtagggtagcatcaaac

SEQ ID NO: 40127 - DNA, 1019 bp, Homo sapiens
tgagcatttaggtggctctcttgctgttcaaatgatgctgcagtgcaatccctattcttcttccctatgctgcaaacacatcataaattaaagtagtataagggaattgctggctctaggggtatgtgcatttaacattttgctagttgagggtatgtcaacttgtacttcctctggcaatatgtcagagtgcctgtgtcaccctaccttgtccaatataacacatggtcagacttttagattttgaggcaaacatattcatctcttttagacttcttttttttttggtctgtatcttcatattctaaactatgtgcttattctgctatttcctaattacattactggaattatctattgtgttcctactttgaaagataaggatttagtttcattgccctctgcccttgcaagtacacacatgcacctgtctgcttcatcctcctgtttagttaaatcacagtttttctttgtatcagatttcttgttggcattaggatgactatgtaactatcgttcagagccaagccatgtagtgtactatgatcacctttttttttttatcatttgttttccctagagttaaaaagtggccaggtgcagtgtctcatgcctgtaatcccagcactttgggaggctgaggcaggtggatcacgtgaggtcaggagttcaagaccagcctggccaagatggtgaaaccccatctctactaaaaatacaaaaattagctgggcatggtggcaggtgcctgtaatcccagctacttgggaggctgaggcagagaattgcttgaacccgggaggtgggttcaagcctcccaagctgggaggcgaggttgcagtgagccaaaatcatgccactgtactctagcctggcaacagagcaagactccatctccaaaaaaaaaaaattgcttagttttctgtatacctatccttcattaattttctgtgtactatcactgattcttcccccacaacacaatttgtgttgtcagagcaacacaaattcttgtaacc

SEQ ID NO: 40128 - DNA, 1049 bp, Homo sapiens
actcagctacagagagcaaagcaattagtgaaggcatacgagatgagggcttaagtacaagcatgtccaactttggaaaataaatgagttgcatagaagatatatgtaaaattacttttttcttttccaatctattttaatttatctgatgtaagctacaaaccttgaatgtaagtaggttttggttaaataacttaaatgtctgaagaaaattaaaggtttttgttttaaacgtgcagaaaaggtcccaggggacttaaaaggccctcaccttttattctcttctcagtgtttagagaacttacatcatagtgagcatccatcattttgtggaagttcttgacttttataaatgagcaggttgatatagacttgagttatatagagagagactcaaaatcagaacagctgggtttttaagatgcagcagttcatgaacaatgggaagagcatatatgttgcaatgcacagaatagtagacaaaaaaaagaaattaatcatggctgagggcaactgtatattctgaaatgggtttggtaccaggtctcagatcactttcctattatgtgagtttcaaaattctgaatttaacatgtttctttaaacagactttcagaataatagatattattcagaataatagaaaatatctgcagcttagagactactaataaaacaaatacctatgtacctaccagctagcttaagatatagaacaagagcagtatttattagacataaaatcaattaaaaaaaattttttttgagagggagtctcaccgtgttattaaggctggaggacagtggcatgacctcggctcactgcaaccattgcttcccaggcccaagcaatcctcccacctcagtaggccgagtcgctgggaccacagatgtgtgctaccacgcctggctaattttttgtattttgggtagaaatggggtttcaccacattatcctggctggtcttgaactcctgagctcaagctatctgccctcctcagcctcccaaagtgctggggttacaggtgtgagccaccgtgcctggctg

SEQ ID NO: 40129 - DNA, 1067 bp, Homo sapiens
aaagccagattgcaataatattatccttctagagaggaatttttatctctttggtgattatgtttgagcaactctgccatcatatcatggttatttaattctgttgtatttacaagcagttctccagcctgctgacagttgtcacttagaaaccttactggtggttttcctttcttctgctatactcatcaaatcctgctgccactgtacatcgtaatgttatcccaccagtatatggctaccttataaaaaggatttttgaagaaagaaacactgtctaattgagatttatatgtaccaagccttaagcatcacgtttcatactctataccactgggaaaattatttgttctttgggagtaatttatattcttctaagaaataatttcacataaatattatttgctgtggtgaatcttagcaatcttttaaaattattcttcagttcttacaatgattaccatttgtttacccacattgattcattcatttagtaaacattttagtgcattccgtgtactgtactggacactgtatgggtactttgaaaaggaaaatgaacaaggaatggtctctgctttcagaaagatcaggtccagtagaagaagctgaaaagtagacacttaactttgatacaacgtgagacacaccataatagaagttatatgagcactgatgagggagaaattaatgcttcttggggtgaatcagtactcaagagaaattacataaaatatgtgacatttgagctgggcgaaagttatagttcactatgggagtaaggagagaaaggcatacctaggaacagaatccatgtgagtaagccaagacacctgaagtacttttggggaattacccatgtttcaaacatagagcatatgatagaagtagctagtaatagagccagaaaagcaagtggaggtgtgttgggtcctctacattgaaaaagtagaccagcagtctgttaatccaaaggacctttaacctcaaagtaattaatctttgcttttgaaatacttgtggagttgtttttgttttttttttttcctgtggtgttgttttttgtt

SEQ ID NO: 40130 - DNA, 1013 bp, Homo sapiens
tgaaaacaaatcattataaaagtctaagtagactgtaatcctaacagctaatacaggcactaagttataccaaactttcttttaaaaacagaacaaaacagcccctaatgttagagagctaatgctgctgttactgtacaagtcaaataggagaggggccatagttaccaacaacatggtctggctccagccagttaaactgtgaacctcaaagctgttgtaataaagtagactttttttttttttttttgtcaggggcagttacaccagaagcattttcttggaacaaagtgcatatctgaacaattaaatccagatgtgctaacagatgtctcttgagcaagagcatcataaaaccagatttcacttgagtgaggaaattacttattccatcattttttatttttcacttggagattacatttcactctagactacagtcccagggactgtgattagaaagggtatctgagaaggtagaattggtatatcctatcagtgtgaagtgagtacatgcatttcaaattgatgctacctagttctgagaacatagaatgctaatgaagcgggccgttatttttctctcttggttttcaggcctctttgccacaaatgtctgacaccctgtgaattagctcttctcctttatgattctgcatggatgtatttggcatctgggcaagtccttttcccaagaatttatctattggcagatttctcctctgggcataaatggaacaaaatgaattatatacttttagaaggtttcttgcagatccatatgttatattttgtggccattactcacagtgtctgtcatactgactagataccaactgctgaatcatgcatattagatacatgatgccttcatatggctttggtcttatttatttattattattattgttattgttgttttgggtttttttgaggtggagttttgctcttcttgcccaggctggagtgcagtggcgtgatctcagctcaccgcaacctctgcctcccaggct

SEQ ID NO: 40131 - DNA, 1049 bp, Homo sapiens
gacttgctgtcccctctgttggcagcttttttcttcagatatcttcatggcttatttcctcactcccttcaggcctccacttctattccgttttctcagtaaggccttagtaaggccaaacacccatcttccttctgttttgtttttctgcatagtattgatcaccacataaccaaatatattttactaatttattttgtctttttaatctgttgtctctatctttccccactaaaatgaagctctctagcacctagaactatacctggtacatagtaaatgctcaataaatatacttgtaagattgaaagaatgaactttcacccttccttgtagtttccaaaggaaaggaatctgtccatttaattgagacctaaatgacggaaaggtttatttcctggtagtgttgaaaatgttgccttgttggtagaaacaggagatattttaattagtactttttatttcttcctccactgaactcatgcactgtcccatcactcccatgcctctgccagaattataattatctacttgccatcttagttctgaaaaactatcagctatactctgcaccttgtaccatttctccacttcaacggtttttctgctgcccaggcttatgctgaggatccaaagtatgtgaaagcagttttttgtgtactaaattgccataagctgcaatccagtagtagtctgttccttccttccttcctccctccctccctccctccctccctccctccctccctccctccttcctttcctcctttcctccttccttccttcctttttttttcctgtttggccttactgaatcaagtagtagtattcttcaagctagatcctttctacaaatgttttcaggcttcagtcagtgctgttgatgtgagtgaaaatatcctcgcttcgtatcccaggagatccctgggttttggaaccagtagactttgtttaaattagaattccatcttcaatacttacatagctctatgtgaccttgaaaagatttcttaaaatctgagactgagtctgacatgtcacctttcaac

SEQ ID NO: 40132 - DNA, 1176 bp, Homo sapiens
gaaaaatatgaatgttgcactgaagaattattagtactgattttttttaaaccaaggagttttgaggatcattcagactttctaattagccatgtgtacaggaattttgcctgccctggtttaatttgtctagatttgtatgcagggtttcactttaggactttgcagtacgtgctagaaagactgatcccgctctgcctagctatttagtgtagtatagtgagcattggctttgacgtccaacaaactgggttcaagttcaactatatgaccttaggtaagctacttgtttaagccttaatttccctgtctgtaaaatatggctaaagctcgaccctgcctcataattattgccaggattaggtgaactcataaatgtaaaaatttatatcagtgcctggcatagagttaccactcaataaatgccaagtatcagtgtgactagggtcgttccatgaaacaatgggaaatacgagtggacatgccaaaataaggggagagggagaaaggggcagggcatgccttgtgaaatgaatgtgaaaacacgtgacagaaacaaaagtgaacagctacctcacagtccactggtagagacagactctcaacaaatccttataaaactagttgattagggcaacccatttctccgggacccctctctgcatcagagagctattctctttcttttgcctattaaacttctgctcttaacctcactcttaaaaaaaaaaaaactagttgtttaattatgattacctatgctacatggcagaagtacagggtgcatttaaaggggctacctttctgtggtcaatctcttgtgatggtttacactgactgaatgtgctgtgtcttcagctgcccacatacttctgctagaaagtggcaagtctgcagttatctgagccatgtgagtggagccctcactactcacgtgtcttactttttgttttgctctaatcttttacccttgggttcagtgagaactttcctcagaggaccagtaaggcctctgtctaagggggatagaaattgcattacaaacatttaatatactctttcaactaccgtctaaattatgtgcttctagaaatgagttttctaatttcttttccttttcagcagtacttggcatgatattctatatttagcctctcaataactttatattagcca

SEQ ID NO: 40133 - DNA, 1031 bp, Homo sapiens
attaatcactgcaccttttgatctcctttgaaacacttcctagcatttatttttctattatctccctcaataaaaaggagccacttttgtcctgctgatgcacgacctggtgtggtgtgtatcgctctatttcttaaatatatagaatatacaagtttggatttggaatgtgtcttcaacattcgcccactatttgaaacttatccctttttccaatgtcttcttccaaaaagcagcttgatttatttatatagcggttattgcagttgtagcattttaattccctttatcatcttctctctccatttgggatgataggcagagggacatttgatgttccagttgagatcataagagaatgttgaagagctaagtaactaaggggcattctttacacagaatctatccagttgtcaggctgtcctcaggggggtgttgctgtagctacaccctcaactatatcatagcattttaaaaaaacttgtcatttaaaagtgataaaaccaaatacttaaaaccactctgatgtttactttgctgatccttactggtgattttgttgttttatggaatgctgtagaggagtccactgttaatcacttcctaaccctataaaatatgtaacaagctgctgaacagaatgatgacaacagagaacggagtttcatttgaattcatgcaaatgtggaggtttcccagaaagccattttaaaagtatgagccacattttgaaaataaaacaaagaataacgccttggaatagaaatccataatgaaacccatataatagctgaaagatgacaataaattctacggggagagctttccattttctgttccttttcaaattctaatactaaactctattagtggtctgtataaaataatgagacatgaagccctgctggtataaaactattactagtctgttactttgcataaattttcactcaaactattgtctgtggtcttcttatgaaggatctgttatacgctttctagctaaacagatgagacctattagctatttc

SEQ ID NO: 40134 - DNA, 1025 bp, Homo sapiens
tctctctctctcgctgactctctctctgtctctctcgctctgtcacccaggctggaatgcagtggcgtgatctcagctcactgcagcctcgacctccctggactcaggtgatcctcccacctcagccttcagagtcgctgggattacaggcatgtgccaccatgcccagctaatttttgtattttttgtagagctggggtttccccacattgctcaagcttgtcttgaactcctgaattcaagtgatctgccctcctcggtctcccaaagtgctgggattacaggcatgagctaccacacccagcccaccccctcctaaggtaggtcttcagattataaataaaataatccttcagaatgacaggagataatttatataatggataaccacaagcacataattttgtctagttcttcaaatgtctttataaccaaaagctcaaagatggaatctaccttacacaggactattttaaattgttctttatattgtgtcctttgtgctgttcctgaaaatatgttagaatcctagatttgggtacagattcaagtagttaactctcatgctctcagcagggcccatctcaactctctcttgtaaacataagtgttaagcacagattttagagttaaatggaccgaattcagtcccagcttggtcatttaccaactatctgaccatttcaagttaaaatgagaatagtgctacaagcatacccctttttgttacactttgcagatactgtggtattttgttttgtttttaccaactgaaggttatggcaactccgtgttcaacaagtgttttggccctatttttccagcagcatgtgcttacttgtgtgcctatgtcacattttggtaattctcacaatatttcaaaacttttcattattattatatctattgtagtgatctgtaatcgatgatttttgatgttactattgtaattgttttggaacatcacaaaccacacccatagaagacagaatttaatagataaatgtgtgtattctgactgctcc

SEQ ID NO: 40135 - DNA, 1028 bp, Homo sapiens
atgtaagtttaaaaatcattattttagttgctttattcttctattttaaattcataaataacacaggtggcctgtattttgaaaagagccctttcctccatttgaactttataaacactgaggcagtaggtgtaaatattatctccattttatattgaaggaaatggggccataggaagatgaaaattactttcccaagatcatagaaatagcatgggctaaagctagggctgagcttcagttacctgctcctggtcagtgttccttcctgcacatctccctcctttaaaaacttagggtgcagtcctgaaggggtgctgttgaaccctgaatggagactgtgaaccgagatcccaggagaggcctttggatggaaaggctggcctttgtttctttgtgtattatagattgatttaggctgtttctgtgggcccattttctcatctctaaagtgggacccggttaatcttttttcagttgtatccacaacagagtaaacaataatggagatttaatttattgagaactttgagcctgagggtaaaagctatttgtagtgtagtttttgcccttctgtgttttttggaaaaggaaagttactctttcctttttatttacatgaaagacagcaagcttgaaaaaattaagtattggaagtgaacagatgagccatccttcatcacagaaacccaaggaaatattactttaatgattcttaatacactccataattactcttaatacaccctgttgggccaggtgaaagactcaggatttgtttttcttccttcattgcctcattgctttgtggtttcttctcatttgagaatgagattttttttttaaagaatgtatttattggtgtgtgataataggctaattttttaaagagatgcaatgtcatcagtgtttgactgctaagattaaaataaaccataaattaggacataacatttcctaaagacattttatgttttaatcagtgctaaaataaaatggaaaggataaataactactaaagtagcaat

SEQ ID NO: 40136 - DNA, 1071 bp, Homo sapiens
tgattttatcaatcttaaataaaaataaatgctttataggtttgggatttgcaagtgtgtaatatgctgcaagccagcggaatctgttgtaatacaataaagtttattgtaacataaaccaatttatcaaaaatatggctcatggattactagcctattccataaaattggaccccctatggagtatttcatattaatttattatacctccaccgtgtgtgttattacttagcacttattacatgccaatgatttcttaggctctgaacaaaatcaaaagatggaacttgacccaggccaaaaagttgtttgatactttggcacagtagcaaggtagaagaagaaaagtcctgctttcctatatgccgcctttttggcgcctgtgcccctagtatacttttgagtcctaaactatctcagccccattttaaaatttggagtacatatagaagtgcttatgattgtcatgtcccattcattttaggtactgataaagaaccttgacttttaaggaaaaagcactaataacatcaacatccctgccctctgagaaacctttaagatcggtaatccaaccacctaaaagttgctagaaatacttatttctcttagcctgtgaactctaatagagcacaatttttctttagttgcacatctgtgagcctgattccatatagagcctaacatggaatcatgttttaaaatatgttatttttaacacctgtagtcaaatctcatttatctcttacaattggtttactttctattttatttgtggtgggtttttatacccaaattgaattggtttagccactagttttgcttttatcacttggcttgtacccaaggaacataggtcgtttttcatattattctgagaaaaatgtaatcaaataaatctcttttaaaaattaatagaccattcaaagccaactagtagtggtttgcaagttatttttgatcatccgtgtttctacctttggttaatatcaaaagttgtttgtggcacaatataattcttgagcagaacagtggtcttctggttataatacttataatatcagccatctg

SEQ ID NO: 40137 - DNA, 1053 bp, Homo sapiens
ctggtttcctgttgtaaaaaccttcagtgagtttgaccattgtgctcttggctcttgggctggagtaccgtggtgagggagtaaacactagaagtctttagtacaaaactgctctagggacacctggtgattcctacacaagtgatgtttatatttctcataaagagtcttccctatcccaaggtcttcatgatgccagtagccatatatgataaattatgttcagtgataacttagttatcagaaatcagctcagtggtcttccccgccatgattcacatttgatgagtttttaaaaatcaaagtgattttgaaaatctctaatggctcagaaaataaaaacatccagtttgtggatgactatatttagatttctctagactctagtggaagacctttggaaaggccatgccaaccgtgcttgtactgctagaagcactttatgtttcctttttgggtgaaatggatttatgtgagtgctttaaacaaatagcaatacttatagactgaaataaaatgaaacttcaaataagactatgtttaatttgtaaacctttgtccatcatgttctttctttaaaaaaaaaaaaaaacaactccccttagtgagtactgaaaggatttgaaaaggcttgtaggctcattctgaagagagaacaattgtgattctgtacagcccgtaaagcaggtagtgtctatggataagggagtgtgggaaaggtgggaagaagaaagtgaatacggaataaaggattgtggtagataaagtgcaaacagaagaatatcaaaaggtaaggaacttatgaagaccaatttcacatgttgagtgctagaactgacaaacgggagggctaatacattcacaaattcagtaatttaagctttatttccaaggaaagaagccttctccacttgctgagtaaaacttgccaaaagatagcccttgctcattctttaaattcattcctatatgcattttttttaaatgtacagttggcccttgaacaacataggtttgaactccactggtttatttatacagggatttttttca

SEQ ID NO: 40138 - DNA, 2051 bp, Homo sapiens
gacacttccgatagtgttattccctagccctgggcgtggagagagggctggggagatcattcggccctaccagtttttctcagtttctcacaagcacaaggctcctgcactgcccttgtttactggtaaggacatctgaacaagcgagagggcaggtgccgatgcacacagcagtgagggaggagcaagagcaaaactctgttctctcgcagccattatgcactgccttctggtccaggccagaactaccacctcccacacagcccaagttaaaacagtcacccggccccatcctcacccattctccccagctgtcaccagccgggtttctttctttctttccttttcttttcttttcttttcttttccttttcttttccttccttccttccttcctctctctccctccctccttccttccttctctctttctctctttctctttctctttctctttctctctttctttctttttcctgcattttccatctatgttcctctaggattgatcttggagaaaggaggcagagataagagtcaaaccaattcaacataatggtccccaaataaatttctgaggtcatatttttccatttaagcaaacagctctgacatactagactctcaatctcagttttgaattcctgggagaaagactctcgcagagcttgggttgcctaggatagtatttaaaagggtttgtatgacccaagcatctgggtcttttggttgtgggggtaagccatgctaccagctcccttcagcacctccctattttctttttcttctttaaaataagacaatttctgtaactactgaactggtagtgtggtatcatgaaggtgaggcaaatgcctgatacctaaaagatgcagccagtcccacagtttatttcaggagggctggtatttgcaatgtgtgcaagataacattttagtcattatgaaaagtatgacttttcatacttttctgacaataagaatttttaaaatttaaaactgtaaacaaaataatgtacttcattaaaatgcaaagtaaatctttaattaataaaagtttttaaggccaggtgcagtggtttgtgcttgtaatcccaccactttgggaggcaaggcaggaggattgcttgaggccaggagtttgatagcagcctgggcagtacattgagatcccgcctctacaaaatcaaaaaattagccaggcaaggtggtgcgtgcctgtcgccccagctacttggcaggctgagctcaggaggtcaagcctgccttgggccatgatcatcccatgcactccagcctgacattcagagcaagaccttgtctcaaagaaagaaaaacatttttatggtgttttcttttttagtcttttcaataatgaaaattttcattttacaggtaaaatgaaaggcctggcatttattcaagatcctgatggctactggattgaaattttgaatcctaacaaaatggcaaccttaatgtagtgctgtgagaattctcctttgagatttcagaagaaaggaaacaatgtgattcaagatatttacataccagaagcatctaggactgatggatcactgtcccgattcaaattattcttcagtccatttccccttcctatttcagctgttccttttcacctaactgttcagtcattctggttttcaagcagtgctttatctcatgtccttgaatatagttgtgtaactttattttttaggtaataattagaacagttcccttcagaggctgcatttgccttcttctgccacctaaatattacttcccttcaaatctgcctttgaatcatcatttttaaaaaaaaattaacatgtttttgttgtagttatcttctggggtttcaattcctcagaaacaacttttttcacaacggaaaggaaagaacactagtgttctttcagtaaagtacaaagtgtttattttacaaaagagtaggtactcttgagagcaattcaaatcatgctgacaaggatactgatagaaaaagtgatttcttcttattataaagtacatttaaagttcaaggactaa

SEQ ID NO: 40139 - DNA, 1710 bp, Homo sapiens
aattcttgaggactcttgatattccagttgttttccagaaagattgtaagataaggatatgatagactatgggatagaatagttaaggttgtctaactttggcaagtacttggcatggcatctacaacaaaaaatacatgctgtgcctaagatatatggatttgagtatagcctgtatagtgtgaacagaagtaatgataaagtcgttggtaaagtaccaatactaatgttggtactagaaagatgttgaagaaacaaaacataaacagggtcactacaaagcagattttaaaagatagtttttagattttatccttttttaaaaaaactgagcaacaaataatgttgggtgcagcttggttggaaatatattatctcataattccataggctagaggtccgacttgggtctgtcccactgtattgacaggactgtgttccttactcagaggctctggggaagaatctgcatctaaatccatttagattgttccctgaattcagtttctttccactgtcggacaggggtcccagcttccttgctggctgtcaggcgtggatgggtatggtggggtgggagcagagggcagctgcctttaactcctggcacatgtgccccatgtctcagagccagcacctgcaggttggccccttctcacacttggaatctgtcccacttccctttatgccacactcctcttctactttctttgcgcgcgcacgctcgctctctctctctcctgcttttaaggtcttgtgtgattacattgaatccacctcagtaatccaggctaatcccattttaaagtccactgatgagtgaccttaatttcctctcagagtctctcacagcagcacctaggttagtgtttgagagaataaggaaggacatctttagaatttagtccttgcttgcacctccctccagggactgcagtgctccctcctgagactgagaaccagtgctgggaggacagatctcccccatgaggcctgccagctaaagtctgtgtgattgtgtgtggtcgggcctgacagatcatacataagactttgtcctgcaggtggcttcctcaagcaaacattgtaatcaatagagaagcagctaccactcatattagctgggaaagaaggatgtttgttattttggtagtgttcatagtgccttgttttaatgtatacttagaccggaatatgaagtggacatggtcttgctgctttaaattttttttttttattttggtatcacatcatggcagccacagagtgactttatatatgttcaacaggagaaaaccaaggcccagctgtgagtaccaggccagcacttggatgtgcagagctacttttctctttctcagctgcttgataaaatcgagacctttaggactgtagcatctgactgagaaaagcaacccaaatgttctagaaacatgtaacctgcctggcatgtgattataagctgcgaataaagaatttaattattatatttattaagatcagttttaataagataaagtagtttttaggctagttttgttttaaatgagaattttaatgcctaaaagagtatgtttcatttacttaaaatttagcaaaagagaaaaatataatttcctaatgaggctgaatgaactatatttgtattttatatgatgtgagttatataggagaaagatggcatgtggctccaaagtaagtggtcagaat

SEQ ID NO: 40140 - DNA, 1035 bp, Homo sapiens
ctgaaaggtggtgagaagaaggtagactggctagggaccttgagaccctaggaacaacaaggcaatgagtttcctaagttttctttttgcctcatattgcccagacttgaagctgaagaagctagtaacctggaaatgctgatggacacagaccaaaaaaaagcctaatgaaagcctgctctctagccacaggacctggaaatgggcagcatttcctggcaagaaagaaaacttttagacaataactgctctactccaactaaactccatagagaaaactgtggcctcagtcccacccatgccagcaaaagctgagtggggagcctagattttcacccaaccagatgtaatgagctgcccagccttcccctgccaaggtgatgtgggggaaggctgggtagggagccaggactttcatcctgccaggctttcccctcttgccatatcaatggagacacatgaggaacctaaaattccaccccaacccagcagtggaaatatttaagataattataagcgggagaaggtacaggaatgtaaagagaggtgaggtttctgtaccttgttcaaactaataaaatgatgtcaccaaatgactgataagttatgtgtgtgtgtgtatacatatacatgggtatatgtatatacatatatacatgtatgtctgtatatatgtgtatgcgtatatgtatatatatgccatatgtatatacatatatagtaacacctagagccaccatttaaaaagctatacaaagagatacatgcaaaaacactacagataaatgaaaattgaattttaaaaagttccagtgacccagagaaaggcaaaaagaagacagaaaacattaaaaaaggaagaacaaacagaaaacaaacatgaataaaatggccaacttaagccctaacatttcagtacttacattagatacaaatacattaagagacaatgattgatagaatggattaaaaaacatgccccagctgtatgctgtctacatgaaactcacttccaatatgatagagacaaggtaa

SEQ ID NO: 40141 - DNA, 1874 bp, Homo sapiens
atgagggtctcgtttgtaaagaagacagcagcaatggcacaaagtcgacttgttttttgatcatttgcatcttcattataaaggaagtccagagaatgtatggctatgtcacattttgggcaatctctctgggctaactttctttaaaaggtcagattctcctggcaacagagagagactccgtctcaaaaaaaaaaaaaaaaaaaaggtcaggttctccttccaagtagtgatctggagatcttttcttttttactatctgtatctgtctccactaatacagtagacaatgtcctcagtgttgccattatttctaccaccactgccaatgtccattttcacatcgttccatatataaatatatgaatatataaaaatataaaaaattaatatatattaatatataaatatatctataaatatatgaatatatatatatatgatggggtccctctccaatcaggtagattggtggaattgaatgcagtagaaaggagaatagggaatggaaaggaggaaggaagaaggacaatggccagataaatggctgactattcaaggcatagagaatcataatatatataaaggcataatgacatcagagaactgaggcagggacctacgggtaacacagtgaatgaagttataagcagtgggacttgagggaagggtgaccaaaacaatcattagggtactcaaagaaaagatgagaattcccattatattcatttgtttttctcaccctgtaatggttgctatttaagtgataagggtatgaaatagaaaatgtttgagatgaccggtttaggggagtggtgataaccgttggtgttagagaagtatgcagctacatatgtggttgcttttgggactgtctctcaaatgtgttgaggaaccactgaagtattgatttttaagccaaaaatgacatgacagggttttctttatggaaagatcactccaaattgcatgtagataagcctatgaaaagcaaagagataattgtctaggcaggaagtagtgaggacttcttgctttcctcaagatacactgaaggcagttgaaaagctcatttttaaaagtctggtgaaaaccactttgttcacttttgttttgtgggagatgtgacacctagtaataaagagttaacaaaccctttccccttttatgaaaatttgacttttcgttaactccctagtttcccagaaaacaatgaaaaattgtgtttgttgcttatggtaaaaataacccaattggtaaattgcatctggagagggagaattgtaaatacttgaaaggaagccatagctttggacttccctgattgtagtgactcttataactgtcccttgtggaaattctagaagttctgcctatggagttgctactagagatactggctcctgtggtacatggggccttctgccctagggtgattctcattcatatccagtgtgaatcttctccctgtacctgatctgtgtcgactcctgtaaggactcccactgaagaggaacacctgatacttctttgttggcaatctgtgttttcctaacagataccgttttgagtaaactggcaccatgtatggcctatggctatggttgtcttataagtctggatgtttagttgagccttaagaagactttctgggccaggcccggtggctcacgtctgtaatcccagcactttgggagaccaaggtgggtggatcatgaggtcaggagttcgagaccagcctaaccaacatggtgaaaccctgtgtctactaaaaatacaaaaaaattagccagacatggtggcgcgtgcctgtaatcccagctactcagggggctgaggcaggagaatagcctgggaggcagaggttgcagtga

SEQ ID NO: 40142 - DNA, 1033 bp, Homo sapiens
gctttctatctatacatttgtcttttccggatgtttcatgtaaatggaattatacagtatggtaaacacattttttgtctattaatttttatattcaactaggttcaacatgtagccgtagccaaatattttaaattttccttctggaagtttgaaaatatttatcttttttgatacttacttctccttctgctttctctttttcatactgaaacagtcttttaaatgattgcattcattgattaattccttatttttcccttctagcagaagaccttccttttcactctcaagacagcatccttggatattaattaccttttgttcattatcccctttcttatgagcaccatctagttgttgaagcaacagattttcatgttgtagttgagatattctctcctctacgtagtcccactttccaaaggatttacttggcttaggtccttttgtacactttataaaaccaaaaccttttctctgagagaatttcttgtgtcatggagtttactttttagggtattgaattcgagcttcggaaagttgctcagttaaaaactcattattatcttttagttcagaaatatcagaactcattttctttcttgtaaagaaacgtcttgtgctctctgtaaagcaagttctaggtctctttttgttttcacactttgatcacactcacttatagcagcagccagtctagcatggaatgactcaacttcagcttccagtctttccttgttttgattttccttctccagtttagacttgagcattgtattctcagttttgaggtcgttaagctgttgaccatactgggatactgtttttgttaatgtttttccattcagttttatagtctcttgaaggtcatcattcatttctttaacaatttcaatgtcctttttccctttcgaggttcctattttttattgtgtatacttacatacacaataaaggcaatatctctcttcaacaagcaattttcatgcatcagatctttttttttcttaaagtatttcttcaagccttc

SEQ ID NO: 40143 - DNA, 1045 bp, Homo sapiens
cttgtgacatgggaaacagacactgctactctgtcctgatggctttggtccctgcatcatccttccaacattgactgttctctggaacctaccagagctgatctaactagaatatataatgcctcctctgttcccattcaagaggaaagtttgcccccaggtcaatgttctgttgagcctccccttgagagaagggagtctggattccctcaccagattccctctcaggggctccctccatcattgctccccgtgctacacaggaactctggacaaggctgtggacctctccagtctagatctggaactgttctgtgccagcacatgggtgcccatggtaggggatggggagcagggccccttcagcctggggttacctggcctgaggccatccaaggcagcctcagaataatacctggggccagggcacagaaggaatcatgtgaaggggagataagaggagccccttaaggtaagcgtggggagacacctggtccagccacacacagccccccatcccaggacccagcccaaggctctaaaccaagcaccaaatggtttaaatatcaccacctcctccactcagccccattctcaccagtccctgtctcccggcctcctgtgtggctagttccccaggtcaataatttagccggtttattgcccgctcccgggtaacttccagggcctggctccctgatcgcttgcggctgcgcttgagcttgcataagtccttgtcgaagacctccccagagcgcagggccgacaccaggtcatcgaactctcctccctcctccagcgagctgcctgcagccaggaccttccgctgccgctgccaccgctcacgttccctctgctccttcagctgcgggcggggggccaaagataggaaccctctcagggagaggcgctgaggccagggcagccccccaaccctgggctaactcctaggccatggtcatgctgcctgcctgtatctgttggccccactttcttcctgcctaggacatacaggcccccagcttcacaccactctcttccctca

SEQ ID NO: 40144 - DNA, 1053 bp, Homo sapiens
atcttttgtcaggtggtggccaggggtgttcaaagctcattgcttgcattaccagctattagagagatcagagagggcaattaattagaggctcctggttctcacatcccaaacacacacagttctggcctgctgggctctctaacttggatgtctttgagtcctcagtggtgccccctgcctgcctcccctctgccctatgccaaggtgtgctggcaaatattaaacaaccagctctctggaaaagacaatttgtgatataaatactcccatgttgaataatttcaagctaccagtatgtcaaatggcttgcaaaatttctgaaaatgtaaacaattggttctcacagagctggtacaagctggctccagcacactctcagcccaccccagatcccctcataggaagaaggcacaagtttaaaggcagactgggtagggatggtatgaatttaatattttttagtattacaatatattcttataaaaaaggtgcaagtgaaaaaggacactgtagattatgtccattagcctcatttgtcatctgaggcagctggtgagaacagccttggcgtgaaggcatccctggtagaagtcgggggagatagatagtcacagttccccagttggtggaaatgggatgggagtagggagaggctggaacagacccttccccattcacctggagaattttctcctcccactgccctaaacactttatttccatcacaggggagaaatgctgctgagaaggttgtgtttgttaggttgatgacgaattttacattggccacaaaattagctagagaaacttatctaaaggtggcaggagcagtggggagggcatgaagaaagcaagaccaagaaacaacctattaaggaccagctcagccaccccgactgggcaccagccccttcttactcagttgagtatgagtccatggtccaaggcactgttggagatctggctacagtggcatctagcaccagagccactggccagatgtagaaaataaatagaaaaatatctttcttttagagtgagaaggctgag

SEQ ID NO: 40145 - DNA, 1060 bp, Homo sapiens
ttctgcatctcttgtgagttctcaggtggtgctggtgctgctggtgctgctggtccataagccaaccaccctttgagtaacaagagcctgcaccattccctaggccctctgcaccatctgaattagcccgtcagtttgtatgtgcttctcatgtgcttcaggggacttgaaaaacatttaagtagatcacaaattccccttattatcttgtctgtaaactaagtggttatattaactcttcatggagaatgtgaagataaaaataggtgtaattggtaatttagagtgagacctagctctagttttaagaaaatgaagggacattcagaggtcatgtgatccaggcctcaacttggtgctgcttgagagaacttgggaattgagaaggttttcatgtggagggaaccctgtgccacggtggcacagcagtttctaggagggctgttaccctgtacatcactgggtgagaagggctgtgaacttggactctgggtgccatctatctgtggatcttctactttgtcttgtcccactatgctttttgttcttcattcctctttccccggtatgaaagagaacttgaggtgggatagggagagggttggggagtagaggtgggaaaaagaattgccttttggacttagtgtttcttctcttttcttcttgccttgcagagttatttttgatgttccccaattccccaccagccaatccaagcattttctcctgggacccgctccatgttcagggtctaagacccagaatgagtttctccagccaggtggccactttatggaaaggatgcagggtcccccagacccctcctctagcccagcagcggctggggtctggctcctttcagagacactacacttcccgtgcagactcagatgccaactcaaagtgccttagcccaggttcctgggcttctgctgccccctcaggaccccagctaacctcagaacaactaactcatgtggactcggaaggacgggcagctatggtagatgtgggcaggaagccagacacagagcgggtggctgtggcttcagccgtggtc

SEQ ID NO: 40146 - DNA, 1058 bp, Homo sapiens
cctcgcaggaggtgtccaggcggaggcagttcctgcgggagcatgcggcccccttctccgccttcctcacagacagcttcggccggcagcacagctacctgcggatctccctcacagagaagtgcaacctcagatgtgagtcaccttcctgggccctctctgggctggtgtccatctgctgaagcagcccttgaaatttccctgtgcctggaaatcctcctgtgtcctccagttctgctttctaacttcttcacctgctaccccttgcttaccaggccaggtgggcttcaggggcaagataggggtcaaggctgagttgtatgattatagaagctgtgtcctacttggaattagatttgaaaacataaatgcagttggatttagaattaagattggatcctggacctctcattcttcaggggtccttcctcctgtttccctgtagttcccgaagtccaggacatggccaggggtggggtggtggacattataaacatttgaagtagacagccatgcccatgccagcactgctgactctggaggtgccccagtcccgtgacaaatcagctggggctaggctaataacaaagaggcctcatttcataatcctcccaaagagtgctctggatctgtagccactgctggagggacttccaaaggtgatcttccttcccctctgttccttccttctgcctctccccactttccccttccccccttcccccccttcttttcctccccactttctttcactatacctcacgataagaaataaagttacttcatggcccaataaatgcatgcatgtatgtttagtaactttttaaccaaacaagatgtactatatgctttacattctggtagtcttacttattctcttcagtctcaaaggactggttctggacccaactgagtaatttgccttcatgactctctaacagatcttgacccaaaccttaatgaaactgcaccacaggaagtgatggtggaggatggtggcccttccacagcctgccgctgctcacctcatttaccccattctgatacctcaccatgaa

SEQ ID NO: 40147 - DNA, 1047 bp, Homo sapiens
ataagattttattgcattgaaaattcacattctttgtacagaaagaatattaagttaaacaattgtgcatattgtttgtattcttccagggtgaaagttataaattaattggattcatgggcctgtacaagagggaaaaacacacttaaaaaggccttaagtgcttttttcttctttccggctttcaagatgttgaagcgaggacgtggtgggtcctctggtgtgaaattccagatttccttgggtcttctggtaggagtgtgatcagttgtgctgacaacacaggagccaaaaacctgtatgtcatctccgtgaaaggggatcaagggatggctgaacagacttcccactgctggtgtgggtgacacggtgatggccacagtcaagaaaggcaaaccagagctcagaaaaaaggtacatccagcagtggttattcgacaacgaaagtcataccgcagaaaagatggcgtgtttctttattttgaagataatgcaggggtcacagtgaacaataaaggcgagatgaaaggttctgccattacaggaccagtagcaaaggagtgtgcagacttgtggccctggattgcgtccagtgctggcagcattgcatgattctccagtatatttgtaaaaaataaaaaaaaaaaaactttaagcccattaaaaagtcttaaggtggggcacttcaaaggcaggggcctatggatttgccagtgacctttaaaatgtgactgtgttgctgagagttcaatgattattgatgtatattccctttctcctcagtctacttaactacacattaatattgtttcttcccttgtaggctctctttatctttacctctgtgacacagacatctaactgcctatccagtatccaatattccttcataactacaattcccagtcccccaaaaagccaacaacaataatataccacctacctatccccacctctcttattcaggatggccatctgactaacttctaaccatgagtaaaaaatggtgggcagagctttcaggaaaccctaaaagggtctggctca

SEQ ID NO: 40148 - DNA, 1035 bp, Homo sapiens
tggaatccgcaaaaggtgggccatgtgctggactcatggagacctcgcctcgggtgagtgaggaggcactgtctctacagtgagcttccagctgccccatcccaaaggcttagaggcctgcacaaaacgaagtctttgcattgtggcagagaggctgtaaggcacacagatggggatgggggagccagacttggggaaagggagacccgaggaggcatctggcctcgagtgttgattatgatcctggttattattatgtctctaattcttaaggagctcactgtctgaagtgatgtggattagacaaaatcaaaggatgccttgagctggatttgtgtcttggtagatgaaagcattggtggccatggcctcaggaattctgtgagtgggtcaaacttggggtcactcagacaggggaacaggagttcaagaaatcagccatccagaaggtggccaagagcatcagtaggagtgtgtgcgtgtgtgtgtgtgtgtgtgtgtgtgtgtgtgtgtgtctatgtaggtaagagagagagaaacaaagagagagagagagagagagagagagagagacctggttctaattcactctccacactgactagccatatgcccttgtggccatttaccttacctcccctctaataactttccatcctcaggacaagcagtgtagcatccccagaatgactaatggcaaagtcttctgcagaatcagggtgcaggtgagctccttctgtgagtgactgcactggggctctctccccttccctttcctctgtcctttcagaagtgcaggtggggcttcatgccccttatcctcactgctctgtgccctcagcacagcctcacatcacattatccttctgagcagaagggcccctgctgtagggcaagaggggcctgtcagggtgtcagagccccagaaaagggcctgtgttcagtcggggctgggtccctgctgctagacaggaaagctggctacccagtctgggccaaggtgtaggaggggctgtgggagggcctctgatttcc

SEQ ID NO: 40149 - DNA, 1050 bp, Homo sapiens
ccccaggaagccttctagggcccttaggtctgcattagacaggtgcccctcctctgtggtccttaggcagcgtgtacttccccaagcccagtagttcattgcgtagtcatggttcctccttccgtctgcccaatctctacctgaccctaaccaccatccacaggaagccttctgtgattgctatagctcagccttgcccacaactccatctcattcatgatctgtacccctcatctgcctcttatcatgtgttgatttttaaatgatccttctctatcactttccatacgcccaagttggactgtcattttccagagaacagattctatgctctctaatctcaactccattcattcagtcattcattcggcacatacttctagaatacctgctatgagccagacactggggccgtggggctgaataagactgatggttttctgcttagggactccttgactcctggtcatcatggtggagggggagatgcctagggttccctgaggcctgagcaaggaagcctgagcctggggtgggcctcccaggcctgctgtattctacccgcctctccagccctctggagcttgttgtcatgagaattctcccttccttcctgactctcccaccagggataggtgtggattaagcggggctcctgtttttctagtatctaaaaaggctgtgcctcccttgcttttatgtcagcttttccatgctgagtaagtttctatcaaactctagagctcaggcaccttctgtggaagcccaagaagagagtaaccagtgaatctctttgctccctagtaccccatgtactgacaagatccacagcagccagcccctgtggagggaagggcactgtgtcagtgtggcctgcttgtttgcccagtaggccagcccctctggcaggtcccggcagccatagaaacagtgctcatggggaagttctaggagacatggattctattcccagatcagtccccaaccggccattgcctttctctgtggagacttcagtttctccatctactaaataagggtcactgcaaa

SEQ ID NO: 40150 - DNA, 1022 bp, Homo sapiens
catgctgggctgccctgccatgctgctgcgctgcaatgccaggctgatatttactgtatattggtttttaaattacagtacaacattgattcgctgctctttcagttcagccctcactctctgtccctgttctgctcggcctttctctgcctctctgtctctctctccatctgtcttgtctctctccaattcagtttttaatgcagagtattatcttacattgtatcatgttaccctatggaattaggcttatgctgctttgtatttattggaggatgcattatattaatcccttccatgcatacagcactttatacattttaaagctctacctgcagccatacctgtcttctttggaccccatgacagtgaggaagtagggcaagcagacttgtctccatttaaacgcgaggaaactgtagctcaggaaggctaatggaatgaccaggtcatgcttgcattatattatattataacataataataatggccactgggtattgaatgcttgctgtgagccctgtgctattctaaaataagctttatgtacttattttatgcccacattcattctgtgcagtaggtattattacttcattttacaggtgaaggaatgaagattcagagtgggttagtagcttgcccaaagtcacacagctattacagtaaaattcaactttggattagctggattcaaaccccagcagccagctcctgagccccctctctcaaccaggatgcatgctgtcacgtgctgtgatccctgagttggattgggggtgggagagtggggatggggtgggatggcttcatggtactacaagaggcattcttgtcctcacatgacttctgtttctttatgttttcactgcacccaggggaaaggcctggggaccttgcaacagcaggaaatgtccccagggcaaggggccaagttcctttaccccaatatccacagatggttagggccccaatatccaccattttggcccccaagcaagggcagaagggcaggcgcagag

SEQ ID NO: 40151 - DNA, 1049 bp, Homo sapiens
aatgatttgatgagttggtaaaaatgaaaatatctataatggtgactggcacacaatagttactcaataaacattagcaatttttttcctgttcctcaacagtttctaactttggatagtttgtttgctgcgtagtttctgtctctcttctccactaaaatgtaagctctgcagcacaaggacgtgcctgtcttgtttaccgctgtgtttcccaggctgggcacacagtgtgctacagatatttgtgaaatgaatgagtggaagtgcaaaagcacgtttttaaaggatgggaaggaactctgacaatgtgagaatgctcacattggatcagccccaagggggacccggagctgtgccaagaaccctattaggggtcaagagagttggcctctggtcctagctctgccgctcaactgctgagccacctccgggcaatttgttggccttctctggccctctttgtgtttcctccagagcgtgggagccctaagactccagggcttccctcttagaggctgacctccaaggagctctggccagctgggaagtgtgggatttcgggataattcagggactaaatgaagagaaaggagaagtgggagaggataaagaccgggaaggaagaaaagtcaacgcgtggctgcggcgctgggcagctacgggtgggggtagattgggggaaggccgcgctgggccaaagcacggagctgctgtgcgctcccccaagcatgtctccgccgcggctgatgcgcccgagcctccgcctgcccctcccttccttgagcgcctcgccagttcccgccgtcactgactttctgacttcttaacttgtcagcaaatcccagagttaaaaatgcacacgcaccccggccagccgccagcagggccgtctggccgaggctccagatgtggggccaccgcgcgggccgcccgccccgccgcgcagactaaacaatcggccttggccgtgagcgcagcgcaattccagatgccgcgtccctcgcgccgcgcgctaattgggccgcgggcgcgaggctctgtcagcgcca

SEQ ID NO: 40152 - DNA, 1084 bp, Homo sapiens
aaaaaaaaaaaaaaaaaaaaaaaggaaaatacagaaaagcataaaaaaggaaataaagatcagccataatcttcccacccagagataaccatggtacgactttagtgtatctcctagttttttttaagctgactctcaaacacacatttacacacactcacatggacacacacattcacacacacatattcacaaatatacactcacacgcactcacacatttacatacacatatatgtaactttttgttacatgtttaatgtacacatgtctttaaaagttcagaaacaagatcatggaatcatgaatacatcaccattttgtcaactaatatttttattaaataaaatattgataactttttccccaggtcatgacatattcttctccaacataatttaaaatgactgtatagtgctctgtctttgggcataaggcatatcattttatcagtcatcacctgttggtcatccatccatttctagatttttgccattataaataatactgaggtgaacatccttgcagagaaatcttcgagggggtcgctaactttccaattgtctattcatgtctgtctactcccggcttcgattttgaggctttctaggcaggatctgtgtctggtttgttgtgaccccaaagtctagcttggctgctggttcactgtaggcatccaataatggttgaattgagttgcttttctagagcatgtgccctcggctgaggaattgggaaggtggatagatgaggaaagagcccacctttcctgctagaacactcaggggtccccagtgcctctatgctggacctgctaacttctcctaggaaaacaccttcccaagcacagagccactggccatcccagaggctcactgaatggccctcctgtatctcttatcttccttgcctggaccctcccccctcatccccttcccccctccgcccccgatctctgactcttgagttcttttgttgtgttttcaagctgaaggcccagcagacagagccctctcacctgcccgtgtctgctggacaatgttgcggcagctcccagctccccatacagtggcctcctccgtgg

SEQ ID NO: 40153 - DNA, 1048 bp, Homo sapiens
ttaactcctagactcaagtgatccacctgtctgagcctcctgagtagctgggactataggtaccactgtacctgggctagagtcatagcagttttgaagattatctctgatactgtttgtatggcttgtcagcactttcttaggtggtgtagacaattaactattttaagaaggaagagcacttagaaacagtaatctatttttattgtttcctgttatctcggtgttaaaattaaaaaaaaaaaaaaaaagactaagaacagaaacaggccagatgtggtggcttacgcctgtaatcccagcactttgggaggctaaggcaggtggatcacctgaggtcaggagttcaagaccagcctgatcaatatggtgaaaccccatctctactaaaaatacaaaaattagccggacatggtggcgcatgcctgtaatcccagctactcgggaggctgaaacaggagaattgcttgaaaccgggaggcagaggttgcagtgagctgagatcacgccactgtactccagcctgggcgacagagcaagagtctgtctgaaaacaacaacaacaaaacagaaacagtaatctctttttagtatttccctcttgaattgctctggagtagattagattattatggactattctatctgctgtgaccatagatagtgaggctattttagaaggctaaaatataaaaaacagaagttggctgggcgcagtggctcacgcctgtactcccagcactttgggaggccaaggtgggctgatcacaaggtcaggagttcgagaccaacctgaccaacacagtgaaacccccatctctactaaaaatacaaaaattagatgggtgtggtggtgtgtgcctgtaatcccagctactcaggaggctgaagcaggagaatcacttgaacccgggaggcggaggttgcagtgagccaagatcgcactattgcactccagcctggcaacagagcgagactccgtctcaaaaataaattaaataaataaataaataaataaatacagaagttaacatttactagtatgtat

SEQ ID NO: 40154 - DNA, 1082 bp, Homo sapiens
ttattccctaccctcattcaaataggaatgttatgacctccgtaacctagagctactgttcttgattcagttttggattgttttctatcctgttccccacccccactgaaacgttgtgttgtgggatttggggaggattagcacggcagtctggcatagtttagagcccaggaagctggtcttcactgctccctcccatcatcagaatacagagctttcagtcattgcctttagaacccagcagtgcttcttttgctgggcaaattgtgtgaaagatgggagggcagcactgttgctagtgagttaggaggatacttttgtatgatgcttgtatctatccaagggaaggatgggctctactgttgtgttagctttttcaaaatgcagcagagaatggccaaaaggtaatttatagcttggctttagcattttgtcacattggtgtcctgctctttcctgcctcctgctctttctttcagtctctgacatgggaaagaagatgtgtaggatatgtcatatgctcacttggatggaccatgtgggtgcattaaaatagcaagaactttgactttgaaataaagtctttaaggatcaatttgttttgtagatatacattgtagttgaaaatgaaaggaagagtagataggggtttactgatttatcaactttttttgagatagagtctcactctgttgcccaggctggagtgcagtggtgcgatcttgactcactgcaacctctgtctcccaggttcaagtgattctcctgtctcagcccctagagtagctaggactacaggcatgcaccaccacgcccgactaattttttgtattgttaggtggagatggggtttcgccatgttggccaggttggtctcaaactcctgacctcaggtgatctgcccgcctcggcctcccaaagtgttgggattacaggcgtgagccaccacggctggctttgatttatcagttttgagcccagacctttctagaatgccaggtaatttatggtacttatttttgcagttatggatattaacttatcaggacaataaggtcaaagtccctgttagagctaattag

SEQ ID NO: 40155 - DNA, 1032 bp, Homo sapiens
gttcttttttttttttttgtgcttacctagttctcctgtttacaggtgtgtaacttgagccactactatagctaatgtctgtttcttttacttgtccttatatttaaatgtaagtctttatctgccttagctatgtgttgggtgttgaaattgttgatcttattttgggagactcccatcccctccccccactaccaccccgcaagtagtttcaagacagtgcacctaggagactgcttaacctaagccttttgtagcttaggtgctgttctgtttcccaatggaccactaccaagtcagtctggtttatttcccaagccttacaatctgctgaacttcttcagttccggcagcgatcctctaacttgtgggggatttccataaaacagctgaatctctcttgggtcatctgtggcaaaagccagacacgtgctcacccgcctgggagccaatagtaacttttgcaaacgctgcctccggaaaccccacggtttgagggctgctgctttaggaacaacacagaaataacgtcttttaacagaataaaacaaaacatacggacgggatagtgagaaagcctttgtccttcgcagtggggagaggtgttaaaggtgaaccgaaaagagtatgggaaactcatgtaaaatacctttacagttccccgggaagaagggggcggagatgggctcgggagcgtctctggccctttaaggaggagggacagacataagagtctgtacctttaagagtctctttgtctggaaaccttcttatttaccctcctgtgcttcaaccaaacttcgaccagctattcacaacgtccccctacgccgccgccccttacgccaggctcaaagcggccgcgcgtttgtggctgaccctaaactttgcgcctgcggcgcgaaccctcggaacgggtgccggtgccggggtcgcggcccagcgctgcgccgttggcgcaatgcagggcctgaggggcggggctccagcgggcgggccaatagacgggcagggggcggggccgtgttcggt

SEQ ID NO: 40156 - DNA, 1032 bp, Homo sapiens
ttttgctcttactgcccaggctgaagtgcaatggtgtgatctcggctcactgaaacctccgactcctgggttcaagcgattctcctgcctcagcctcccaagtagctcggattacaggcatgcactaccacacccagctaattttgtatttttaatagagacagggtttctccatgttggtcaaattggtcttgaactcctgacctcaggtaatccgcctacctcccaaagtgctgggattaaaggcgtgagccaccccacccagccaggatcatatgtagtaggagtgagatttaaatttttttcacttttttcctaagtatagaaatgcaacatgtcattgtagaaaataaataacatttttaaagaaaggattttaaatcacccctaaccacccatatagagatgaccaatagtaatatttagagtatttctctctgggtgtaaaacaggggcacaagtcatagctttcatgaaagaagcacaggacgccagatcagtagatagaacacatcagcaccacacttcccccaacacctccccacccatgttttgtattttaatgtggtaggaatcctcttttcaactcaggtagttttgaggggtttgttgttgttgttattgttgagactaagtttcgcttttgtcatccaggctggagtgcagtggcacactctcggctcattgcaacctccacctcctgggttgaagcgattctcctgcctcagcctcccaagtagctgggattacggggatgcgccaccacgcctggctaatttttttttttttttgagatggagtctcgctctgttgcccaggctggaatgcagtggccatctcagttcactgcaagctccgcctcccaggttcatgccatcctcctgcctcagcctcccgagtagctgggactacaggtgcccgccaccgtgcccggctaattttttatatttttggtagagatggggtttcaccatggtagccaggatggtctcgatctcctgacctcgtgatccacccgtctcggcctcccaa

SEQ ID NO: 40157 - DNA, 1024 bp, Homo sapiens
taaagacaagcctggaaagctcccagcttttagagatttggttaaaagcaagaggtgctagcaaagaaaatgagcaatgagtgaggctggagtgaaatcagaggagtgtgggtccttgaaatgtagagtggagaaagaacttagtttggtgaactgtgatgaatctgtggcaggttaggttaaaaaaaaaaaaaaaaaaaaaaaaaaaaaagtagatcattggtgaccacaataaaagccatttctgtggagtgatggggatgaacgtccagttggagtaagttgaggaaagaataagagatttaaaaagaggatgcaaaataggtttgagaatttcccagttatctattgctacctcaaaaaacacttaacacttagtagcttaaaacagtgactctgcagggatagtgtctgctccatgtggtattagctggggtagctcagaagctggggctggagtagctcagaagctggggctggagtcatctgaaggctcattcacccatgtctggtggttgagactggctttcagccagaacccctgcatgtgctctgggcttcctcacaacatggtggctgggttccaagggcaagttctgagaaagagagcctggtggaaacctatcacttttgatgacctagccctggaagtcacattgtgtcatttctgcagttatcttcaacaaggcagccagaaagtttcctccgggttgaagagaaagataatagactcctccctttgatgggaggaatgcgtgaagccagaatgatcgtcctgccattttctgaagatacatctgccacaaggggctttgttgtaaggggagcaaaatttaggacaatagctgggcaggggatgtgggcaggtcagtttacccagtaggcacagtgcctagggcccaatattttaaatttcttttaaaaccaaaataaaggccaagtgtggtggctcatgcctataatcccagcagttgggaggccaaggcaagaggatcacttgaacccaggagttcaagactgggaa

SEQ ID NO: 40158 - DNA, 1033 bp, Homo sapiens
aaagagcctgtgctccagactccaggtggacaggaggcctttgagaattcctcctccattgtcacaggaaggaagcctgaggcacagtaggtgtgttctgtccccatccctttccttgtaatgcttggagaggaaggaagagaggtgacaggtcacaggggaaggaggtcctagaagccgagcagccagggactttgtcagaccacacacccccattccccgtaggacacctggatttccaagaactcagatctccttctaaattctacacacctctctttctttatttttagagtcttcttcaagatcaaaagccgaaatgcacacatgaaaactcacaggcagcaggaggaacaacagaggcaaaaggctcagaaggcggcttttgcagctgagatggcagccacgattgagaggactacggggcccgtgggggcgccggggctgctgcccctggaccagctgagtctgatcaaacccatcaaggatgtggacatcctcgacgacgacgtcgtccagcagttgggaggtgtcatggaagaggctgaagttgtggacaccgatcttctcttggatgatcaagattcagtcttgcttcagggtgacgcagaactataaagccctgtgtgtcacttagagacagtgaaaacccacggcctccatcttcattaatcaggaaacctggactgcctgcttgttttgtaacccttttaaactacctgttttaaaagtggtcattttattcaggtttagaaaaaaaaatcctatttcttttccttttatttaaaaaaatttgtttttgtggggggttgggggaataaataattggcacaactatctttaagaggtgtttcatctgggctaccttctcatgaaatcattcccagtagggactgaagctgaccttcatgttccattgcattcagatgtcaaccatcccggttgccttttatcccaaagcttgctgtgagtgtgtgtgtgtgagacgcaggcgaccctcttagtactggggtcttggggccaacttttccca

SEQ ID NO: 40159 - DNA, 1030 bp, Homo sapiens
acacctgtccatctccaagccctcacccccaccatgccttctgcctgccctgctgttccccagctccaggagggctgactcctttccttcacttagatcttgctccaatggtgcatcctcagaagagtcttctaaaacaactgttctctctcctcttatcttacttggttttcttagcagttacaacctcagcaataacagtaccaactatgttccagacagtgttgttaaagcttttcgtgtgtgaatgcatttgatcctcacgttaaccttataaaagaagaagactgttactctgcagacaaagaaaccaagtcctaagggaggttaatgggatagctcggcactcggagttatctattcagtaaacgtttatggggtcctcattatggactaggctctgtgctaggatctggggatacagaagtcatcatctttgcattccagtcatcagcaaaccaacgttccaagaccagattgggtcaatgactcctctctgagaccccggacaaattgcctacacagatacctgtgctttattttacccatctgtaaaagggaattaaagggacaacccccagctcctcctctgggttggttcttgtgagatatatgggtgaaaccactttgggacatgcacagtggggcacagatgcaggatgtcactgggtatacttattctgggaccagggaacaacaagcacatccccttctcctacctggatgaaggaatggtggagaatcagccactattgacctctatcctggtggtattaagtttatcagattccccccacctcccgcccttacttgtgggcattgtataacatcagaggattcttagatgtctcaaggattctgactagaatctcaaaatcattttttggcctgctgctagaagagatactatgcttctacacctggccagtaggattatggcatttgaggcaacagtcccgtatgattggaagtggttggttatattgtttggaagaggtgaccacccaaaagtcccttgtctgttgatggc

SEQ ID NO: 40160 - DNA, 1048 bp, Homo sapiens
tggaagctggtacccctcatccgcttatctccacctcccttcaacccctcacctgcccctcaacctggccaatgagctgttataacacagcagtaatagtcccactagctttgggaagatcaccaaattcttcccccttcccaatcccttgcctcttacccagaactagttacataatttactgagctcagtgcaaatgaaaatgtgaggcctcttgattaaaaatcattaagactttcaagatggtgacaagagcaccttcagcaagcatggggtcctgtgagaccgcacgggctgcatgttcctaaagccagtgctgcccttgccacttccatcttaggttaccaggaccaaccatggagatgtatataacacaatttgagaggcactgaacattccctcggaaggaatttgagttatttctatcatggcctgtgagattcagggctgctatcctgagccactgtgcgtttggaaaatccgtacaactgggtagggagggtttggacagtgcccatgagtcctggtagaaggggcagagaaggatgatttataaatgttcatactgcccaagcagccccacggatgctgacagcatcatttgttctgtcctttacaaagtattttcatggataaatgaaatgtgttatatccatacaatggaatgttattcatccataaaagcagttggagtactgatacatgctacaacatggatgaaccttgaagacattatgctgagtgaaagaagccagtcacaaaaggccatatggtgtacaatcccatttataggaaatgtccggaatgggcaaatctgtagagatagaaagcagctgtcaggagaagagaggaaaagagagtgactgcgaatgggtacggggtttctttgggatgatgagaatgccctgaaataaagtagtcatagtagtagttgtaccaccttgtgactatcctaaaaatcagtgaattgtacactttaaaaaagagtgaagtttttggtatgctaattaaatttttatttttaggcctggcacagtggctcacgcct

SEQ ID NO: 40161 - DNA, 1218 bp, Homo sapiens
aatcctagcaaatcaggaggctgaggcaggagaatcgcttgaacctgcgagggggaggttgcggtgaaccgagatcacaccattgcactccagcctgggcaacaagaatgaaactccgtttcaaaaaaaaaattggccgggcacagtggctcacgcctgtaatcccaacactttgggaggccgaagcgggcagatcacgaggtcaggagattgagaccattctggctaacgcggtgaaaccccgtctctaataagaatacaaaaaaaaaaatttatctgggtgtggtggcacgcgcctgatatcccagctactcaggaggctgaggcaggagaatggtgtgaactcgggaggcagagcttgcactgagccgagatcgcgccactgcactccagcctgggtgacagagcgagactccatctcaaaaaaataaataaataaattttttaaaaaattaaaaaagacttttcgccatcttttgtctttctgtggagctgtcgccatgaaggtcgagctgtgcagttttagcgggtacaagatctaccccggacacgggaggcgctacgccaggaccgacgggaaggttttccagtttcttaatgcgaaatgcgagttggcgttcctttccaagaggaatcctcggcagataaactggactgtcctctacagaaggaagcacaaaaaggggcagtcggaagaaattcaaaagaaaagaacccgccgagcagtcaaattccagagggccattactggtgcatctcttgctgatataacggccaagaggaatcagaaacctgaagttagaaagactcgacgagaacaagctatcagggctgctaaggaagcaaaaaaggctaagcaagcatctaaaaagactgcaatggctgctgctaaggctggagtgcaatggcacgatctcggctcaccgcaacctctgcctcctgggttcaagcggttctcctgcctcagcctcccaagtggctgggattacaggcatgtgccaccatgcctggctggttttgtatttttagtagaggtgtggtttcttcatgggcaggctggtctcaaactcccgacctcaggtgatctgcctgcctcggcctcccaaagtgctgggattgcaggcgtgcaccaccacgcccagcctgagatttatatatttaagatgtgataaaatagtagtaatcaaaacttacatgtgaagaataggcttctacttc

SEQ ID NO: 40162 - DNA, 1045 bp, Homo sapiens
ggagcccctccaagagcatatcccaaccacgcactttccatctcctagatcccctcagtgtcctggcatgatgtgggtgggctgcaggaggtgaagaaggagatcctggagaccattcagctccccctggagcaccctgagctactgagcctgggcctgagacgctcaggccttctgctccatgggccccctggcaccggcaagacccttctggccaaggcagtagccactgagtgcagccttaccttcctcaggtggccagggggcctggaagggatggtgggtggatcaggggctgcagcaggctggggagcaggaggggctgcccaagaggtcaattgtgtgtatgtgcatctgacggctctcaccttctcacatcctctcactcagcgtgaaggggccagagctcattaacatgtatgtgggccaaagtgaggagaatgtgcgggaaggtgagtgagcagggaggggcagggcgtcccatgcttcccaaaccccgatggcccccaagccaccccctactcccaggctactcatgatcattcctaatcctcctttctacaagtcaggttcctgcccagctgggtctagtacctgggatgccagtgctgtattgtcaggccccagtttccctccctgctctcacctaacttcaaccccccacaagccgagctttgccctcctgtgggcccctctctctcttcagtgtttgccagggccagggctgcagctccatgcattatcttctttgatgaactggactctttggccccaagccgggggcgaagtggagattctggaggagtgatggacaggtaggggtctgagtgggaatgaaagctgaggggtccagggtgggaaggatatgagaaagctcacagcagtcttcagagtccagagatagaagttcctgctgtttcagttctgagataatataatggaagctgaaaggggccatgaaattgggcagggtccactgaggagaatgggggcctacctggtggggcacattgggcacagctgagtggagggccctgttgagact

SEQ ID NO: 40163 - DNA, 1063 bp, Homo sapiens
tgcaacctccgcctcccaggttcaagcgattctcctgtctcagcctcctactactggctcgcgccacgacgcccggctaatttttgtaatttttagtagagacggggtttcaccgtattggtcaggctggtctcgaactcctgacctcaggtgatccacccaaagtgttgggattacaggcgtgagccacctcacccggcctattgatccatattctgtaatcaaaatatcataagcctccataatgtagtggggcatacaaaaggctttcatccattcaggtgaaaggtgaagtttgggtgtggtggtgcatgcctgtaatcccagctacttgggaggctgaggcaggagaattgtttgaacctgggaggtggaggttgcagtgagcccagatcacaccactgcactccagcctggacgacagagcgaaattctgtgtaaaaaaaaaaaaaaaaaaaagtgaggtttcagatgtgtatgttaatctactcaatctaattagtttattgaattgctacaatgtattcagtattgtgctttataatatggaggatgatgtctctgtgcttttgctcattcttatccttgacttcaaattgtttcctattattctagcctcatctgttaaaatcctaccctcctttccctcaagagccatctaaagatgacacctttatcacaaagcctttcatgatctcacagccacgaatttagaacttcctcctatagcattttctatcttttttatggcatttattttattctatcttgttatgattacataatctgtttaatccccaattatatattgtaaataccttgaaggaaaggagtctttattatctttggtgcctggtgtttagttttaatattttattaaatacatccaaggaaagtttttggtttctgcctttacttcaagaagaaagttgtagaacagataatagttgttccatttccatgggttactgagtaaagactcaccagttcgccataacagacataagagtgacaaaaaaataaaccttcattgtgtaaaaaaaaaaaaggccaggcgcagtgg

SEQ ID NO: 40164 - DNA, 1031 bp, Homo sapiens
cccaaatccaggtgagaagctttgatttcaggcacagtccagccttctgtcaccagccaggaaggacatgaacctttctctccctcagggccatccattctagagggcagagagttggcctcatttctgagataacttaggggacagaagttcactaccctgagcccattgtgaggccatcctcacagccgtgactccttatatttctactgctgggttgggaccttggcttgtcaagactaagtagtcagcccccaccaccccaaaaacaaaaccaagcaaagaccacatacagattccatttataggaaatgtcccaaataggcaaatctataaagacagaaagtagatgagtggttgcctagggctgaggagactgaggatgactgctaaggggcataggggtttttttggggggaggtgtcaaaaatgttccaaaattgtaatagttgcacaattctgtaaatttactaaaaaacactgtataccttaaatgggtaaactgtatagttaagtgaactgtatctcaataaaacaaaaacaaaacccaaaaaccaacagctgaagctcagaggtttccagtatctccccttggtccctgttgaaggggaaaagcaacaatttgaaggcttagagtagccaacactgactgccttttaatggacattcacattttataaccacatcatctgagcccatttcccatgcttgggaaactccccgccacaaatctacacaaaagatagggctcacttcctaccctataaaagaccagatcctggttttcccagtgctataaagccatgtgaccaagacttagctaatcagagcaaagcaagaaagtagagaacacattttggtggctatgtgacactttcgtatcaacaccataattctgataggctttatcagccagaatccattatttgactttaaagtaggattgacatatgtgacaacagggaccctgcagcactgggtccctcacttcctcctgtcccagtagctacatccctagggttaaaatcacc

SEQ ID NO: 40165 - DNA, 1051 bp, Homo sapiens
aggcttggcccgggctgcatgcactgcaggcactacatggcggaccgtctcctgggcgtggtctcgagctggctggagggggccgtgctggagcagatcggtccctgcttccccaaccgcctcccccagcagatgttgcagagcctgagcacctctaaggagctgcagcgccagttccacgtctaccagctccagcagctggatcaggaactcctgaagctggaggatacagagaagaaaatacaggtgagtgccttggaagggataagcaaataagagggtagggggaagaggggcgtggagcagactggaggaggccatggcatctgggaaccctgtgctccttcaggtgggccttggggccagtggcaaggagcacaagagcgagaaggaagaggaagctggggcagcagcagtggtggatgtggcggagggagaggaggaagaggaggagaatgaggacctctactatgaaggggcaatgccagaagtgtctgtgcttgtcctgtcccgacactcctggcctgttgcctcaatctgccacacactgaaccccagaacctgcctgccctcctacctgaggggcactttgaacagatactccaacttctacaacaagagtgagcagccaggcagagggactggggactggggagagggtgggctgctaggaaaggacctggggttgggggcagaccctgatgttgggaggcttgatgtaaaaagagatagtctttggctgggcacagtgctcacgcctgtaatcccagcactttgggaggccgaggcaggcagatcacttgaggtcaggagttcaagaccagccttggccaacatggtgaaacctcgtctctgctaaaaatacagaaattagccgggtgtggtggtgtgtgcctgtagtcccagctactcgggaggctgaggcaggagaatcacttcaacccacaggcagatgttgcagtgagccgagatcgtgccactgcactctagcctgggcgacagcgagactccatctcaaaaaaaaaaaaaaaaaaaaaaaagagttggtctt

SEQ ID NO: 40166 - DNA, 1048 bp, Homo sapiens
tgtcgcccaggctggagtgcagttgcgtgatctcggctcactgcaacctcgacctcccgggttcaagtgattctcttgcctcagcctcccgagtagctgggactacaggcacgcgtcaccacacccggctactttttgtatttttagtagagacggtgtttcaccatattggtcaggctggtttcgaactcctgacctcaggtgatctgcccgcctcggcctcccaaagtgctgggattacagacaggagccaccgcccagggcctgcctcccctttttctgtgaagacatcagcactcttttagacctggctgaccccagttctcactattaccctctctcacatttttgttttgttgatacaagggcctctctgtcgcccaggctggagtgcagtggtgcgatcatagctcactgcagcctcggcttcctaaactcatgatcctccagcctcagcctcctattagcaaggactgcaggggcacgacaccatgcctggctcaaaatttttctgtagagattgggagtctcactatgttgcccagtctggtcccgacctcctagcctcaagtgatcctcccgcctcaggcctcccgaagtgctgggactatagatgtgagcccccatgctggcctcatattctctttcaggccattattgtgttctgctcctggctgctgggtttttctttctctttctatttatttagttatttatttggaaacagtcttgttctattacccatgctggagtgcagtggcaaaatctcagctcactgctaacctctgcctcccgggcttgagcaatcctcccacctcagcctcccaagtagctgggactacaggtgtgtgccgccatacctggttaagttttgtattttttatagggacgggattttgccatgttggccaggctggtcttgaactcctgagcccaagtgatctgcctgcctcagcctcccaaagtgttgggattacagacatgagccgctgagtctggctggatttctctaaagcatatttgatgtgctggtctggaatcttgcaga

SEQ ID NO: 40167 - DNA, 1039 bp, Homo sapiens
cttctacttctcctttgaacagcagtgcatcccaagaggagttgcatcaagatgagggtttggtcgctgctcctatagttagcaactctgaaaagcccattgcaaaaactctggtggccctagggaaatggtcagttgtagaacatgtaggcccaaaaagcacaggcagcacctatggcttcctacagcctctgacaaggttgtgccaaagcaggccttatgaaacaattaccccaaagacagacactttggccatatggacctctagttccttccagagtgacactagtagggatatatctccagagaagagtgagcttgacctgggagagccaggaccacctggtgtagaaccacctcctcaactgttagatatacagtgcaaagaatctcagaagttggtagaaatccacctcagagaatctgttaaccaggataaggaaagccaagagctccgtaaatctgaggattgtagagaaagtgagatagagacaaacactgaactaaaagaaagggtaaaggagctgtctgaggggatagttgatgagggagtaagtaccagcattggaccccacagcatagatgattctaatttgaaccatggaaacagatacatgtgggagggagaagtaaaacagcccaacttgctaatgattgacaaagaggctgaacagtccaataaattgatgacaggaagtgaaactccaagtaaagtagtgatcaaattgagtccacaggcttgctctttcacaaaggcaaaattagactcatttttatcagaagctaggtctttactcaacccacaagatacacctgtgaaaatttctgccccagagttgctgcttcattccccagccagatcagctatgtgtttaacaggtagtccacaagagcaaggagtttcagttgttagtgaggaggggctagagaattcagctccagaatcagcttctagaacttctaggtacagaagtctcaaactcaagagagaaagatcaaaagactttcaagttaaaaagatctatgagttggctgtttg

SEQ ID NO: 40168 - DNA, 1070 bp, Homo sapiens
agccacgtgtggaggctcacgcctgtaatcccagcagtttgggaggctgaggcgggcagatcacctgagatcaggagttcgagaccagcctggccaacatgtgaaaccccatctctactaaaaaaatgcaaaaagtcagccagcatggtggtgcacacctgtaatcccagctacttaaggaggttgaggcacaagaatcacttgaaccagggaggtagaggttgcagtcagccgagatcatgccactgcactccagcctgggtgacagagcaagactctgtcttaaacaaaacaggctgggcgcggtggctcatgcctgtaatcccagcactttgggaggccaaggcgggctgatcactaggtcaggagatcaagaccatcctggctaacatggtgaaaccctgtctctactaaaaaatcagaaaaaaaaaaaaaaaaaaattagccgggtgtgatggctggtgcctataggcccagttactcgggagactgaggcaggagaatggcgtgaacctgagaggcggagcttgcagtgagccgagattgcatcactgcattccagcctgggtgacagagcgagactccatctcaaaacaaaacaaaaaaatcccattgatctggactggtgtttctcaaactttaaagtacagacaaatcacctggagatcttgttaaaatgcagattctagttcagatctgcttggggtggagctttgagaagctatatttctaaaaagttcccaggtaatgctaatgctgtttcgtccgcactacactttcagtagcaaagagctagaatttagcttgtgtggagttgtgtaacttccatgatattctgcatgccctaagtctagtcggagaaattacccaagagatctatctagatatgttggtaatattacctcttggttagaggctaaagctgcttgttcccctggggaaagggagaggaaatgttcttggacttcatgattatagtcttttgccctaagcattttatagcccccttgacaaacaccagtctcttagccttgtctgctcttattctttccaagtccatttgttcaatg

SEQ ID NO: 40169 - DNA, 1107 bp, Homo sapiens
cccaaaggagaagaaagtggtcagagagagtctgattagggtcgctgctttccttgtccttccttttctgcactcctgtggaacttggccccctggttttctgcagtggagaagatgaggctgcagatgaaaacccagagtctcaagagatgctggaggagcaactggtgaggatgttaacccgagaagtcatggacctaatcagtaagtggcatgtcgaaactggggctatagaggattttcctggaagaagagctggtcgctcagccaactccatgaaggcctgactaatgcaaaggattcatgtttgcggcgggcatggtggattgcgaggtcaaaagatcaagaccatcctggccaacatggtgaaaccctgtctctactaataatacaaaaattagctgggcgtagtggcgcgcaggcctgtagtcccagctactcaggaggctgaggtaggagaatcgcttgaacccgggaggcggaggctgcagtgagccgaaatcacgccactgcactccagcctggcaaaagagtgaaactccgtctcaaaaaaaaagttcatgtttgtagcaacactgacagatccaaaagaaataactagatagaagcaaggcagtccttaagtcaacctaaggatactttatgaattgcaagctgaatatggggaaacaaaaatagcagaaggaatttggattcattaggaataacttcctagttttgtcaaaatagggaaatgttttaaattcttggacatggaggctgttaattttctttttatttttactgtgtcattttgtttgtttgagattcaaagtagaccagggatgtatcaagcatcctttcctagtcactcactctcagagaattctgtaattttctctcagctagttgaacttgaaggaccaaaacagttcggtcatcagaatgcctctatttctattggtgaagctaattcttgtgccttggacggtacccccatcttcctccttcctcacctggccagagacaggttgggatcagtgggcctgaggtggctgttgtggtagtatatacccacccttcacctagtaaccctgctttcttgctttagcggtttgctgtgtttca

SEQ ID NO: 40170 - DNA, 1048 bp, Homo sapiens
ttaacacttcattctcattcagacccttattaatagttgaatctctttctttcttttctttttttttttttttgagacggagtcttgctctgttgcccaggctggagtgcagtggcgtgatctcggctcactgcaagcttcgcctcccaggttcacaccattctcttgccttagcttctcgagtagctgggactacaggcgctcgcccccatgcccgactaattttttttttttttttttttttttttagtagagacggggtttcaccatgttagccaggatggtctcgctctcttgaccccgtgatccactcgccttggcctcccaaagtgctgggattacaggtgtgagccaccgcagccagcaaatctttcttacctgaaattataaggagaatggtgaaggagagtttgttacaaggatgtcctccttcctatttttttattcctactttttgggccagtgaccataatgtgcagcctgacggaaatgcagctaaactaagagtataatggaattcaatatcagtgccatttaggattttaggaaaagaactttaagattttttcactgttaacacaggatatttttgacatctggcaaatcctttagggattgattctgcccaggggtgcaacccaccacctggcaggtgagagatgtgtgcctatgcactaaaatttcttaacttgttgcagcacgtgtctttgtaaagcctctggtgctcttctgtcccccagagcactatgaagccctggtatcccccatcctcggacctcttttcacctacctccatatggtaagagataagtcaggaacaggaagcaaagagtactattaaggcctctggccatttctgagctttgcaagtcaggagctcctagaagtgttgtctactagccctgccagactggctgggcagagcttctaccccagctgactatccttgctgtaggatcgagcagcccccaaagaactaaactgatttaattgccacaagacagcttcagttgcagattctgctcctaacctcctgttaactgaggag

SEQ ID NO: 40171 - DNA, 1059 bp, Homo sapiens
tggtggtcaaaaaactcctgggaccacctcagatttaaaagaattttgctttctagctttggactctgatactgtcctgtgtcttggggtttagttctcatgttaatttatcttaggtattgtatactaagataattatatctatacaagtctgttccctcctccagcgagcattcagatatttataccttcttttctttcccctgccaggagttgatgggcagatctgtgtgaaactgtagtatcactggattacaagcaaaacccactctttccttctgcatcagatggaaaagctcaatagcattcttgtttctttcagaacccacaatacattatatgcaccagaaatgctagccaaaatggcagagcctttcaccaaggctctggatatgcttgacgcggaaaaatctgctatattaggtaagaaatgtaaccttttttctcctaaggtttatcttatccctaatggatgtccccttttttgttgttttttaagagtcatagtctctgtcacccaggctagagtgcactggtgcaaccatagctcactgtaggctcaaactcttggactcaagcagtcttcctgcctcagcctcccgagtagttggaccacaggcagatcacaacgccagacgaactttaaaatttttttgttgagacagagtcttgctatgttgcccaggctggtcttgaactcttatcatcaagcagtcctcccaccatggcctttaaagcactagaatcctagtgattacaggcgttcttatgggttccttgagcagcttcagcctatcttgtgcttcttccatcttgtcttgcactgccttgaccatctatttgttcagaaatgcagaatgtggagttcctataagctctatatgaacaagtgtatttacttcattatcttagcatacagagaaaatcgaaggcaatttattttttttccccgttaaccccttcttcaatttagccagtaggttgtggtgggtgttacagccattcaattataaataaatcatggcctttaacctgaaggatatttgtatactttcctgc

SEQ ID NO: 40172 - DNA, 1049 bp, Homo sapiens
ttcaagtctagtctgggcaacatagcaagatctcatctctaaaacaaataaacatgagtgaccttttttcctcctctcccttagctattttcatctgtcacttttgaaactgttgaagaaagtaaggtaagaccattaattaaaccaatagattctaacttcttgagtacaaatgtatgaatacctgatactcagtttatatttttatataaatgggagggggtagtaagggtggtagattatcatatatgttgttttgccactatagggcatacaagaaacatggattcttggtggctataaatgttactccattatactcttagggttgtgaaaaatcattgtgaatttgcccctgactgagatattcacatgagtctatgcagcacctgtatattatattaaaagcagctccgagtttgttgaatgtctcttttcaggcccccagaacccgggcagtgaggaatgtgaggaggcatgcttgttcctccatcatcaagatgtgtcgtgactacccccagcttgtgctggtaagctgctggaccctggctgaagtagccaagtttggttacatttgtgtgtaaatccagctttcagtgtacctcacataaagaaaaaactagaaactatagctttgcatcatataagcatccttggccgggcatggtggctcacacctgtaatcccaacactttgggagactgaggtgggtagatcacctgaggccaggggttcgggaccagcctggacaacatggtgaagtccggtctctactaaaagtacaaaaaaattagctgggcatggtggtgcatgcctgtaatcccagctagtcaggaggctgaggcaggagaatcacttgaactcaggaggcggaggttgcagtgagccaagatcacgccattgctccagcctgggcaacgagcgaaactccatctcaaaaataaataaataaacattcttgaattggtgttttcttagtatacttagtagtatagttagaaatgtgatggcaaatgtaatctctcttcaaaatacaaatagttctctgc

SEQ ID NO: 40173 - DNA, 1025 bp, Homo sapiens
cttgtgccttgctatttgagtgctgtgctgtggtaatagttgtaaacttgaaggatggcacccttctctagacatagcccttaaggctgtcatgaggctattggatgtgaagcagtattttgtatattacattgtttccttattgggaagattctttatggtctcaattttaattatttagattctcatggaaaagattataaagggggaggaggggagaaactaattcatgtttatcaagtgcctactaatgggccaggcaatgtttttgatgttcacctgcgtattctcattcattactcaaaatggttttactacaaggctcatagaggtgaattcagaccgctcattgttagaggaggaggaggcatggtaggaaccttcacctacctcattgctttcagcacacatcatcttttctttgccccagctgagaggggttagattaccctgctccttcaatcatgaaattctcaggtgttctctaaggctccattgtctctctgtgtcttctgcgatctttcaatgctgataattgtgtgtgtgtgtgtgtgtgtgtatgtgtgtgtgtgtgttttaaagcttgttctgcagttggaactggagaaggaagcctctgttccgtcttctcaccttcattcgtgcagtgggaagccatgactctttttttggaaagtgttatcacccagatgtttcgaacactaaatagagaagtaagtaattatttcccatgctgactgcatgattattttgacctttttcttttcttttctctttctattttgggacgctatatctctctgttgctcaggctgaaatgcagtggcacaatcatagctctctgtaacctccaactcctgggctcaagcaatcctcctacctcaggctcctgaggatctagaactacagttacttgccaccacacctggctaatttataataaaaatggagtctgtgttgcccaggctgatctcaaactcctggcctcaagcgaccctcctgccttggcctcccaaagtgctgag

SEQ ID NO: 40174 - DNA, 1016 bp, Homo sapiens
tgtcccaggtggtttagtactaaagttataaagatttttgaaacaaaagtctgattaattgtattataaaattaatttcactctgttcaaaattgtccttctaatatcactctgagattccagtatccttttttgcaaagaagagaaagtagtaaaattcagctcacattccaggtaatttccttgatccacagcctgtcttactaacatgtggtccatagtgggtggtcattactgataaattgcagtagagacagcttcaaagtattgtacagatttatttctatgaaaaaatgtagttgataactgctaagtaataatctgggttatatagaatccaaatcctttgacgttttcttttttttttctctttagtttctacgctcttcaactcagatgacttggggagccctcttcaggcatgaaatcctgtcccgtgatcctttgctattagcaataataccaaaatatcttcgtgcttccatgactaacttggtcaaggtatataatgggaatctaaacatgtggaatgtaggtgaatacacataataagactttgaggctgggtgcggtggctcacgcctataatcccagctctatggaaggctgaggcgggaggatcgcttgagcccaggagttggagaccagcctgtgcgacatggcaaaacctcgtctctactaaaaatacaaaaaaattagcagggcatgttggtatgcacctgtagacccagctactggggaggcttaaggtgggaggatcacctgagcttgggaagttgaagctgcattgagctgagatcgcagcactgcactccagcctaggcaatgagagtgagaccctgtctcgggggaaacataaaaaagactgattggcattattaacagcccttcttcatcactaagattcctttactggacatattttcttattccttaggaagaaatcagtccttactggttattataactgctcttccatatgagagtacttaatatatcataagtattgggctagg

SEQ ID NO: 40175 - DNA, 1028 bp, Homo sapiens
ctcaaactcctgacctcaggtggtctacccaccttgctctcccaaagtgctgagattataggtgtgagccaccgagcccagccctaggtgttattcttaattttattttcagaagttctttaggaaaatactaattttttttttttttttggagagggagtctcactctgtcacccatgctggagtgcagtggcacaatctcggctcactgcaacctccgcctcctgggttcaagcgattctcctgcctcagcctcccgggtagctgagattaccggtgcctgccaccatgcccgtctaatttttgtattttagtagagatggtgtttcaccatgttggtcaggctggtcttgaactcctgacctcaaataatccgcctgccttggtcttccaaagtgctgggatggtaggcgtgagccaccgcgcctggcctaattttgtatgcttgtaagttaacattatgtgcctttgtatggatttgaaatataaggataaaaatcaaccatatttgtatattcactgaatagccactattctgatgtatttaacatcatatatatatgtatttttttttgttgtttttttttttttgagacggagtttcacttttgttgcccaggctggagtgcagtagtgcaatcttggttcactgcaacctctgcctcccgggttcgagtgattcttctgcctcagcttcccaagtagctgggattacaggcatgcgccagcacaccggctaatttttgtaattttagtagagatggggtttcaccatgttggccagactggtctcaaactcctgacctcaggtgatccacctgccttggcctcccagactgctgggattacaggcgtgagccaccacgcctggccaacatccagtatttttgagtacatggttttcatatacttaggctatacatacatgttcatgaattgtattcatttaattatgcttctgactttacttgttctccctaggggaatatcagttatgcgtgcttagtaaagttgtgttattttccaag

SEQ ID NO: 40176 - DNA, 1035 bp, Homo sapiens
tttagagacaaaaggtaatctggtcccatatttttcaagtttacatagcctaaattactcttggaacaatgagggccacttgaccaaaccttagtccctgctcctgtttccatgttcatactacttgattttgacattttatgggtaaataggggccaaagtcaactgtaaatagaaactgcattttgaggagaccctggaaaagaaatatgtgacccaaagtcctatgtggcattctgcctctagagtattaaagtgatagcttccctaccactcaggctgttttataaaatgtaactggtttaacttgctactaacaagcctgtagttgaacaacttcctcctgtattaggggctaagctgtttacttcctctctatagctgctgatagagatgaaagctttgtccacaatttacttatcttttgcctgtattgtaaagaaaattttggaaaatcacatttcagtacttaataagacatctccaggaactagtgagcctctctgcaacattaatggaacatttagggggataaaaagtatataaggcagactcccaaggagtttatacatgtttatgatcccaattgtggtaatcagatctaaaattcttcactatatacattcatccaatgagtatcagcacctatcatgtgcaaagcactatgaagaatctttgcctttaagaagctacatagctagttagggggaaaaggccacgtatacagtgaatgtagtcttttttttttttttttttttttttttttttgagacagggtctcagactgtcacccaggctggagtgcagcggcacaatcatggcttattgcagccccaaactcccagattcaggtgatcctcccaacctcagcctcctgagtaggtacgactacaggcataagccaccatctttgtattttttgtaaagactgttttgccatgtggcttaggccggttttgaactccagggctccagtagtccacccacctcagcctcccaaagtgttaggattacaagcatcagccaccgtgactg

SEQ ID NO: 40177 - DNA, 1048 bp, Homo sapiens
cgagagcgagaagtggattatgatagcgacatgccccggaagatcaccgaggtgctagtacgaaaggtccctgacaaccaacaggtgagcacacacccatccctgtctctcatgtccacactgtggaagggccctgtggtggcaggctgtctcctggcctgggatcctgggggcttccagttcatcacttgctccctagggagcgtcactgcccttgacccagtcttcagttagaggggtgagagattggagttcttatctctggcaattcatccacagttcctagacctccgtgtggccgtcctggggaatgtggactctgggaagtcaactctgcttggagtcctgacccagggagagctggacaatgggcggggccgggctcggctcaaccttttccgccacctgcatgagattcagtctggccgaacctccagcatcagcttcgagatcctgggctttaacagcaagggagaggtgcatgggatcaatgggacccaatggggccagactctgaggatgggatggtagtagtgaaggacataggatgggggtagagtgtggagactttttgaaatagtatagatgaatgccctgaggggactgtgaacaagctctgcccctcttaggaaatcaatggggaatcaactaaattaaataaaaaatggggtcaagattaagaggcagggtcacccagggaatggtttaggtcctggcaactctgaaggggttggaagggctggcaggaggcactgagggccctgggccctgggccaggtggtgaattacagcgactcacggacagcagaagagatctgtgagagcagctccaagatgatcaccttcatcgacctggcaggccaccataagtacctacacaccaccatctttggcctcacatcatactgccccgactgcgccctgctcctcgtcagtgccaacactgggattggtacgaggcattagggcagggacagggctgaaggggggtgctgactctcctaccctgggcctcaaatcttggagacagaccaatgctcctcttctt

SEQ ID NO: 40178 - DNA, 1033 bp, Homo sapiens
gaggctctaaattccccccaagtcctagaaaaagaacatagcgcgaggactggaagtcagactacagctcccttaagcctttgcgcgccaaggcgcgctccttccccacgcctccgacgactcccgcggccacttgcgccgcgatgcctcctgggagttgtagggcggcgacgtgtcatttaagtgaattcccaggcctggggactctatatcccgtggtgccccgcggctgtttctgacgcgacccggaggccagggaggtggggggcgtagcttgtgcagagccccaccccactctgctcaggccggccggacacggcagtggcagtaagggcggcggcgacggcggcggcggtcgggggaggggccgggcggggggctggcggcagcggcggatggactcgcgggtatcggagctgttcggcggctgctgccggcccggagggggcccggccgtgggcggaaccctcaaggctaggggggccggcagcagcagcggctgcggggggccaaagggaaagaagaagaacggaaggaacagagggggcaaagccaacaaccccccgtatttgccccccgaggtgagcacctgagaagtggtagggcgggaagaagccactctttccggcccaggactctagggaggcgggacccagataattaatctccccttccggtgtcgagaccccagggaggaggggcacgggaggagaacacctctttcaggtcccgggaccccagggaggaagggcagagactggactctcaggtgacaggacctcagggaggaagagtggagagggaggactcccccttctgatctagattaccccaggagagaagtagagaaaggggatcccaggaagagcaccccgaccaactgcgtgtgccgccatagggcaagagagactgcatcctgggacgagaggcagacagtaaccaccacttcttctaaacttgttccacagggagaaggggagtacccgggaaaagagcaatatgttccacacggacacacacacagtactcggga

SEQ ID NO: 40179 - DNA, 1059 bp, Homo sapiens
ttcagaatctggaaccagacggaggtggagttaagaagataggacagaacaggcaggccaagttcactgaagcttaagaaaatcatgtttagactctgtttaaaaacatccaggctggctcccattctatagcatgaagggcaagtccatgttcttctcgccagtgcccacgtagacgtagccatagttcttggtgcggggagcatggtagaaggtgaggcccggccagagcaggctgcgcagcaccaccagggcattgcccctctccatctggatgctccaggaccctgagataagacaggcaggaggtgaggcctggtgctgctggagccacagctctgcccttcatgctgtggcccctggctccttgggcagccaggcccaggtgctatggttccactggggagagaccatttaattctccagatgctttactccctgattgtcttttagccattattcttttcgttttaagagacatggtctcactctgtcacccaggctggaatgcagtggcgcaatcacaactcaatgcagtcttgactcctgggctcaagcaatcctcccaccttagcctccagagtagctgggaccatgggcatgcaccaccatacccagctaacttttctgattttttgtagagatggggcctcactgtgttgcccaggctggtctcaaactcccgggctcaggcgatcctcccaccttggcctcccaaagtgctgggattacagatgtgagccaccacgcccagcccttttagccatctcactgctcattaaaaccactttcagagggagggcaaaggaaatgaaaagaggcgaaactcaaaccagtctgttttgttcctgtcagcaagtctagctaaaggttgagtgggggaggaggctgaatccaatccacaggcagaggggagttgggctgggccaagggagacaccagctcctcccacactatacctagtgcagtcaccagttctagtgtggtttgccactacttgccattttgctgtgtcttccccatttcctgaagcctctcctgagttggattagaccagac

SEQ ID NO: 40180 - DNA, 1020 bp, Homo sapiens
tcctttgacctgtcccaggcagcctggtgggcatgtgatggtccgaaggaggcccaagaatccactcagatctggtcacagggggcctagatcatgtgagattaaacttcacaaccctggttccttcctccttggcttttatgccttcctcgcacttcagagggaatggcaggaggtggaggggctgtttgcatatactctggcttgtggtatatagactttgaggtctaaaatgttacaggtttttcctcttgtgtggaaacatatggcatgtctcctaaccctatctgagcagacattttgtccaagaaagatgcttcaggtacataaaagattggtgacccttcttgaagagtttctgttctctaacctagtctatcagaagatgatctcaggaggctgggtgtaggggcgcacacctgcaatcccagaactctgggaggccgaggcaggcagattgcttgagcccaggagttcaagaccaacctgggcaacatagcgagaccccatctctacaaaaattagccaggcatggtggcacgcacctatagtcccagctactcaggaggctgaggtgggaggatcacttgagcaagagattgggaggcagagattgcagtgacccgagattgcgccactgcactccagcctgggcaacagagtgagcccttgcctcaaaaaaaaaaaaatctcatagagaagctgggagctcttggggttgataatggggtacagaaaatcttactaagttgggattaacctttgttgggtgaaggtagcagacccatgtgcaaagctctgtgtggaggaagtgatctcagctaggttcccaggagatatcagcctcccctgtagaccatgaagccctagcttcccggcatcaaaagcaagcccagctgaccctcatcccctattttcggtttccactaggatgttctgctgcttagccagttcatccggcctcatggaggcatgctgccccgaaagatcacaggcctatgccaggaagaacaccgcaag

SEQ ID NO: 40181 - DNA, 1115 bp, Homo sapiens
tcaaacagcaatttcaatagagtggcaaacaaggaatccagtttggagaaatgaaagagatagttgatgaagagatggaaatagtaagtatgtttgaagaatttagcccgtaagggaagtggagcatttgctagaaaaaaaagtctggatattgcctgattaacttatccattagtagacccattaataaagacactaaagaaatcatgcagatgatagagaggacttggatgtttcatttgttcccatgctgcaaaataggcatatctccataccattttggggagtctaccaagtgtcaaacactattggctacaatttgcatattcttatgaaattcaaagttgaggcagattttgctatgcttccagaaaaaaaggcaagaggaatcgttttgttttaacaacaaatatttgaagttagacttaattttttcctttggagagtttgtgaaatgatggactgtaagccaggtacagtggtacatatctttaatcccagcactttggaaggccaaggtgggaggatcacttgagcccagaaattggagtctaacctgggcaacgtagtgagaacgcccacctctttaaaaaaagtaaaaaaggatggactgtaaatcaaatgggtctctgaagtccttcatctaaatgttaggttgaattaatatgattctacatgaaggcactaccatattctatattcttaagaatcacctatcttcaaagcttgtaaatgaaaacattttcttttgctagtctatgcattatgtgtaaggcataaagtattatacatatagctaattttgactagtctcagctggtatatgtgacacccaaacaatattgtacacatagaatttaaagttgtgggaaagaagctggttctcttgctgaaaatattcaggcatcctacttttcaaagtatcagataataatacataattttagtcagctcttgaggactgagcaccaattttcctgtctatgaagactttcagtctaaaacagtgattttcaactggggggcaattttgtcccccagtaacaattggccatgtctgcagacatttttggttgtcacaactggtactactggcatctggggggtagaggcga

SEQ ID NO: 40182 - DNA, 1027 bp, Homo sapiens
gctgttgtgggccattctccctctccaaccccagagttagaatgtgaatcagcaaaatcggagctacagctctgtctaatcatctgtgtatcctttaaccactaagatttatattttgtgactaatgatcttgtgctggaagtgccatctcccacacaagtccccaaagaaaactggctttaagggctctgacttagaaaccaatttttccccctctcgtttttcctgcaggatctatcttgggatcccatggctttctttactgggctctggggccccttcacctgtgtaagcagagtgctgagccatcactgtttcaggtaacttttcccattaagttcttaaaactgtgtctttgtgtaagcttcctatcagggctgggtattacggtgactagaacaggagtaaaaactcagggaggtgggcatggggttggggaaagctaaagtgatcaggctgagctggcctggttggtctggtcacaggatgggggataggtaaagaggtgatgttgctgttagaagtgtgatggggaatggcatatggcggaagcttttactcttcagtccttgcaagactcttacagtgaatctgacatctctcaaccctatcattcccctagagcattaaaatccttttaaaaacggaatttttttaattacaaaaataatacatgcttattaccaagaacttgagcatgatagaagtgtgacaccctcccctccttgtagatgctaagccaggagagcacaggaggcacgcttgttggcagacatgcctcctggccccgtcatgccctcatcccacaggcatttcctgagcaccgcacctggggttggccatacagagatgaaagagagttgctttctgtcctgaaagaattctcactgtcagccacaggagcaaacttgaaaataagtaactctaagaaaatgtgatagaatattataatagaggattgtacagtgctttggaaggcgtcatataggagctgctagtggaggaagaggaggagaaagagtggagg

SEQ ID NO: 40183 - DNA, 1022 bp, Homo sapiens
ctgtttaccaatgaaggagaatttcttacatccccactttctgctcatcctagccagtttagaaaactctttttattccttagatattggtgttattttattctgctcttgtatttaagtacatctttatatgtaaatatttcaaaaaatataaagggccatggaaaggtattcaaatttattgaaaccattcctatgaggagggctaaaggctgatcccttcctgtggtctctacacatagaaaaatccccaagtccttgatgcttatttccagaattccatcacatgaattaaattcagtgtccatcacgtacaccatctgtcagaggtcacagccatgtcattagaccttgagctcccaaaaaagagagaacttggtctatgggtgggttcctactagcaaatcttgaacaaaccagaagctttatcagaaaccgctagataaaccagtagcttattatgaatgctaatatgactataactgagaaaactgaaagctataaatggtggcttcatagcatctatatatgtttgtacatacaaggtacatttatagatagatagatagatagatagatagatagatagatagatagatagatgtatataaaaccaaaagcaaaataagcccagcttccctggattctgactgacaatgaacaaaataattgaaaaaagaaagttcagtatttcagtcataaacttccaagactcctttctatttgagaatgtttttgtcttgctaaccacagagaacagttggagtgagtggatcattttattttgattgcttctcctgcactggccctgagggacagacttgatgatctaataagtcttttccatctctaatatctataattttggctattctgtggcagcttcttattgctttaaataagccatcttaattcaaaaaacatacatctggatttgacctgcctaatatatgtcaagaagagtgtgtccctttaaagccccaccagggaatttctgagagactaaagaaactgaaaggaag

SEQ ID NO: 40184 - DNA, 1095 bp, Homo sapiens
ctgcccaaacagctgcccagttttgtgcttgaaacccagggccctggtgatgtaggtacccaagggaatctcttggtctgagggttgcgaagaccctaggaaaagcatagttatctgggctggaatgcatcattcctcacagcatggtccctcacggcttcccttggctaagggagggagttccctgaccccttgctattcctggtgagggaacgccccaccctgcttcggcttgccctccgtgggctgcacccactgtctaaccagtcccaatgagataagctgggtacctcagctggaaatgcagaaatcacccgccttcttcattaatctcactgggagctgtagaccagagtggttcctattcagccatcttgccatccacacccgagagcagctataccattttatattactacgagcaatgcgtaagtgttccagtttctccacaacctaaccaatggatgaaatatttttaagcaagggattcacacacatacacagtaacttcaacacgatcttctatttctcaaaactctcattagtttaaaaaaaaaaaggctttagtgcaagcccaaatatctccaaaaaaaggcctatctcacgatttatgataggagattagaaacatacccacaaatggcacgttgtttttaaaagagtttaggttccattaaacgttacaaatacatgtatcttctcatcataagcatcacatttgatgatggactttgcttcaaacagtgtcaaaatcagtaatgcatcacattttagaaaacaatttcaaataaaaccttgttacaacactgctctatattactttatcactatttaggatcatacctaattgtttacaacagcatatgaattacttaggatttgttagacttaaaagcaaaatgctggcagctagggttcagtgtttggcccatgttagcattctgtcctggaaggactcctttagttgggtgtcaaaatagctttaatgcttcaccaaatgaagaaacggcatatcatacattttatattaaattccttttagacatactaaggaatttacaaacaggatcaggttccaggatggaaagcacatca

SEQ ID NO: 40185 - DNA, 1049 bp, Homo sapiens
taatctagaagcaattaaaagatagcaaagggaaacatgatttttgagaaataacctaaaatggtaactaaaagtaatgaataagattacataaaggaaaatgtatctgatacaaggagaaaatgccctaatcatgaagtctgcattatttcctcaaaaagaagcggtagctgcttctctcttcaaagtttttgtttttaaaatagactggacagatcacctgagagccatcgtggttgatgacactatttacatacatgtgtgtgtgtatatcttttcccccatgtccaacctggtacttatgtattactacttttacaatctaagactgttagtattagtatatgataaaaatgcactttaagctagcttcaggtattgcctaagctaatttggatctaataaacataaagaatgggctttttaaaactgatgacacaattttaaaatgcttaatttaaatacatctagaaaataaaacaagccatgacctggaaggttcagttagccgctagtagaacaatcaaacaaaatcaacaacaaatggtaacaaactccaccccagaggggcacccaaggtgttattattcctcaggaggggaccaccacctggaaaggtctcctccattttcttcagctatgagaatttgcgcactacaagagtgaatatgcctgcactttttttttttttttttttttttgagacggagtctcactctgtttgcccaggctggagtgcattggtacgatctcagctcactgcaacttctacctcccaggttcgagcagttctccctacctcagcctcctgagtagctgtgattacaggcacctgccaccatgcccaactaatttttgtaataatttttttttctttttttttttgagacggagtctcactctgtcacccaggctggaatgcagtggcgcgaactcggctcactgcaagctccgcctcccggattcacgccattctcctatctcagcctcctgagtagctgggactacaggcacccgccatcacgcctggctaattttgtgtgtgtttt

SEQ ID NO: 40186 - DNA, 1026 bp, Homo sapiens
atattggacttaaattggactttagaccaaaaggacttcaacaatcatttacagaacattctacccaacaactgcagaatatgcattcttcttatgagcacatggaacatttgccaagatagatatcacatgttaggccactaaacaagtcttaagagatttttaaaatcaagtatcttctcagaccacagtggaataaatctgtaaccagtaacaagaggagcttcagaaagcataaaaatacatggaaattaaacaatatcctctggaatgatcatgggattaatgaagaaattaagacacattaaaagattttttgaaacaaatgaaaatggaaacacaacgcactgaaacctgtggtatacagcaaaagcattgcaaaagggaagtttgtagcattaaatgcctatatatcaaaaaagcagaaagatcccaaattgatgacctatcattctgtctcaaggaattagaaaagcaagaaaataccaaacccagaattatcagaagaaataacaaagacctgagcagcactaaataaaaataaagacaaaaaaaaatacaaaagatcaaggaaattaaaagttggttcttcaaaaagataaacaaaattggtaaattgctagcaagactaactaggaagagagaggatccaaataaacaaaaccagaattgaacaagagatattacaactgataccacaaacatacaaaagattgtcacagactattatgagcaactatacactcacaaagtagaaaacctggaagaaatggataaattcctggaaacatacaacctcccaatattgaacccagaagaaatagaaatcctgaatagaccaataacaagtaccaagattgaatcagtaatttaaaaatctcccaacaaaaaagaattcaggaccagatggattcacagccaaatgtgtacaaagaagaattaataccagtcctcctgaacctgccccaaaaaattaaggagtagggaattctccataaataattctatgaggtcattaccatcctg

SEQ ID NO: 40187 - DNA, 1024 bp, Homo sapiens
ttcgacaatgcccttgagaacaggtaggagaatctcttgaggctgggagttggagaccagcctgggcaacattgtgagaccccatctataccacaaaaaaaaaaaggcaaaacaaaacaaaaaagctgggcccagtggcacatgcctatagtcccagctactaagaaggcctaggcaggaggatcgcttgagctcaggtgtttgtggctgcagtgagctatgattgtgccactgcactctagcctgggcatcagagtaagactctgtctctaaaaacaaaaccaccaaaaacaagaaattattctcaactctcctccctccctttttacctcccttctctctacctgtcttcctctctcttctccctcttcctttttcctctctcactctattcactctcatatcacacatacctttttacccccttctgcattgcctgttctatctgaaatgtccttatcctctttcatactcttctactcacccctccttttctggtctgtcttgcccattaaactatgatctacctaaggtaaggaccacattttagtcatctttgcattcccagcctctggtgtagtgtccagtacaggagtttagggtaaggtgtagtctatggatttatttctcatgactttaggactaaggtaatgtctgttggtaataatggggcattttctaagaaccgtatttatgtagaggttttgttttgttattgctttaaatttagctaaataagagtgtctgagtcaaaggtgtctaattacattgacagtcatccactgagaaacgcagtcaatacaaaatgctactgtttgtatgactggattttttgcaaagctactgaaaggtagtcatgccataatctggaaattgtatttagcacattcctataaaacctttcaatgtaacttggtatagctatgtatctgcaacagtccttagctcttgtcacctgataaacaagtttcatgcttttctttaattttaatttaaatttcagaatgaatatcacaacataaat

SEQ ID NO: 40188 - DNA, 1067 bp, Homo sapiens
cagcaatatatgtaacaaaataatagctgaaaacttcccaagtatggggagagatgtggacattgagatcaagaaagcacaaatgtcccatgttagattcaagtgaaaaagattctctggagcacattataattaaactgtcaaaagtcaaagacagagaattctaaaagctgcaaaagaaaaacactgagtcacatataagggaatttccattagactatccgtatatttaccaacataaactttgtaggccagaagagaatgaggtgttgtattcaaagtgctgaaaggaaaggaaaggaaggaaaacaaacaaacaaacaaataaaaaaacctgtcagccaagtatactgtatccaacaaagctctcctttcgaaatgaaagagaaaaagagaccttcccagaggagcaaaagctgagggaatttatcaccacttgaccagacttacaagaaattcttaaaggaatgctacaacaggaaataaaaaggtgagaatcattgtaatgaaaacatgtgaaagtataaaactcaccaatagagctaaatttataataaaactaagaacaccccaatgctgtaacgatactgtgtaaatctttcagtcaactaatatgaaggtttaaggtcaaaatggtcaaaaacaacaactgcaatgttggctaaggaacacataataaataaaaatgtaaattaaggccacagaaatataaattgtgtggcagagtggaaaagtcgagagtatttttatgtgaccaacatttaattaattacagcagatatacaaacaaaaaagagaacaaaaccaaagcagtaaacagtagagcatgaaaggaagaaaggaggtataaaatgaccggaggactggacatggtggctcacacctgtaatcccagcactttgggaggccaaggcgggcagatcacttgaagtcaggagttcaagaccagtctggccaacatggcgaaactctgtctctactgaaaatactgaaattagccaggtgtactgacagtcctgtctttcttatgttttagattgtgtgttcccccacccccccaaccagtc

SEQ ID NO: 40189 - DNA, 2048 bp, Homo sapiens
tcttttggggctcaggagtcacctttatagtcaggcccaggtaatgcttccttctggacacaagagttcatcagataaacattactgtgttagtctgttcttgtgttgctataaagaaatacctgagactgggtaatttataagaaaagaggtttaatggactcacagttctacaggctgtacaggaagcatggtgctggcatctgcttctggggaaacctcagaaagcttacaaatcatggcagaaggtaaagggggagcaggtgtctcatggaatgagcagaagcaagagagagtgttgggggaacacacttaaacaaccagagctcctgagaatgaactcactatttcaaggacagcactaagccatgagggatccgcccccatgacccaaacacctcccactaggcccacactccaacactgcagattttatctcaacatgaaatttggagggaacattcaaacttatcaattacctgtttcagaggcaggaaaattttgtggtgtagttaaaggattttatagggggagattcatatcaagacctagaatggaaactttgggtatccatattttttcttgtataacaaatttttgtattgcctacatattgtatttcttttgtgtctatgagtagttttactgtgttcattaatttttttcctttgtactttacttttttactctaccttcctcacttaaatttacaaattttatggattttttttttgtttcaattcagtatgcatttcaggccttttggaaactcaccgtaattcacttatatataaaaaatgtttttcccagctaaaacaatatttttagtttcaggttttgctatgcttgcagaatctgtgtgtgtcgtgctcattcatttctatggaaaatctctttatatcttgactgtggatgtagtacttacgtctttggtcatctaattttagactgattttcaagaaaacatttggtcatgcatttattttgtcctctacattgaagcactactgttatacgactactgtgaatacttgctgtagatctttttgtaagtcccttttaatattccagaaactttaactgccttgtttgaagacctgcctcatattaacaatttttcaaaataaacaacattttagtgagtttgtatttctttgacaagaacttgaatgtgagtcttagcctgccaaatggctatttaagagaaacatttcggtatccttgttaatgaccttggctttaaccatttgagaggtacatgctatgctttatattagttcttctggtacctactttgcaatactattttaaagttctattttatttctctgatgactgtaccataaattaattatttgaacccagatttttgttagtttataactcgcattaatttttgggattgtggactatgttgtgttatttgggtatatgtaggtgtgggtgtgttttaactgtgacttctggtcttcaagaaaaaagctcagaccaataattgtttttgaaaaattcctgacataactgaactgtaatttattaatattttacttttacattttggaaacaaaataaagagcaagaacaaccaacaaaccaaaaaagtaataaggagaagctaactaaacgtggatcttgttgtagtagctaaacaaagaaaggaatttgaacactttaaacatgagaaatttatgatagagttgtgtagcaagtacacatttataatttatttaaaacaggatctctgactgttcagaaactatgtagatgaattgtgagttatgggtgaatctacatggttcttgctggcctccatgactgaagaaagcttgatgtttagatattgggtgaggctattgatggctctagatccaaggatgacaacctgtctctccgtaaaccctttctctgggatgactattttgatctgtgcctgagataactgatcatgctaattgattttgaagcctagaggcctaattaggcagccaattaagtaatttcgaatagtgacttcatgataagtaatttgagccagttacgttcaggtg

SEQ ID NO: 40190 - DNA, 1048 bp, Homo sapiens
ggcttaaacttttgtttggtatgagagaacagttattgtggatctctacatcctgaagtagaagcagaacttccgaaaaattttactatactttttaaaatatgaaaaaagtgggatgaatttttatgacaaaatataagttcacaaagaaatacctatttatagcaagctgctttgtgaaacactcctcagactttctggtatacatggttgtcttctctgaccttaggggaacttttgtggaaactttgagaagtactgaggcttaggccaagcaaaaaacaaaggcggaaaaacccaccttaaaacactggtgagtcatcagtgaggcagacacttgtaggttgactaacgaagcactcattccctaacacctctcctgtctacctgtataaaggagactggaaaagctaaatacagtcaatttttgtaattcttggtagttagattctgtaaagtcaccatgatgactgaattagcaaattctcaactattgctcctaaggaaaatatgaacaaacacacatacacccacacatttcatgtaggctatataatcttaatcctgaaaactactcatcctggtagagtctctctttatttaacaaaagagaaactgaggttcagagtgttaactgactttttgatgccccatgaataggtcccagatttgggattcaaactcgttcagctggttctagagctggagctacttgaactacactgcactgccccccacagctctgtcctctggtgggcatctctgtgtgagagctgaaacaagaaggcagagtgtctccctgttagaccttagctgggaatatgtgtatcagctactcagatttttcactgctctacatgtttgttaatgatcatgaaaacacagcaagtactgattttggggttacaagtaaattttggtgagtaggctgattcacaaatacgggattgcaaataataaggatcaactatttactttttaaatctccctaataattaggggtaggtatgtgacagagttcttctggttaaaggtaagtaattaaatg

SEQ ID NO: 40191 - DNA, 1024 bp, Homo sapiens
gatttttgaaggttttttgaaatacgtctttgatggttactttaaaatcctgtcagataatttaaacatttgattcatcttagttttgacatctgttggttgtttttttcattcatattatgatttcctggttcttgggatgacagtgatttttggatattatgaggctttgaatgttttttgttgttgttgaagtgtaacatgagggctaggtgagtatattctcaccttcccactgcctgccctttcccccagtaccactacagcaaagtgggacactgacttacattgcctttacagataggatgtggatgttcacctcctcagcccactgatgccttcttgcgaaagtggtctacctcccttcctgtttgcctctggtttgagtttaacattggtcccctgctgaacccactgctacaggagtaggaggggaaagtggagtgcccaccagctctgcattccttcacctttttggcttcattggtacaaagtgggttgggactctgcttccctctgggctttgctgatcctgatgggtggagtggagaacaggagtgctgagtagccctgcttgacactgcctcttcagtctgtcagcatgaaataaatatatagagacaagtctccaagcaaaggttttatttggaaataatatacaggaattgcagttcagaacacaaaaactggggtagcccctaggtgtgtctgaagaacaaaggaaaagtctggggctttactgggggaacagaggaagcttatgtaatttgttttgcaagttcattggtgttggcagtgtcttacaggggctggtgaattctgattggtgagtgacagtttctaggtaaaacttgtaagcttaaagttatggcaggctgttgcggttttggactgggcttgtgagatagttcctagaatgtttttccctaagactcctcccactttatttttgttgggtatgacaaaaaaatctcctttgcataatcagttttcacaagtctctttgcttctgggtaggtatgga

SEQ ID NO: 40192 - DNA, 1031 bp, Homo sapiens
tattttttagagcagttaatgtttacagaagaattgagctgaaagtacagagttcctacctgccaccctccctacagtttcaattatatttgttgagccaatattgatatgttattattaactaaagttcatagtttaggattcactcttggtgtttcacattctgtgggtttggacaaatgtataatgacatttatccaccattatattactacacagaatagttccattgccttaaaaatcccgcgtgctccacctattcctccctccttccctctgaatttctggcaaacactgatctttttattgtctacatagttctgcctttttcagaatttcatatagttggaatcatatatgatgtagccttttcagattgacttctattacttggcagtgcacatctaaggttcttccatgtcttttcatggcttggtagctcatatctttttattgttgcataatttttcattatatggatataccacagtttatccatttgcctattgaaggacatcttggttgcttactagttttggcaattataaataaagccactataaacatttgtgtgtaggtttatatgtggacataagttttttactcaaacctttgagtaaataccaaggtatttgattgctggatcatatagtaagaatatgtttagttttataagacactatcaaattattttccaaagtggcaaatcattttacattcccaccagcagtgaatgagagttcctgttgctccacacctttgtcagcatatggtattgttagtgttttgggttttagccatagttgtaactcattgttgtcttatttgaaacataatgacatatgttgagcatcttttcctgtgcttatttgctatgtgtgtatgttcttgggtgaggtgtctgttcagatcttcgggcccatgtttgagattcttattttcttacttttgaattttaagggttctttgtatattttggttaccagtccttgatcaaataagtgttttacaaagatggtctatggcttgtc

SEQ ID NO: 40193 - DNA, 1033 bp, Homo sapiens
aacacactcagctaacatgaaataaattattttagagatgggagctcactgtattgctcaggctggtcttcaactcttggcctcaagtgatcctcctgcatcagccttctgagcagctgggattacagatgtgtgccaccacacctggcttttcagtctttatttcaaaattgtctgtactttatgatccatctttaaatatttattttcagtgttttacatgaagagtttaattattagatacaagtttctgtatttctttcctttctgtattttttcatttttttttgtatgtaattcttttctttaatgctgatttcctttctccaagtaatcctgattttcttgccccagcttttactatcattagttttctgaatactgtcaatcacattacattcccatttggcaatttttgctttttcttcatttttagattatttttttctctgttattttcacttttctcagcatggattgagaatgtgtgtggtcacttatttaaatttttttcataaggtgttgtagaaaactgattttttccttctgagctgttatgtacttgggtggtcactgaatcgtttgatactgtagctgtgagctgtgtttgctcatttatacattggtttattgtttaaaatctcttcctggagttaattgcttttagtctattgacttgttttttttttttttttttttgcatttcaaaatctcaaaaggctttcgagtgttattaacatgattatggacatggctgattacatttaaatagtaaattatgtaaattttaatgtattttagaaatttgaaataagccctttttagtaccaactttcaaattgattcccagacgagaatttttatcttctgtttaaaatgatagagatttggtaataaagactgctgtcttaattcaaaatttggaataatttttgtgtgacttggactaaaaacttataaaaatttagatttttttctagcttttaataaataacgaacatttaatgggcttccttgttcttaataatttgat

SEQ ID NO: 40194 - DNA, 1071 bp, Homo sapiens
tgtggatgtaccagtttctttaatagtcacccattgaaggacatctgagttgtctccagttttgggctattaaaaataaagcttctgtgaacatttatatacagaattttgcgtgaacacatgttttcatttctctggaataaatgcccaagagcataattgctgtgtcattatggtaattgtgtgtttaattttttaaagaaactgataaactgttttccagagtatctgtacaattttacattgtcatcagaaatgtatgaatgattcactttctccatattcttatcagtctttgttgttgtcactgtttttaaattttagccattctgatggtcctgtagtgataatctcctgtggtttacatttgcatttccttgttggctaatatgttgaacaccattttgtgtgcttatttgccatctgtatgtcatcttccatgaaatgtccattcctgccttctgtcattttctaattggattgtttgtagttttactgtcaagcgttgagtgttttccttacggtttgtagtttatctgttcatcctcttaacaggctcttttgcatagcaaaagtttttaattttgatgaggtgcaatgtatctaatgttagggatcttgcttttgatgtcaatcctagccttagattctaaagattttcttctactttttttttaagttttatgttttatatttagacctgtgatacattttttagtttttatatatgctgtgaggtttaagtggaagtttatttttttgcctatgaatgtccaaatgctccatcactatttgttgaaaaggttatatttcctatattgaattatacttttaagcttctaaaaaatctgtgagccattatttgcttggtccatttctgcgttctgtattctgttctattgatctatgtttttgtccatctacagtaccacactgtatttattgttgtagttatatgtagactttaatattaagtagagtgagtcctttcatttgttcttcttttataagattgttttagctgttctagaagtagctgttctacaaattattattttcttaaattattgt

SEQ ID NO: 40195 - DNA, 1052 bp, Homo sapiens
gatacagaaagcctagtgacccccaatcacatgcaatgtaaaaaggtttctccaccccacattatagtgaaattgcctaaagtcagtgacacatagaaaatcctaaaaattgtaagagaaaagcgtttagtcacctataaaagagccccatcagactaagagcagctttctcagtagaaaccttacaggtcagcagagaatgggaggatatatttaatgtgctcaaagacaaaaaccctgccagccaagcataccttatctagcaaaatgattcttcatgaaggaaggataaataaagtcttttccagacaagcaaatgctgagagaattcatcactactacacctatcttacaagaaatattcaagggagtcctaaacctagaagcaagcaaaagggtgacagttaccattatgaaaacacttgaaagtataaaactcactggtaaagcaacaaatgaggaagaaaaaaagactcaaatggtatcaccacagaaaatcagcaaactacaaggacaatcaatcagaaaataagaaaggaacaaagaatattcaaaacaactaaacaacagttaacaaggtgacggggaaaaacctttcatatccataataacctgtgtgtaaatgatttaaattcttaaaagatatagattggctgggcgcagtggctcacgcctgtaatcccagcactttgggaggccgaggcaggcagatcatgaggtcaggagatctagaccatcctggccaacatggtgaaaccctgtctctactaaaatacaaaaaattagccaggcatggtggcacatgcttgtaatcccagctgctcaggaggctgaggcaggggaatcgcttgaacccaggaggcagaggttgcagtgagccgagatcgtgccactgcgctgcagcctggtgatagagcaagactccatctcaaaaatatatatatatatatatatatatagactgaatgaatttaaaacatgatttcactatatgtttactaccagaagtgtacttcacttgtaaagacacatacagactgaaagtaaaggga

SEQ ID NO: 40196 - DNA, 1030 bp, Homo sapiens
cccgtgaattgcttagatacgtgttttacaatttctgattacttgggggatttcacaggtaccttccttttgttgatttctaggttatttatggtcagagaacatactttgtaagaagtaatagcgtcttattttcctattttgaatctgcattactttctattttttacatgctagtaggagttaaatattgattcttaagagcaaatgcttttcataatttggagaaaacaaaccatgggactgataattttaacttagtgcaaagttgcactctacttcctgttacgatgatggttaaaagttcacctgtgttgataaaagacctgaatgtaagagctcaatctgtaaaactcttaaaggaaacatagtgaagaagcttcaagacattgaatttggcagtgatttcttggatattatactaaaaacacaggtaacgaaagaaaaataaaaaattagacatcattaaaatttaaaagttttgtgcatcaaaggacgctgtcaagagagtgaaaaggaaatccacagaatgggaaaatatttctaaatcatatgtctgataaggggttaatatccagaatacataaagaactcccaaaactcaacagaaaaactcccaaacaacccaattaaaaaatgggcaaaaatgttgaataaacattctccaaagaaaatatacaggtggccaattagaatatgaaaatatgctctatattaccagtccttagacaaatgcaaatcaaaaccacaatgagttaccatttcatacccattagaaaggctatttattaaaaaaacagtgttggcaaggatatggacaaattagaacacttctgcatggctggtaggaatttaaaattgttgaactgctgtgaaaaatggtatagtggttcttcaaaaattaaacagaattaccacatgatccagctattgtatttctggttatatacccaaaagaattgaaagcagagtatcaaatggatattggtacaccagtgtttgtagcagcattattcacaatatccaaaag

SEQ ID NO: 40197 - DNA, 1036 bp, Homo sapiens
tgggtagatagcctatatagtgtagatctgctggacaaatggagaattcattccagaggggaatgcagcaggttggcatgagatttcattatgctgctccgaatggcacacaattgaaaacttatgaattgtttatttctggaattttctgtttaatgttttgagactgcagttgactgtaggtaacttaaaccatgggtaagtgaaacttggataatggggagcagaggaaggaattttttagagttggaaaggccttggtccgctctgctttgggattacttatgtgataaaaataaggcatgtgattcagcgttttctgtttcttgcaatggaaggcattttacctgatactacagctctcttctgtaattttatttattccttatcagaacaataaaactgtcactttttctgaacttctgcacttagaatctttgccaatctttgacctttctgtatactaatgtgtgtgtgtgtttagttttagtttttatctcattactgattaacacttctttgaggacatagactgttttaaattttagtgtcctttgtattaaattgctgagcacagatttgagcttgctaatagtaggtggttaatcatgtattagtacaagagaaaaggaaatggcttttaaattgtgtgcctcctctaaagtttactaatttctgctgtttctatcctgtgtttgtcagtgtttcatggtcgaagtctccctttgttggtttaatacaacttgggttcctatttcaattctgattaaagtagaaatatctctaaaatgctagtaactatctgccccagacttttatcccagttgccaaatagagtgggtcccattgctgattataaatgtagtaatactcatttaaagatataaaatataaacatatgaggtacatttcaaaagaatttgtttgttgttcggtgcctattgcttcacatatcagtaatgatacaggtatagatatgaatgtgtgtgtgtctgtgcatgtgtacgtgtgtatatatgtatgtatttttgttctg

SEQ ID NO: 40198 - DNA, 1057 bp, Homo sapiens
tccagatggacaatgcaaggtgtccatgcatctgtcatactggggtctagaggatggtggccctcttctcacagctccaccaaggagtgccgcagtaggtactctgtgtggaggctccaaccacacattttcctttcacattgcctgagcaaaggttctccatgagggccctgcccctactgcaaacttcagcgtgggtatccaggcattaccatgcatcctctgaaatctaggtggaggctcacaggcttcagttcttgacttctgtgcacccacaggctcaacaccacgtggaagctgccaagacttggggcttccaccctctaaagccacagcccgagctataccttggcctcttttagtcatgtctggagcacctggcacgtaggacaccaagtccctagactgcacacaccgcggggaccctgggcctggcccaggaaaccattttttcctcctaggcctctggaactgtaatggcaggggattccgtgaaggcctctgacattccctggagacattttgctcattatcttggggattaacatgtagctccttgttacttatgcaaatttctgcagctggcttgaatttctccccagaaaatgggattttcttttcagtcgcattgtcaggctgcacattttccaaacttttatgctctatttcccttttaaaatggaatgcctttaacagcacccaggtcacctcttgaatgctttgctgcttagaaatatcttctgtcagataccctaaattatctctctcaagttcaaagttccacaaatttctagggcaggggcaagatgccactaatctctttgctgaaacataagagtcacctttgcttcagttcccataaagttccccatctccatctgagaccacttcagcctggagttcattgttcatatcattatcagtattttggccaaagccatttaacaagtctctagggagttccaagctttcctacattttcctgtctttctgagccctccaaattgttccagcctctgcctgttactcagttccaaagttgctttcacattttcag

SEQ ID NO: 40199 - DNA, 1069 bp, Homo sapiens
caggagggagaactgatggcaaaggtcatttcaagcagagatgaagcaattatcctcaacccctgcctgcaccaaaaagacccaaaacaataagagaaaaaccctaaactaaaaagaataaggggaaaaacttaaagggctaatgaatagaaaaaagagaacttcccattatgttttaataggttgaaattatataaagctggaatggaaaagagcatgagttataaggtaaagagaataagtttcaagttccaattgtacctgctctgtgtttccagataagtcactcagtttttgtaagcttcctttttctcgttgcagtagatgctgttagtaccccatccagtccctttttatctggatggtttatttacctatccctcacccatagtgttggtgacttacagctctcagttctcactagtgccacagaattgccaggacctgcctgcccagaaaccccagagatcttaagcttcccactttcccagggggtaggtaggtgacttgtagtcaatgactggttgatataagggtataaggccttgtctttgtctcaatatgtgacatctccctggtgccagttagactccagagctcactctgagatcaggttgaggctagtctttagctgaacccacagttttgttgcctcattcacttctttaaattttttactaagagcagttcctcaatcatgtgcacagagttcttaggttttgcctctcagggacttgacctaacacccacccccactttccccagccctttaaaaaatctgcgatcaggtatacataatttaaaatgtacagttttcaccattttaaagtatacaattcagtggcattaagtatattcccaatgttgtgcaactgtcaccactatctcttttcagaactttttcatcaacccataggataactccaaacccattaagccgtcgcttcctatcttccagcccctaagcagccactggtaacaccaaggagtagaattatctcatcatatggtaatttaactcactgaagtacttgccagctgttttccaaaagggccatgtagttttata

SEQ ID NO: 40200 - DNA, 1030 bp, Homo sapiens
tgtattttagatattaacccctttgcagatgtatggtttgcaaatatattttctcattctgtatgcttgtttctttactctgttgattgttttctttgttctgtagaagtgttttagtttattgtaatcccatttgcctatttttgcttttgttgccagttcttttggggtcatatccaaaacattattatccaaaccaatttcatagagcttttcccctctgttttcttctagcagctttgcaatttcatgtcttatgtttgtgtttaatgcagtttgagttgatttttgtgtatgttgttagataaggatctaattttattcttctgcatgtagctaaccagtttccccagcaccatttattgaagagactatccttccctcattttgtgttcttggcatctttattgaaaatcagttgacagtaaatgtatggatttacttctggattcactgttctgttccgttagtgtgtgtgcttttatgcccgtaccatgctgttttgattactgtagcttgatagtagattttcaaattaggtaatgtgaagcctctggatttgctttttgctcaagactgctttggctatttggggtcatttgtggttccatatgaattttaggattttttttctgtttctgtggaaagtgtcattagataaagattgcattcagtctttaggtcactttgggtagtctggacattttgacaatattctttttttttttttttttttttttttgagacagagtcttcctctgttacccaggctgaagtgcaagtggtgtgatctcaactcactgcaacctctacctcccaggctcaagtgatccttccacctcagcctcctgagtagctggaactatctgtgcatgccacgatgcctggctaatttttgtattttttgtagagatggggtctcgccatgttgcccaggctggtcttgaacttctgagctcaagtgatccgcccaccttggcctcctaaatttctgagattacaggttccatatggcatgagccactgtgcc

SEQ ID NO: 40201 - DNA, 1028 bp, Homo sapiens
ggttggaatccaaataattttgattagagtccatctataaattatcttcaatctcaatatttaatttatttacttttcattattactaataagatgttaagatttatgtacttattatccacagaaatgttctctcttttagagttcactacgtttaatgcctaagcatgaaatattttagcagaaatcttagtaacaactatgatcaactattttccctctgttttatccatatttgaatttcattgagtggaaaaagtaactagttatatttgatattactatgtatttccagaaacagtcattgcatcttccattggacataatatccaaagtaaattcattttctgaggatttacctacattaggtagactttgagtattatttgatgatggtggttactactgagtaagaaaagtaatattttatgtatttttattggtaaataaaaattgagcttgtattctgatctgaatttcagatctttagcctgttaacacttaaggttttatataaatgggatggctttaagtaacagcttacagttcaaattattgtgtactttattttgtccatgatcattttaagcaattctaattattagatataccggcaagaatatgtctcaagtaattttgttatggaggaggaatctttctgcctgcttcctcctgccttacaaactctggtgattgcctgtttgccctcatttatgataaagttccaaagtgattgtttgtacctcccatatttaattataagacacatcataagacacataattataagacacctatttaattataaaacacataaatcattgcaagcagtaagaaagatagctcgtctgagagagaaacacacacatatacaaacccaaaaagcatcttcaagggtcatttaatgtgagggcagattgattgccctgtctgcctcagtacattttaaaagatatcagtgtaggaatttaatgaactagttgacaagaggaacatttttttaaacatacttttttatgaaagactgg

SEQ ID NO: 40202 - DNA, 1619 bp, Homo sapiens
gttttgatcttgaaatcaatttcaaagaaaaaaagttgttggtatcttgcttctccattgctttgtagtgaataaaatgtgttagaattggttgaacttttgaaaataccaaggtatttgtgtttaaatgctatgtgtgtcttcattgtaaccatttgagtaattttttattttcttaactaatgatcatattttaatacattagttttactttatcaatattgtgctcatttctatgcatttttttaaggattattttagacttatttgctgctaactctattcttttatttgctgctcattctttgaaaaacaaaggagaaaatggtttgatgcaggaatttttaaactttagaagtcctaatttggcttaaaatgttctgattatgaggttttacgaaggaagtttttaacttattgtttcatcttggtatgtgactgtttcttattttacttttttttgacaatttttcttttttttggatttgatgtatagctgtttaagcttacacgggatctatttggccttatattgactacttctgttagtaaaatatgtatagtttcatctgttaaattatggtgactgtgcagtattccatttccttgtttaatggggtatatgtttatgtacacaactgcatgcacatttgtcttattgcgtatgtatacaaggcattgttttgtagtactttttgtaataagagcatttttctcagtttattttaattagatcaggtaaaaacccaaactagcaccatttccctgattgtttgaacaacttcatttgattagttttagcagctgtctaaatgtgagattatgtggaatgccagaagagaaaatgctaagtcaatctctcctgccttccctccctccctctccctatctctctctctctaccaatctctctccctctacctgtctcccccattcctcctctttccctttctttctccttcaggcttttttgggttctcttccttttttccctcatttctatacagcctcaaagtagattcttaagttctagtaggggatattgacattaatcctcactaatgaatactcggtagatttggagctcttaacattcattagaaattgttatattctaatatgtaatgcctcagttgttagatagtattggcatctgattatagagacttaatttctttcagctgtttttaattgtttcttgaatccttttatgctaatttactttaatacattgttcacatagtattaacactttaattatgaggattacttttttttctttgattattctttgaagtgcagagtgatccatacttgtttaatgtagctgtataagtaattcatgtttcttgtaattattagaacaattcatctttgaatgctgtcatttttgtaataataaaaaaaggcgagaacttgcagaaaatatgggaaacatgctcatatgacagctgaggatgtggctagactaaagcaggaaactactacccacaatgcaatgttacatacactaccacttaatataatttatatcaaacatgctactgacaaaaccaaagaaaaataatatcccagctatgctatttaacgtatctagggagaagtgaaagtaatctttt

SEQ ID NO: 40203 - DNA, 1026 bp, Homo sapiens
tagtgacctgcggagattaaccatttaaaaaccagagacttcttgctgtcctcctggagaaagtttgcaccgcacttgtggttctgtggttgtttgtgaggcgaatgaagcattcacacaatccaaaaaagcaaaagctttaaaactccttttttttgcaagcactattactggagaggcagaatcatgtggtttgtgacctcacagtactcttaagtaaagtgggactgcctaccactgtggcttttcccccttgctctttctctctctctctttctctcacaaaaggcttgtggtaaggcctttcctggcatccagaaggatatagctttttaatttttgtgactcatgaggatttggatagaatacaaatgctgaaggagcccaaactcctgtaaggttaagcatttgtagagcagagctctgcagttaagggctttcctttctactccccgctcaacctctgcctttttgcctcctctttttagttcattattgtgtctgtggaaaaatgaacaaaattggctcaagagtctgtgtgaaattctgaacaacagtgatgatatacaataattcacatctttggactgtatcacattctggggtctgcttcatatttgctgggtggctggattccttctgttttcctttttcttgtcttcttaaacttgtgaatctgtaactcattgtaaaaaaaaaaaaagtttaccttaaggtctggttgcaaactgcttgctaggcttgactataattggctgtcatgaaagtgttagtctgggcattcttttacaaattttaaatcacgtctgtctagtttattatcaatctattagatggcggcctttacaataaagattaaatgtaatgtttcatgtataccattatctcatgcctagtttgaagatcttaaaaaaatgaatgacagggattgtaatatagtttattggatgaatcttagttttctttatgattgtaatattttttgtctttcattgaagtgtattcagtttatatagttctttaagt

SEQ ID NO: 40204 - DNA, 1050 bp, Homo sapiens
ctggtgcaaattccttgtattttattgtgtacttgaaacagtttttagactagcacctgttgggcagaccacatttaatctagaagattattatatacaaatgttttttgtttattcattcacaattaccaagtgggtgcctactgtgtactatgcaccattctaggctctggagatatagcagtgaataaaacaaacacaaaatccttaatctcagggctacattctaattgtattagaaatatcaattttatttctcatttctcagaaatacttttgtttttgtagtaaactgtattcttgcagtttatagttttgtgtataaaaactttagacttaattgtatgtatctttacatatagtggcaatactactttatatttttggctctagtaattttttttcctgtgactaataaaacctttgaaaacagtaattgcttatttgagtcacttcccaattttacttgaaattagcttttctgaagcaaagatctttttatttaaaaggagatgtaaaaggaattaattttgaataaaagagaacattgacaacatgaactgattatgcagtggatggaattgtatgttaagcaatcattgtttggttgcctttcttatattctgacagatgacctgtttgtcagacttcagagtattttagagactatattgaaataatataattttaatgatgaaatataaagagcagcaaattgatgaaaaccagtgaaacaacctatgacttaaaaaaatgaatcttccagtgcaatggttcccaaaccttagtgtgcattagaatcacctgagagccttgctgaaccattaaactgctgggtctcacctccagcctttctgattgaataaatcaagggtgaactcagcaatttgcctttcaaataaattcccaggtgatgttgatgttggtgatccagagaccatacttggaaaactagtgcttttatataatgtcatcttgtagtgccccgatttatcaataagtagctaatttaatcatagccgtagcagatggtgacttaaagaaaactca

SEQ ID NO: 40205 - DNA, 1161 bp, Homo sapiens
ttcaaattgtaatgtaagtgagaatatgtataaaggcagatttcctgaaagtgatattatgtataaaagcagattgagaacataaaaacactgcataatggaaagtcttttttcctttcagaaatgaaataggaaatgtttaagtttctagatccagtgaaattaagtgcttgtgttaaaaaatgttattttataaatgtggctacataaaataattgatttttttatttaaatattactatcaattctctcatgagaagataataactagaactttcagtttaggattatatgtgtaattaccagggaaaaaagtgtcttgcttacttacagaaatgaattcttgaaattcaggtagatgaagttatttgagtaattctgtgatgaaaatccttagttatatggggaaaaataggtaaaaattcacagacccatcagcctaaaattgcagtataattgctgattatcacactggagagtggcagtctctgttctgaactaatttgatggtagatccatgctgtaattgatatatagctatttatagtctttttttatttttagagtgaatattcatacgtttcaccatgttcctgaatgcttctctagactctgctgaaagtattatgtgatttatgtacagtattaactttcaaaaatctgaaaactttatattctgcaatacatatttcagataagagactgtgaacctgtatctacctcacagggttagtacgaagattaaatgagatgattgaattaaaacacatagtgtagttcctggcagatgataaacattgtgctcttgttaccattatctttttaaaaaataaatatcatcatcaacatactgattaaggagtttataaaaagtaattcaagtatagggggaaatatttgcaatttaatgggaagaatttcataattatagagaagaaaggatttgtctacattatagcatgctgtagaactttccacagtgatagaaattttagttcctttttatccggtgtgatagccactagccatgtgtacctattgagtatattaaataagccaggcagctgagcaactgaattgtagattttatttaagtttagccataaacttagcaaacagctaccatattgggcagcacagaagaaatatagtaaatacaaa

SEQ ID NO: 40206 - DNA, 1030 bp, Homo sapiens
aatggaatgctcttcattgtgctatggaaagtttcttatctcaggatattcgggacgttggagcgaagtatgcctaagtctagggctgcacttttcactagcagtttctgccttgatggagatgttccataatctgtgcctttaggcactagtggtagcctaggcacagtggctcttcagcacttgaaatgtgataagtgtcactgaggaacttaatttttaattttattcataaattaataaattgatttacgtttaaatacccacatgtggctagtggtagctactgcattggacagcacagggctacaatttagattttgagagtccttccgagtcttgatatggttgagttttaaatcagataagccagctctttggaacatttattgccatagggaattgtaattatattcaaataatgcctttcattcaaatactgcagttcagaccatgggtctgttagtacttatttacatcttgacaaattaaagcaaaacgttgtctcctaggttgtacagctaatgccagattcagagagctatgacagtattaactggagttttctttaaacattattgtactattttgtgattgtcggtttctgctatcttttaccactttggttggtttttcagtgagaagtttccagctcttattcaagtttttttcttttttaaccttttgtgtaataaagcgatttgaaaaattgtaactcttgagcattaggacattttagaactagttttatggttatccaaatcttttggagagataagtgaaattaggtaatagatgtttcacaaaattactttacttgaaatatgtgcatctgttttttttttttaaagcaagtgtatataaagtcaaatttgaaaataaaactaaaagaacaaataaaaaacctttataggtagcggtagcacccttaaccttggcctgatgtctgtaaaatggtgcccttgggccaggcacgttggctcatgcttgtaatcccagcactttgggaggctgaggccagaggatctct

SEQ ID NO: 40207 - DNA, 1024 bp, Homo sapiens
aaacagacctgagtacactgaaattgaggggcagcatggtcagtccccattattatataaattcaagcaaggacactttcttctggggaagaggtatgagggatcttttgctgtgcctctctctctcaggacatctcaatacctttgataattagagctctgaagatggatggatttatttgcacaaagaatccaagggaaggcacctgaatctctactgtctcccccatgttcaaactgtagggggacccttgtgggccctgacaaaggcccaggggtgatcagcaacaaagtccctaaagcaaggcagaaagagacagttctgtggattggtccctgcctaggttggaaggacagaggagggacaatgattctgggtccatgaggttctgatccaaacctgttggcaaacttgtgctccagggaagagttttgtgagtgaacagaagaagcagtaactttcccagaatgttcaacccactgtggacattgggctcctcatctgggtctaatttaactcctgggaacgtggctgtactttgtaccttcttgattatactaggctggtggttcttagaatttaatgtgtataagaatcactgggaaacttattaaaaatgccaagacctgtgtcctttcccagagattctaatagactttcctggaatgaggctcagaaatatgcatgcttaacaactatcccaggtgtttctcatttgggtggtctgtgaagggcgtcttttaaaaagcaccttgccttccatagggaatagcaaccaagatagagacccagccattcttttcttacaaatgttagggctacaaatggcaccaccattttaccctgctgctgtggggcagtggcccctggagctctgggcccggtctctcccaccatggcaaggtggggaaaataccctggaatttctgggccagtggatgagagatgctgatcctcatccagacgcaaatctggaatgactgaagatgctctttgctaaagttaaatcactgatcacattgt

SEQ ID NO: 40208 - DNA, 1033 bp, Homo sapiens
gggttgtagaggagccaggtgggagtaggaagcatgatgaaggctgtcaccctggaccaggtgagaaatattcacggcttggacaagagtggtagcaatggagatggaatgatgtggatggaagtaggatttagtttgcaaataaaaacaaattttgctgattgtttaagggagttaaagggaaaggaaggacaaaggaaaactgtttctctacacacaacacttctgacaccaaatgtgtgggttttccacaccaaacaattctccagttctcttcagatatcaactgggtgtcctagaacttaattcaattctgacactaactgcatgacattatcacagacccacaggttaggggctcagtcccgcaagactctccccaacttcagatgcccattgaaattagtacagccccaggttattcacacttctgtccaacttgtctacaaatcgggagttttccacaaccacctctctagattcgataatttgttgtaagggctcacagaactcagggaaacactatgcttactatttctggttcattacaaaggatattagaaactatacacatgaatagccagatgaggaagcacatagggcaaggtttggaagagtcccaagcataggagcttctttctctgaagttgggtgtgttaccctccggcacatgcatgtgttcaccaacccagaagctctttgaacccctttattgagggattttatggaagttacagtacaaaggcatgattgattaattcattctccattggtgactagctgaatccccagcccacctcccttccccagaggctggggaatggggctggcagttccaatcctctcatctcatggttggttcctttgacaactagcccctaatttccaagagtcacttcattagcatagtcaggtgtaatcgaaaggggcttatttgctgggcagggtggctcacacctgtaataccaacacttttgaaggctgaggtgggcagatcactagaggtcaggatttcaagaccagcctggccaac

SEQ ID NO: 40209 - DNA, 1025 bp, Homo sapiens
tgcctcactcctatcccgtttgcattcagctgctaaagcagccatgaggcagctgatacagagcacatcgtctctaccatcctaacggaacttgtgtaatttgtaaatctttattgccacctaggggcaccaaactgtttaatgctctcaaaagtttaatatgttgattaacactttatattttataggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattcatatcagcctaaattttaattttaaagatgattccttttcagtgtcgaagttaaaaactgtttttacattactttgacagacaagtagattaaaacaggcaaaatcccagtgaaaacctgttgcaatgatacaagactccctaaacatagagtaaaaaacaatttcttgccttttattatctactatgggcagtggagtttaattatagcaacatgatattctaggtagaatttggcagctcttctctttgacttttggtcacggtaagaaaaattagaacaagcaaaagccattgtttcagcacaggattggtggtactacacaatttcaaatgatgactaaaaggagtagagaagggttaagaatattagagatgaggcaaaggcagtggattaaattggtaattttttgacactttctttaattctttaaggcattctacttgctaaagaaagg

SEQ ID NO: 40210 - DNA, 1095 bp, Homo sapiens
cttgtctcattcatcttgcagccctgatgtttcttcctcaaagcacttgctgggcaaatccttgttaattaataaagggattttcataccagtaggtatgggcacacagcacagttctgagagcctcagtgttggaatcagatggacctggatgtgtcatattcctaccacaagactaagtttgtgaggcttagcaagttaactacctttcaaagcattctcatttgtaaaataggaagaagagtgtacttattccatagagttattctctttatgcatataaagggcttagcacaatgtctggcttacagaaagtgcttcatagctgttagctattacttttggaaattatgaaatacattcagatcagagcagcaactactctgctacaggcagtaagaattacataaatgacctaactatacagagtttggagcatacaaattcaagacggatcccagacctcctttggagagagtccttaacttgtttgatttttcttcctgttccccaaaccaacagtatgtcctcatctcgggctaatgtttgtgtctggctttctaagatgtcacttctttgtctctgggtctaagcctaccttccccagcatcctgagatactgttgtagctcttcactccgcccttcctgacagtattttaccttcctattctccctttcctctggtcctgggtgcttagtttcccaaccagaaattaattgctgcttcctttgaacagcattgcctttgtgtgtgtgtaaatatatgagtatacatgtgtgtgtaacagggaaagaaataagtcattttggcatctcctaattatccaggcagagctggttggtgggtggccaactgcaaaatcattcaaatctgatatgtatttgttgctattaggacatgtgtaaagaacagcctcactgactttaatggcacctctatgctgtatcaggcaccctgttaaaggctgtacttacattgtcctatttactactcacaaaggtcctattataagattgatgttctcatcccaattttctaaaagagaaagcagaaatagagattagtaacttgctttaataccacaaggctggta

SEQ ID NO: 40211 - DNA, 1203 bp, Homo sapiens
aaataatttagaagttacttaagtctaggcaaatgtcacattaatgataactcagcaagccattcaagcaagaccttgtctgatctctaccaggcaaatcttgtttgctatcttacacgtgcaacacaagtaaaaactcttgtgttgtttcgaatgtgccagaggatcactcactctctcactgtaatggaggatggagaataataggctgggggggacatagatgtctctctctctaggaccctgctctccttcctccaggccttgccagtacagtcaccttacagctgtctttgcttccctctcttctctgcagaaaagaaggacacagtgttgcggcaggtacgcctggacccctgtgacttgcagcctatctttgatgacatgctccactttctaaatcctgaggagctgcgggtgattgaagagattccccaggctgaggacaaactagaccggctattcgaaattattggagtcaagagccaggaagccagccagaccctcctggactctgtttatagccatcttcctgacctgctgtagaacatagggatactgcattctggaaattactcaatttagtggcagggtggttttttaattttcttctgtttctgatttttgttgtttggggtgtgtgtgtgtgtttgtgtgtgtgtgtgtgtgtgtgtgtgtgtgtgtgtttaacagagaatatggccagtgcttgagttctttctccttctctctctctcttttttttttaaataactcttctgggaagttggtttataagcctttgccaggtgtaactgttgtgaaatacccaccactaaagttttttaagttccatattttctccattttgccttcttatgtattttcaagattattctgtgcactttaaatttacttaacttaccataaatgcagtgtgacttttcccacacactggattgtgaggctcttaacttcttaaaagtataatggcatcttgtgaatcctataagcagtctttatgtctcttaacattcacacctactttttaaaaacaaatattattactatttttattattgtttgtcctttataaattttcttaaagattaagaaaatttaagaccccattgagttactgtaatgcaattcaactttgagttatcttttaaatatgtcttgtatagttcatattcatggctgaaacttgaccacactattgct

SEQ ID NO: 40212 - DNA, 1045 bp, Homo sapiens
ctgacctcaagtgagctgccctcctcggcctcccaaagtgctaggattacaggcatgaatcaccacgcccaacgaaaggcaattttttaaatgatagaaaacaaattctcactgctctaagacaattatcttcaaatgattttatcttccagtccttatctgtgtatgtatgaatagtttaaaccaaaaagtacatagaatagcttttaaaaaccatactctcggccaggagcagtggctcacgcctgtaatctcagcgctttaggaggccgaggcaggcagatcgcgaggtcaggagatcaataccatcttgactaacacggtgaaaccccgtctctactaaaaatacaaaaaattagccgggcgtggtggtgggcgcctgtagtcccagctacttgggaggctgaggcaggagaatggcgtgaacccaggaggtggagcttgcagtaagccgagatcatgccactgcactccagcctggatgacatagctagactccgtctcaaaaaaaaataaaaataaaaaaaaaaccatactctctggcttcaaatacttgccctgtcattgtctagctctttgatcctgagcaagttatatctctgtgcttcatccgtatagtattacctatcttatgaggaagtttggaaaatctaatgaaaaatatttctaaagtacttaaaacagaagctggcacatattaagcactgactaaatattagttattgttacacatatttgtatcgtcaggattctccagagacacagaagaaacagaaccaaattggtaagcttactctccactcatgtgtaatatctctcaatgaaaagaaaatctcacttgatgaaaaggatattccagtgctgtactactcattcattcagaaacaacataaatgggaattgagcataaaaagaactagaaatactttcctagatgtcaagaaccactatataatgaaactaatatataactaaaaacttcatttatatattcattaaaataaatcataataaaagtttaatttaggtaaaagttgtgagaaag

SEQ ID NO: 40213 - DNA, 1078 bp, Homo sapiens
taccaatgagaatggcactaatttaatttataactcattgtcagcctttttttcacctcatttgctttatgtggatgtgtttcctctttctggaagaagaaatatgggctaatattacacacagatgccaagctggctcattctgtgctttgctgatattctatggatagttgccaggaacagtagtagcctcggatcactattatttttttgtccattctgagtctgcgttatgtgtaaaagtctcacttcagtcagcttgacaccacaggacacagtgatggctcgttttttgcaagtaaaaacaagcctttcagatacagattttcactcatttttccaaactgagactcatttaaattgtttattaattttcaaagatttattgagcatctactatgttcaagaaatttttgggttctgaagtaaaaggcattgaacagaaatgatcaagttgtcaccctcatgaaccttacgttttaggactgcaaaagggatgaataggacaactaaatagagaaatataaactatgttatatgatttctaggtgatataaataaaacaaataaagcagaataagggataaagaacataagtggtcagataaaagcctttctaaagagtaaaattgaagcagagagctaaacgaagcacctgagatgagtggctctggcagagagaaatatatgtgctaaggctttaatataggaccttgcttggcgaagctgaagaagagcaagaaagcgaatatgtctggatcagagtctgatctgagtatgagtgttacaagaaggggtctaagaggtagtattgggtcaggtcatataggacactgagaattaaccttcgggtgaaattaaagctgtttgaagtattttgagacaagagggtgtggtctgacatactttataaagatatttttgtctacattacataaattaatttgcaatggggcaagaataattctacagagactatttaacaggttattgcaaattttgcgtgggatataatggtgatgtgaaatagcgtgggagcagggatggtgataaaaaggaattagactcaggataaata

SEQ ID NO: 40214 - DNA, 1067 bp, Homo sapiens
gctgtcaaatgtttttaagttatacaacattggaattctctactcagatccctcaaaaataacagatcagggattatgagagaccgagttaaggagatccaaaatctacttcgagcaaaattttgtggtccatattcatggccattctcaagttgatgggagtgaagagtgaatatcatgggatgaaaattctgaggaccaatgatgtgtcctaatctcaaagaacttcttaagtaagctttgtttattaatttatttcaatgtttctgcacagagtatactccattcccctacctctgtataaactaaaaccttcctgctgccacttagaaatatcctctaatttttttcatctttggtgaaaagaattaatgaatagccttagtcaagattatctcatcttgtaagttttcctccagctatacataaatggtctagaaaatactatgtaggtggtgcgtgtgtgtgtgtgtgtgtgtgtgtgtgcgcgcgcgcacatattctttcaaagagaagatcaaatctgggaataaaggcacgtaagtgcttagcaacaagactgatgtgtcttatcagaaaagagatgatgatagtgatagctgttggttcagcaagagggttctacacatcaggtgtgatgtaattccctatgtgtagtgatttagagaatgagctgcaaatagcttattggtggtgaactgacatgagcaagacagtcttcatattagacatcttagggcttgctaggggttttgctaaaactgctggtgaactaattaggtaatggaaagatctatgaggaaaacagacaattatatattccatacaaataaagagaagcgctacctctcctgatgctggattgtaatatatgtcctatgaagccagagaagtgttttcattccttaaacaaaataattgtttctcaccctccaggttaaaatcagctctgaattacagctttattggcaaatttaaaaagatgcaggcgtgtggtcagaaagtcttctaggtgacataggccctttctttttcaaccttagcaaatgtttttgagaatgaaaata

SEQ ID NO: 40215 - DNA, 1052 bp, Homo sapiens
cactcttccacaaattagtagtgagctaaactactcactactaaaattttctgacctaaaaatacagttacagcagcatttttgtgactatgatgaaagtgcaaaggaattttcatatttcaaaatccatttaactgcaactgtggagtttccatctaacattcaattggaagtgattaatctgaaatgtaatcacatgttaaaagtcaaatatcaagagaagtatccagtagaatacagagattccttttatttaagatataaacaaatccaattaaatcatatgctttgtagattgctaacagtagttggcaatagctgtgtgaaagaaatttcatagatgaaacacacaaaatttcattccagatcaacattaagagattaatatttgcaattaattttgatggttgagaacgctaaattcgaaccccatataggaggttttttttttaatcactgctatagcaaattaccacagacttagtggcttacaactcccatttattatctcacagatatttagctcaaaagtctgagtataatgtggcttaactgagtcctctgcttagaaatctcttgagacgaaaatcaaggtattaacatagctgtgtttctttctggagacgctggggacaattctacttctaaattcattcagattttaaacaaatttgatttcttgtggttgtataactgaggcccccatttctttgctgactgtcagccaggggctaatcttagctcttagatactccagacacattctttttcatgctttccatgtggcccttccacctctggcaggttaagtgcctctcatgcttctaatctctctaacttattttgctgcatctctctgactccagcttcagaaagttctctgtctcaaagtgcccacctgaataattctggtaaatcttccattttaacccccataatcctaattatatctgcaatgtcccttttgttatagaacatagtcaaaggctacaaggattaggatgtagacatatatctagggccattattctgcctaccatatccaactaagc

SEQ ID NO: 40216 - DNA, 1037 bp, Homo sapiens
ttgctttgtgttttatcagatcaacaaaacactacatgctaccttataaaacttatgggaaatggcaaggaatctatgatcctgagttcccttattgatggtcttgtaacctagcatgcccacttaaaattttattttgatttttgaaataaaattatggctacagtcttactttactgcagccaattgggttatatatttttaaataacattaatattcttactgataagttagttgtttttatgtcaacatgttctgtatactacatgatttaactaaaatctaactgcttaaggaccaccatataattgttccattaagactaaatatacatagataaaatgactgacccttgtcttactggcctaactcaaaactgagagctgaaggaaaggagagttcacacaacagtaggttaattcttttagataggtatgactttttccatttgctttgtcagcttcctatttaaaataaatatgcaggctttgaagaacgataattctgaatttgaatccaggctctgccatctagtggttatgagaccttaagaaagttatttatcctcttagagcttcaattagtttacctagaaccctgtaacaatgattactgcccacctaggactattttgaagattaaataagacaatgtatgcaagggtcctgtctcttagtaagggccccatgaatgtaaattagtataattaacatcattaatattaacagcatcattattacattataattccttattagtaacttatattagtagacaattttgtttatgaaatttgttattttattgcttaaaagcataaagatattagttatagtcatagaggaaaaaacaactactaaatataagactcagagtgttggagctgctgaaaatactggatagactgaagatactggatagatcagaagaaactggacagaccagaggagaaaaaaactgaaagatggtcacaaagagttaacattaaatccatttcacatttttctgggctgaggctagacctgtcctgaaacaa

SEQ ID NO: 40217 - DNA, 1049 bp, Homo sapiens
gtatagtttgaagtcaggtagcatgatgcctccagctttgttcttttggcttaggattgacttggtgatgtgggctcttttttggttccatatgaactttaaagtagttttttccaattctgtgcagaaagtcattggtagcttgatggggatggcattgaatctataaattaccttgggcagtatggctattttcacgatattgattcttcctacccacgagcatggaatgttcttccatttgtttgtatactcttttatttcattgagcagtcgtttgtagttccccttgaagaggtccttcatgccccttgtaagttggattcctaggtattttattcttttgaagcaattgtgaatgggagttcaactcatcatttggctctctgtttgtctgttattgatgtataagaatccttgtgatttttgcacattgattttgtatcctgagactgctgaagttgcttatcagcttaaggagattttgggctgagacaatggggttttctagacattcaatcatgtcatctgcaaacaggaacaatttgacttcctcttttcctaattgaatgccctttatttccttctcctgcctgattgccctggccagaacttccaacactatattgaataggagtggtgagagagggcatccctgtcttgtgccagttttcaaagggaatgcttccagtttttgtccattcagtatgatattggctgtgggtttgtcatagatagctcttattattttgagatacgtcttatcaatacctaatttattgagaatttttagcgtgaagcattgttgaattttgtcaaaggtcttttctgcatctattgagataatcatgtggtttgtgtctttgtttctgtttatatgctggattacgtctattgattttcgtatgttgaaccaggcttgcatcccagggatgaagcccacttgatcatggtggataagctttttgatgtgttgctggatgcggtttgccagtattttattgaggatttttgcatcaatgttcatcaaggatattggtctaaaattc

SEQ ID NO: 40218 - DNA, 1007 bp, Homo sapiens
attcactaactgcagacaaaatacctaggagaaaatagttttttaggctcaaacttatcacatcatactaaatttaacacacataatgacaactagtgaaaatttaggtgagagaaaattatggcttaaggctcagaagttctcagtcaggatatccagcttcctaccacaagcaacacatagaggcatttagaaaatgggcggagtgttttgttttttaaataacttgggctgggaggctggtgctgatgactattagtagcactcccaatcaaggaagaattttttagccccaaatgccagtagtataccagttgagaaggttttgggtaattgagtgacaaagaagaaaggatagggttttatttccgtgaaaatggaaatagtggctcttattaattaaacacattctttcaacaggattatgaatttctgtttgaagttggtgtttccaatgtatttggtcctgggactcgaattccaaaggctgccgttcaggtgcttgatgatattgagaagtgtttggaaaagaagcagcaatctgtataatatcctctttttgttttagcttttgtctaaaatattattttagttatgatcaaagaagagagtaaagctatgtcttcaatttaatttcaatacctgatttgtactttccttgaaagctttactttaaaataccttacttataggcctggtgtcatgctataagtatgtacatacagtttcacttcaaaaataaaaaaaaaatccctaaaaactctctatactctctataacaatactttatcaagaactctggacaatggtattatttttaaaaatcatggtgatgtatttattagaatgtttcttataaatctgtttactttttatattaagaattaaactgtacctaaaaaaactctgactattcccatttgtcagtttagcattacattgtcttgagcaccagaaaataaaatccatatattaataaaaacctatcttgaaaaactagtggagtg

SEQ ID NO: 40219 - DNA, 1049 bp, Homo sapiens
gatatagagatatagtaatatctggcacatattaggcacacagctaatgttggatgagttagtgaacaaatggatggaatatgctaaaagatttacttcttatcaaaaaatatttatgggagtgttgctgtttatccatttgtgttaagtggtgaattattcagcaaccttcaggtacttgtctatatatataattattaggtcattcagtcatttcttggttgacaaatgttgaaaagagaattggatgcataaaggcatccagaataaatttttcttaagtaatttcagaagagatgctttcataatgcattaaaaaattcttattttacatttttacagtcatttacttatgtaataaaatgtttaattatattgaatattatggtaaacagatatctttatcacaaaataatgaagttaatggaaccaccatttcatgtttcagatgtacagtgggagaaatcacagatgccctgaaaaaggtatttggtgaacataaagcgaatgatcgaatggtgagtggagcatatcgccaggaatttggagaaagtaaagagataacatctgctatcaagaggtaatatgtaaggtttcttaggccagaatttcatcttttctgttagcacaatccccttgaatctactgggagcttaatttccttacatacaactgagaaaatttttgaattttataataataaatagtaaattaaatattaattatatagactatataacatataatagagtatataatttattcattacatataatatataattagaaatatatcatacatgatacatattatatatctatactatcattttaataggtacatgataatatttaataataaatatcaaatattgaaactaatattagttttcatataattaatactattttgaactttcaccatagtccccttcaggagtttctcatgtcaaacagatgtttaactaacaatgatattgcttcatatcctccaggtatttatatttcaatctgcttactatggtagagtttcatattttttgaagttg

SEQ ID NO: 40220 - DNA, 1027 bp, Homo sapiens
atgtttgcaaaaaaaattcagatttgattttatagttttcaaaacaatccatttaaaaatacatttctattaaagtattttattaaaagaattaaaaagacagctagtattaaaaagctcatacaaagaacagcagtttttgatcatccacttgttttttcctgcttcctggagtaagatacatacttctttgcttatttttgtttttatctgcatagtttaaaatcacatgtatactatttcttgtaattttatcaactgtagacattacacatgagaccttagacactatctattgctttcctagtagggtagtttagattttggctgattcatacccctacttttcctcctcccttactaccaatataattatatctcaatgtaatcttttctgaattcttctaatgttctcatttgacttaaattgttttttctctatttctgctcactattgctgttctttgactcctctttgccattatagtaggaatatattttcatttctcctctgtttaattctgaatcttgaatcccatgtctatctcttggttatttggaagtacatctcatagaaacctgctaaaaatggtgcatgggagataaattatttgaaacttttcctgtttgggaatgtctttattctatttttataattgattaatagcctgactaagcttgacattatttccattcaggaaattcataagcaagtttataagcattgatctgttttttattctagatttttattctggctttcaatatttctgatcagaaatttgatgccattctcattcaggatctttctttctgaaagtattgggacctcttctttattttttgtattgatgtataacttggtgtattttttcctacatggtactgaacctttattgggtctttttcatctcacctttttttaaaaaatatttttatagctctaggaaattttcttgtattatttctttgacagtatttttcttgtcattttcatatgggttctctttctagaactcctagtcat

SEQ ID NO: 40221 - DNA, 1028 bp, Homo sapiens
agggtaagtggaatcaggccccaaccattgtcctcaccttcatttggttttgctgactaactgggctgagaagtgtattctaggtgacccaggggaataataggccaaagactaaaagtaaggccattttcttgttattgtcctttgtttagagcagtgttcctcacccattcctgcacagcagaatcccctggaaagttccttatttaaaagtaactttttaacagtacagttaaacagtccatttaacatatttaaccgtccattaaataaaaggactacatgcatgtggcgggagaatttctaaacagaacaggtatatagtatgaaaacgaaaagacttgcttctctctcctgtcactttgccaagaaataacagctttgaagtgttgcaggaaacaaaactttaagcatgtaccagcaaatacactatttccttgttaagaattatctctgtttttaccatgactgtgatgtgctagatataatcttttatatttgtctgtgcgtggggtttgttgagtttttccttttaaaaaaatagatttctagtattccgtcacagggatgtatttaactagtctccatctgatgggtatttagtggtttccattttttcctccctattttgaatgaagctgtagtggccatccctttatgtgtgtggatagatttgggaatatatctgtagtataaatacctagcaaggaaattactggattaagagttatgtgcatttttcttttggtagagattgcaaaattaccctctttaaagattgtaccatattaatacttctattaatgaatgctcataaatgctttgtatttaccaactccttttatcctatcagtaactacctcacaatgtgtagttatctttattttacagatgagaaaatggaggtacaaaagattatgtaacttgctcaagagccacaaacttgaaaatcgcagagccaggatttgagcccagagctcatgctgtgtcctggcagtttataatcaatcccacagtgtatgggaaca

SEQ ID NO: 40222 - DNA, 1077 bp, Homo sapiens
ccaaaaatgagagttattggtgacaatgattacagcctcatggctttcctgggagtttctcatttaattacacttcgtccccatacacagttctgtctgaagttctgtgggtcaattccagaggtggggcatgatcagcatatttggatcacagacagaaccagttgtttaattcacaatagctacctgccccctccccaccaactctaattggctggtctagtttggcagcctaaaaaggcttactcctgctaggggtactagctactgatgttaggaattgaatataacgggtttcctctttattctgtttgtcccaggactgtcctgattgcctgtaatgttaagcagatgagcaaggatgctcagccctctttctctgctgaggatatagccaagatcaagaagttcagtaaaacccgatccaaggtctgggcatcctttagaaatttgagggtgggaatggatttctaagagttgtgttttggtgcatggctatttttgtactagatcagaaggaagggttgaggtttggtgttagctttttctatttttgtctcaatcaacaaatgaagggtgtttttgctgtttgttctttagtaattctgttgttattaaacaattttaatacctgctacctgctgggctgctaaatgagcctagtacaaatattaggataggtgttaacttgcccgtgtaccagtaagtctatttattactgaaggcgttagtgatgcattactacttaaacattttttctttgttttagttctccaacttgtttttatctttttaagataggatgtatatccacatttagaattgaactacatatatgaatgtgtgatgataaaggttactgttcaagcacagtacatgttcttattaaacctaaaatgttttgaacctggggatacttttttcccttaaagattaaacctctaaacaagttttggaatccaggctgctctgtgcctactctgataatggcctgatagtgtaatttgtcttagaaaataattttttgcagttaggaacaatgtacctgtttgtgtgtttcttcaagtattttctttt

SEQ ID NO: 40223 - DNA, 1116 bp, Homo sapiens
ctccggggctcaagtgatcctcccaagtagttgggattgcaggcatgtgctacgccacctggcttcacaattcttatttttttttttagagacgggatctgtctctctcaggctggagtgcagtggtgccattatagaacactgcagcctgaaactcctggactcaacgaatcttctcaccttagcctcctgagtacctgggattataggcatgcaccaccaggtccgctaattttttttttcacttttttctagagacagggtctcgctatgttgcccaggctggactggaagtcgtggcctcaagtgatcctcctgcttccatcttccaaagtattgagattacagacatgaaccaccatgcccagccacaactcttattatttttttaagaaaacacttgttcattttagaaaattaaggaatagtcaaaagaagaagtcatctacatagatgttttaacaacgttataattttagaatctgctttttaaaaagtagaaaaataatgctagactgttatgtaatctttacaaatattttgttgcgggtttgggagcaggttggcataggaaaatgctttcttcttggtgttcagattgatctggattgaggacaatgcaaggttttcctctggagacaaaagatcatttatatggattacttgatgtctgaactgattctatcaaacaattcctctcctcccctcatcaaattttaattgagaactactgtattcaaagcactattaggcgctatggaggacaaggatataaataagacccagtcctcgtcattagtcttcacagtggtggagaaatgaaacataaacaaaaacgaatgaatatcttagaattataacttaaacatactttagcatcatttagtctacctccagatgaaatgctgagatcagagaagttaaacaatttgcttacggtcccagttagtgatggccttaaggactaggacctgtgtctctttaattcatgccagttgtattttctaagtcattctgttgtcttcttcggaccttaagatctccacttttttagaatttcctcttcaggaagtacttgggaagtactcttctgttgattactgtggccaagcttct

SEQ ID NO: 40224 - DNA, 1051 bp, Homo sapiens
taatgtacatatttggggaatacatttgatattttgatacatgtgtatcatgtgtagtgatcaaatcagggtaattaggatatccatcacccacctcaaacatttatctttcctttatggcggaacattccaattctcttctagccattttgaactgtgtaatacgttattgttaactatagcctactgtactatcgaacactagattttatttcttctgtctagctgtatttatgtaccattaaccaacctcttttcacatcccattcctctctacacttcccagcctctagtaagcaccaatcaactttctatttccatgagatccacttttttagctcccacatatgaatcagaacatgcagtctttgtctttctgtgcctggcttatttcacttaacgtaatgacctctgtttctgttggtgttgctgaaaatgacaggattttgttttcttaatggctgaataatattccactatgtatatatacgtttcttttttaaaaatttagtttgatgaagaatttctggaaacaaaagaacagttgtacaagttgcaggatggtgagtatgaaaatgaaacaactgcctctaatactgattttcctttaagagctgctgtttatgtggaagggcaaaagtattcaatgacactgaacattcagaacagtatcctaaaaccaaaaaaagcaagagggaataaatagttgaaattgccaggaaatcacttcttattcaatagttccataaaagctggccgaagggggtgagcagttccttccacatcccggtgaacagctcctctccatccctttcttctcccctctcccctccaatctcttcctccccctttctttctctcccttgccccttccctccttctcatctttccctacttccttcacactatctgaggcatcctggcctgcttgaagtatgcaaataaatatccccatttacatggggtactttctgaagtaaatactacacagaagtgaaatcaacgaactgccccctcccttcacctttaattcctggtcagccctgctccc

SEQ ID NO: 40225 - DNA, 1078 bp, Homo sapiens
tctgaataaggactgccccacctcgccctcttgtttcagggtgtgtttgctaactgttaagaggaaagtgaaaaacattcatggtcccctgaacctgctcaacttcacttgtgtctgtcatttttctaacccccataggcttctgagtttgtaattcttgatttatttcataggttttgaatggatgtcttatatatgtatgcaatataaccctttgtcaaatcttctctcttcattctaccctgcccctcctactcacctatgagtcaacatttttagttacagtaataaaaactcaaccctaaataagttaaacaaaaaaagaacatgagtcatctgacccacctaccccagtccaatcacaggaacaggctgatcaggtagagtaatgagcccactcctcagaccagactggatgaagctagattggtctctctcccagggtgaccacatggtttacaaggtggtggggaggggccctccccgtctctttgccagctaagtttgtgctcacatagatctgagacagtcgggagggaccagctggcagccaccagacaagtccatgattctcaatatcccacgattgggttgaacctaaagttgaagcacacacatctgagtaactaggtcactaaaacctactgaaaaacagccttttctaattcagggagttctcaatgctggtcagtcacttaatttgagtcatcattgacattgctctatgttggttgtttcttccatgcttggaactttacttgcccgaagaccccttaaaacccaggcaaatcccctttgagacgtggaggatttacaccatttctaccattaactgggagcatcagttgagcaccttgtccctgcatatatcatataaactttctgagctaaatgtggtggcttgagcctataatctcagcttcttgggaggctgagggtggcaggatcccttgagcccaggaggttgaggctgcagtgaactgtgattgagccactgcactccagcctgtgtgacagacctctaagaaaaaataaataaataaccctttctgttaactaatatgatgttttgactttt

SEQ ID NO: 40226 - DNA, 1033 bp, Homo sapiens
aaatgctcccccccagtttcacccccgagttgtggtgtgaagatggtctatagtgcctacccataactggcatatacatgataaaggtctgcttatcccttgacagtaacttaacagagtccaattcctgaacactcagcctggaggcctagagaaccagggtaaccatgcagtgaatccttagtaagtattatcctgcccttacttaaaatggcttgagcttaggttattcctggctgcagctctgcttctgggatctgttgctgtttttccatctgaaccttgccaggaacactactgcttaattttttttttttatactgctcctcttgcagcagtctcctccatttcattttgtaggatcttgcagagttggagtggtacctagccgttctattgatgtctgcccttataaaatgcatttttctgcttgtgggatctatgtgagtgtgtgtatttgcctggtggttccttgggagaattctggatataatgacctctctgtgtatgttgatctgaaagcctgtgaatagtatctcatttaactgttgtctttcacctgtggtctttgatgactgtggctttctgagaagggcctatgtttagagtattagaactctcctatctgtgaacctcagtgtttatggttgatgtggttgaatcagggagaatgcgcaaacagaggtgtgtgtgtgccggatgacttatacacgttttgggattacagtgtaattgtgtcttagtttgtggttgtgcttacctttgaaatacagttttaacttccttataaaagcacatgtgttctagaaaattacctagtaaaaagaatttggtgaaacaaatcattttctggggcaaattgcattaaaatgctaaggaaatgttgtggcaggaagaaaatcagagatgcctttgattgcagccaaagaagtaaaagcagcagctcaggcctacctcaaggtggtaaccaaggttgatatgggcatcttcattcaatctgtctgctcctagttaactgctgtccaatattagg

SEQ ID NO: 40227 - DNA, 1030 bp, Homo sapiens
cctgcacttaaatgccaccttcccagagaggcctccccaactaccagatctaaaatatcattcctcacatccctccccacacacacctctctttgacttggctttatttttctctgtaatatttccattgtgttgtatctatattgaaatcaagggctttttcttttgcctgccacataggagagtctcaaatattagaataaatgaatttgtgaatgaatgaacatgagatgattaacgttgatgttgcccaaaccctcccttgtgggagctgtaaccttatctcacatatgaagggcactgtgtttttaatagccctgaggttgtcagtaggacatcttaatcatctcagaaaagtggacccagacatatttcggaacagagcatatgatggtgaaccatcaaatcccaccaatgttaagaattaatgagctttctgttctcctatgaagttaatgtataaatttgctgctctgtacctttcacatttagaactgaagacaaaaataattgtgaaggtgaaggatggcattggaaactatttttagaaccctgcaacaactgagattttttttaaaggcactcagtctaaccttatttgattttatgacctctcttaactgttcctcagattatagcttgggactaacaatcaccacagtttttctagttgttattagaactaacaaacagctcctaataagaagagaatggagagatagtagctcagtccagtgaagaaatgaaagaaatccataagtcacaatactgggaataatccctaagcttattaccctccccacgaggtcaacactagccgggttgtggggatgtacccacaggtaacacagtgcaatgatttgccaaagagctttatgggcatgactccagatactgtgataaggatccctcatcgactgccctgagaaataagttttcaggcactgagcagagacagaaaacatccatcagcagctggtgagacctgggaggtaggttccaaggtgatgagtagggcaaaaacaaagaa

SEQ ID NO: 40228 - DNA, 1033 bp, Homo sapiens
tatggtgacatcaatgtgattgtaaattatttataaagtccacattatctagtgaggatgttccgctcacggattagcgaagagacatagggaaaatccttcaaatactatttcattcattctgtgatgccattgagcaaaagaaactgccaagtcataaaagtaattaccgagtaatacctataaatctaataaacttggccaggcacagtggctcacacctgtaatcccagcactttgggaggccagggcaggtgaatcacctgaggtcaggagttcaagaccagcctgaccaacgtggtgaaaccccacctctactaaaaatacaaaaattagctgggcgtggtgacaggagcctgtaatcccagctacttgggaggctgatgcaagagaattgcttgaacctgggaggcagaggttgcaatgagccgagatggcgccaccgccctccggcctgggtgacaaagtgagacgtcatctaaaaaaaaaaataaactttttttgagataacacattacatgtttgtaattctgtatttaaaaactgagtagtatcatgtttatacaactatgtagcactttttaaataataagagtgaagcttctgagattaagctcctgccagacattaaagacagttcaaaatcattttggccatggttaggtctacagaatctcagaagcatgctgctctccccaacccttgcttgcaatcctgcagcattcaccgagggccttcgcagctccaggcatcttgccagtgctggggaaacaacaaatgaaaagataacctcattttgggtgaaggacaaagacaattacaaattataggaagtatgctgacggcaacaatcagaattctgatgtgagaataatctcttaggtacttgtaaagataatttggaggcacgtcaaaagatactggagttttacctatgtggttaaatgggtagttcctattgtctcaaccaaataagatattcctggaagtttcacatctctaaaaaattatctggaagcttctgattatctga

SEQ ID NO: 40229 - DNA, 1115 bp, Homo sapiens
catattattgcttagttctcaatgaggaaggaccctgcataataaggcatagtggtggttccaccctaatgctgtcccctctgcctcctccaggtaatcccactaaaggttccagctctaaatatgctcctttgtccttcctccccattggccccaatctctccccttaccctgagaatgttagaattactttcctaggtctagaccataggtcttctgcaaaatttttttctggaaagaaccagttggaaaatatttcaggctttgcaggacatacagtccctgttgcagccacttgactgtgccatcgtggagcacaaaaacagccatagacaatatgtaaatgaatgggcatggctgtgttctaataaaactttatttacaggcttggaaaacatagcaagacctcatctctacataaaatttttaaaaattaactgggcatggtggtacataccagcagtcccagctactcaggaggatgaggccaaagatcgcctgaacccatgagttcgaagttacggtgagctagggtcatgtgactgcactccagcctgggcaacagagtgagaccccatctctttaaaaaaaaaaattacaaaacagaaggcctgtgcctatagtttgctgacctctactctagagtaatgaggtcccctccccttggacctaaagctcaatcattttatttgccaaagatcattttatgtcccagattgtggcccttcccagcgtaccctacttattttgaatttacaggtacattcacgtctacaacaggagagatgacatggatggtccatcttccttccatctacttcataccatatggtccccagtataggctcttaggtactaaactagaaagcacctaagagccaagactaagcctataccgttttaaatgagtgctcatgaaagtcatgttagttgctgaaattacctgcggatgtgactgcagaattgtcagaactccagagaaatgtcacctaaaactgcatttagtacttgggatattatccagaaggtgtaagaggattgttggggagttgatgggaataaattatatccctgtctttcccctctaagttcagaacaaattgaaaaaatactgg

SEQ ID NO: 40230 - DNA, 2077 bp, Homo sapiens
tgggaaagaccaatttggccacataacccctgtcatctgccatccagatactaaaaggcaaagcaaagtgtaaattgaattttctatgtgacattttaaatagtatttctgttgcagcctgtgattcagttaacttacctcaggctaagcctcaaaaaaaaaaaggaagaatgattgaaaccagtgacaaaagatttagtcaatgaggacttgacctcaggagtttctccttgataagatttgatcttgaaactaggcctagtgttagggatgcaattctcagtaaagttccctataaagaaaactgtggtcatttggttctcatctgcccttacacattttagacctacaacaagaaaggggcctcccgaaggaaagaccacctgaaggaccaccagaatgggtccatggctgctgtgaatggacacaccaacagcttttcacccctggaaaacaatgtgaagccaaggaagctgcggaaggattgaagtcaaagaattgaaaccctccaaaccacgtcatctgattgtaagcacaatatgagttgtgccccaatgctcgttaacagctgctgtaactagtctggcctacaatagtgtgattcatgtaggacttctttcatcaattcaaaacccctagaaaacgtatacagattatataagtagggataagatttctaacatttctgggctctctgacccctgcgctagactgtggaaagggagtattattatagtatacaacactgctgttgccttattagttataacatgataggtgctgaattgtgattcacaatttaaaaacactgtaatccaaacttttttttttaactgtagatcatgcatgtgattgtaaatgtaaatttgtacaatgttgttatggtagagaaacacacatgccttaaaatttaaaaagcagggcccaaagcttattagtttaaattagggtatgtttcaagtttgtattaatttgtaatagctctgtttagaaaaaatcaaagaccatgatttatgaaactaatgtgacataatttccagtgacttgttgatgtgaaatcagacacggcaccttcagttttgtactattggctttgaatcaagcaggctcaaatctagtggaacagtcagtttaactttttaacagatcttatttttttattttgagtgccactattaatgtaaaaaggggggggctctacagcagtcgtgatgaaacttaaatatatattctttgtcctcgagattttaggaagggtgtagggtgagtaggccatttttaatttctgaagtgctaagtgtttttatacagcaaacaaaaagtcaattttgctttccaccagtgcgagagaggatgtatacttttcaagagagatgattgcctatttaccgtttgacagagtcccgtagatgagcaatggggaactggttgccagggtctaaatttggattgatttatgcactgttatctgttttgacacagatttccttgtaaaatgtgcctagtttaccaaaattaacaaagggggggaaaggaccttagaactttttaaggtaaaatcaaatatagctacagcataagagaatcgagaaatttgatagaggtaacttgtttaatgtaaatctaatagtacttgtaatttctttctgcttagaatctaaagatgtgtttagaacctcttgtttaaaaataatagactgcttatcataaaatcacatctcacacatttgaggcagtggtcaaacaggtaaagcctatgatgtgtgtcattttaaagtgtcggaatttagcctctgaataccttctccattgggggaaagatattcttggaaccactcatgacatatcttagaaggtcattgacaatgtataaactaattgttggtttgatatttatgtaaatatcagtttaccatgctttaattttgcacattcgtactatagggagcctattggttctctattagtcttgtgggttttctgtttgaaaaggagtcatggcatctgtttacatttaccttatcaaacctagaatgtgtatatttataaatgtatgtcttcattgctaggtactaat

SEQ ID NO: 40231 - DNA, 1033 bp, Homo sapiens
gtctaagaacagatgtaccgtttctgacaaaaatcgtttcttgcgtgtgcttttgtagagaacacatttcattttataaagatgaaagagtgctcctgtgcctgccagcttccacagggcctcttcaagatggtttagactcagattatttgggacagatggcttgtaacaggattcttcaatatctccaaatactaaattccacagtctcttttggtagcctgctgctggttcagtactcttggactgaaattttaccttatgtttaatcaagctgcttttctgttgccgtgatgttagcctagattctcaaattggactatgtcctaggcatttgtccttatagtaataggtcatttatcgcaattactgggcttcatatttttccggggccactactgttaccctctccattcctgccccaccaatctgtattttcactttgaaacatttcttcactcttgtttccagcttctttatttcctcattacatagaaactgaccctgactacagccctctgaaagatctaattaaaaagtgaaatgattgattcccttatttttgttagacatattcctcctgtttgatctcagaatacttttgtttgaattttgttacagcatggttttgaacatatattcagcttatattcatatcatcattctactgtctgctcatttgcaaactggattttgtttttgctttactatatctggatccttttccccattatgaatgtctcattttttctaggtcaccaggtatgctcctttatgtttatccctattttggcaatcctttgtattaatatacagtaggtgctagatatttgtgtatttaattagtacattccttttagttttgtctttcatgtttgggtaatatctgtttctgacaagttcctctcctgatatattatcaactccccccccccgccttgcccccaccttctcttgctgtctctctaggggtgtgttagggcttacaagtggacattgtgggttgtcagaatgattggagctcactgatggc

SEQ ID NO: 40232 - DNA, 1865 bp, Homo sapiens
gtcctgtccttggataggacatctagacacttgtgaagtggtcattagtaaattgagtgtgaaacatggcattttggagaataaattgtgaagcaacctccctgaaaacttattagtaggataggacattcatgttagcgagtggacctagggtgttgggcagagtcagggagaccaggtgacttttagcacagtgcttttctaccttgtttcggtctagatggaacagggttatcagtgtccagaaaaaaagtctttggcttccggttaatctgtccgccccagccattgaagagagtggggtacttatttatgcaatatcaccctaggccttttctagtgtttgtatatcatctctctgcaagtttcttctgtcaaacctcaagctaattcttttcctttttgatacactttggagatgaagaaattctgatttttttttggtatgatagcccattcctctgctttctctccaaactaagactaagtagttatcccagagtcgttgctatagaccagtattctgccctccttcctgattctatttcttttcctttttttttttttttttttgacaggatctccctcttgtcaccaggctggaatgcagtggtgccatcttggctcactgcaacctcacctcatgggttcaagccatcctcctgcctcagcctccagagtagctgggaccacaggcacacaccaccacacccagctaattttcctattttttgtagaggtggggtttctccatgttgcccaggctggtctcaaactcctgggctcaaacgatctgcctgtcttggcctcccaaagtgttgggattacagctgtgagccactgtgcctggtccccaattcttttaactctacttaatccatgtttttaaatgttacttttagttatataaacttatgtaatcaatatccatagatagagatctgtaactgtttttcttttcttttttttctttttttttttttttttttttttgaggtagagtctcgttctgtctcccaggctggagtgcagtagcacaatctcagctcactgcaacctccgccttccaagttaaagcacttctcctgcttcagcctcctgagtagctgggattacaagcgtgtgccaccatgccgggctagtttttgtatttttaatagagacatggtttcactatgttgaccaggctggtcttgaactcctgacctcaattgatcagcctgcctcagtctcccaaagtgctaggattaacaggcatgagccactgcacccgacccataactgatttccttaaattctgcatatccgtattttaaaagggatatgggaaaagcttgttacttatcctggctttagaaactgactaatattgggccgggtgcggtggcccatgcccgtaatggtcgggcatggcccgatggtcggtcagatggtcgggagttcgagaccagcctgaccaacatggagaaaccctgtctctactaaaaatacaaaaattaaccaggtgtggtgatgggcacctgtaatcccagctactcgggaggctgaggcaggagaatcgcttgaactcgggaggcggaggttgcggtgagccgagatcacgccactgcatttcagcctgggcaacaagagcaaaactccgtctcaaaaaaaaaaaaaaaaaaaaaaagctggctagtattggacgtggtagagccatttctcattccatgaagtttctatttgagacttttttagtcatagcttcactgagatcatgttatcactgtatttgcttttatgtcatgtctaggcaggcctccttacctgagaattaatatgaccacgtttatcctgttcctaggatgccaaaatctgatgattca

SEQ ID NO: 40233 - DNA, 1613 bp, Homo sapiens
agttcctgattccagagggtttcctgatttagtatatactttaagcctgtatacacatacttaatctacaccttggaccaaaagagagtcagaagcagatttctgggacacttatatctttatatctgagaaagctttatggcagagctatccatgttaagggcctagcattcctgaattggtcaggatgcttttggtgcaagaaacagaaaacccaactgagacctacctgtgcatctgacctgaaaagtcctgagggcaggacttttgctccatttctctgaagtcccctcagatgtctgttatgtcctagactgattttccaagatgactgacagcagctgccaccataatctcacatggggattccctgacttcctgccaccctccaaagagtcctttaccttaaggtgattgacttaggccttggttacttgaagcaataactggaacagtggacatttgataagctgggggcccatcccagaaccagggaagtgaagttaaatctcctcagctagctgcttcacctttaagaagggcctgcagaacacaggaagtcagctacagcgtctgttttaaggaccgaatggatgattggattaaactaaattgacttgaattaaaattagaatttagccttacattttgtaaaggactcttagttgataggcaggaataggaggacatgcgttctaggcaagagggagtttggagagtaagcgagtgtggaatcattgggcaaaaagcaaatagcacaattggcagaagctggtttagaaggcaggagtggaagaaaaggtgagaaaggcaagttattgatgtaataataatggctaactcttactgagctattgtatgtcagaccttgcactgagcccctcacaaggacttatttctattattaatggatgctacagcattcccattttacaggtggaaaaaggcccagagtttagacacttgatttggggtcacaaagcattccagctcagatcaccttgacaccctggcctgctccgtctcctaaggtgtttggtagaataccaccaataagcttttgaataagaatgaggacattatgagtgctgtgctccagaaagacagtcttgttagagtgtagggtggattgttgtgggtttgttagagatggccagggcagtgaaaaggcctgacctgaagccacagccatgagcacagacttgagagaggtaattgtgagagactgtgtccaggataagacttgaagaccagttggatttgagggccagcaagaggagggatactcttccaaagagaagagggagctttgtgatcagatggaaatagccccacagcctagatagatatccagactagctgtttcttccaattcctcctcttcacggccaacctttgtcttagctatttttttggttgcctttctgcaagaacatgtttctaccacatttcatctattgtcagcttttcacatttcacatctgggtagagatggagcttataatcagtggcatcttaaaatcactgcaggtaactttccacattttaatattacagaattgggatgcctcctacacttttccctggtgagaaaaggaaagccccaatgttac

SEQ ID NO: 40234 - DNA, 1004 bp, Homo sapiens
cccgtggcaggaagtgcttcatagaattgtacggaagagctgatgttgcttgtcaggttttgtaactcattctcctaaccgcttggcagataacctgttggtctgcacttgttttgcttgcacgtctcagccaaaagcatttcgtgcagaatctacagatagaaacaggcggttttgcattagatggccgtggacaaacattttagccttccatctgtgattggggacaagtgggttacttttctggtagctcagacactgcctgggattctccaggaaagctctgcacttgaaagggaaatgttactcattttccttttagatttttaccctagattctaacttcttattgccaggaactttttctgtactgtttctctttttgcattttcgtttctatttctaattgaagacaaaggggaaatttttattgatagttacagataggtaatgttacagaatgtagtacagaactttgctgaaaagcgacagtagaaggcttactaaaatttgatgtttttcaagaaaaatatcttgtaacttcagatattgacctcacctccttgactcaatttccttgtctatacatggggattttatgtggcaggatcattgtggatttcaagagataatgcaaatgagagcccagcattgagtctgccaaatggtggtttgaaaatgtttccttcccattccctgaaatcaacagcttcttcttggttacagaccttaatttttggatgttctgtttgcaagaatctttttttccactacctcttcttttgctccctgcataatggttgcttgtcttcctgcttctagaggtgagcatccatccttgggtgtcttatttccagcttgaattacacaaatcaaagcaaaactgtttacttttcttgagggtaactttggtgcctaggtgggtagttagtgtgaagagagagttttacctcttgctttcctggctacattcttctctcctaaaagattttgtaatttttttt

SEQ ID NO: 40235 - DNA, 1072 bp, Homo sapiens
tcctaagtaaccagagaagatagcagatgtgcacctgttcacatcttcagtacccccaggcttcttggttgttgatgcgtgcaccaggcttgatttgtcaattctccaagtcgtcacaaagttattcgctgagccactgcgaataactcttttaatagggagattattttcagtcctaggtctgtaaatgcctactgggattttttttttctcttagttatttctccttttttgtcctctctaaccatcagtatctgtgatttgcccatcttactctatataacttataaaataggtgcagtacctgatatatataataggcactctcttccattaacttcaagttctgttggtttgttgttcaattctgaggttttaagttgctttaaggctctcactagcctgatcttagctttgtacaatgcatgctcatctgtcatcctgagcctaggctcctgatccagagtgggaacatggagacttctcagcgttcattcctttaacaggccctcacgtttgctatgtgcagagccttttggggaagacagatatttgtagacgtagtttctaacttcatatgttgtcatgtgtttaaaggaaaataaaaataattcagctgctcaagaagagatagattatgacagatgtcaaaagatgcaccagaaatccttcttggagaaagtaaggtgcttctgactgagggaatcaaagcaggcttcacggaagaggtggcatttaagctgagtctatagcagcactgcccatagaaacatgtaattgtaaatgttctcatagccacattaaagtaaaaaccagatgaacataattttatattttgtttaacccaaaacgtccaaaaatgttatcatttgatccatgtaatcctttactcacaagtaattttacattttttttgtacggagtcttcaaaatctggtgtatattttactctcacagcatgtgcatgttttcattaggacaagccatatttcaagtactcagtggccactgtgtgcctggtagcttctggactaaacaagcatgagtctggaggataattattaatcctgca

SEQ ID NO: 40236 - DNA, 1019 bp, Homo sapiens
ctctgtgtgcattttcagttacttataaagattttgggttgggcatggtggctcatgcctgtaatcccagcactttgggaggccgaggcaggcagatcacttaaggccaggagttcaagaccagcctggctaacacggtgaaaccccatctctactaaaaatacaaaaattagccaggtgtggtagggcacacctgtgatcccagctacacaggaggctgaggcacaagaatcacttggacctgggaggcagaggttgcagtaagccaagatcgtgccattgcactccagcctgggtgacagagcgagactctgtctcaaaagaaaaaaaacattttggacccaatacttgttgacccttatgtagttgaatagctatggaaaagtaataatcactgagaactgtgaaggacttcttagcttcatttatacctaatggtttctacacttttaaagcaactttaaaaacttaaaaattgagcagactatagcaaaagaataagatggaactaagttatttctcctccgtagccatcctaccctttggagaccagagtatgggagttacatgattgaagggacaccaggacagccctacggaggaacaatgtccgagttcaatacagttgaggccaacatgcgaaaacgccggaaggaggctacttctatattagaagaaaatcaggctctttgcacaataacttcatttcccaggttagttcctatattaacatgccccagcagatctctcagagatacaggtaatgaaaagagcaagtcacgacccgggcattccaccttacaatcctcatacgttacagatggtttatcttttatagactgcacttgatagactctgtaacagtagagctgcagacacagttgcatgccagcttctgtcagctgtggtggctgcaccgtggtgagtgcactcagtgggggctcagtgggaaagaccaggatactgtgatgacagaccagcagtgtggccgtgtctgccgcaggcgagggtggagggag

SEQ ID NO: 40237 - DNA, 1030 bp, Homo sapiens
tgttaataaatgtactagtgcaccctgcattgcaaattttatatggtttcagagtggagaagttgccttaaattacttgagataaaccaaaattaaattgttgaaacccctcaaataacttctccacacggtatatttatgattatgatttaactctccaaaagtgggactggtagtgggattatgaaagtgtaatctaccttacttattactctgccagtaagtaagtgtaatctaccttgactggaatgtccagataacctctttcttaaacttatagtaagccaactgaggaaataaattttaaaatgcagcttcttttttacaacagcaatttacagaatctttgcttcaaaacacatcttttttttgaagtacagcttgtcaaaatgggtatcgacctttccataggatattaagtaggacagaggaaagaagggatggaagtggcactactgactgatcctttctacaggtttccatattatgcatatgaacacttatgtgctgtactgtaaacaaatgtgactgtctggagttactgtggatcctttacagacttcacgtttccctgcctttttcttctggaggccacactgaaaacaagtctggaagaatgttaatttttctcacctttattttcaataggtggaatacatgttggtatcttttgatcatgaaaataaaaaagtccggttggtcctgtctggggagaaagttcttgaaactctgcaagagaagggggaaaggacaaacccaaagtaagctctcatgtgctgatttagtgtttctgaaactgctaaaacttctagaatatagagttttttctcaattattggaggcaggatagcctaacagttaagagtacaggctctggtttcaggttgccatagtttcaaatcatggttcctttactcaatagctgaataaccttgggcaagttacttaacttttctgtgcctcagttctctcatctgtaaagtaaagatcatagcaatacctacctaaggtgttggaattaaatacatta

SEQ ID NO: 40238 - DNA, 1045 bp, Homo sapiens
ggacaaatgctaacaagtttagtaatgtgactgcagccttcccagctaatctgctggcaagcgagccctgtgaaaaggcagatgcaggacgagccctttctatgaaaatcaggctgacctcatttgatagttatgcagcctgtgtcgatctcttcccagggcagcaggtagcaggccagaatcagaaccccaagtcaggagctttaacttatctgagattttcatcctttagcatgaatttcaaatatggcagggaaggagattgaattcacaaaaacctaaatcttccaaatcccacaggttacagttactctgttggtgggatccactataacacccaggtacgattcctgaatgggaacctgatgctgcctttgtgagatgtggttatgacacagtgtctgcactcagattcgtatgatggtggaatggcattaaacttggaggtcttgaagccctgtcgtcctgtccctggaggcataggtgacccccagtgagcactagcagtcactttggacttagaattcctgtatttagcattgactctcacttagtctctttagaaaactctcttttttctctctgttaggttgattagtctaacttcagttcctaggaactaaaatcctgaatttctcataggcagtctgaatttagggcagcctaatttataacatgccttagaaggaaatcatgtgtgcattcttgcttgctcagcccaagaagtgtatcaggccctgagcggggcaccgcccactgggggatgtgttctctgtcttgtccccatgctaaagccctaaactctcctgcacctagagggaaccgctgcagaaattctccatgattctcacccactacagtgccccagctctggctactgcagggcagttgatccaaagcagcttctgtctggggatcaggatactgtttcttgtcaaccacgtggtgactagaactctagcaggggaatacgttcttaggaaaaagccaaggaattcatttgtctttagaactcagaacctattgtactgaagtacagatgatt

SEQ ID NO: 40239 - DNA, 1037 bp, Homo sapiens
aaaacgcattgacacaggctcaggctaggcttcttaaaataagatatagagcacaaattaattatttcttaataggcattacaaagattcaggttccttctataggtcatagcgtattctgtaacacaaaaagcaaagttgtcgcatctctctatcttttttagctgtcactggacattgattcaacagcatttattgtccgttaacccctacccacccccagaagttcccttgtgccctttgcacgtgtgtgcatgcgtgtatgctagagagagagggggagagcacttcagttgattctggttttccttcagacaccacctttgagaaactgccttaaagagtgtgtggtcattaattagatgaaggggagaaaggaaggcattatggtcaaaagaacagtgtaacaaaggaggaaaggtgagaaataccattggatagtatgtgaaggttattgtgcagtttagtgttgtaaatgcagtgaataggtttagccagcttgtagaagtctttgtctagttctcaaaaagtagaggttatgttgtactttaaaagcatgagaaaagtagaatcgaaaaaaagtgtattagtcttctatacctatctcctacagaaaaaatcttttaagacttatcagttactgtgacctaccatatcatggttgaattcctccatgttaagaccctactgtctagaagtatggtattagcagatgtactcattgattggtactgtctgtagtttcattttgaagcataaacctgagtaacattcagtaagactctgtatgttcagaaaagatgtcacaatattaattgagcctctaacatcactatttatgtttctgaacatttttacatactgtcaaggcatctgaatatattcttaaagttagaaaactgtatatgaagcattactgatattgctggtattactggaaagaccatatcctaacgagcttgctaattagtactctgtttctacatttcatgatataatcaggtgtttttaaaaaaacattttaacagctttattga

SEQ ID NO: 40240 - DNA, 1082 bp, Homo sapiens
ttgcccctccctggttgcatgatacacttctcctcctcattcataactcagctatcaggactctcccaggaacaactgattattcccctttgtatgctctgctaaattaaaatttcaaaacatgtacccctttgtaaagtggactttcattcaaggtgcacagttcagtaattactaccaaaagaactactggtacaactttcaccctggtcaaaacagaacattatcactcccttataaaaaaagttttacctttttttatagtactttatataaatgaaatcatatcatgcgctttctgtgtctggtttcttttgcataatgttatatgtgtgagatttacttgtgtcgtatacagcagttcatgcattttcattgccgtgtagtatctgatttatggctacaccacgtgttggtgtgttttttaagattgtggatggatattagggttattttcattttgaggcattgcaaatactgctgttttgaacatttatacccaagtcttctggtgcatatgtgtgtatgcatttctgttggacatatacctgaaagtggaattgctgggtcataaggtatattatattcaaatttagtagatactgacagtttcccgaagtggtgactgtatcaatttatactccccccagcaactttgcttgtaattggctttttaacctaagctatctttttgagtatgcagtggtatcacatttttgtttcaatttgaattttctctgatgactaattgagaattatttcatataatatatatttattgaccatttagatattctgttttctgaagtgcctgttcatatcttttccccttttttctattaaattatctgattctttaggagttctttataacttattttatttttattttatttttgagatgggatcttgctctgtagtccaggctggagtacagtggcacgatctcagctcactacagcctctgcctcccaggttcaagaaattctctcacttcagcctcccaagtagctgggattacaggggtacgccaccatacctggccaatttttgcatttttagtggaggcggggtttcaccat

SEQ ID NO: 40241 - DNA, 1028 bp, Homo sapiens
tttgcaataaatggaatcctgttttaagtaggggaagccgaaacttaccttgtagttggaaatctagccttttctatattatgtctacttagagtaagcctgcatacccttgtgtaatagagaaaggctgtgaatccacaactgttttctgagtgcctactacacaccaggaaaaaaagttaagattaaaggtggcatcgggtttcaaaaattagttgcagatggacccaataataagggtgagctgtctctaccttctttcctcagattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagaga

SEQ ID NO: 40242 - DNA, 1025 bp, Homo sapiens
tgactaacaagccatcaatcattgtgtgtaattatattctttaatttatccccatgttgaaatactggcattctctttacctcaatagtacatgcaaaagacacagtccctgccttactggtctgtcttctcagtgtgatgagagggtaatgaaaccatgtgggcatctgtagctggtggattaatgatattttagcatgagctttccattttcatgctgacactttctttaatagtggttattcttgctggtgtctagtgttagaataagcacactttattttttcctccccgaactcacctgtatccaaaaggaatgcattgtaaaggaatgcatttaactttttgttatgctgagttggagttggcatggcaaaaagatgttcttgaaattctcaacgtgatctctggtgccaggtggccgttcttcccattaacgattgagcgcctcttcttttccgtcttttctttgtgtgcattgttgtgtgtgtataacccagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaaggtaagactcaggatgaagacttttcctccacctttgcaatcaatgtcccaagtagacttttgaatgttctatttagggccctagaatttgtaggaccagctatctccatttgtgcaccttctcatactgtgggaaatacaggaatttttttttgaatgtatgcttttgcctagtggcccacatagagatgatctatttaggaagcctttgtgatcttccagattgatttttctttttaaagcttcattcatttttttggtgtgtatgatttgccattggatcttttcacttattttaaattattattcttactgtgaaatgtgac

SEQ ID NO: 40243 - DNA, 1011 bp, Homo sapiens
tcttagaatcattttattttggataagccctgggcaagtgggccagtgcttactttcatggctatgtttaattcctagaaacattttaaaattactgccttactaatattgtttctgtcataagaaagaaaaataatttttagaccaaagctttggtagtatacttgataacctttgtaatcttttttttttcaaactgtttcctttgggctaaatcagcatgcagccgtctaacacaaatcattacaaacccccttttctgagattttactaatcgctatgaactaagcaagaaattaaagtcggttgctttagctactgcaaattgcacatcatcctgtagtttagaattattattgacaactagaggttctttctttcttcactgaacagtttggagactcccagcaactgcgactggtccggatcctgcggagtactgtgatggttcgtgttggaggtggatggatggcacttgatgagttcttagtgaaaaatgatccttgcaggggtaaggagatgcttatcatgataacatcatgaaagtatttcaattttatattatatccagcaccaaaacatactgggcataattttggtcatttattccaatagtgaatgtttcacattggtctgtcagcctaaagttcccaaagaacctgtggcagtcatgtaaaccatattcttctcatttttttctttcttttttttttttttttttactttttctggataaatatggtgggcgggaaatactagaatccattttctttaggagacttttacatctacgattttccaaacaattataccaaccaaggaaaggattttgtctgttatgacatagcaaagtaagagaaaagaaaattgaggtgatgaagaccgaaaatactggataataaaagtttaaaggtcaaagtttttatgaaatgaagagcaggtgaggaaagccataattaaaaaatttttaaataataatccaatgctaacttgactctttgaagttgcaga

SEQ ID NO: 40244 - DNA, 1025 bp, Homo sapiens
aattatttgtattcattacacttgaaatatcatctctataaggaacttttagttatttccttataacttttgttttgagtataatcttgaaccaaaatcatctagtcccattatctggttccttaagggtaattttctttaaatcccctcctttccctttgcttattagcggcaccaatttttttctaacaaaataaatttacacttttatttttaaattttaattaacatttcaggaagaattataggaaagtttaagtctcaatgtttaaggaaaaaagatttagaaatagtggtttttaaaagtttgatggaaaaacacatgagttcctgctggtgcattttacatgctttctaggtccttctgagttttaggatcctgagggatttggttggtattgtttttgggttttcttcttgaaactcagtattaaaacactgaaaagtagcagatttttttctacctagagttttctgtttatccatcatgagcccaaataaagtcacaattgtatgttacctgctttacaaagaagccatttatgtttaattgactgttcattttgctttcttgtctgctgggatgacaaccgtgaaattcagtctggtagtttttatgagttggacatgaacctattagaaatgatttaaagtataaaatcatttctcacaggctttcaaaacataaacctgtgatcagaaacctggaatctagaaatttattcaggacttgcagaatttgtagcatatctacattattggagatctattgaaagggcaagaaaaagatgattgcctgttagtatcaacagttatggtacagacaactatgagagaaaccttttagatttggcagctgtatcattaataatgtgtcattggctattctaatattacagtaatctaaaatggcatattaatccagcctttaacaaattggtttaccagatcattagggatgcagaaattttagttgactgtgaaatttatatgagtcatactcatttactttattctttttaagt

SEQ ID NO: 40245 - DNA, 1073 bp, Homo sapiens
tatttttattttcaatttactctctttacaagcattaacattttatttatttatttatttatttttgagacggagcagagtctcactctgttgcctaggctggagtgcagtggcacaatctcggctcactgcaacctctgcctcccaggttcaagcgattctcctgcctcagcctcccaagtagctgggactacaggcgtgcaccaccatgcctggttaatttttgtaattttagtagaaatggggtttcaccatattggtcaggctggtctcaaactcctgacctcaggtgatccacctgccttggcctcccaaagtgctgggattacaggcatgagccactgcacctggccacattttatattctttagaaattagtaaatgcctgcagtatgatggtttagattttttttaccctaaagataaagcatatgatttattcttcttcagaaataataacatggttcttttatccttctgcttttagttcatttctaaagacggttttctgtagtaactcttatttgattgacatcatttctttcatttcagaccttcatggaggaaatgaccagaaaacagcctgatgttgataaagtaacgaagacctataagaggagagctgctgatccttcctcattacaatcccatattccagtcttggataagggacgagcaggaagtaagcagtgatcaatttctttaaaatgtcaataaataagggagctaattttcttttattttgaattatttgaaatttgggggcaattggtgattttacatgagcacttgatatcatgaaatactttctagaaggaatacgtgtgctcaagtattgtagaaacttatttaaaaataaagaaaaaatatacccaggtttctatacgtaactttattgtcttgaagtgtatctttcatattagctagaagaaaattgaaaaaatttacagtaagaatggaaatcatcacaccctttgcattgtctcatttgtcttccattatatatataacattaaagctgaacataacaaaaatgaccatgacgtggataatcttcatgacttagttgttca

SEQ ID NO: 40246 - DNA, 1022 bp, Homo sapiens
tttttacataaatgccatttctgtaaactcactgtctaaatatttactactctaggtaattgccagatcttttatatattaaaggtcatcaagaatgaattaatcatttagcattagtaatacaactggaaggctcaagaagttcaagtatgtaaaaatgctttggaaagtcttctgaaaactattggactagtcctatcataaatgggatatttagatactgtaccatttgcatgtgtgcttgtgtgtgtgtgaatgtgtgtattggtgtatacgtgtgtgtttgtgtctttctgcaggcacatctcattttaactgttagagttgaatcagtcaaataatcacttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcaggaaaaaaaaaaaaaaaaaaaaaaaaaaaaaagcaaacccagaagcttttcctctaaggtgaaagacaaggatttaagcctctaaaatttgacattatgagttagtacctaagatattatgaaagaccaaggagtgttataggaataaaagaccatctgccaacttcctatggaattccctgccattatctctaagacatccgtggtacacacatcaagattgcttagtcctctgttaggttcttagatacatctcttagagtagtgccaaagccagcatccacttgacattcacactagtgatttgagagaaattgggacaccatattaaagaatcattaagaaaaggaatttgttgcattgttttatgaaattgaaataatgaaggctggctgccattatttaa

SEQ ID NO: 40247 - DNA, 1027 bp, Homo sapiens
actgtttgctaacctgttggttggcaaagccaagatgattaactatgtcagtgacttagaaagtagaaggagagagaatagcattctgtgtcagcagtgggtgaggcataggaatattaatgaacacagcacagctacagaaaacataaaattatcaggggatacaagatgtgtgtgtgtttcagagcaggaaatactaatttgagtttcttaagacttttttggctttcatatgtgtcaacatatgtttcattttcttttgtataattttaaaactcatttttcaaatgcatatattggaataagttcagccttgaaatttatttttttattgtagagaacaaaatgaaatgaaatgtcaaaattataaatagaaacatctatccatccaaaaatattgaataaagagaaaatattttccttattttttttgcctataattcttccattggtaagcctcatgtgagatttttactttgcgtcacctcccctcagtaagtagtgtgaattagaataatgatataaccaatagatttctttgtttggagttagtgatttttaacaatattttctttgtatatctcttttaaaatagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacaggtaaataccaagacttttcttaagaaattataaattttcaatttcagatattaatgtaaaataattattaaagataaaattagaattatttctgcttctcatatattctattttaaccatgaggagcgtcaaacttaaaacatagaaggatatgatgattaggcttcactggatacgtttatggacttatacaacatgaaacaattatttttgtccttgttttatagacatgtcattcataatatcaaatttataaat

SEQ ID NO: 40248 - DNA, 1050 bp, Homo sapiens
atacgtgaggcaaaaagaaaatcccagagaactcaccactgtgttcttccttgtggcccaaggtccatggtagttctgtcctcttctctcccctttgtggaatcttcttatgtatgttttatatataatgcctgggatttgtaggtgtacttaccacgaagaacagagaaaagctaatgtactccatcttcccatgagttggcatagtgttgcagagtttttaaagtatgaatttttaaaaatctagtttcttatctccacccatctttctccccacctacctgttctcccacctcatctggatttccagattcctttgaaaagttagaagatctggcagtactggacttgaatagccaaaatgttcattcctcattaattcttccaactgaggtcatttcagtgatcatttatggttggtactgtggtgtcacaggcccattttattcatgggaggcactggggtttatccgatggaagacattgaaaatgttcgtgctctttgacttgatagtcacttctaggaatctacactaaggaactaactagagatgccaacagaaatttatatacaaatatattcattatagggttgtttgtataataacaaaaatgcagaaagcttaaacgaaaatccaggtatgctagaatataatggtattatttgaaaatcacatttaaaggagtatgacatgggaaatgttcatactaaatgaaaaagcaggatatgaagctgtttatacagtgtcatcccagacattttttttacaaatctttctctcttgatttgtggaagaaaattcactacaataccagcagtgttaaatctaggttttaattttcttctgtatgtttttctctgctttatgaatttgtactgtgcttataaattactgttttaattactgttatgatcaggaaaataacatttattaaaatatttaagaatgctcttaaaaatgttttctgccattattaaatgagatgcttaaaaattatacatgaatcatttaggggtatactctgcatatatagagatgtatatttaca

SEQ ID NO: 40249 - DNA, 1052 bp, Homo sapiens
aatttggtctgtatccttccagtcttcgtcttgaaagaggaggagaatttatatagtaaaatccttttgaaagtgaaagacaatgtatatagtaaaagtcttactaccaacagattacacatcttaatgccactgatatcttctggttgttcatgtgtgtatttttatcttcatttctttgaaatacctgcaagtctgtccaatgaaaatacctccaataaggctacatagacacacagatgtttagagctgggaggaacatgcccagcatgcatgggataaagtgacttgcatgtggtctcacaagcagtaagtggcagagtagcaactaaaatttaatccctatctcattctccctcactgctgtgcctcctcataaattatatatagagaaaaacccttgagggtggtaaaccattttttttctaaaattcttcaataatccgaaggttccattattacaacaaagtggaggtatctaatgaaaatatttccagctgtaaagactgtggaggatgaggatacaacactaaaaggatcataaaacattaccgtgtagggaaacgtaagaatagagtagtaggtacctgtcttcctggtgtggcagagattttgcacttaaaagataagtttccaaactcataattttcaagtttataaagaagctaatatatccctgaaatattttataaggttgcctacttatagatgtttggaattaggaccagagtacagtttgataaaaatgtttgttttctgttttacccaataactacatccatgaaatataaaaaggagtgattaaaaaaagcatatctttagacctggacattagccacgtattttggactatctgttttgcattgtttaaacaaattaccattctgagtctcttctctgtatgaaatagggacacgatatgacctgagctcatctttttagacacacctttagtcatatgcaatttgttttattaacagtgactctttccccagacccctgcccccagcctaccaacagccacacatgatggggtaaggacatgtgtcttg

SEQ ID NO: 40250 - DNA, 1031 bp, Homo sapiens
tataagataacatggggtgggttttctaattatatcacaaacgtaatacactgcatggtaatcattcctcttttccaagatatcagcctctgtttttatcatccttgaagtatgatcacatgtgggtgaaagggagttggtgaggtcaggctcactgagcctgtaatgattctactgtcatgatataaagccagtttgtcatcattttgagggtcacttaattctggcttggaatatcctcttcattttacttttctgttacctgattacttagaggttcccagaaagcaaagaataatacaagttaacttgcttgtttttgcttctgaaattttaaatatttatattaaatttcaaagataaaatcttgccgtgtcgacaaatgaattgttctttgaacttctcaggaaacatttttctttttgcaaaatagctttagataaaaaaggtttatttaactcgactgaaactaagggagggggggagtggggcaaagcatcacattattcgcctgcaaaggacttgagctccaagaacagttaaaggaaaagtctgttgaagctcttaagtgttactaacttatttgtatgttttcaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcaggtagggaaaaatggtttgttgtttaggcaataaattttctccagctgttcttggagcttttacctgaacaaagatgactgttaatactgtttccattcatttgctgtgcttccaaaatgaaagagtggatttgaaaagaagttgactgggcttcttcgacgtctgagcaccagggcaaggctaatctgcacattgttcacagccatctgcctcattgtttcacagat

SEQ ID NO: 40251 - DNA, 1027 bp, Homo sapiens
cgttcatgtttaagataccaattcaaacataatacttaaagcaaatgctattctaaaccaaatgtcctaactcactcagtgaaaactatcctgagattttgaaagtagattggtgttatcttttgtgttagttagcttgacgttttaaaactattttgattatatataagttctgttgtacataagtttttctacttctgaatactagtcattggactaacatgtctgaagggtgaagtgttttctatactgttggtaagttagagtaccattttccacttacacttatttatgattacggttaaattctatgcacactgttataaattggtggaatgaatagcagggcgattctgtttgtctctaggcaggaagaaagaaactcctttggtgttccctctatccctactcctatctgaagactcctagctcaagattatcttcaaatctaaaccacattattaagtaacattaatattaacacattattatttatcaaagacatatgtaactgactgtatacaaggaatgcctcccagtaattcctattatgtgattaacagccaatcaggtcttctgatcattatgaagtaaccattatcaccatattgcatgatttaatttcaatgaaaatcaaagagacttgatgctttaatgagtcctagctaaatctgtaccttccccacctctatctaggccaagcttgtcccacccatggcccacggcccacctgtggcccaggatggctttgaatgtggcccaacacaaattcataaactttcttaaataacatgacaagattttttttgccatttttttaagctcatcagctgtcattgctgttagtgtattttatgggtggcctaagacaactcttcttcttccagtgtggcccagggaagccaaaagattggacacccctgatctagaccattgtgaaaaaatgccttacctcagaacctgcttacagtttatttctggccactctgttgctgccccaattgtaattcattttgtccccacaaat

SEQ ID NO: 40252 - DNA, 1108 bp, Homo sapiens
caattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacat

SEQ ID NO: 40253 - DNA, 1088 bp, Homo sapiens
atggtcgggttctggtgagggcccttttcctggcttacagatggccactatcttgctggtagagagtggtggagagacatcatttctctcctgtttcttcttctaagggcgctaatcccattcacacgggctctaccctcatgacctaattacctcctcagagagagaggaaacctgattctttttgctactcactctcatacaccattgaacatgacacagaacacttctgtgaccagatgtgtgtgtatttctccccatacaccaaacaattctccaacagataccagctggatgtcctataattcaattcagttcaattcaattctgacactgtctacctggaattagcttcagaccccacaggttaaggggtcagtctcataatgctgccccccacttcagataccaatcacaagtcccaaattgtgatccgtatttcagactgatcagctataaattaggattcccatgacccttctcacgttcaattaattgctagagtgactcacagaactcagagaaagactttacttacatttacccacttactataaagaatattacaaaggatacagatgaacagccagatggaagagatacacagggtgaggtatgggagaaggggagcagaatttctgtgccctctatgggcatgccatgctcaggactccatgtgttcagctattcagaagctccccagacgaatcctattgggtttttatggcagcttcattacataagcatgattgattacatcattggccattggtagcagctcaatcttcagcccctcttccctcctcagaggttgacagggtgacagttccaactgtctaatcacatggttgattccctggcaacatctgccactgtcccctgctccccctaccctaagactatccaggaggccaccaggcgtcacctcattcaaacaaaagatgcccctcatgaaggaattccaagggacttaggagctctgccatacactcctgtcacttaggaaatcacaaaggtcttaggagctctatgtcaggaactgaggtcaacgaccaaatatcagaacaaaagattctcttagtgtctgt

SEQ ID NO: 40254 - DNA, 1053 bp, Homo sapiens
agagcagaaaaagaataaaacccaaagaatgtgatggttttttaattaaacagatatgtggataaattttaaaacggaaaaacctatttagtaattgctgcagaagactcttacagtcctaagacagttaaagaaatatgaaaaagaaagagatctcaaaggagaatgaattctaattaagtcatagcgtaatttgaaaaattaaatgtacaattaaagttgttgctgataatgcacatatttttctctcagaagatttcagaatgtatcaaggataaatttttatgaggattaggtggcctccatttctttgatgtttattaacattttacaattacttttaacaataatataaacccatgagactactacaaaaaatcgatctttctacatgtagcatactatcttctacttatattctgatgaatcataaatgtaatttttggggcatccaatttgttcatttcatttgaaatgcttttggccaatagcatgttgttattagcattattattcaaagaactgtgaactgtgttgtcaacaatctgatactactaggccataataacactcctcaagatccccttccagggaaattagtggataaaacaagattttagccccataagaggtgcagaaaacaggattttgggaccagtctcaaggcctgggtgtggaaccagcaatggggattgcattgactgacaatgtcagccttccagacttgcgctaatctttggggtggtgttaagtcaggaaacttttatgaattgtacaaatgcccagaagtgtatagacttcgctgtcttctggtcccaacaggtattctcttgtcacagatccttctttcatgtcttaatttccttgaaatccattcaaaacaatataaggtacccatttgaatactgtaattaacagttttttttccaaaatagcactataaacaactattattgttaaattaggaccttgatacttgctaggaattaaaaatgattaactctcctgaatataattgtcaagagtaaaggcatgtgatgttttgagaagaag

SEQ ID NO: 40255 - DNA, 1026 bp, Homo sapiens
ttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagaggtatactctgtgttctgagaccttatcagctacctaatgtcaagtttcctcatttgtttcctttctctcctagactaaatttttaaaacaattttgaatgtgattggctcattgtagttctgacaggaaaataatgctatactctttctggtaacttacttgaatctttatcataaattaactttaatttttgaatgtttgagattaaacatacagatgtaatagatatactgttatatctgtggagatacattctgaaaaatgtgagtatcaaaaaagctagaagaaccaagcagttagctttaacttctaacatattctgtggctagactttgtcttagtcttttttaaagatataattttaatacctttaattgtcatctaagataaaattcagactctgaaaataatataatacttattcctgaaccctccttggtttgaaatttttcttcttttcactaatcttgtctttgtaattcaaagaattatgtttggattgagaatggataaagtgacataatgttcttgaggtgacttttaacattttataaattcctgttacagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtca

SEQ ID NO: 40256 - DNA, 1032 bp, Homo sapiens
aaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttct

SEQ ID NO: 40257 - DNA, 1737 bp, Homo sapiens
tgatctcggctcactgcaacctctgcctcctgggttcaagtaattcactgcctcagccttccgagtagctgggattacaggcgcctgccgcctgccaccacgccgggctaatttttctatttttagtagagacggggtttcaccatgttggccaagctggtcttgaactcctgacctcatgatccacccgccttgggttcccaaagtgctgggattacaggcatgagccaccgtgcccagccgagattcttaacaaatcactgcattgcctaaggcattgagggttcaacaacagatatttttttctgagggaatttttagtttttctaaatctgagcatgagaaatagctcagaatttcttagcaatagctaagttttaaaggaggtttgataagcaactgagactgtcttagaaataacctcctcaagaaatactgaaaacttagtatttaaatagataaaatgctcatgtgtcacaggattgaccctgatactaaaataaagaaaatagagtgctgaagataacagattatgagatttgtttctgtatgaattattattagaaaccttatttaggttagcaaagaaaacaactgaaattctcatcaaaattattggagatcaagaaattagaggaagcaaaataagatgtatggtctgtaatagaaattaaattcttgaaattcaccaaagcttctcaatgaaaacaaatctgtctaaaataatttctgtattcctgtttaaattattttatggtgatcttgagttgatgatacaaaactaacacactagaatattaataaagagaaattaaattgtaattataaactaatcctgatcatgtagttctataatcaatgtaaagcatactcctcccagctgacattgattctgtccctagtagagtaaaaattttttcttataattttttctatacattggagctgaatccctaagtatatatttaaaagctattatacttaacaaatatctttatatttatggagtatttaaaggtgcttgtcaaagtgattcatatgaggcatgttattaacaacagcaacaaaatctgtgagtatatgaagcgcatcttttccagagccatcaggactgtagctgcctttgcattagcaattctgattattataattgtcataatatggcaagtataaacaaataagggatctgactttagaaatttcaagtttttgtataattttccttcttccccatgttatttcctaatttggctctctgttctaaagttctgtgctttgtttttttaaccataagacatgggaatataagtatcatttttaatttctattaggttagaaaactaaattctttagcatcatttggttcctatgtgttgggtgttcttcctacctcttaggattatgttgcatgcaagagaagaaagggcaccgtcgtgagagttttatttcccactttgtcactcacccaatgtgagtttgcaaaaatatctgtcctcctcgtttctccctttcctcatctgttgtaaattcccttcttgctataaaattctaagctagctaatttttaaaataaaattattcctgaggggcaaaaagatattcttcagaaaacctgtcgtgaagggttttttgtcctcttctgctgactttctgaggcttcctctctgaagaaggtgatgctgctggtggtggtgatagcgcttgttctgcatttgagttcacttggttttgtaagta

SEQ ID NO: 40258 - DNA, 1053 bp, Homo sapiens
agtggtgaaactattgcaaagcaatttttaaaagttatctcagtgatttttaatgcatgtatttctttttaacagtgggattagtaggcacttaaaagcagacaatgaaaaagacatattttattaatggaggtagcaaacttgcttatggaatatattttattttgttgatatgcaaattttattaggctgaacgttataaaattgtcattaaaaaatcagagtacaaatattgaaaatttcataaggtttgaactaatataatattgtgcatatgaaagatattctttcctttatcttattttctacctgtcatttgtaaataaattgtaaaattaggtaaataatatatttacccagtgagtggttaacatttttataacttttaccaattaatgtattttagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttagtatccttttttgttcagttttagcacagatttaatgtctatctatggtaaatgagtaaaatctacacatatgaggctatttttttacttccatagttaatttgttaattacaatacctctacttagccatatttctttcttacttggaggactttagtaagacatttaacttaaaataagcattttttcaactctgttactattcatgtattctagcatttatatagttaatctgcttgccttttctgaaggaaaaaacaatgtagttctctaattattaccaacttataatattcaaataaccatgacttagtaagagcatgaagcatgcatgtgatagggctgtgtgtagcttctatactggacttaagaaatgtaaataaatggaaatgccctgatgttcattttaattgaagatacaagaaagtcaaaattctcagttactgaa

SEQ ID NO: 40259 - DNA, 1030 bp, Homo sapiens
aatgtggtccttcagaacatgaaccaagtctattctatgtcttccacttacatagataagtatgtaactgctatctcaatatataaattgcttcatacaactctcatttttatttactattaatttaaaattttatttttattaatataaatattaacttttattttgtcttaagaaatacattattggctgggcgtggtggctcatgccggtaatcccagcactttgggaggccaaggcaggtgaatcacctgaggtcaggagttcggtaccagcttggccaacatggtggaaccccatctctataaaaaataccaaagttagccaggcatggtggtaagcgtctgtagtcccagctactcgggaagctgaggcaggagaatcacttgaacccgggaggtggaggttgcagtgagccgatatcgcgccactgcactccagcctgggtgacagaggaagactccatttcaaaaaaaaaaaaaaagaaatacattatttttatggattgatgacacttctctatgttgatagtggatgtgcttcagagatgagtgtgtaatgtatggtcctcccacattttgcatgtaatttgggtagctcagcagttgtagccaatgaattttcatctcatacttaaacaaagttagaaagaaaccatcttatgttgcagtctcttgctgaataccacttgtggggcaggggatgggttggagcacatactctctattaagaagaaagccagaaaaatgtcagtttcatagtaaatgtatcagtgttccaaggtgaagaacatgttatgtcatgtgtcataatggtgcttcaggactacattatgcaaaaataaacatttaaccataggtggctattgtttaatttcctttttaaggttgaaaactgttaacttggtgttaaaaaacactcaagctgcagaagccctcgtaaaactctatgaaactaaactgtgtgaagaagaagcagttatagctgacaagaataatattgagaatctaataagtactttaaaggtatg

SEQ ID NO: 40260 - DNA, 1060 bp, Homo sapiens
tttttggttcaggatttggtaatgttgtgtctgcactaaagcactcttctcttagctggcatttttctttctcttagttaactttaattagtgtcctctctgccatgtttctaagtacttcctttccaagtactttgatgttgtttcatgctccttgcagttgagtgtattggtgtttgccatgatatattgtggaagccttcagtggtctgttgtgctaatctttttttttttttttttttttttgaggcaaagtctcgctctgtcacccaggctgggatgcaatggcgcgatctcggctcactgcaacctccgcctcctgggttccagtgattctcctgcctcaccctcccgagtagctggggttacaggcacccgacaccatgcctggctaagttttgtatttttagtggagacagggtttcaccatattggccaggctggtctggaattcctgacctcaggtgatcctcccatctcggcctccaaaagtgctgggattacaggcatgagccactgcgcccagcctgatctttagccatttatatcactgtagaagtcatatgttcctgcagaatcctatctaattctcatgtgagctaatgtattaataaagttttggagtactgaaatgttaccttggaggtatctatgccaaaaaaatctctcatgcaatttttatgttcagctagctttggctacctgttaatgtaggtggtgatatccttatactatatccatatatctatctatctatacataaatgccaacatacctgtatatgtatatatacgtgtggagatatatatatatatatatagcctaggggagattgctcttttaagatgggtgttgtatgaaagataaacattacttttatccaaaattattttgtattatgacaatagcatttttctatacctctctgccctatatttttaaacaaattcagggcaccaagcttgcatataagtgatttgcaatttttagtctcacttccaatttcattttaaggccttttcttggttttatacttctaatttaaagtttatgctatctt

SEQ ID NO: 40261 - DNA, 1021 bp, Homo sapiens
ccaaatttgaagggcactttcctaaatctctcctgactggtgtttgctttctttttgctctcattcgttgaaccaccaaatagtttcaaaggttaagtgcaaacttcattagtgtatctgcatttcagaaaaccgaaggttaaaaacagtcataatcttctcatacagtgaagctaagggtttgccttgagagctcatcagtgttgtaatttgacagtgagcagtaatgtttgtctaagaggattggtggccagaaataagccacagtgtctaatgagacacggaccggctgggcaggatgccacggcatttcttgtgtgtgcctttctcataagcaaaatggcctcagactgaagaggatggtcataaagtctgtgtggaacagatgtcagagtggaattttcagacttaatggagaggatctaagtaagctctggattttgaaatgagtgaatctatggagctgtgatctcctacaaatcaaatggggaatgtctgtggatgtgtaagagctgagaaagaagaacaatatgtagatcctgccaaaactcctttgaaccctgaaaaatactctcctggaagaaaatatttcagaagaaaaccgatcaaaaaaactggaggtgacaaagagtcagttggggcaaacaatgaaaatgaaggcaagaagaagagcagcagtcagccttcaaaagaacagccagctcctttatccaggggactggtacagcaggaatctgttaccctaaactctgcactgggagatggtattcagcaaaagaagacagaagttgtagctgacagcgttaaacagaaacttctgccgagtgctgtaagcagttggtctgactgtgtgaacacttctcctgctaaagacagtgaaacagaagtaaaagttagtgaactggatgaaaggatttcagaaaaagacagcactccatattgcgcaaagaggaagaaacatttagatgatgtcaacacaagcgaaataacattccaggaaaaaactgatgttttttctttc

SEQ ID NO: 40262 - DNA, 1050 bp, Homo sapiens
ctcatactcttcacccagctcacgtctatggatttctaaaaatgttcctcggcatccttgaacctgttttaggctagaagtagaagatcaactgcgggggtgaaaactccaccctcttgttaaggtggcactggtcactgtatcgggaatcatgaataaagtcagggcattgtccgtatttgaagaattgtaaccccatgtagtagtccaggcttatgtttgttctggtgtcttaaaaatgtaataatttgaattgtcttcttgaattattaatctgaaattcacttttttaagtttttaaattaaatttagtttttaagtaataagcattttaaaaatttaaaaataggtgcatgaatgaataccatgtgaggaatgttttctacttgtctcctttttatgtttaagaatgttaaggataattctgagttctaggaccccaaattttgcttttctctttataggttcgaaaacatgtgaatgatctctatgaagacttaagggatggacacaatttgatttctcttttagaggttctttcaggagataccttggtaagttttaactttcttattttattttgaagaacgtgtaatcttttctgcataggaccagtatgttttcagtacagactattcagatttttgcaacattcatcttttgagctatgaattctgcctgaaaaagaagttttggttagattcctaagcattttcaaacttcaaatgatgtgaatttgagagattgaagcactttgattacttcacttatataatcagttctataattaaaatactatttttgttcttgcttcttttttacctttgggtttttttgcttagcagaagttggatgcataatataaccacatattaaaagacttacaaatagcaagaaaataaacattgctttctgaaaaatgatctaacccattccgcaggtgtcattttttttttttttttggtgaacattacttccccttcttgttacctgttctccttcattatgttctgttcatgctcttcttttcatttctggtctgtcttgtgt

SEQ ID NO: 40263 - DNA, 1033 bp, Homo sapiens
ttttgagatggagttttgctcttgtcgcccaggctggagtgcaatggtgcgatctcggctcaccgcaacctctgcctccccgcaatctccgcctcctgggttcaagtgattctcctgcctcagcctcccaggtagctgggattacaggcatgtgccaccacgcccagctaattttgtatttttagtagagacggggtttcttcatgttggtcaggctggtctcgaactcctaacctgaggtggtctgcccgcctcagcctcccaaactgctgggattacaggcgtgagccactgcccccagccaaaataggggaatttttgaagcatcaactttataaagggctaatgaaaaatactgcttggtagagtgtattgctttgggttcttaaaacctacaaataagacttttttccccagaccttagatttatgttagtagttcctaaactttagccttatcgaactcacttggaaatattttaaactttaaaaagttgcaaaaataaagtagtacaaggaacactgatagactgtttacccagattgagctcttgttaatgttttacctagtttgctttattattctcccttccccagtcgtgtgtgtgtgtgtgtgtgtgtgtgtgtgtgtgtgtgtgtactttttttatctgaaccacttgagggtaagttatatataccataatcctttacctctaaatacttcagtatgtatttcctaagaatagggttattctgttttggaccacacagttagcaacttcataaatttatattggtataatattttaatgtctgtatttcagtcttgtttgttgatcttttacatcatcctctcttccccgagggcaaggaccagttcagggtcaggtattgcatttaggtgtcatgtctctttaacctgctttatttgtttatttaattaattattttttttgagacagagtctggctctgtcacccgtgctggagtgcagtggcgtgatctcagctcactgcaacctctccctcctggattcaggtgattcttgtgcc

SEQ ID NO: 40264 - DNA, 1071 bp, Homo sapiens
cactttactaaatttgtgtgggtctatttctgggccctctgttatgttcctttggtcgacttgacttttcttttgccaaaaccacactgtttcgacaactgtagctttataataggtattgaaattgggtagtattagtcattcaacttgttattttctgggattgtgttgtctattctaggttggaataattttttataccttagaaataagcacttggtaaatattctgtgttgagaaactttttctcggtacacaatggttacctttttaaacacaagtcagatctgttattcttttgcctcagctccctccagtggcttcctattttagtgagaatcaaattgaaggtcttcgaaatggcttatatggtcctgtggtacctggctcttctgttacctctttagcttcatcttttaatactttttgtcttggtctctttatttcatacctaatggcctccttgctcttgtttgagtacaccaggcatatcctgtcttaggtctgtagcagtggctgttggctttatctgaatgtctttcttccagatatctgtatggctaactccttcatctcttttaagtcttattcagatgccccccttctcaatggggactctctgatcattttatttaaaattccatcttgcctctcacttgtccctcaacctccacaccctcaatttctcttaacctgctctgttttatttcacagccatcactatgaacatcctctaatacttatttgttttatttatttatttatttatttatttatttatttatttatttgagacagggtcttgctctgtcacccaggcaagtacagtcgtgcgataccagctcactgcaacttccgcctcttgggttcaagcaattctcgtatctcagcttcccgagtagctaggattacagatgtgcaacaccatgccacgctaatttttgtatttttagtagagatgggatttcgccatgttggtcaggctggtcttgaatgcctgacctcaagtgatctgcccactttggcctcccaaagtgttgggattacagatgtaagccatcactccctgcc

SEQ ID NO: 40265 - DNA, 1034 bp, Homo sapiens
ctttcttgtatttggtcagtataatcactgggcacttttaggttttatggtccagtacaaactggttttcatttttcttagtatagtgatagatttcctttaccctggagtgtttaaagttcatgagtaattttgaaaataaggtagtaaaatatatttaatttccagctgccagccagaaaactgtagtctatttctgaacaaatgaaactcagtacacagacatatttagtgattaatgacctattctaagaggaagcctgaaaggaggaagaaggtgtgttttctccctgggctgtgaatgagaagataaagtaagtatccaaagtacataaatctgatattctgagattaataataggctttatctggggtaggtgttagtgactgagaattaataagacagtttttaaaatgtagcatgcatagtgaaaagaacacaggctttcaaatatgacagacttaaggtccacatttggcttggctcattcaaactctgtgacactgggcaaattaccaatgtactctgagcctcaatctcctcttttgtaaaacgggcatgataaaacttactatctatcatagtagatagtaactatataaatgagaaatcacagatgattggacagttaaaaatttttttttttgctttctggcaagaaaaattccggctctggagaaataatgggaaagtccccagtgtcagcaaaggaaaacatgtccaggaagggtaacagaaggagaagtatgacctgaaaacctgggagcagtctaggcatgaagagaaatgagctcacctctttgagcttcactttactcatctgaaataaaagaagagagcatccctggtagagactggagtctgaaatatcatgaggtcaagctaggaagagttcctgctgtgtatgaatatttgtaaataagcacagatattgtacatagcagcgttatttacagtggccaataggtggaagctaagtgtccattgatgggtaaatggataaacaaaatgtcgtatgtacatacaatggaat

SEQ ID NO: 40266 - DNA, 1039 bp, Homo sapiens
tgtttttcaaaagaaactataacaaacagttgtggactttgttagggcttgggtaggtgggccagaagtcatggggtgttacttggatgacgtcatagctcagggtctggttcttagcccagggagactcaccctttctaggtaaacaaactccaaggtgcctgatgtttaaaccagaacttgtttattaacgtatagtgaaaagaattcaacagccaagtggtttggacattcatgttggatagaagactagtacatttttttctatcagaaaatctgtatgagaagccatagtatgcctggaattggaagtaataggaattatgttttgaccagcaaaaaatttttattgggatgaagtccagcctaccaatttttttcttttgtggttcatgcttttgatgacatgtctaagaagttgttgcctaactcaagattataaagatatgcagctacatttttttctagaagttttatagttttgtcccttacatttaggactgtggtctgttttgaattaacttttgtgtatgatgctaggtaatatgctagttacgtatgaatgtctagtttttccagcactatttgttgaaaaaactgtcctttcttccgttgaattaacttggcacctctgggaagaatctgttgaccctatattgctaggtctgtctggaccctgttcagttccattgacccgtgtgtttaattttatgccattaccacaccatcttgatgatgatagctttaaatgttgcaatcaggtaatgtgagtcccagtttgtccttttacgtaattgttttggctagtctgttcctttatatttccatgtaaatttttaaatcagtttatcagtttctataaaaatgtttgccatgattttgattgtaattgtgttgagtctaaagatcagttgggaggctggatgcagtggctcacacctgtaatcacaacactttgggaagccaaggtgggtggatcgcttgagcccaggagttcaagaccaatctggacaacatggcaaaaccctgtctctacaaa

SEQ ID NO: 40267 - DNA, 1132 bp, Homo sapiens
ccttttgatatagtttgcaatcatttattgcatttgtatttcattacttgtgctaggcttcaagactgtattatttattaatggtattcaatcaaggagtactttggggcattagatttatctgtaacattgccaagtcaaactttggaagaaactcacacttttaaaagtgtttttactctcattacatgtattaatgatatgtaaactttaagtgtgtgcaaatggcctcttttgagaagttttaaagttacctattttgtcactatgtgttgttcttgcatgtctaggtcagtatttcttttgtgtttggctaagtgatcaccatatacatgcagttttcaggaaaggcctaaatgttgtcccctccaaggctcctttttccatttccagttaatggaagatttttttcatagtacttttaattccactttagcagtgaacttgaacaagctatttctggttggccatttctttctccaagatttttaaaccagtgttctgagtcttgggggaactacagcttcaagactagggactgtggtcttcagctttgaagtggcttcattctgggggattagtgaagctttctagatttgtttttcccttctcttattctacccttcccctcctccccattaacagaactataggataatatagggtacagaactatagaactactcttgggtagttctgtttgtaaccctgattctgctctcccacctgcccagcctttgagaattaccattgcctgtagggaaaagatgtaaacattgagtatgctgattttcacttatttcattttatcctcaagaaaactaaagtccagaaaaggagggtcagtaaaggaaaaagcaagctctaaactaaggtctcctgattattagttcttcacattgctcagtctcctttgtttcttactggtgtatagaagctgctttcactggctatatccaagttaatgaaaagtaagggcaagaatctagaagaaatgagtggaaaaagtgaagcaatagcaaagacagaagtagtgatatcagtgttattctttacatgcaataagaggaatgctgaggtttcagtgttaccattgatgtttctgtattttagggccttgcattatgttggt

SEQ ID NO: 40268 - DNA, 1033 bp, Homo sapiens
actcatgctcggataggtcaggtgaagtcttttctgatccttcctatcagagtgaggtgcccttagttttgattctcagcactaggtacaaacctccaacatagcagctaccccagcaaaaaaggaggtctctgcagtaagactcacgtgggttcaaatcctgctctgtgtatctgcaggaaacagcacactaagaggatttaactgaagagagtttaatgaaggcactatttacagaaatgtgggcagggctaaggtgcttcatcagcctataggtggagcctacttaccttcaactcctggtctaaggggcagcagagggcattggtcttaattgatcctggtaggaagagctggagccatggaagagcccttccacaaggatggtgcctgagggttgcagctactgccagaacctagtgagtcaggagggagcagggcgaataaatatactgctctcttagctcgtgctctcagtggtatctcctgttgacccaacctacctagaagctggagggcaaaggaacttgggtgatgcagatcacagccatcagtctcccagggactgagcaaggaagagatggacagacaatctgagagggttacagtgacagcagagaataaaaacatacctacctggtggccgagcatggtggctcactcctgtaatcccagcaccttgggataccaaggtgggcaaaacacttgaggccaggagtttgagaccagcctagccaacatggcaaaaccccttctctactaaaagtacaaaaattagccaggtgtggtggcacacgcctgtaatcccagctactcgggaggtggaagcaggataatcgcttgaaccaggaggtggaggttgcagggagccaagatcgtgccattgcactccagccttggcaatagagtgagactacgtctcaaaaataaataaataaataaataaataaaaacaaccccccccccaaaaaaaaaccacttagtattctttgccaagatatttcaattctctgagaatcagtttccttattat

SEQ ID NO: 40269 - DNA, 1036 bp, Homo sapiens
atacagttttgtttactatagccttgcattatagtttgaagttggctaggataatgcctccagctttgttctttttgcttaggattatcttggctatacagctctgtttttgttccatatgaatttaaaattttttatttctaatgctgtgaagaatgtcaatgttagtttaatgggaatatcattgaatctataaattactttgggcagtatggccattttcacaatatgattcatcctatctatgaatgtgaagtgtttttccatttgtttctgtcctctctgatttccttgggcagtggtttgtagttacccttgaagaggtcctcacttttcttgttagttgtatttctaggtattttattctctttgtagcaattgtgaatgagagttcattcatgatttggctctttgcatgtctattgctggtgtataaaaatgcttgtgatttttgcatattgcttttgtatcctgagatcttgctgaagttgtttatcaccttaaggagctttgggcctgagacaatgaggttttctagatataggatcagctcatctgcaaagagagacagtcttatttcctctcttcctttttgaatacgctttatttctttctcttgcctgattgccctggacagaacttccaatgctatgttgaataagagtggtgagagatggcatccttgtcttatgctggttttcaaggggaatgcctccagctttttcacattcagtgtaatattggctgtgggtttgtcataaatggctcttattattttgaggtaaaaacattttaaacttgatatgctcaaaaaaacaatagcaaaatttaattgaaatattgtaattataccctttcccttttacaaacaaaatgttttgataaaatacatttattatacaccatgccttaaatgtatttgtgttaatcactggaactctagattcagcttttcaatgaaacatattcacagtatagactaattgttaaaggcagtactcattttcaagctagtcagtcaaattagaattgcttt

SEQ ID NO: 40270 - DNA, 1039 bp, Homo sapiens
ataatattactctgataaacaattctggggcaggaatatttccatgcctctatgctaaataaaacttagaacaagcaaacatagttgtatgcttgctttaggaaaatctcactcttgatggtgaaacaactaaaatagcttatttatcaagactgatttcccaaaaagacttgcttcaggacttcccatttcatcattcttaccaatccaaaactattttgtcagttctaaccaggttctcaccttgaaaaatgctgattaaagtggtccagcccacccaaccctaaaaccttgtaaatatccttctctgtctttcctcttcttgttcttcctcactgaagtcagtctgctaaacttagctttgctagatgagtgaggttttttaatgttgtttggagagttgacagtatataagctagttatgctgaataatatatggggaagaaatcaagaattcagaatcttaactttcttttcttattttttaactgtctgctagtttatctgtatggacatgcatgtctgaccaagctatgaaatctccattcttagattgaacttctttccttctcgcctccatttatttttctcatctacccccaccccaagtcatgggatagggagagttgtcctattccttttctgtctcctaaagtagtttacccttatagaagtcttgaaaccagattcatattttatctcattttagtaactagtatccaaatcccaccaagtttacataagaaatagcaaaacaaaaggaaccaactgggtatttatctaccaatgaagatactttaaatagcaatacatacaaggtaatgatctaactttgtatgttttgacatagaaaagtaaacaccgtgaaagtaggtgaaagagtatatatattacctcatttttaaatgctttcgtgcataaacaaaatctgaaagtctgtgtgcctcaggaaagaagtagataatcactttattttttttaaataaatatcttttattacctctgcaattaaaagtattacacatttttaaggatgaaa

SEQ ID NO: 40271 - DNA, 1026 bp, Homo sapiens
ccagagcacaggtccaaaattacttccaaaaatcatcttttcaggctaggtagtttcatgtgttacttcttttattctctcaggattctaaaatttacttccacagtcctgtgaaataagatgaaaaaatctccctaccattcatgatttcataacattcattgatctatttatatcaattccagttaaaggaggagcccaacacacttaactgtgcttactgggactcttctttttggatctggtcttgacaactctttagcccagttgtccccgcaacttggggaagatttcggggaaaaagagcttaggtttttgctaacatagatttcaactcttttatattctgaaacttttcattagagactcagttataatatttttcttcctctttttctaccatctttaatataaagttcatacaattgggagaaatatgttccactacttacagtgcttaggacattttttccacagaaacattgttttacctgacaattttttcagtgttgttagtactctgtttcaggaatagtatcacttgtataggcttttatggattgtaatataatttaaccactatatatatcatttatatatattattacttctatgggaaaatgttctaaattttctattttaactaacagggtaatataacctgcatttcatggttttggggtgtgtgtgtgtgtgtgtgtctgtgtgttagtcataatgtacttttcagtctcatttcagtgtaatagaataaagactttgtatttggtctaacaaagagtttcatttgtttacttattagtgaagacttttcaaatgctttgtctcttttatgtacatgttctcaatcaaatagtctcataatgaaaattcaggtataaatgcctggaattgtatactaagttaaaatgtatcttagattgtttttgttagatcattgtcatattctagcaactcatattgaatataatgattttgtgcttttaatatcaacttttagaactatattttaatgaatatattttt

SEQ ID NO: 40272 - DNA, 1034 bp, Homo sapiens
agagggaaggggcagagccaaatatattgaaataagtgatacagtgagtttggagaggagggagaatcattgagcaaagtacatagtagttaacacttcttatcaaacatactttttgtggaatgtttttacaaatggttatctctctccacataactctaccatgtattgggatcaagaggaaggtaggcataaatgtacacacatccacatttttatgctgaccttggttatcctatgtttattgtcatattgcagttgtcaggttttttttagtttgtaaatttgcctaaagagtgtccatcctgaaaaggttttgttgcctgatctgctaaatctgctgggtactttattaagatgttaatggtaaaacttttattttgttctgttatttgcagagcaaagatggtcgacctttgccagcaagggataaacgcgccttaaaacaatttgaagaaaggttacgaacacttaagaagagagagaggcatttagaattcattgaaaacagctggtggacaaaattttgtggcgctctgcgtcccctgaaggtaaatgaagtttttaaaaattatgctgtcactcttccccaagtttatgtagtacctcttggagagattgagctctccttttgaggcattacagcatggtacttaaaatggatttgggggtttaatctggttttaaatcacagctctctttggtagtttgggtaaggtgcataacctttctgagcaatgtattacaacaattgttgggaaattaaaataaaaatatagataagtattgcaatatgctgctagcatattcttcaagtttatactttcctataaattgatctgggacttagagcttaggagcctatgctttctcctagtagatttacagattcaggtcttatgttaagtgtttagtctattttgatttggtttttgtgtatggtgtaaaataagggcctagtttcattctgttggcgtgttcattttttccagcactatgttggattgactatcctttccttagtatgtattcat

SEQ ID NO: 40273 - DNA, 1023 bp, Homo sapiens
cttactaaatttaaaaaagtaaaacttaacaggcacggatatatatgtagatattctaattttttggtgccaccaagtggggaaatgttgaataatgatgtcttcagcaaaatgtatcgtatggaccagtgaactgcctatagaagcagtgactgctaaattgtttactatatacctctatccataaaactttaaatatgtccaccaggatatttatgattataaatacatatttacatattattatgctaatctttgtacatttaatgtaaaatataaactaataggttaaagaacattaaagtgataaagattcaaatatagaaataaaacatttaatattttcttcttgtacccatcaaatgttggtttgcctccatgtcttagttcaggtcagtataacagatgtaccatagactgggtggctcaaacaacaaacatttatttctcatggttctagagactgggaagtacaacatcaaggtgtctggtgtctggtgagggccctcttccttgatttgcagttggctgtcttctcattctatgctcatatgataaagagcagggagagagaggaagcaagctctattgtgacccttcttataagggcattaatcttatttataagggattcaccctcatgactcagttatctcttgaaaactccacctacaaatatcacactggggattagatttcaacatacgaattttaggggaaaacaaacattcagttcatgttacaacaccttatgaatcacagcagtggttctcaataatatttagagaaagaaattccctttaaaagtcaaatttctcagcctatgtgatagcatatttcactgaatatatgctaccgattgtaaggtgcaccgttactttatgtgtcactataaggaaaaatctgacaagtttttcttaatcatttataatctttgttttatatttagtgagtgagatttgttggatttgtctgcattcataacaaggaaaatatgaaatgaaaggcgttcctaaaacttta

SEQ ID NO: 40274 - DNA, 1032 bp, Homo sapiens
taatactgcatatttttttaaacttgagatgagaaaattatttatatcacaaagaatattatttatagctgtttctttaacttgctggaatagcaaatgttgtgtcaagtgtactcaaatttaagttggaatgaacacaaaagttaaagttcatttaaatgggatggtttataggacgttctcagcattgtagttagtacagagtaagagctcatatgtcagctgccacaattgttcttgacccagttattactattgttagaaattgctgtaaagttaacttgaattatgggttgttattctgataatactgttgatttcttgggacatgggacagaaaaggctatttgggcatcatgtactatatagaaagagttatgagaagagggaatcagataggggagtgaatttgttaagtgaatatatatacatatagatagataaccatgattaagtacatatgtatttagtaaagctcggtttattatttatttccacagctttatattctgttatattgttctgtgtgttcttctggatcccttttgtctacttctattatgaagaaaaggatgatgatgatactagtaaatgtactgtaagtatctttattttagaggccttagtttaggaaagaaaaataatattacctgctttttcagagaatgaatgactgaattttttctagagcagtgttgtctaatagaaatacaatgttagctaaattaaaataaaaagaaacagttgaaattaatttaattatacattgtatttagcataatatattccaaatattatttcaaatatagtcaaactattaatgaaatattaagtttcttttcttcacactaagtctttgaaatttgggttgttttttacacaacaatcaagctagccacatttcaagtgctttctagccacatgtggcttgtaactattgttttagacaaagcaattctagatcaggcatacaaaattttttctgtagaaggccaggtagtaaataatttaggatttgtgggctatatggtc

SEQ ID NO: 40275 - DNA, 1029 bp, Homo sapiens
ctttgtaatgactaattattctgtcacaatattgactgcttttctttgtcattgtgttttgatgtaaatgttagctattttcattggtagttgggaaggatatgtttaaaaaatttttaacaatttaaaagtctaatgtatccaagttaattttcatgtgagttataatttaatgatacgtggcttttaaaaggtagattgttgcttcgtatatgtttaaacatcttaggaattactatgtattctttggtacagtttttgtccatgacctttaagtggctctctattcacttgttttttgctagttctcgataagttgttttaaaaaaccaacttgtttcatgagtttaatttcgctcaatttctatggacatgaggcttaaaaattttttcttaatgtgttctttgatgttagtgggtctgctaaaccaaaaatctgtttatcttttatttgctagtagcaatcttttaacaaaaacatttataagtaaaagcatattttatagagatgttaggatatgagagtgtcataactttagagtcaagaataatttgcctttgaaaatggctgtgagtttgatgtagaacttttaaaaaagcagtttttcctgtttcatgatagtggaggcagcaatattttttcccccatttacagatatataaactcaacttgacattagaactgatcatatgataaatgttataaaataaatgttcatttaattctctctttacagttcaacatttatggactaaaagaagaaatctttataaaggacactgagaaagaacagattattagaagatagcttagaaggttgtatcagggaaacaaatatttagagcagttttaaacctattttgaatcattgactactagagggatattatagtctgttgagaattgtgtctgttctccacttcatttccccagatgttgattgctaaaaacttttgtgggcacttttaccagcaacatgggaattttggttgccatacatcttttaagtcaatagctgccccattttt

SEQ ID NO: 40276 - DNA, 1057 bp, Homo sapiens
ttagaccctttgctttatgttccctttgcttagaatgcttttcttccagttatttacttgactaatttaactcctttagcctttaaatctttgcttacatgttacctgtgaatgaggcctaccttcaatctctggctcattttatcctagtctattttttttctttacagcctttaattacattctgatgcattatatagttttagttatgtttattgtttgtatcctcctgctagaatttatactgtgctagggcaggaatctttatctcttttggtccttgatgtgttttaagcacaaagaacagatattggcacatagtaggtactcaaatatttgtgaaattcatgaattttttattttctatgtaatttagggaaactcacttgaatttcttactttgttaatgagagagaataatgtgtacttccgtgttgttaagattgagtgagtggggtgggatttcagccatggccaagtttgaaaattggcagattctctcaccagaaaacaaatatgaagttggacaaaactgaacagaaaacaacagcttcagttctttagcaatcaatgaaagacatacaacagtctgagaagtgtttatacttaaaaactgctaagggacagtggtagtttcttgtattttagcctagggctgttatgtttccctacccccaacttccagcttggttattgcagaagatctgccagggcagggtgggtccagggaggacctacagctgtactgctgtatcagaaggggactcactcagttgggtggtgctcacttctagtgctattgtttatggaagtgacaatcttggagtcaggtgagcggagaggacccaggattctactagcatgggattgtggtcataattgggacaagcatatgtctggctgaagctgcatacatgtgtattggagactggagagggcccaacctagtcatgtactcctggctgccctagaggctctacacgtgtgtaggagaccagaaaggaaaagccaggggcaattggcctgaacttttaatacactctcctaccaatatgca

SEQ ID NO: 40277 - DNA, 1021 bp, Homo sapiens
acaagcccctgacatatgtgtccttctcttccctctctccacctggtttctcttacctttccaaaagctcaatttaatctatatttagcttcttgaagcttttttcaaacgttctgtgtatgttctttactccctctttccttcctactattttctgtttccctgagatcattctccctcctttcaggtctcagtttagtcatttttgagaagccattcctcatcttcagtctgagttaggtgccttttgtctgtgttttcccagaactgtgttgtcttatctcagcatttacatactgaaatttgtctattgtctgtctctcacttattgaagacatagattgtttttatgtgggtggatagattttggaagtgatattcagtcgtattaaaacttgacttttaattgttaggcaaatgggtgtttcattaatatttctattgtttccttttatcctaggactgggctaatgctaatgtcagcagacagattgaggacactgtattatacggttactatagtaagtatctttcagtttctttccctatttggactgctaaccaaaatactgatacgactccgatgagtggagaaccccaggttcttcctcttgggtcgaattagaaaaaaatgacatggacacacatggagtagttttaaggagcagggagtttagtaggcaagaaagaagggggaagaaagaaataagctcccctgtacagagacagagggaggggagctccaaaaccaagagagggaaccccacctgccacggataccagtcaggtatatgaagaggctgaaggtgccagtgtttgatttgcatagggctcaggattggtttgaccaggcatgtcatccacatagcctgttaaaaaaaaaaaaaaaaaaaaaaaggaccctcccacctagccttttaatatgccaatacagggtgccatgatcttctacacaggtggggatatgtggggacggccatgtcgccaggaacatgtggggcaagggcaagaagaagagtgc

SEQ ID NO: 40278 - DNA, 1051 bp, Homo sapiens
tcatttgattaaatttattactgtgtatcccatcattaaggtaactaattttcagtaattaaactgttggtcttctgtttagccattattctcagttctgtgcaggagtgagctgaaacaaagttgtatagcccagagagtgagaagctgcatttcatgtctcccaacagtcagaaagggattatgtactgtttaaggaaggagtttggcgaatattttgaaacccttttgggaaagcatagaatattgaaaatccaaaattaaccaaatccgtgagtgtgcaagctcaaagctagagaccttaggaatatcttaggatgtgcaaaacaggaagaaaacaagaactgagcaggcagcactaagtaagtgtcatatagcctccccacccacccttccaaccctactcctaaaagagccataatttagtcccaagtatacttttctgatcttttcctgtgacatattatggtatcttcaaatggtactgggtttcctgaggcttgtgctgctgactgccaaccccatcctagagagcactgagcgacagatactgtaaacatcctacactctcagctgtggaaagtaagaaagctgggagaaggctgtttactctttctgccttggaagtcaactaaagagaaatggattttgaatatttctatgtcttagaattgatcctatcccgtgtttgtttctgaggtcaactgtaaaaggaaaaaaggtgaattgactaagtcatccaaagaaatgtaagataatctataatatcagttatatttgaactgtttcacttagtttaaaaagaaaaaaaagattaccaaatacccaagtgacaaaagttctggttaacttgtatgaggctacattttgtgggttgctgcagtctgatctgtaaaagcaacacattacctatacgttaagctaaacatttctcctttaacctgagagcattccacactgaagtctgcttttcttgaagcaaaaattctagtgtccttggacttgctattttatcagggatcaaaggcaccttggagccccatgctttagg

SEQ ID NO: 40279 - DNA, 1034 bp, Homo sapiens
aacttttatactggtaaaacctcttcattggaacaataatgcctcatcaaaatctgaactcataccactaagtattattataataatttggtattctatagcagtaacagttatttccaaagacattccaatatgcctgtagtaaatattctagatttaattaaaatattggcaggactaccgttttccagattaaattaaaaagcaattattagcattgcagattaagtttttaaatgaatatttcaattcagcgacactggctagaatatcttctgttttgtcacagtgtcacagatcccatcaccatcactgtaaactaaaattagctaacttttaaacataagacccacaattatttattatagcccaaaatatcagaatgttctttagcttataaccttgctcatagaatatactggggaaaggactccaaaaattgtctataagaaaatcttggttttttttttttaaatcactttcattggaaatccaactgtaaactcatattgttaaaaaagttcccataatgttaatttttttggaaatttgcacacttaaaaggaaactaatattgataggcagctgaaaaatatatatattcacatatatattttgaatatatattcatatattttcatatatatgaatgtcatatattttcatatatatgaatgtcatatattttcatatatatgaatgtcatatatattttcatatatatgaatgtcatatatattttcatatatatgaatgtcatatatattttcatatatatgaatgtcatatatattttcatatatatgaatgtcatatatattttcatatatatgaatgtcatatatattttcatatatatgaatgtcatatatattttcatatatatgaatgtcatatatattttcatatatatgaatgtcatatatattttcatatatatgaatgtcatatatattttcatatatatgaatgtcatatatattttcatatatatgaatgtcatatatattttcatatatatgaatgtcatatat

SEQ ID NO: 40280 - DNA, 1144 bp, Homo sapiens
agcccaagacccctattcaaccctaactgggttccttttcctattttccagtgcagcttatccttgtacctaaagttgagtagccccactaggaaagattggcagaaaggaatagttaagcaccccttggagcttgctgcctgcaggagcctacttctaggtactcagcttcccttccactctctagggatcctgtagaccacagtgtttgtgctcaactgcagaagcttcatgtgagaaaaaagtttccttttctccactgacatattcttccactttttctttatataatttcctgctggtctctttaatccccaggcttctttcaaactcctgtttctctatatagtagcttcctgtacaaatgtatgtcacatttatatgtggaaacttgcctaaataaaattaggcagatgtgtgatgccagatatacacatatgactcaccccgcccctccccttgcttcatttagtttctggtcaaataccactttactaagaaaggccttacctgaccaccacctccacctaaaatagctctccttcaaatggatcatttggcttactgcacttccccttgcagcagttgtcaccacctgtgaaattatataatatcttaattaattgtatttgactccatgaatgccaggatatcagggactcactgctgagtctctatagcctagaacagtgctggtacatagcccttaaattcttttacacaaagaagaacctattaaattttgtcaaataagaaacttgaggtttatcttaatgacagagttgctattatcaccaccatctgttttaaagttgagtatactaaaattcatagcctactcaaggtcacacaagtagtaagtggagccaagcttcaaacatagatctcctgactccattcatatgaccctataaactgtctcaaaacaaaaagataaattaatataaatatttattgaatatgtctttgtagagaaagcataataagcataaagggcaatgcgttaacctttatcacaagcaaccctattggaatgtgtcaacttatcagaatgaatcaggccagaatatcaagtataaatgaagcctgtagttaactgaaagttgcatatcaatcaggcactccagtttctctcctcaaactc

SEQ ID NO: 40281 - DNA, 1076 bp, Homo sapiens
ccccataggaaatttcttagaaatgctgcctaattaggttaattttagcccattgtgctaatctgtcacaggttttttggggatcttgattcactattccaaaatatgcactgccttctttaatgtcaaatttggaaaaccttattttcctctagtttaagatggtaatacaaattaaaatattgtatagaaaatgtccaaggaaggtcagagctgtaaaggctgaatctcaacgctctcctccaggttgataatctatagatcatcagtttcttcagttctttttttttttttttttttttttttgagatggcgtcttcctctgtcacccagtctggagtgcaatggcacaatcttggctcactgcaacctccacctcctgggttcaagcaattctcctgcctcagcctcccgagtagctggggttacagatgcgcgccaccatgcctggctaattttttgtggtttttttagtagagacggggtttcaccatgctggccaggctgatctcgaactcctgatctcatgatctgcccgcctaggcctcccaaagtgctgggattacaggcgtgagccaccgcgcccagcccatcagttcctttagagcatatttgtgcagcagttgtgaaatctccctaacggtattcggattcagactaaatttccccacgtggacatcttgagagacttagtcatatagactttgcctaatacattttctctgtctgcccatctagtgatcagataaaaaggggaggaaataaaaattaacactcttgttaaataaatatctgcgcaccttctctccaagcttctcagaaaagataaccgataattgctgatccaagacagaggatttcagacatttgtttgttcacttaataaatacgtattaagttgttactctgaaccagaccctatgctgagagtttaggatacagctgtgaactacttagatgtagccccagaaatggccgttactgcctggctctcagagaggctgaagggtgtggtgagagtgtaaagcagctaattgtgagtaagtggtagacagactagagctgggaaatagcat

SEQ ID NO: 40282 - DNA, 1954 bp, Homo sapiens
acatttctgccatatatttatgaaaggaaaacaaaatatttgctaggcattatttgaatatgtaccagttaaaaaaagaggtctgtggcttttgggttaccaaacataactactaaaaggcaaatcctggtgaagtgttaatttaaccaattaaattatatttaagagtctaaacataagggaaccagagaataagcacaggaaacatatttgtatgagtagatatgtacagatataaattcagttttatatattttctatttctttacatccctgatttctatatggaccttctgtagatggctagtttgttatttataaatttgagctgtttgcacagtagatgttactttaattgtgttattctaattatctatttatctatatatctaattatacatctatctgcttttaaaactatagcaatatatgcatgcttttataatctcttcacttttatatctgacttttgaagaggaagttaattttgatgaacagtgatgaggaaaatatccttgaagactaaaacactgcaataaaaagagaaaaccatgagaggtttccatgtcttggtctctgtttatattactaaagagatgttaaaaatatcatttggggactatcttatattctgtaactagagcataactatctgctgacacataggccacttccgaaatattgcttaataacacattttcaaataccctggtgccatctcaggcaaattaatctctgaactaacaagagtctttactgtgctgcacagatcttctcagagatatgtaataaatggtatgtattcaaggactgctgcagtaatagtatttatgtagcttggctagaaacatttgctctcttaacagtgggcatttaagatgaagactgtccctggcattgtgcagcacagtaggaacattggcctgctgactaaacaaatatgattgccaaagtgaattattaaattccaactggcctcacttgctagagaatttcactcctttttctcccacacagcttcctactttttattaaaggaacagttttcagctcttgcaaataattgcagtattttgctagtcattactacagcagtttcccactgtttatattttaaaactagcacttggatgagtcctgttgaagcagaacaaataactgtgtgtgcatctgtgtaaatatttatcgaaatttgctttattaaaagtcccagtgaacttttgttctaactgctataccttgtgtcacttctgacacagtcacatcatcaagctactgttactttacaaaacatgggtgacttcatttcagtatttccttcagaggacttatttgggagactcccttccaatagaggaagtgggttgatgagtgctggtgttctcattccagatccttcacatctctggaaagctgcatcctttgtagaaaatagatctgtatgtgtgccaaagtataaccctgatgttcatcagggcagtgggaggaggtcatatattccttgtctgtttgaacagtgatcctcccatttggcaggactttgagaggaagtatttaacaatgggattttataaaatttaatgtagtaaagactgtttttatatttgaatggatctaaggaagttttctttttctccctccgataagtggggggtgtttaagggtaatggtgtctacgaatttattgggaggatttggctgttttattggaccttgtggaataatttgctttcattttatcatttccatgaaaggtagtcctcagaagaaaaaaatgtggtctcttaacttcataccaatcttaaatgttttgcttaaggggaattagtgaggaaataacagtctcaggaaggttgaaaactgtgattttactcaacaaatattgctcttttaatctctccagccatgccagaaactatgaagttattttctttcacacatgcactgtaagacc

SEQ ID NO: 40283 - DNA, 1031 bp, Homo sapiens
caatttatttttcattaccattttatcagagaatgatatttaagcgatactcatttctagagtagaagagattttattccttataactgtaaactctatactatccaagataatactcttcttcctagaatttgaattcgttaacaatctttcacattttcacaatccatgggaaatcactcccagtaaatgcttacagcattcgtccactttcatgaggcaaggagtaggtaggtctgtatttgtattaattacaaagaaattcaagggaaggttcatcattatcatcgttagcaggaaatataatgaattagaagcccttgaattggactaaaagagtgtggagtatgtgtaaaagaatgaatcagagaaggtaaagattaattttaaagggcagaattttgtttgtacatttaggtcacttcaatttcagatcagttctatgtatgctttctagaaaagatatcaaagaccacctagatttcttgcctttaggtgtgttttaccaaaggaacaagacagaagatgaatgccaaaactattaatgcagctaccctggacactaagcccccaaagagatggaggattggaggatgtagagcctgggcactgggtccagtgctgacatggaacatgttcattcttagagtttcactgcaaacactccaaggatagagagcgagaaggttatgtggacatgagaggagaagggtggaagaggattgaatggttcagggtagctaaaaaaaatttttacactttatctcgggctgcttctaaaccctccaccagaaagaattaatcctgcaagcacttaaaacaaaactgatgtgaggaagataataaaacctgtccagggtacagacatccagatttgcaatttagggtgggaagactttagagaccttgtctaacagggctaaagagtatccttatggttttaaagtaggtacattgttttttgtaagcatttctagggttatataagacaaatcagagtctgatgtattgaacacaattggatcttattc

SEQ ID NO: 40284 - DNA, 1161 bp, Homo sapiens
gcttgaacctgtgaggcagaggttgcagtgagccaagatcgcaccactgcactccagcctggtccagagtgagattccgtctcgaacaaaacaaaacaaaaatattgagctaatctaaatggtaaaaatctagatttgaagaaatttattttaaaatagttgttcatttgtcaaatagaaaagtatgatcttagcaggtttggttagatccctatctgaaacaaagtaaactaaagatgtttttcttgatcaatgcatagcaataactgctgttcaaacatgtgaggaatcaccagtaaattgggggatagaaagcaggaaaaggagcttttttctcttattttttttcatttatcagtttttcccatttgtccatcctttcctataatcatggaaatttttattttttacactcctctccccatttttttatcctagattgccaccacaccaaggttttctagagttaggcagaaagagaacctgggcctagatgctaatggaaactatcccatgctttctcagactctctttcctccccagagacaagaggagcaaaacaggagttgatggctcattgctgttgcttctgtggctgccctgtttggttgacctgagctttttttaaaaacctccactcttgacgcttaactctatgaataaaattagggccagtcacactgtattttcatcatcagttatccctagtgattcaaatttagcacaaacctgctgtgagtacatattaattaggtgaatacagtagaatgcaatcataacatgagtcttttaataactattctttgtttgatttttattttagaagtttgaagttattttgttgaaaatctagaaaatctttatgtgagcaactgaggttcgggtagcccacaacagtttaaatcaaacattaacttgcagtaaaacactactgaaagtgtctttgattttgaggtgcagagagctgtttcaagttaagttgctatattagtctgttctcatgctgctaataaagacatacctgcaaccgggcaatttattaaaaaaaaaaagaggtttaattgactgacagttccacatggctggggaggcctcaccgtcatggtgaaagagcaagggatgtcttacatggtggcaggcaagaagtttgtgcagaggaac

SEQ ID NO: 40285 - DNA, 2600 bp, Homo sapiens
tgaagatcttactgagttcttggatggaaatgtcagtaatgggcacttagtgccttcaggacttgttctatactatcccagaaatttctgatgctaaacttggcaatttttaaatgtcatattccttttctccaaactctttaaccacaagaattcagggaaggttatggggggtgacttagttatctggataatacatattgtggacaatatagcattatccttgggaatgatttcatattgttgaataaataggatcaacttcttgataaaccttagtcccaagcatttcatcttcattggatagtgttacatagtaatatatttatgttttcttttaatcatttcataacttggaaaatactaacatagtcaaaactctagggtaggtgatacatgagtttctgtagtaatctggttggagacatgttgtaattctgtatatatatgtacatttatcccatgcatgttatgcctaaactaagacggatacccctgaattaagaggtgctgttatacattgaccaggcttaagaatatctctttaaagtgtgtcgacatttaattgacctttggaagttcattctgttaatcatactcaaagtgctaaagctatggttgactgctctggtgtttttatattcattcgtgctttagcatataaattcttcagcataattgctacttatttagcaagagtttcctttatttgaaaatgtgagttgtgcttgtatttttgtgtctttctttctttctttctttttttaaactttgcttcaggctgggtagtggtagaggtttgaattaaaatgttttcctgtcagtagttgtatgaggtgtggcttcttaatctagaagtaatggaaatttcttgcttaaatgaagtgcacttttcttcctgcagaagttagaactcttttagacaagcttaacacttcaaaactgtatatctttaacagaaacttttggaaatttttaaattccatttgtgtagattaaaaatatcaatgctaatactttctattaaataaggatttatctattttcataaaacctctaattatattccttgaattgctatgagtagaattttgttgtaaacacaatatttttaaaaagtcaaatatattttaaaaatcttaacattatattactataacttagagaacaggtgtttacatgtttaaaattttctaggccttaaatttgtgaaatcagtctttcagaagttatttttaatatagttatctgtgttacaggtttataagttgacatttcaatttaaaattttttcaatttatatttcaatgaccaggaaaaaatagttaaacttattcctaaattttaatagaaaaataaaaaaccacatagttgttaatttctggtaatttatcttgagactccaggcatgtttttagaacatttttaccttaaaagcaattttgaaatagggaaattaaagtttaaagcagagttttcactttaatgaggtaattttatacttcccagataggtaggcccatattcaagaacactctgatctctgtttatagtaagttttgatgccattatatcatttacttattcacgcattataagcatagtagatagccccattgtcacgaagctggcattattttcttgtctgtcattcaatattgtccccttttttttttctgttttcatcatagccgtccttttcattttattgtagccctgactcgaaatgaaagtaagtttgaactcttaaaaaagagttcctcaaactcttttttaagaatatacagtgaaatgtcttaaataatattatctaaataatacctaaagaatgcaaatgacttgcaatgctgaatagtcagacacaggatgttccatgctaagggtagactcatatttccactttataaaatgtggtttcagaaaacaaatagatgtgtttcttccttaataattagtgtttcaggaccaaagttgactaaatatggaagtttaagataaaacccggtttcttagggaatctttctcagtccttagtaattctgtagaattgatgatagagtggcaacttcaatacactcagtattcttttctgtttgaagtctgttttgccattggaaaaaacttattgttgtttgaatttgggtatatgtattcacagatggtttactttatttttattttgtttaaacaaatactttcatgtcccaaacactgagacatgtttcatgtcctaaacactttataaatattagaatatttaatccccttaactctgtagttataattatcttcattttacaattgagaaaactaagatacgacgttttatttaatggtaacgccttaagtaaggggagagtgataagtgtaagcagagtggaaaacttagtagtgctaaggagcaacagaagtatgtgcaagagtttgggaagatgtgtctgcttggaaaggatcagggactcagctgggatcagtcttaaagagcaacatgtcctcattcctcaattttaagcctttgggctctagaagtaaagggcaaacttagaggaggcactcctcaggtttcagctgcctgttccggcctggtgaggtggctgtac

SEQ ID NO: 40286 - DNA, 1050 bp, Homo sapiens
aagcagataatttggcaagcaagtgtggctaagcccaggcacctctgttcttggttgtcaaaactttaatctacaaactcatataatggctcctataatctctatctataaatgcccaacatgtgagaattttcaagcttatcagttaaaaaaaggtcggggggcagtgattgtttagaagagaggttcaaagcataggttgaggagtcaaccagtcctgattgcaatcctagttttgccatttactgcttgggtggcttcaacctacatccttgactctaagtttgtttccttacttgaaaaatgaggataatagtactgcctcataggagttgttttgtaaattatgtaagattataaattaaaacatcagctaataaatcacacggtatatatttaatatatgtagcttttaatttattataataactttttcaaatttcctttttagtcctggagagttgctgtagaagaaggaaaagagaggaagacaacacaacacaggaggggataagtacctctggacacaatggaagtagtagttgttgagcagagggaaagggataggagaaggatgtggactgcagtgctgcagtgccaggtaataactttgatcatgtacctccttggctcaggtgctgtctcttctactctcctccttacttgtactaccttatttagcacttaattatatactttcttgactcactttgagacacactgattatgtggtctgcctcaaagacagaatcctagttttggattttagcattactgatctatagccttgcaggggcttaaggatggcagctgtctctctcccttgggatctagcttttgcaaatattgaagggaagagatttctttgatcttataggaatagatccacagttcctctccagatttgcttttatagagaagtgtgtgtcaccaaaacaatggagatacggtcagagaggcccctacccccagaattttaatataattttactttctggggcatttattcttgacaaatactttctctcctatcagctcacttgttcctca

SEQ ID NO: 40287 - DNA, 1024 bp, Homo sapiens
tggcaaaaccccgtctctgctaaaaatacaaaaataaactgagcgcggtggtttgcgcgtgtaatcccagctactcgagaggctgaggcaggagaatggcttgcacctgggagatggaggctgtagagggctgagatcgcaccaggcactccagccagggagacagagtcagactctgtctcaaaaaaaaaaaaaacaaaacaaaacaaaaaaaacaaaaaccaaaccaaaccaaaacaaaacccaaaaaggcaagaaattaaagaacttttagaagctttgccattacctaagggagtagccatataataaaatggagactaatttaaagggcaataacccagaatcctgaggaaataatttgccactatgctaaacaagtagcattaaccaaagcagttgccatactgatggtttgtaaatatgttctagtcatagtctgcttatctccagaatggattgaggatattcctgatagacagacaagattttgatgataaaattgcttgactgttattctggacttaaggaattctagtgtattcttcagtgattggggggaggggttgtggtacacaaaagaacagctccaaatgttttttagtgtgaataaacaatcttgctgtaccaaatgaatatttagaacaattagaaagaaggaggggcatggtggctcacacctgtaatcccagcactttgggaggccaaggcgggtggatcacctgagttcaggagtttgagaccagcctggccaacatggtagaaccccgtctttactaaaatacaaaaaaattagccaggtgtggtggctcatgcctgtaatcctagctactcgggaggctgaggcagaagaattgcttgaacctgggaggtggaggttgcagggagccgagaccactgcaccattgcaatcctgcctgggcaacaagaactaaacccggtctcaaaaaaaaaaaaaaaaaaaaaagaacaattagaaaaaaatgaattctgtaaaactaagtttgagaatgttctccaacac

SEQ ID NO: 40288 - DNA, 1032 bp, Homo sapiens
gcaggagaatcacttgaacctgggaggtggaggttgcagtgagccaagatcaccccattgcactccagcctgggtgacagagtgagactccatctccaaaaaaaaaaaaagaaaaagaaaagaaaagaaaagaaaaaattatccagcccaggccctaaaatataaagatctctccctgtttttttcttttcccccccgggatggagtcttgctctgtcacccaggctggagtgcagtggtgccatctcggctcactgcaacctctgccttctgggttcaagcgattctcctgccttagcctcctgagtaactgggattacaggcacccgccaccaaacctggctaactttttgtatttttagtagagacagggtcttaccatgttggctaggctggtctggaactccgatctgaagtgatatgcccacctcagcctcccaaagcgctgggattacgggtgtgagccaccacgtctggccttctacctggctttttccttctgagattgtactaaggttctgtcaagatggtgtaggagggctgggcgcggtggctcacgcctgtaatcccagcactttgggaggccagggtgggtgggcggatcacaaggtcagcagttcgagaccagcttagacaacatggtgaaaccccgacgtggtggcaggtgcctgtagtcccagctacttgggagtgaggcaggagaatagcttgaacctgggaggcagagattgcagtgagccgagatcgctccactgcactccagcgtgggcgacagagcaagactccgtctcaaaaacaaacaaacaaaaatgatggtgtaggaattctaataaacttaggtttgcatgatcaaaagttttttctggtggacctttagagacaaattgtgcttttctatgagtagtgttgtctggtgttgacagtcaacactactcatagaaaagcacaatttgtaacctttttttttaaatgggattacactataaagagttgatttttcagtccacatccatatgtaccaaggacatcccc

SEQ ID NO: 40289 - DNA, 1030 bp, Homo sapiens
ggctcactacaaccttcgccttccgagtacaagcaattctcatgcctcagcctcctgagtagctgggactacaggcgcatgccaccacgcccggctaatttttgtatttttagtggagatggggttccaccatgttggccaggctggtctcaaactcccagcctcaagtgatccacccaccttggcctcccaaagtgcagggattacaggcgtgagccaccggacctggcctagagtggcatcttaaaatatgcttgaccagtatgcctcaaaactgtcaaggtcatcaaaaacaaaaaaagtctgagaatctaccacagccaagaggagcctaaggagacatgatgactaaatgtaatgtggtacactgtttgggctcctggggcagaaaaaggaccttaggtaaaaactaaggaaatcagaataaagtatgggctttaatataagatgttaataataggaaaaactgagtgtggagtaaatgggcactctgtactatcctcacaactcttctgtaaatctagaacccatttttttttttttttttttgagacgaagtttcactcttactgcccaggctggagtgcaatggcgcgatcttggctcactggaatctttgcctcctgggttcaagcgattctcctgcctcagcctcccaagtagctgggattacaggcgcccatcaccacgcctggctgattttttatattttaagtagagacggagtttcaccatgttggcaaggctggtcttgaactcttgaccttcaggaaatgctgggattacaggtgtgacccactgcacccaggtggttttttgtttttttttttgagagagtctcgttctgtcacccaggctggagtgccgtggcatgagcttggctcactgcaacctctgcctcccaggttcaagtgattctcctgccttagcctcctgagtagctgggattacaggtgtgtgccaccacgcctggctaaatttctatttttagtagagacaaggtttctccatgttaggctggtctcaaact

SEQ ID NO: 40290 - DNA, 1033 bp, Homo sapiens
ccagtgtatattacttgaagtaaatgactgtaggttcctttgtgggaaggaagagggaaccattactatgtactgccatagcattgccaggtccttcctcctggggatctggcctctccttcagtcattcagtttcagatctggaaactggcgtatgtctggaaactgggcaagggagcatgagactactgcttccagcctaatcatctagccttgatttctttgatgtacagattgaatagtacccttgttggctgcccaggtatttttccttagtcatttaataaccctctagtagtcaggtccctctgtgaagctgacttgccacttgttatgatgattgtgtctttctggcatctgagggttaagtggccttgactggcctttgggggatagtggctatcatcgcaattgctattagagaccagttttatcacggcatctcctactgtaagtcccggctctcagagaagagccactactgaacttagcagtgttggtgacattctcactagaacatttcttattgctttggtaagtaatatattttctgggtcctcttgtggattttccaactatttgccgtatatagtctatagcatactcacttttccgagccttttcattcatctaccttttgctacaattttggcatttctacctcacttagtgtgggccactgttatttccatgcttctgggagccatcctggtagtaggattgcgtcatctttcaggatcctagtcagggcattaaatcctgaaagcagtatctggttcttttttttttttttgagacagagtctcactctgttgcccgggctggagtgcagtggcatgaactcagctcactgcaatctctgcctctcaggttcaagtgattctcctgcctcggcctcccgagtaactgagattacaggtgcaagctaccatgcccagctaattttcacgatttttagtagagacagggtttcaccatgttcgtcaggctggtctcaaactcctgacctcaaatgatcctcctgcctcagcct

SEQ ID NO: 40291 - DNA, 1033 bp, Homo sapiens; identical to SEQ ID NO: 40290

SEQ ID NO: 40292 - DNA, 1050 bp, Homo sapiens
agagaaggggatttggtatgttgcttaggctgatcttgaactcctagcctcacgcaatcctgcttcggctttccaaaatgttgggattataggcatgagccatgcgcctgaccttgattacctcgatgatgtgtatgtcatacattggagggcaaagacatctctgaattcctcacaacagccatggcagggggcaggtacccatgttacagatgacagactgatgcatagagaagttaagtcgtggggagtttactttctcctaaattgtcctgttactagatgaatttgtttttgtttcattttgttttgtttttgagacagagtctcatgttgtcacccagactggagtgcagtggctccatctcggctcactatagcctccgcctcctgagttcaagtgattctcctgcctcagcctcccaagtagctgggtgcatgccaccacgcctggctaatttttgtatttttagtatagatggggtttcaccatgttggccagactggtctcgaactcctgacctcaagtgatccaccccgcgcttagcctcccaaagtgctgggattataggcgtgagccaccacaccaggccatgaatttgttttcaatatttatttattttgtattttctatttttgagatggagtctcgctctgctgtccaggctagagtgcagtggtgtgatcttggctcactgtagcctccacctcctgagttcaagtgattctcctgccttagcctcccgagtagctgggattacaggcgcccaccatcacacccggctaatttttgtatttttagtagagatggggtttcaccatgttggccacgctggtctcaaactgacctcaattgatccacccaccttgacctcccaaagtgctgggattacagacctgagccacagcgcccagcccttcaatatttatttaaatttgcctgctggctaacttctcattgcacctgggctctagtgtaattaaattacttcattctctttttaaaactttttacttttttcttttttgtgtttttcattctcttatcta

SEQ ID NO: 40293 - DNA, 1049 bp, Homo sapiens
aggtatgtttaataccagaaagggaaagatcaactaaaatgagttttaccagcagaatcattaggtgatttccccagaactagtgagtggtttagatctgaatgctaatagttaagaccttacttatgaaataattttgcttttggtgacttctgtaatcgtattgctagtgagtagatttggatgttaatagttaagatccgacttataaaagtttgatttttggttgcttctgtaacccaaagtgactaaaatcactttggacttggagttgtaaagtggaaactgccaattaagggctggggacaaggaaattgaagctggagtttgtgttttagtaaccaagtaacgactcttaatccttacagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggttggtgggattaataattctaggtttctttatcccaaaaggcttgctttgtacactggttttgtcatttggagagttgacagggatatgtctttgctttctttaaaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacgtaagtggctttcaagaccattgttaaaaagctctgggaatggcgatttcatgcttacacaaattggcatgcttgtgtttcagatgccttggttca

SEQ ID NO: 40294 - DNA, 1024 bp, Homo sapiens
tttttcgcaacgggtttgccgccagaacacaggtaagtgccgtgtgtggttcccgcgggcctggcctctttacgggttatggcccttgcgtgccttgaattacttccacgcccctggctgcagtacgtgattcttgatcccgagcttcgggttggaagtgggtgggagagttcgaggccttgcgcttaaggagccccttcgcctcgtgcttgagttgaggcctggcttgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgaaaactacccctaaaagccaaaatgggaaaggaaaagactc

SEQ ID NO: 40295 - DNA, 1051 bp, Homo sapiens
aaaatagtgctattgtcaaaagatgaaaatagatgctgaagaaaaagaaaaccaaatatccatggtacctaccttataagatcgttgtgaagattaaatagaacacgcacagaacactttgctcataatgcaataaaggtatttgcatataatgcaatagatgtaattattttctggctaactttgagtcaggtgtggtgaccagggtcacagatcaatccaagtaaaatattaaagtgatgattggtgtgctttcagaaaggaaaatgctgaccactaaagagccaccattgggtcactaagagccaaaatggcaaaacagtctaacttctcaacataatttttagcctaatagaataaagaaaatatagtagatttgatatgtcaggacttcagccaggcctcctatgatagatgccgttttggacaaggtggagaaagatgaattggatgtacaattagataaatttgtcactactaaatttcagtgtaatagcatgctcattaacggatctagtcatttgagaaacactgtgccaggcactgtaccagatgttgaagacacaaacatgaaagtaacatgattcctgctggcatctgtataagcttaagctggcctggatgatggtgggtcatgtcatgaagtataatgctggacaggcagcagggggatcctgtgcctgagcttcaagcatcaggtgggtggttgaagtctacatcttaaagacccaggtccaaccctgaaattttatgagtcttataagccgaaaaagacatttatctagatatcataagaagctaaacaggtttagtaacataaatgatgccagcaaatagttgtagcagttgggaggatggtaagcaagtgcctttgtgcctcagataatgaggactgctgtactggttctcagctgactgagacacaactattccaaatgtaagtaggcccggtgaggtggctcatgcctgtaatcccagcactttgggaggctgaggcggttggatcgtttgaggttaggagctccagaccagcctgaccaacatggtgaaa

SEQ ID NO: 40296 - DNA, 1050 bp, Homo sapiens
agtgacagagtaagactccatctcaaaaaaaaaaaaaaaaaaaaaaagaatgattcattaagctatgtttatgtggttttctgcatctgcattttattttatagtaaaaaaaattttttttaaataaatgagtgagaatggaagatgaaaatgttcagtagggagaatccataggctaacaggaaggtttgtcttctctcacaacccagatcccagagaaacagtcaagattacccgaagcagacaggactagggcaaggcttatttccctctgagacagactcttagggactgccttggactgaaccctataatccttctgacagccagacttatttactgtaattatattaaaaaattaacaacatattgctatgcatttcctttgctttcaagtggtggtcattggctgtgatgaatgtgtatgttttgtttttttctctcaccgtaattaatcctgtatcttcttattccttccagaatgggtttttatcttcattgccttatttaggctcttggttatgtatgatcctgtctggtcaagctgctgacaatttaagggcaaaatggaatttttcaactttatgtgttcgcagaatttttagccttataggtaagtgaagcaatcaggttttgttttggtttacagttatttaccatgtttacagttataggagataggaaaacaaagtgtgtttcccacttttacacacagttaacacaatactcaacacagaacacctcgctctaatcaccaaaatgtttgtggggatttctgcctacacataaccagttctgcagcggacaccagctaggtatcctgtaattcagttctgacactgtccagctggcggtagcatcagatcctataggttgagggctcagttccacaagatcgcccccctacttcggataccaatcacaagtcccagcttgtgacctctgcttctgactgaccggctataaatcagggttcccatgactgtcttgtcaggttcagttaatctgctagagcatctcagagaactcagagaaacactttattttatg

SEQ ID NO: 40297 - DNA, 1048 bp, Homo sapiens
actcacatgggtgtggttggttggttgcagtattaaagttagggtaggcttcaacaggaaggtcagattatttcgagacatccgaaagtgaactggtcagaaacagtcatcccactgtgttagaaattggttctgggacctcccacagatacggaaatctgtgaatgcccaagccttttatataaaatggtgtagtgtttgcatgtaacctatgcacatcctcctatatactttaaataatctctaggttggttataatgcctagtgcaggataaatgctgtgtaaatatactgtattgttttggggataaggaccaataagaaagtctgtatgtgttcaatacagatgcagccatttattttttactaaatgttttcaagctgttggttgaatccacagatgcggaacccacagatatggagggctaactgtatatgggcaaaaggcactctaggaaaaggaaacagcctagagcaaatgtcctaaggtgcctggcatgttcaaagaacagaaaggcaagagtagataccactcagtgggtgatggagaggaagttagtagggggtgggccacatcaattagggccttgtaggttattttaaggactggcttttgagtgacatggagagccatcataggatttctcaatgaagaatgacttacatgttttagaggactagcctgattgttgtgataaaatagaccatagaggggcagcggtagaaacaggcagatcctttaagatgcttactgcagcaacctagatgagaggtgatgaagactaagagcagctgttagccatgaaaacgatggaaagtgttcagattatgagcagaggaggatctttatcattcacttaaaccttacccttcctcatccacccatcccacaatttcttactgagtatgagtctactttgtataaagcactgttgtaggctcagagaatacagctgtgaaatagatgagcaagccctttcatgggtcttacattccagttggtggagatagacaacaaataattcataagcctgatactgtcctatag

SEQ ID NO: 40298 - DNA, 2487 bp, Homo sapiens
atgtagataattcatctagtacactggtgccctgtttcctaaatctccttaacagcccacccttcactgccactgttagctatcagctgtgtcacagagtgagttttgccattgctccaaatcagcaagttaaaacttttttattaccatgctttttgatcttttgctcagagccttttcatagtctcataactacactcttgatacatgtgttctttgagctcatggagacttctagttcctgatttttccattttctcctggtctgtcagtctccttgtgtgggcttcattgttcacttgaagtatttttttcacattgcattcctttgaggccttttgccccttccatgtaatgagagcaaaagcacctgagaaactacataacctttacatttatttgttttggtaaaatattttggcttttactactaacatttagtttgctaaatcagtctttcaagataatactttgtgtgtgtgtgtgtgtgatttagaacgtaggagtgaggtacctgtatatcctagaattacacaaatgaattaccaacaattaaatggcaacttttaaaattgtattttaaacatcaagtaaccagagatggaaaaatcttcctataccctcttcagattaccctgtacattattttgatggacgaaaacggatgatcttgagcactatttcatggatgggaggaaaaaatccatttttggggattgcttacatcgctgttggatccatctccttccttctgggagttgtactgctagtaattaatcataaatatagaaacagtagtaatacagctgacattaccatttaattttatattatgaaagcaaatcatctgcatgtgcatcaaggccagtcctattcaacctagctttcgaatgctgatatctggttagtatgtcattttgaagttggcacataacttttctaaaaaaaagcagtctttgttgtttgcttcttccctacggatgacttctaaaaatatatgacgggtataaaaaaattagctatattgatcatatcaacactgtaactgctgaaatggcattctaatgtttgctttttattcggacaggccacatgatgcatagagcctctttcatgtgacttgtgtctactgcttaaatctttatgctgtgttgatgatattatattgacatatgaagctgtatatgtgtatgtattttgtggagaaagggattacaagatgtatgagtataatgacttgctaacctttcaggattcagagaaagatgaagaaagaccatatctaaataatacacttcatcattttcatgtgtataaatgcttaaagtaccatctttgttgaggtggttcatgtatccagtttatccagtacagttatttgtcaagcttagctttgatttcaaaggacacgcttaccttgtctggcataagaattaatgctcatgtctgcagtggttgggtaggtcctgcttaggagaattaaaaaattcctctttccgtttggttgaatgttgcagtcaggaaccccaactcacttggaatgtttttatatgtaatcatttcccttgaagcttatactttataagggaagaaagaattcaggtgatatgggaaaactgcttggcagaccttcatcttctgcctcaactgtaaaccacatgtaagtgcttaatggagactgttttcattcttgtgatatttaacattcagaaaattacttcagctttggaaatactcaggctgtttttattctgcaggtaagtgttttgacttaagtactaatattccagaaatttttgaaagcagtaaccttaatttcctatgtatttcattccacttttgcatataggtcaaatagcaatgtgtatgcacattctctttagttaaggcaccaattgttttggttggttttcctaagacatactttaaaaagatgttctataaatttcctaattaaattatggggattttggagtatgtacatgataaattataatatgtatatggttgaagttattttattttttactaatgaattattttaatattccttattgaataaatgctgtaacttgtttgctatggaacttattcttaaagttctagttaaaaataatttttccacatgcatgaaaatatgtattaatcagaggtggcttaattacattgaaattgcttttttgttgttgtttttttactgaaataactcatgtttgtgtagaagaatgcctgtttactcagagtttatattttccttcagttatattttaaatcaaaaggtctgggtaatgtatacttttgattaatatatactttttttaaaaaacaaaaaacaatgtaatggttaatagtagaaatgtgccacacttttcaagttttatataacatatgaaattcagttaaaagaatgtgtgtttcataatgacttttaactggtaaaaatattacttgcacgaagtacttgatgtatggttatcctgaaatttc

SEQ ID NO: 40299 - DNA, 1111 bp, Homo sapiens
tgttatctatagcctacttacattacagacctgtgtattataagtgagaaaaatataggtgttgaattcttaatcagtaatttagggatagctcatagttctcccaaaggcctggataataatttctctcttcttttccttgtaaaaaccagaatcccagtaaggaatgtgaaccttatcgaagaaatgaagacaaaccaattgctccttgtggagctattgccaacagcatgtttaatggtatgatatagatacaaatatagacatatataattaggacaatttgcataatttcattacagatttgatagtttagtaaacatgaatgaaattgagaaactcaaacatttaagactaaatcgagtattgaatggggtattataatgatttgtgattttcttttgagcatacttacattttagagtggatttctgtctctgagaagaaagaagcagaaacattctgctaatcttatttcatataaaaataaaagtcaggctgaccttcccactgacttcatttttatcattgaaaaggagctatagttgatcatttagagcagcactatctgatagaaatataatgtgagctataaatacaagtcctgtaggtaattttacattttctgtctttttttttttttcctttttctttttttgagatggagcgtcattctgtcgcccaggctggagtgcagtggcgcgacgtcggctcactgcaacctctgctccctgggttcaagcatttctcttgcctcagcttcccctgtaactgggattacaggcgcccgcaaccacgcctggctattttttttgtatttttagtagagacggggtttcaccatattggtcaggctggtcttgtattcctgacctcgtgatccgcccacttcggcctcccaagttgctgggattacaggcgtgagccactgcgcctggcctggtaattttaaattttctaatagtcatatttaaaactatgaaaagaaacaagtgaaattaattttagcaatatgttttatgtaacagtatatccaagatactgttatttcggcatataatactatataaaagttgagatacttcatattctaattttttatactaagtct

SEQ ID NO: 40300 - DNA, 1031 bp, Homo sapiens
tgcactcaaactttgttatagctaaaaatatataaaggtttttaatacgacagaagtttgtagagttgttcataccatccttatgccttaatcgtttctttttcggttttgactaaatgtttcctctgaataatatgctacttttttggaggcaaattttctcctccctaaggtttggtgacttcatttgatatgacaccaatgttaaccaaggaaatgaacactgactatttaaaaaaccaaaaagagaagatgttttaaatgattgggcagactcttggcatcaggtttttagaagcaactggctcaattagccagctcaggaaatgtgccacattgtgtgtaaaaaatccaactccccaaattacagaactgttggaacgttgtgcacccagtttacatttgctggagaacgtcatccttggctcagatgtaatgaaagagtcatcattttcccaggtgaactggggcaaaccaaggtttagtctccttttattgccagggagagattgatggttgcggctagaaactatgcaaaagttggcagttgtagcttccttgagctttcaggtttgtccaagtgaaagtcaaggagtgtgaacccaggtaaacgaaatgtttaccactaaagaagccaccatggatttgaaaccactgaggtgcatagcactttcacaggaagcatgccattctgcagagctacagtcttctctgtgaatgactgtgcaatgtagattagctcatttaaattttaggctaaacatgcaagagggagattttactgagatggctagtggttacatccacagcattcaattactataataagaaacagatatgtcactctagagaatttgggctttgccttgattaatataggagtttataatattttataatgattgcagctgcaaacactactccatagttgttagcatattatctaccattagctatgaaaaggaagattcaaatggtgaatggaacaactagaggatttgtttttaagaataaatatattctaataaata

SEQ ID NO: 40301 - DNA, 1064 bp, Homo sapiens
ctccattctcttttattattatttggtttgtgtatactattttaaaatcactatgaaataagatggaatcaaatgattgctatttttaattaattaattttaaagacagggtcttgctctgtcacctaggctggagtgcagtgatgtagtcatagttcactgcagccttgaactcttgggctcaagcaatactcctgcctcagcctcccaaagtgctgggattacagctgtgagccaccatacctggacatggctgtttttgtaggtcaaaatgatcaaatgttggtactttcatatgtctctatctaataatcaatagctatttgaattaagtcatgtgatttttttttttttttttgagacagagtcttgccatctctgctcactacaacctccgcctccagtccaagcgattctcctgcctcagcctcctgagtagcttgaattacaggtgcacgccaccatgctcagctaatttttgtatttttagtagagacagtatttcaccacgttggccaggctggtctcgagttcctgccctcaagcgatccacccgcctcagcctcccaaagtgttgagattacagggatgagccaccgtgcctggccaagtcatgtgatatctttactctggtgaatgaacagtgactatctggggctggtaacatagggttaagaaaaatttaccaagacagttgtagataaataaagacagatttattacagaaagtatgaaaatacattgcaagaaagcaacaggcaagtcagcaagagaagagctaactgcgaagagacaaaggcctgctggaaattttacaggattttatagaatggagcttgtgctctgtgctgaagagggctttgtgcagtatcaatgccaaggttgcagtgagctaacttaacaatttttctgtcagctgagggtctagtgataactggtcacaggaaggttgtgagttgtttgcagaggacagctatgtgtcctggaccatgaagaaaggcagaattgtattgtagcttatttgcttcttctttttgctttaccctggtcccaccagcctgact

SEQ ID NO: 40302 - DNA, 1143 bp, Homo sapiens
aaaaaccataccctaccttacaagtgaggccttttttttttttaacttcttttcctttaaaaattttctcttattataaaaataatacattctcattcaaggaaatatggaaagcacagaaaatgattataatgtttcacgactgaaactcaactcctgtaggtttgtagtcctctgatagcatttttcttgtctttcagtatcgttctttaaaaaacaaaaatgagcaaaaatctatgctaaatgtcaatgaaaagtcaacagcaattaaaatgatgcagaaaaccgacatgattaagtgcagtctttggggaatggactgttctaattcagttgtgctattaacgaaggcctaagcggaaaggcttattgtttaaaacgtcctttaaaatctttttcctaatgcgaaccaataatctttcctgattggcaagagtagtgtaatgaatgtaatttatttttgttgcctgaggttattgcatgatcctgttgtggtgttctatgacatcgtctgtgccaatgacagtataatactgagaagtgtaggtaataggcaaatgtgggtaactggccatttgtacagacttcaacatgtagttttaaaaaaatctttaaggccgggcacggtggctcacgcctgtaatcccagcactttgggaggccgaggcgggtggatcacctgaggtcgggaggagttcaagatcagcctgaccaacatggagaaaccccgtctgtactaaaaatacaaaattagctgggcgtcgtggcacgtgcctgtaatctcagctactcaggaggctgaggcaggagaatcgcttgaatccgggaggcggaggttgcgatgaacggagatcgtgccattgcaccccagcctgggcaacaagagcgaaactccgtctcaaaaaaaaaaaaaaaaaaactttcagcagcttgattccatttggaaaaattgtttttttaattaaaaataaatctttgcttttaaaatgcatatatgctggctttgaaaatggaagaaggtgccaggagtcaaggaatgtgtgtggcctctggaagctggaaaaagcaagaaaatcagttctcctcaagagtctccagaaaggaaaactgacactttgactttagcccaatcagaaaggtatt

SEQ ID NO: 40303 - DNA, 1033 bp, Homo sapiens
ttttcttcattttaaatctattgatatatgcattttattttattttattgccttatttcccatgcttgaatttccagtactatgttgaaaaaggtagtgagaacagatacttttcctggcttctcatcttagaagtaaagcatacattctttcaccattaaatataatgttagctgtaatattttttacatatttttatcaagttgaagaggttttctctattcttatttttctgagagttttgtttctattttgtttctaaaaaagtattgcattaagtgaaatgtattgtttctgcatgaattgatacaataatgtgattttcaaaaaaatatttagcctattaatatggtggcttatattcattgattttcaaatattgaagcatttttgcatccctaaaataagatctacttgatcttggtgtataattctttttatttattgctgaattctatttcttctatttttgttagttttgagtctatatttatgaaggacatcggtctgcaattttcttcttccgtactgactttgctttggaatcagtgcattaatagcttcataaaatgaattggaaaatgctctctccttttcttttttctgaaagaaattgtacagaaattcttctttaagctgttggttgaattttccaatgaaatagcttggctatatttcctttgggagtggttttaaattataaatgtaacatttgtgggtctttaatagttttagaactattcaaattgctatattgggagaattgtagctatttgtgtttttaaggaactaattgatgcttatctaagtgttctaattttaggtatagagtttttttttttggtagtatcatttcttatcatattgatgtctgcaggctctagatatcccgtttcatttctaatattggcaatttgtgtcttatctcttatttgtcagtctttctagaaattgtcaaccttactttactttcaaataacgaacttcttgttttattgattttctctattatttatctgttttcaattttatt

SEQ ID NO: 40304 - DNA, 1005 bp, Homo sapiens
ttataagttacccagtctcaggtatgttctttatagcagcttgagaacaaactaatacaatacataaaaatataaagattttatctgtaccacgaaaaaagtgttaaaaatatatattactttgattaacctcagagaaatattttgatcttaaaatttcctgaaagtatttagtagttatgtgaggttcacccattcctgcagaatagaaattaagaacccagagctatattcaaatttctgttctgattactgactgtatgaccttaggcaagctgctttatcatcttgtagctcagttttcttattcacacaatatagacaaagctatacttacgctaggatttttgcaagaataattatatggaaagtccttcgctaagacaattcctgaattacagtaagccatcacaaaatattagcaattgttctttaaacatacttaagaaatttctgctcatgaaagtctatgtatattttgctgtgggaaatggaaagaaaagaccaaactttctgctggtcagtccccaggcatcacagacaagcagacagtgatgatggtagtaatgcctccttcgagctacttcatttccaaaattcctaagtatatactaccaattatttgcaatgcaaaaccgatgctcatgcagaggaaaatgctgaaactattatgttaatcttcaagtagaataaatctcaagcccgaatatatatttcacttgcatttttattaaaagtgtttttgtttatttcttttgccttgcttttgatagttccataagaagttattgccagtaaatgagaacacacatggagagtatgcagaatgtcacttttatcagcagttaaaagagtaaaaactttatatgttttgtacaattatttaagtgtgaatcaccagttctttctcaatctattcagtgttctctctagagggattctcagcagatctcttgatggttccaatgcactattctgaagaaaaaatggtttccactggaattt

SEQ ID NO: 40305 - DNA, 1082 bp, Homo sapiens
tgaatttatctatttattccatttagttctgtcagtttttaattcatgtatttttaaactcttttatcaggtacatttttatatcttcctattgaatttatcctttttatcagcaagcattatacttctttatctctattaatatatttggcttgtaagtctactttttctgatattaatatgaccacatcagctttctaatttttagtatttgcaagtcatggcatatatgattttctatacttttagtttcaactggattttgtttttataattaaagtgtaatttttacaaacatcctatgtaggctaaaatgctattaagataatcattgcattttatttaatttatacatagtataattatttgtttatttttaagtctactgtactgttatttgttttctatttttgccataaaagtgagtagccaatttttattaagttcttacatttcaatttgacatccacaaatattaatgaacaacacatctaacaccactggaaaactgggcttaaataacacaaggccattattaaatgatcaattcagaagagttaatcgtgaagtagtactatgctgaatctagcagactgtggtaagttaagaatttttattgtaatttctaacataatatggaattttataaaatattatataattaatataggaaacaaaataaaatattagaattattaaattttacttaaaaattttaaataaattttttaaattaaattatcacaaaagaaagaagagaaaaaggaacagaaaaagtataggcctttcttgttcctactggtgcaatattcctagaaaatttgtttacagttttgtttcattatgttttgaaacattaatcttagaagtttatgacctgtgtatctgtcagtcctttttctcttaataacatccttccttggaagtcttaaagtcttttggaaagtaaaattcctggagacttgctctaatttcctaaaggtcctatgcaaagtacatatataaaacccccattgttacccttgccataaccagaagaaaaatagtaataataactattagaaaaacatattatttgttta

SEQ ID NO: 40306 - DNA, 1050 bp, Homo sapiens
actactaaaacgttcgctaatttgagaagcaaaataaagaaaatctcattgcttttttgtgggggctgttttactttattaatgagctgcacaattttcatgatcactatgttttataaatctatttatgatttcatatgttacaaattgtttatatctttgtccctttttaaaattaaattattctattttttaatttaaccttttttaatgttaattatattaaatccttttacatttgtggtatttctctactttctcatttatatttttattttctttgatatatatagaattttttttttagatcactacacgtatgttgactacaaccctaagtttattacatgttgtgtttatcaagctataaaatgttctcctttttcttccttaatatgtatttggtatgcatagcttaaaacatacagtgttttatttcacatatatgttttatttaaaatattatttttattaattttgattctatcttgattttgaaatctacttatgatgccatgtgaaaataggtaatggccgtgtagcactaaatcgcatgttttaatcacagtagcagatgttgttggtgttctgcccatcccctcagacttccttgctatttctgtgtttatcagattgatttccaatgactagtacttgaggtctgtcagtggtttgccgttgacctgcaggaattcactttgctgaaatgcatagcattccagagtgcttggaaattcacatccactgggcagctcttcacaattgctacttggtgagagtgtataaatacctttgctcctccgttggctgagattgttctgagatgtgtgtttttcacaattttccacagcctgcctgcggattaagtttcagttgcccactgtagtagctggcttaagaacgaagcacttattggctactttcccttgctgttttaacttcccacttccctgaggaagtctgggaatacttgcccttctagacattataaagcagaattgattaaaactgtgctgacacccttttggtatcctcagtgcttgtcttaaa

SEQ ID NO: 40307 - DNA, 1083 bp, Homo sapiens
tgatgagcattttttcatatgtctgttggctgcataaatgtcttcttttgagaagtgtctgttcatatcctttgcccactttttgatggggttgcttgttttttttcttgtaaatttgtttaagttctatgtagattctgcatattagccctttgtcagatggatagattgcaaaaaatttctcccattctgtaggttgcctgttcactctgatgatagtttcatttactgtgcagaagctctttagtttagttagatcctatttgtcaattatgacttttgttgccattgctttttgtgttttagacatgaagtgtttgcccatgcctttgtcctgaatggtattgcccaggttttcttctaggatttttatggtcctaggtcttacatttaagtctttgatctgtcttgagtttattttcgtataaggtgtaaggaaggggtccagtctcagttttctgcatatggctagccagttttcccaacacttattaaatagggaatcttttacccattgcttgtttgtgtcaggtttgtcaaagatcagatggttgtagatgtatggtgttatttctgagggctctgttctgttccattggtctacatatctgtttttgtacaagtaccaagctgttttggttactgtagccttgtagtatagtttgaagtcaggtagcgtgatgcctccagctttattcttcttgcccaggtttgtcttgggtatgtgggctcttttttttttttttttttttttttttttttttttttttggctccgtatgaaggttaaagtaattttttctaattctgtgaagaaagtcagtggtagcttgatggggataacactgaatctataaattacttcgggcagtatgaccattttcatgatattgattctccctatcaatgagcatggaatgtttttccatttgtttgtgtcctctcttatttccttgagcagttgtttgtaattctccttgaagaggtccttcacatccgttgtaagttgtattcctaggcattttattctgtttgtagcaattgtgaatgggagttcactgatgatttggctctctgtttgtct

SEQ ID NO: 40308 - DNA, 1033 bp, Homo sapiens
ttacaatcgcatgtgaatatgcaattatctcaaaatgaaacgattaatcgaagctagcagttgtgtttctacacacaattaacaatcccaaaacaatacagaatacaacttaattcacaacagcatgaaaagagtaaaatatgtagcaacaaaattaacacaaagtacaaatgaaatttattgcttatacactgaaagtgacagaatattgtcacagtaaataaaggaatacttaaataaatgaaggaatattttgtattcatgggttggaggactcattaatgtcaagatggcaattgtccccaaatttatctataaattcaacataatatcaaaattccagcagacatttttatagaaattacaaactgatccaaatacttatatgaagatacataataatttagagtaatcaatttttaaaaattaatgttggaggacttccactccacacccaacactttaaagctgtagttatctagacagtatggtactaacataagactagacatgtagatcaagatatctgtactgattaaattgagagtccaaaaataagtcattatatttaaggtctactgattttcaacaaaggatatatgccaacttattgggaaatcatacacttttcaagtaaagtttctggaacaattagatattcatgcacaaataataaatcatatacaacaactgtgtaattcacaatgttttcagtcacagataacttttaaaaattggttttgtattgaataataaagtcaatacatttcaatagcttcgtatcataaatatattttttggctgtaacataattaaaatagaacaaaatttatgtatgtttacatgttaagaaacattatttccaaataatctctgaataaattagaaagggaaaatgatcaaaactgagtgattaaaatgctacttattgaaaattggatacagttaaattagtatcctgagtggaagtctggagtcttaaaatcttacttaaaaaaagaaaatcagtgactgaattatctattttgagtca

SEQ ID NO: 40309 - DNA, 1049 bp, Homo sapiens
agaaaagaaaaatactacaaaaagctggtgaaataaatcaaagaaaatcacactatttatattttggaaaacccaacataataaagacttaaattctcccctagctggtatacctattttaaaaaatccaagaaaaatctctgtcaaaatgacagcattatttttaggtataaataagattattctaaaattcatatgaaaaagataacaagagaaactcctagaatagtgaaacaattttgaaaatgaagaatgcagtgggagaaatgattctccagtttttaaaaatgtattatataactacagtagtcaatattgtatggtattggtggaaatttagatataatagattaatgaaacagtttcaaatactgacacttaggaattcattgagtgaaatacaaaatatatttataaacttcaacaatagactagatcaaacagcgtaaagaatctcagagcttgaacaccaagacttttgaaagaagaagccaaaaattgcccaatgcaggcatagcaagatgaaaaagcaattcagtggaactttgaaaagtggctttttcatcagattgtgagagaacaattggacattcataagcaacaacaataacaacaaaaattaaacttgacctacatctcacaccttgtataaaaattaatgcaaaatgaacatgtaaatttaaactaaaaatcttttagaaaaaattagaacactttcagaatctaggactaagcaaagaattgttgacttgacaccaaaagcaaaattcattaaaggaaaaaattgattaattgaacttcatcaaaattaaaaattttgcactgtgaaagatcttgttaagagaatgaaaacacaagctacagacttggagagagtatttgcaaaccagatatatgaagaactagggtctatctctctatcttccatcagtctatctatctatctatcatctatctatctatccatctatcttctaatctatctatctagtaagcacataaaatgatggcacaatatcattattagagaaatccaaaccaaaaccata

SEQ ID NO: 40310 - DNA, 1033 bp, Homo sapiens
tgttgatttaaagaaagttatatttggtattatagtgcctaagtacatcagacatgactattactatcttaaaagcatgtgttgttatgtgatatcaggacatctgaacattccactgtcgtaggaatttgtccttgtgggaaagcattactaaactgcttcagtagttgtaaacatctcatgaccattgctcatgactatcaaggaatatgctttgctagttttaagatgatgttgattttaaaatgatgttgccctggctctcctatggtcctttttccctaacaaaagcatatgcatgctcaggtcaccacactgctgaaaccctgtaaacgtccctcctgcctgggtaaaataagtttgagtttcttagcttatgagtgagagtttccatgatgtggcctttgtctatcatggaaaagatccatgatacccatggtttccaaaacttgccatactcttccacattaccttacctttgcagaggctgattctcctgccttagctaagttccttttcaatgccctgacactaattacggaatgccaatttcttcgtaacaactctgttacatttgtattttggtccatattttttctattttatgttgtctttttaaaaattatgtttatttccccctactagattgctgcaaactttggagttcattgttttatgtacctgccatgtagcataaggcctggaccattgtaaattctcagtaatgaatattcagtgtcattaaattgtattactattatttttcctttgaaggatgacatagaaactctgctggaccaatatcctagctgataaaagtcatagttgatacttgaatttgcctttttaccttagctcaaagaagttctgtctaccatactgataatatgaatagtaacaataaagttattctttaaaattttacttttaaaagatggaattagaacaaaaaaattaagaaagggtttcctttttaacttgagtcagtcaatttaacaggtttaacattgaaaatcttataaaaattcaattt

SEQ ID NO: 40311 - DNA, 1095 bp, Homo sapiens
gcacaatttaaaatcatatgtttctttaagcatttaaagaaaattattagaaaatgatacttgtcaatagatgcacttccttatttgtcagcctcttttagaagaatactccttagaaggactccaggtgtgattttttttcggtgagaaaaacatacaaagaatctttgtttctggtccttcatctgagtaacatttcactacatatctttttgcctcatattaactatgtaatcaactggctttgtgatttagaaaacaatgaaatacctgttaagttttccataaatctctttctgtaagaattatacaccccaactgtcatgattctattccatcgtttttcccaccatcatgcctacagttgattgaaccagttaaggatgtctactcctagctagaccaattatttttcaatttgaaatttggtataaagactaagaaaatttgtatttaatctggttagatcaagaaaataaagaaactaaactcaggaaaccaaggtttttcatttgtatatgaagaatcacagagaacaagcatgcaaggaaagaagaatgaatcagacaatggaaagataaaaggatgagagagtgaagaaggtgtgctgtttaggtttctgatggctttctacttattagttccaatcatggccacagttataaggatcaactgcttttgatttccatgaaatggcaaaagcttcatcaaatgcatttacttattttgcttaagctcacttcagtttggtcagaggcgtttcaaccagtgcaactccatgttgaataggggctgggtaaaataagggtgagacctactgggctgcctccgcaaatggttagacattctaagtcacaggatgagttaggaggttggcacaagatacaggtcgtaaagaccttgctgataaaacagtgtgcagtaaagaagccagatggcgaccacagtaacccctgatcgtcctactgctaggctcccaccagcaccgtgactgtttaaaatgtcatggccatgtcaggaatttaccctatatgtctaaaaggagaggcatgaataatccaccccttgtttagcatataatcaagaaataaccat

SEQ ID NO: 40312 - DNA, 1110 bp, Homo sapiens
aatacattaggattaacaaaagtttatacattattcaaatttttcagtgttacctaatgttctctttttcctctaggatctcatccagataacatgttatatttagtgtcttagttccttaggctcctctagactgagtttcacagatcttccttggttttttttatgaccttgacaattttgaggggtactggtcaggtattttatggaaaggtaattggctggaatttgtctgatgtttttctcagtagcagattgggttcatgggttttagagaagaagaacacagaggtaaactgacattctcttctccttaattttaagctgcattcaaaagtacaactaccccacctccaagcagatctccaggcattcagagcacatgcttgcccgaaccagcagcctgacccaccccactcttcctgtgcagagatcctggtgtgtgtgtgtgtgtgtgtgtctttgtgtggggggccctctgctctatcaccaggcagatactatcaacttgaattatcacggatgatgctaacttcacatacctgactgagatattgcttgtcagatttctgtaaagttactcttttactcaagttcctcttttttaactgtaaggtgtttttttcaatacttctttttcatactgcacctctgggagaagatcactatgcgcagcctaaaattaaggagtggggagttctgttgcaccataaatgcatgtacataaattactctggattcttctgtatgtgatatttgtttaaactgcccatttatttatttaatcatttagttatattaatatgaacttatggctatttgttttgcattttgtgttataaaccggtactcctttacttattgctaaattatttccagctttggccattgagagctttttcagttgactcctgtgtcccattgacatacccccattaatgtgtgtgactctgtgtgtgtgtgtgtgtgtgtgtgtgtatgtgtgtgtgtgtgtttgttgaagcactttctctctttctggcattataagatgttccacaggcatcttgtacattccctgccttagccgtagaatcaatcatatctccaagaagtcctggttcattttat

SEQ ID NO: 40313 - DNA, 1041 bp, Homo sapiens
gcaattaatttttttaaactccttcagatcatgaggattaatatatcaattcttatgaaaaacattttggaaattgaagaaaataccaagtcatttcagtaaaaagcagaaaaaaattatctgaataatatgaatcattgagaattcttgacaaggtgaacacaccttatctccattttagtcagaaagaagaaaagaaagaaaatattatttcagttgagtcatttgaacatttaagcaaatacaagtatgatgacttaacaactcttaggtgtgagtaagagtttagtgttctattattactaacaagatagacttttgttaactttcttctaagaactgtttcttttcacttattcagcacatgtggcaaaacaaagtcatcaagcaaaatggaccctacaaaccatggataatataaattgtagaaaattctaagatgaatttttacacattgccttttcagtgaggaaaacatttattgacagaagttgttgtaggaaaattgagctgcttcttttgggtgctgaggaaagagtacaagaatctcaggccgtatattttaaaaatttcataggtctattctgaactgttttaatatatcttatttttggatagtgaaaactaaatcactttaacttcagtacccagagctcctcattcatgttcacatctatgcagataccttaacaattactatgtttatatccataatatccacaaataaacagctttaattttttctttctaatttttgtgactttttcttgccttagagcacagactaagatttgcaatataatgtcgaatagaagtagtaagagaagtcaagcttgtattattcctcatcttaatatttcaccattaaatatgattaaagtattttgttagtaaatgccctttattggatggaagaaaccatcatttattgcaaatttgctaagattttttttttattatgaatgattgatgaagtctaacaaatgttttctctatatctactgtagactcacacatttttattatgcttatgtgatgcat

SEQ ID NO: 40314 - DNA, 1099 bp, Homo sapiens
ttactctccatgacatataaagcccactatgacttggttgcttactatccctctggcttcaacagtgatcattcttccactcattttctcatctccagccactctggccaccttgctattcatcatacatgccaagatttctctcatcttggagtctttgtacttgctgttttccctgtctggggtgcttccccactatacatccttcgggcttgattacttatcttctggggtttttgtttttgttgttaaatttttctctttaagaaagactttctgacctccatctataaaatagcacttatttgccaactgccactctctattctattttttattctttttaaaaattatacttaatgccacatgacataatatatgtacacatgtacacatgacatgtaagtgcacacacatgcacacatagccacttccaggttacttcatctgccatgtatatgaacatctaaaaatctcctttgtatgtgcatttgatcaggtgacatttattaggaagcagttgatgattatgtcctcatttacagttttacaaaaatgagtttatcattcaacaaggcctctgatatttgataagtagagtgactataaagtttactattcaaaggaacctagagaacagcaccttgagaatcaaagatatagttgataatttctttaggatacaagcaaacttggattttcttaggcaatccatgaggcatagttatcctattgataagtgaagctggttgggaattcaggcaagaagcttcctcctgtgtcaggattgccccactccaccaatattttatgcttctgtttatgcttcaagactctcctcctacttcacttccttcctgagacctctgaggatgccattatgcccttaagggtcagaagagacagctaccattgtctttctctcagacttttttacatatctaagttcagttgtgacccctcatgacctagcagtgcctaactcccattagacactcaataaatctccactgtatgatttaattaatgacttgaggctaacttcttacagaaatgtgcagatccatctgggaatggggcttgggttggaatatcagac

SEQ ID NO: 40315 - DNA, 1058 bp, Homo sapiens
ctctaaatgttaaaatgctgtgaaaagttctacacatttggtatttgtcaaatgtagtccaggttactttgcctttagtccttttcttaaaaaaagttaatttcgtaattaacaaaaagcaattacaaagtactcataagtactcatgtctataactcaaaagggttttagacatactcaataataactttgaactctgtatgccttttataatttgtaaaattttacattggataaaaaacaactaccctagaaaataatggatagctccactttgatgcattcagtaactgtggatagcaggttgaggggtctctgaggaagaagttataaaacaatcattgcactgatggcagtgggggtacagcttgtgtattttcccaaccaaatcccttcagtaatgaagtatagcttttgctctgggtaaacccctctctggatccttgaattttagacccagcatttgtgctgtggaagagattcatcccaaagtctcccatgcttctgttgaattctggaattacatttgtgctctgggttgagttacaattatttgctcctagcagtgtgattaccttattagaaaaaataaaagggggaaagctgatttctggtggcaaatactcaaaatatatcttctttcctatatgagagattgttcttttcaaattttttagttctacataaacagcaggtaacagggagtaaaagatatctgtgactataaagaatatatttgtggagttttaccctaccatgtgtgctgtttgaaggctgtcttgtgctatatgtatgagacactgattgggggaaaatcatgaagtaaaagtttgtctttacctctatctctgcctttgcctctgtattgcaaatctgggaaggagacaaataaatccattttggaagaaattttttataacatgttgttgtctgcactcagaattaggttctaccccttccccaaatgttaccaaagaactatttcagttgatgcagatcaaatggaagattatttacaccttgaatgtgagttctgtaatcattagtttctgaacaga

SEQ ID NO: 40316 - DNA, 1029 bp, Homo sapiens
atatgttcctcaggttatttggcttatcctaaatttagactgagcaatttccaaattgcgaaaatgtagagtatggaaacaataggaatattccccttggtatgtcatattatatgtgagactttaattattttaagtcaatacctagtgtatctgtggaaactgctttcttattttctataatacaaattatagtagcaggcgtatgaatattgctgctcaataaatattactttgtggcaagaatcaataatttctccccacccttctataatttctctatttagtgtcatattggaacatcaactataatgatacaggtaaaatatatatagaaatacaaaatagtacttactattctctctctagaaatttttatctactttcacattttcagtttgtcagactcatagtctgacaagactatgtcaaagtattctgcaacaggagcatagaatagcagggagtcattcttattattaaattgtatttttttgttgttgttattgtctatttgggtaggggaacgagagaaaatagtttgttcgggattaacgttgttctattaagcagttagtattttattctgtgctaaggcccatgcattaggctggagactgcagggagaattctgtactatccttcccaatgatgcctgtcttcaagttaaatgtacctctggtgcagcatcagaagcatcatcctaatatttatatcagcttataccagattgaagccttacagatgcgccctctggtgtgttggtcaggtcctgaggaacgacccctcatctccacactcagcctcctccagaaagagctccttgcattggctctgggacttgtttccataaccttttatggtgaccgattcctagactctattctgttatctcaagcagatggacaccaatattacttgatgggagaaggcacaaagcaacagtgtcaagaaatacaaattaagagaattaggaacgttcccattcgtataagagctcctaatgggaaggaaggcagtggagtttag

SEQ ID NO: 40317 - DNA, 1034 bp, Homo sapiens
gctagctcttcttgttgaattgatccctttaccattatgtaatggtcttctttgtctcttttgatctttgttggtttaaagtctgttttgtcagagactaggattgcaacccctgcctttttttgttttccatttgcttggtagatcttcctccatccctttattttgagcctatgtgtgtctctccacgtgagatgggtctcctgaatacagcacactgatgggtcttgactctttatccaatttgccagtctgtgtctttgaattggaacatttagcccatttacatttaaggttaatattgttatgtgtgaatttgatcctgtcattatgatgttctctggttattttgctcgttagttgatgcagtttcttcctagcattgatggtctttacaatttggcatgtttttgcagtggctggtaccggttgttcctttccatgtttagtgcttccttcatgagctcttgtagggcgggcctagtggtagcaaaatctctcagcatttgcttgtctgtaaactattttatttctccttcacttgtgaagcttagtttggctgcatatgaaattctgggttgaaaattcttttcttgaagagtgttgaatgttggcccccactctcatctggcttgtagagtttctgctgagagatccgctgttagtctgatgggcttccctttgtgggtaacctgacctttctctctggctgcccttaacattttttccttcatttcaactttggtgaatctgataattttgtgtcttggagttgctcttcttgaggagtatctttgtggaattctctgtatttcctgaatttgaatgttggcctgccttgctaggttggggaagttctcctggataatatcctgcagagtgttttccaatttggttctgttctccccaccacttcaggtataccaatcagatgtagatttggtcttttcacatagtcccatatttcttggaggctttgttcgtttctttttactcttttttctctaaacttctcttctcgcttcatttcattc

SEQ ID NO: 40318 - DNA, 1110 bp, Homo sapiens
aaactttaaagcagcaattttacttgtgcagagagaaacagattacagagaagtggtaaaacaagtcttgggagagtgaagggttaataaaatatatttaagaaatttaagtaatttgagagaaactggttgttagcatgaagaagcgatcattgaaagattttaatttttttttcttgtagtaccgatctaatatattggaaaacatggtaggaaatagtaaagagagagaaattatttagggtcaagtatctcagaggaagtggcagagtatagtatttagggcagatgtacaagttaaccttgggaaatagaagggaatttgtcattttttctcttagtgaagtggacaaaggagtgactcagaatttaaagacagagaagtatattttgtgtaacaattatgaaaattgtactaaataattgtattattcagggttatccatagaaacataaccaataggatatatagtatatatatgtgtgtgtgtgtgtgtgtgtgtgtgtgtgtctgtgtatgaggaaatttattatagaaatctgttcacaaaattatgatggccaagatgtcccacaatatgctgtcttcaagctggagaacgaagaaagtcggtggtgtaatttagcctgaggttaaaggcctgagaacccagtgggtaaaaggactgctggtgtaagtccctgaaaccaaaggctccggaacctggagtcctgatactctcttacacaggaaaagatggatgcaccagctcaagaagagagagagagagaatttgcccttcctcacagattggatgatgtccatccacattagtgatagtggatggatcttctttactcaatctactgactcaaattctaatgtcttacaggaacacccttgcagacacactgagaaatgttttcaccaactatctgggtattctttagctcaatcaagttgacacataaaattagccaccaccacacattcttaaacttaaggagtcctttctggaatgcaactctgcacacttgaaattttaatgaatgttaaaatcttctggtactgggctgaggaatcacttattatgaaaaagtttgatgacattctgcaacaaaaatttccta

SEQ ID NO: 40319 - DNA, 1044 bp, Homo sapiens
tccttcatttctgattgtgagtcctttgtcttagtctagctaagaatttgtcaattttgtttatcttttcaaaaaacaacttagttttgtagttttttctttactttttactattttagtttttctctaatctttattatttattttcttcttctggctttgagatttgtttgtccttcttgtcctagtttattaagatgtaaacctaggttatgtatttgagatctttcttctttctaaaggtaggaatttcttgctccatcttgctccaaaagcactgcttttacttatgggttataatttccggtatgatgtgttctcacttcatttgttgctagatactttttaaattcccttttgatttcctttttgatccgatggttgttcacagctatattatttagtttctacgtatttgggataccaaaggtgtatggtcctttcaatgtgctgttgaattctgtttgctagtattttattggggatttttcatctatgtttattaaggatatgggctgtagtttttctttttttgacatgtttgttgggctttggttttagagtgatgctggccttgtaaaaagaggctgaaaatgttccttcttctcaataatatgtgaaacataaaatagtcaaactattaggaaaagagaatagaatggtggttgccagaggcgaagggagggaaaaaggaaaaatgttagtgaaggggtataaagttttagttacgcaatatacaaaagttctcaaaatataatgtacagcactgtgactatggttaataataccatattatatgttttaaatttgctgaaatattctcaccacacgcacacacacacagatacatccacacacaagaagattgtaactatgtgaaatgatgaatgttaattatcttgattgtgataattaattcataattcatgcctatataaactcaacttgtgcattttaaagctaaaaatagataagacactactggaaaggtagagctttgtgtagaaatcatcttttacaatatgttaatatactacaaagtct

SEQ ID NO: 40320 - DNA, 1138 bp, Homo sapiens
ttagctgattgtattgttcagcatatcttagttttgctatactttatgacattcttgagtgagttttttgttaactatatatatgtatgtgtgtatgtgcatgcatgtgtgtatttgtagttttgacaaagtgaaaaattaatttgaaatgtctgaagttgttatatctatttataaaataaatgcaaataccatgtcatccttaaaattaatatatgtaaagctcacaagatattgggaaatatgagccaatgcttcatctgttccaattcaaaagactccttcttccaacctcaaacttccaaacaataacaattacaacaatatgcatgtagctaaaacaatgcaaatatcacttatacaagtacaattttgcttttctttgtctccaaatgttgttaacaaaaatttcaacagttaatgccatcttcttcaaggtcaaattctcatattgtttttattcctcctctagttattgcttttggatattctctaaactatgaactaaaaactgttaaaactagccactacctacataccctgcatctaagaagaaaggaacagagaaagggaacaaatataaacaagttaaaatcacttaaatcagatcgtgacactgaaagggtacagatatgagtagataccacagctcatgagttcacaatcaagtctatgtgctagtacattctgaggacctacctgtactctaggccttcaggactgatacagtttggctgtgtccccacccaaatctcatcttggattgtagctcccataattccctcaggttgtgggagaaagcagtgggagataattgaatcatgggggcagtttcccccattctgttctcatggtagtaaataagtctcatgagatttggtggttatataagggaaaccccgtccagttggatctcattctttcttgcctgttgccacctaagatgtgcctttcacctccctccatgattgtgaggcctcttcagccacgtggaactgtgagtccattaaacctctttttctttgtaaagttcccagtcttggttatgtctttatcagcagcgtgagaaccatttaatacaaggacttaccttacattaggatagaatagctcccaacagtcactaagccctgtctat

SEQ ID NO: 40321 - DNA, 1024 bp, Homo sapiens
acgtttattgatttgcgtatgttgaaccaaccttgcatcccagggatgaagcccacttgatcatggtggataagctttttgatgtgctgctggattcggtttgccagtattttactgaggatttttgcatctctgttcattgggatattggtctaaaattctctttttttgttttgtctctgccaggctttggtatcaggatgatgctggcctcatacaatgagttagggaggattccctctttttctagtgattggaatagtttcagaaggaatggtaccagctcctcctagtacctctggtagaatttggctgtgaatccatctggtcctggacttttgttggttggtaagctattaattattgcctcaatttcagagcctgttgttggtctattcagagattcaacttcttcctggtttagtcttgggagggtgtatgtgtcgaggagtttatccatttcttctagattttctagtttctttgcatagaggtgtttatagtgttctctgattgttgtttgtatttctgtgggattggtggtgatatcctctttatcattttttattgcgtctatttgattcttctctcttttcttctttagtagtcttgctagcggtctatcagttttgttgatcttttcaaaaaaccagctcctggattcattaattttttgaagggctttttgtgtctctatttccttcagttctgctctgattttagttatttcttgccttctgctagcttttgaatgtgtttgctcttgcttctctagttcttgtaattgtgatgttagggtgtcaattttatatcttttctgctttctcttatgggcatttagtgctataaatttccctctacacactgctttgaatgtgtcccagagattctggtatgttgtgtctttgctctcgttggtttcaaagaacatctttatttctgccttcatttcgtgatgtacccagtattcattcaggagtaggttattcagtttccatgtagttgagtggttttgagtgagttt

SEQ ID NO: 40322 - DNA, 1028 bp, Homo sapiens
gtgatccataatgtcatggtacaggtcaaaaacttgaagatgaagacatgcctattgcatgtaatatttagcagatttttagtgaccattcaaagaaatgttttactgttaaccagatagcaaagggttaaggaaaagtgattgggaaaagtagaaagagataaatatttgttaatgttctctatagtgagtttttttttttaagtaattggatttagactttccagaaatgaagtgaggtattatcctattttatctcacaaataacccagacactgggtatagctttccgtctaggcttttattttatttccaggtttgtttcttgctttcttaataggttgcggttgtttatcttctggcaccttaaatgatacaggtagaataggatgctgtgtggaccatggggatttttgccagtcagctttgtttacttgtctctgctgcccccttacacagggttctagtctcatgattacatcttcaccttgaaagttacaatttagtccaggaaaagtgctctcaagtgtatcttgatatctgagtgaaaataaacctgaatcagccaatccactatatcattttgttgttagactgggctaccctatattttgctgttagatttcataccacctgattctgtgtacatgcttgactgtcctcttggacacctcaaattttcagaaaagtttatggtttaaatgtgttttcactttgctcattttcgctgtaactcatttcacatcactgtttttcttttgtattatctggcttattattcttggttttcacatatctagctgcataatgtaactacttaacattttaattggttatgggaagcactgaatgcttcatttaattagtggagaagtaatattttataaatgaagctatggtagtaatagtaacaagtattagttgtaattatatcttaactaatttacatcgtatccaagagactaagaaatgtttgacagttcttttcagatttaagctgtgaaactctcactttgataaagactgct

SEQ ID NO: 40323 - DNA, 1029 bp, Homo sapiens
atatttttcctttatctaagttatagcatttttttctacaacagaaaggtaattcatcatctccagatccttcaggtttagaatttgattgccagattttctctcctgttttatgaagcataatggccttttatcatggagtttgttacagtgggatcttaatcatgataatggtggcacacatagtgattttgattgatatatatatataatcagtatttcctaggattatagtcatttgccatttattacacaaggagataggacttttcaaagcctgtgaaaactgccatttagttgtttttaaatcctctttaaacagttctaagaacaaagtttttgaccaagagtaacttatttctaagttaggaataagaaacctttagtcatcccagctttatactcaatcacaatgttaacttagataagtcacttattttctatgagctttacctccctcatgagatcgttaagaatctgtctcttttaattagaaaataaataagatcattgaactattagtgttttctaggttcttttttctcattttaataaaataatttggattatgtcattacatataagtataccaatggggccttactgacaagtttgagagtcaaacaaaaaaagaaactccatatattaagtgtactgttgttcccttttaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatct

SEQ ID NO: 40324 - DNA, 1156 bp, Homo sapiens
gataaggagcagcgtgaggtaggaagttttaattaagggtaatataaattggagaagtcacagtagagatacagtgctataaatctgagttggggccacatcgtgggtggctttgaatatgaatctaaaatataagctctgagagcaaggggctgttgaaagtatattaacatgagaataacatgttttacactatgccttaaaaatgttaatttgactgcagtgtctaatttaattgacagagaagagacaaaaagcataaatagcagattgactgctacagttgaccaactaagagttgatgagggcttaatttatgaaagtgagaaagggacagatgcccagacatacttgaggatagagttcacagcccttgaccactaattgggtttataaggaggaggaaagggaaagaataatgaaaaaccaagattcccattactgtaagaatgatatgttgttaaagaaaaatagaaaaaggaacaaggatatctggggagtcactattaagtttagacgtggaattttaggtgttggtagaatgctcaggagaagggttaggacaaattgcaggaattttggaattcatttacacagataaaccacaagtatgtgaagcaaaaggtacagtgtcaagatgcgttaagaacaaaattttaggaaatacatttaaaaataaaagaaagagttggaagacaagaaatgtattagctgtttgaagactgaggaatggaagaagcacagcagatacctaagcaaagactgggagatgagacttgggtttggtgtaatgatatagtgaggccacactgaaagctctacatagagtggaggggtcagggttaaatgtgtgtgcataaattattggagtaagccaatggagaagaaagcaagccttcagcttcaacttttaccttaaaatatggttttacgaacaaatttttaaggaaaaaaattatcatggttctaatcttacatgttaacatttccttgttatgtagggatcagacttgttataacataattccactttataattcaatgaagaagaaagttttgtctgattctgaggtatgtaatatttcattattattaccatattgatattctctatataaaaaaatttacatattgtagttttcaggtaaaagctgtt

SEQ ID NO: 40325 - DNA, 1059 bp, Homo sapiens
agctctttgaaactttatgtttagtgtgaggtagtggtggtgtcaagaatgcttcttattaaactatatagtagctttttgttaagtgtcactagtatgcatctgaggaacaactgtcaacagcatgcagttgtgttctattaacttttctcctggctccaattttcttttttatcatattcttttaccttgtttttctaatttttaattcatttcatgctatatgtttttataaacttttaaatcctttttggtaagaaaatgagaacataactacttttctctttgagtttaaaaataaaactgattcagattaattgctaacttaattcattttaacttaactgtgtgtcaaaatgtggagtgctttaatagaactcattagtcaaaaactaccaggaggtagacatcaccatttctattttatagacaaggaaaatgaagttcaaaaataattaatatattcaaagttatacagatacgttatttgaacccaagtctttcaggctctagcctatgctagccacgagaaaactcaagtactgtgatagctgaggaacaggaaaacattgcataaaggaagtaagtgacttacagttttcttatgacacagaaggaacatgagaatatttagataagaaaaagccatagcatttatagcttgttcaggtctttgggaaaaagcaggttaagtaatacgacgacagcaattggataaggaaatagacacaaggagtgtcctctgttttaaaaagaatagttgttttatttttgtttcttttttgtttccttttacaggaaagggagagtgagtgagtattaagggtgattgagatgaaggaagacaggttggattttatgttgtttgttgtttttagcgtggagtcttgattgattgttggttggggaaacttgcttacagaaagtaagaaattaaaagactaagtaattgttgagtggaacttgccgcaattataattttatttcagtgaaaagtttgggtatagtgttaatgatgaatttcaaatgctagattggtaaaaatgcctaaaacaagtg

SEQ ID NO: 40326 - DNA, 1051 bp, Homo sapiens
atatattatttcagtgaaggcaatcaatttgcaatcataaaccaatcttattaagcagttaaaccatctccattcctcttttcttctcaacctttcccatcaccttccttctttacaggttagagatgtaatcattttagatattgactactatacacttttgaagccatgttgtgctttgaaatgctaggcatatatgagaattctctaaatatattctctttatccagggcaacattaactctcaaactgagagtattctaaccacaatttaagttagtctccaatagctttgggtcctcatatagccaggtcaaaatgatatattcattctggcaaaaaaagagaaatatactgattatatgaatttgacacatggtaatttggatagacatacaaaacataaaatacatgtgggctaattatttatcttataaaatgtctctttatttttgaaagagtttcctctaaatattaagtttctatataatatttaaaatattctgtttattagaaacttaagaactgtatttccagaaacacatctgttacaacaagtccttcaagtgtcttcaaactaatttatttatgctttaacatccttttagaaatttagaatatatttctagaagagtccattgagaacaaagtatcactttgggcacagtatactaattaattggaaagaattctgatttttttggttcagatgttttgtactttagtattttgtatttggaatgtaggaataattctgtttctttttcccccctttaaggaagtaacacacaaaatgtgggaaaaatcatatcacttgcttagatttgttatatcgagcagtgattaaatttgttaataaaatatgctttttgttaataaaatatgcaaatgtgattttttcatttttgcttagttttcataactgtggaatagacatataattcacattcttcattaaaacatcaaaatgggaaaacttttgtcccaagtatattattttatttaaatattaaaagaatccaccccattgtcctctttaaaagttatctga

SEQ ID NO: 40327 - DNA, 1081 bp, Homo sapiens
tcatattgtgttatctcttattaatcaggagaagagtctctctctttctctttcttttcttttctccctcacccaaccctccctttctccctccctcccttcctcccttctttccttccttctttcttcctatcatcatctaacaagataatgtcctatatttatactctctgtgttaaaaggactctctgatgcttccagtctatgtttcagcttctttgggtaaggaagtactttcggtcttcttaccatacactttagtaattatcactttcaggttttaagattctttagattatatctctcttatatatatatatcttggtacaaaaggcatgttaatctgttgccatgaatgtgagtttgtctctccagcttctcacactgcattatatgtggtaaattacttttatgtagtaattctttgacatagtccatgacttgctatcacaagggtatttgagatttgatagttatatgagaaggtatatgaaattatacagaatttaaacatgcagatgaaaacattttaacaaatatttgagtgttttcttttgtgttaagcacaaaatatgaggaccacaagggagaataagacgtggtctttttagtcagcctacagttaagttggggagacaaaatatacaaaatataccttaagggataaatattgataaataatttcaaacagtagcatgacaaatgagaaaagacagttgctgtatcttaagatgtagagatcattgtcagggtggacgattggagacgttttgttgaggagaaggaattgaaactatgccttgaaagataaataggaatcgagtcagtaagaaagagaatgaattttataaacaagaggaacattataaaaagctaagtgtcaagacatgttcatagaaatttagatatttaggaagcttgattgcagtagattttggaaataatgacgaaaaacaaattgagatgaactgtcagtgacttcaaatgatctcataggcataaatacctatgaaccttgtgggggctttagtaaattattttataggatggtcgagaagctaagagaaaaatagtttggttg

SEQ ID NO: 40328 - DNA, 1050 bp, Homo sapiens
gaaaagaaaggttaattgagataatatgcactcagagggaagcatatgcatttttgtttgttttcagcacttgtctaaaaagagcaaatttaatcaagcaatactaaagtggtaagataactaaatgataaacccagtaggaatatagtaggacttcctgttacattttaattggtgaaagtcactggaggttaattttaggtcacagattaccattgctcctttcattaaaactgacattttggtcaaaagactggtgtttttatttgttaacatgaaaaatatgtgaagcatctttatagtggaatgtaaaacacactcttattcaaagattcataagaatgatatgaattgtatcagtattgtgaagcataacatgatgtcatgattttacttttgttatatggtctacctactgtagtgtacttaaaattctttgtgtactgaatgcaggtgagaaccaaaattgcttcagttttgggaagataaccaaatgtagtgaatatgttgattcaatttgtgaaatgtagagaacttaatttgaatgaatgccctaaagcattttttttactcagcaaatccctaatgtgtttccgatgtgcgtatagaccagctttctgggagtcatagtctgctacagctcttccttcacttccaacagataatcagtgatgtgctccttatcccttttattccccaaacagctgttataaccatgtctttgattattcttttttgctataataatttgtgttaccacttattctctcctgaccatactattttaacaactttcagctggtctcctttctgtcttagcctaattcacactgatgccaggatgatctttagaaaacacaagtatgatcctgatactcacctgtttgatatcttcagtgaccctcattacacaccacttttcttagtaaaccgtaaaaggcctttcacaaattttttttactttttcatccttatgccttcacctcacactctaaattaccttgcaggctgcttgcagttctatgaactactcacattgtttcacatttt

SEQ ID NO: 40329 - DNA, 1069 bp, Homo sapiens
ggatcacttgaggtcaggagtttgaaaccagcctgaccaacatggtgaaaccctgcctctactaaaaatataaaaattagctgggtgtggtggcggacgcctgtaattccagctattctggaggctgaggcaggagaatctcttgaacctgggctgcggaggttgcagtgagccgagatcgcactacaatactccagcctgggcgacagaggaagacttcgtctcaaaacaaacaaacaaacaaacaaaaaaaaacaagaaagaaaaatgaaacaagtgatttactactctcttatctttgtgattaaacaatagcacaataatttgattttaaaatgaattataaaaaagattttaaattttgtacccaccccatggatttcttaaaacctgttcatagttttccagataaaaatctacactaagtggtctctcttcgtaatctcatctgctatcattgttttgactactatggtataaactgataacacccagatctctatctctaacctaaacctcttcttgtagcttcagatctattactcacataaacattagcaggatctggctaaaatactatagtgaccatgtcttgtctgcttacaaattgtctagtgactacctcagcaggttaaatacaaactcttaacaggcatttaaaactcaattatcattcttaggtaaaacatttccagcataatcacttattttcacttacactttgtactttcaagttttcttactttgccaattcctagcccgagcagcaatccccagcaacattgagatgttactgaaaagaaatgactacttagttttcccttgagtattggagctttgctgaaaaaactatgtcagttgaggtatttctaacatcatgctatttaaatttagcaggtctttaattgttgcttgcagaatttttccacctttcttactgcttttattccactgcatttccaaactttcttcacttttttagttcattcgcttgttgttctctccctctcacttttaatcctcagattttgttttgttttgtttttgctgaggttacatgatctctccc

SEQ ID NO: 40330 - DNA, 1025 bp, Homo sapiens
actgtgggtaaaatgctgtcagatagcattccatgctgcagagaaatctcttgtgaaaggaagagtccaatggatgcagcagacttcattgttgtcttattttaagaagttgtcacagctaccccaaccttcagcaactccaccctgatcagccaacagctgtcagcatcaaggcaaagccctccaccagcaaaaatattactacttgctgaagtttcagataattagcattttttagcaataaagtatttttaagttaatgtatgcccattttttaaagacataatactattgcacacttaatacactgcagcataatgtaaacgtaactcttacatgcacttggaaaccaaaaaatttgtgtggtttgcttcgttggaatacttgcttaattgcagtggtctggaactgagcctgcggtatctaggaagtatgactatatttgtttttatttgagtcttgcctctgaaactttttattttgaagaatgttgaagtttttaaagggatttacaaaatcagaactttttttggatatacagaaaaaaatactaattgcttatagtaagaaatccagctgcatgctgaaaggaaaagtaattggtaccattacctccatactgtaaaagtactagaagaaataacagtggttacaaagtaaatatctgatgctgttttcttccttcatcctaaagtgcagaagtgtgttgactgtttttaaggcacatttctttatcataatatgtgtgtttttttcaggtgtggcagtagactaagctaattttagagtacttgaagccaaattgttaggattggaaaaatgtaaattttgtttaattcccaccctttctcaacacactttctcataaataatatctatgctgttgtgttttcaagtatagagatgtactcttttagcttccttggcttcatcctttgatgacaagattgtcttgacttaaaaagaaaccctgtaaatttggtgtctcattttgttttgggatttaaataagctaagggctatac

SEQ ID NO: 40331 - DNA, 1050 bp, Homo sapiens
atagttcaattaggccttttgaagcttaacctctggaaactcattaaattattaaaatttgggggcatagactttaggtgctgtttggtttctgcatcgaattgaagtgattcatggccctgtgtctgaagttgtttgaagttttcatggcagtacgtaggccatttttttctggattttgaggataattttaataccaaagtgcctaacagtagaaagccacgtcataaagacctgtggaacttttcttcatgagaacattaaagtcaaatgtgttactagacactgcctaggctttatgaaaaatgctaatacagacgtaccctgtttcattgtgcctttattgcattttgcaaatactgtattttttacaaattgtatatttgtgaaaaccctgagtaaagcaagtctgtcagcatcatttttctaacaacatatgctcaagtcttgtctctttcacatttcgatacttctcacaatatttcaagctttttcattattattataactgttatggtgatctataatctctgatgttcctattgtaagtctttttagggtgccatgacctgcacccttatggcgaacttaatgaatgttgcatgtgttctgattgctccaccaactggcccttccccatttttctctccttgggcctgcctattgaaattaatccaattaataaccctacaatggcctcttagtgttcaagtgagaggaagagtctcaggtctctcactttaattcaaaagttagaaaagattaaggcgagtgaggaatgcatgttaaaagagttagccaagttgtgaatgtaaagcaaaagttcttgaaggaaattaaacgtgctactccagtgagcacacaaatgatgagaaagttaaagagctcattgctgatatagagaaagtttaagtggtctctataggagatcaaaactagccacaatactcttttaagccaaaggctaatccaaagcaagaccctgactcttaattctgtgaaggctgagagatgaggaagctacataagaaaagttggagctagcagagg

SEQ ID NO: 40332 - DNA, 1050 bp, Homo sapiens
tgggaaatacagacttgagcgacttgttccaactgcagtgtatcagcacatgaaaatgcataaacgaattcttggacacttgtcatctgtgtactgtgtaacttttgatcgaactggcagacggatatttactgtaagtaattgctaaagtattatttatattcatatatgtaattgaggaaatattgcttataggtgaacttgaagtaaaaccttgcttttttttcttttaataggaaaccggaaattcaggtggtttcacttactctaacagaagagtttagttaaatttggactttatccaaattcagaaagtttctaaatgacatgttgcagcacagtcacagttattatatggttgtacatcatgaataagtatggttctcaacatatatcaaatacacagtttgacattttgcaaaatggcataaaataattttaattttgaactaaggacatctaagtatgttgagagattattaaatgtgcctttttataattgtatgagattattgaatatacctttttatattatctgtagaaaatcacttgcttgtctatgagaaatttcccttaaaatagtgattttaaaaaagctaaaaaattctgagcatatctaatactcttattacctgttattcttaacagttcattcttcaaaatatctgatgttttgtttatagagcctctttgggtttgtttatttgttattgtttcttgtaacctgttgaatagagaaaagcaaagcttttgagctttattttaagtgagaaaattacttttggaaatatttgattttcaggtgccttaacatctacattcattaagcataatactacactattatgatgatatttattattaaacactaccctgtgggctgaaggtatgcattcattcacaaggtttttaatttcttttgaaataagaaaatttgaagtggaagttaaatggaaattttcctgtctttgaagagagcagctgtgaattttacgtagttatgacaattatagattcctctttttagtaaatttgcttgtaaactgagac

SEQ ID NO: 40333 - DNA, 1019 bp, Homo sapiens
gcacagaaaaaaaaaaaatacatatgtatatataaccatatatacaataatgtaatcaaaatttaatagaaaagaattatttagtaaatggaaaggctggaacaaatagttacttgaggaagaaaaaataatctttagagacctcataatgagtattataattgtagatggattaaagagttaagtgagaaatctaaactacaaaaaagtaaaagaaaatgtaagtagatgtttattgtactgttgggctgagtaggagaacttcatattaaagcagtagaagatattaatataattgactgtgtaaaatttgtgaaattgtggggtgtcaaagaacagcataatatgaaagccaggtatattgtggtaaatggaaatgtttctctaataatgtaactggagaaattaaagtttagaacgagtaacttgcttaaagtctccatagtgacaaatttgaacacaggtctgtcagacttaaaacctcttatttcattaaggaatacaacatagctgttaaaatgctgtttttgaggtaaacctttgcgaaattttaaaagtgattgctatagacaatagaattatgggtttttctttcatttatgttcttttctaaattgaatatgcattagtattatgattggataagtaaatcagttctcgaaaaataactaggtgtgaagtaagaagtgacttatgggggaatttgacttattatcctagcacctaaagaagtaatggatgagaacccaagggctgaatatgcgcatagtcacatctaatgtttaagaagttgtgggccttttgttgatctctactaattggctttgtagacttgagcacatatactttatttcaaaggctgttctgaatgatttgctgcaaatgacatgcttcagtattttgctccttttttacttcagactttattcaaatggataacagtgatttctggaatttttatttcatttatcctctatattcagaaaattaagtgaatacgttctccccttatttcccaa

SEQ ID NO: 40334 - DNA, 1322 bp, Homo sapiens
ttatgagtatttggttgtcattacttccttgatacccgtgttaataacaggtctttccattgtggctctatagtgaattaaacattcctccttatatgattccctccgaaacaaaattgaacctgaactatctttgacatgtttctctttttgtttaaaaattcagtgggaaagattacacaaacaaatcttacaacaaagttgatggcctgctttgtagtattatcttacagctttcaaatcaaaactgatgtgaattatttctttatagcatatcattttttcagtccattttcaaatacgcaattgtcattctctatagcataatatacattcatacactgtaatatgcttaggcattagtgtttcttttttatgattaaataaatttaaattccttgcatctttatctctaggtttatttttgtcagtctttgaatttaagctagtctctttagatattttagagttttcctactgcttttttgaattccttgaggtagattgagttataaaaaattagaatgaacgtatgctctatagagaaagtttggaaaacagaacagctcaaaaattaatcagtctcactccttaactgctgtacatactttggcatgttttctttcagtctttcttttctaatattgatctgcataggcagcatataatagttaagggtacagtctttggcaccagactgcctgagtttaaacctgggcttcacctctagtaaattacattttatcctttggtttccttactggtaaggaatatctgcttattgggaataatggaagtatccacctcaaaggattagggaggattaaatgagaatatatgtaaaatatttagaatagtgcctggcatgtagtaaaacactcagtaaatactagctgttattctctaaatttgctacacgtcgtaagagtgttctgtagcctttttcctctccttgttatgtattgtatggtgacatttatacccacattattaattgcagcagataagactttttttttttaatcgtcagattcttgaagtcctagtaaaaacctctcataactctaaaccatggttgctttcctcttcctttatagccattttctcaagggtttgatgcctggctttaacgtaacttctgttagaaaattatgattagcaatttttttttaccctcatatttccttttcattaaaacacttttgtggatctctaaaatgagcaacatttcaagtaattttatgccttattaaatactttatgccacacaatacatttatctgatagaaattctgaaatcaccaacaccatatatagacaac

SEQ ID NO: 40335 - DNA, 1810 bp, Homo sapiens
gatacttattatacagatcgtaagtttatatgacttttgtttggcatttttatatatatatatatatatatatatatatatataattttgctttcaactttttgtttccttttatttcttgtcttttaaaaatataaaagtggcttttaaaaatacaatatgataatctgtgttttatctggaacatttagtcatttacatataatcattgatgtacttgggtttaaatctactatctaacttgctactttgaaggcaatccctttttctctaattgtttttaagattttttctctttctggttttctgcagtttgagtatgatatgtcttgatgttaattttttaaaaatttgtcttgcttagattctggaaatgtcttttattgacattgaaaaattctcagtcattatcttaaaataacctctgtgttcctttctctctcctttcctatgggacttaaacactttatctgcttcgttatcctttcttctatgttttacatgtttttgactctctgatgtattctgaattgtttgctctgacttacttttcagagataacgtatgtgatatctgcgtggtgggtaatcatctatgattttttttaaaacataagattgtcctgtttaaataatttcaatatataatcttgctataataaacaaccattaaaacaacaaaaaaatttgagagacgagggtatatttgtacttagaaaagtattctaaggtggtataataggattcctgcaagaagggaaagataaaatattataggagttttcccatttaggaaaagtttatcctgtctttgaaaaactatagatccacataataaggagaacacgttatgcttgttctttcagtacattgtcagtcaggcctgtggtaggtaatgaaagtgtaagaatgattgatggtaaataacatttgctttgtgagtaattcctgtatgccagacactgttctaagcattttctatttatttactcttttaaaaccttaaatgttctataggtaggaactattatgcttattttacagaggagactgaagcatggaaagattttggtaacttgaccaagttcacacatgcagtgagaagtgaagccaggattcaacccagactgtttgactccattatgctatgctttattcccagtaaactgaatttattaataataacacttggctactcaagaaaattggtgttagtcattttttgtaaaagggaaccaaatatttataaaatcaaatataatattttaggccacgtcgttgatggtcagattagtaaatactgctgacaaggagagaggaacatttatcttcccttattcacaggagatacattctgagatccgtagtggatgtcggagacaacagatggtacagaaccctatatatacgtatggcaaaaataccttgggttttgcatccaagcatagaaatgtaattgattcatttaggtaacagaattaattgccaagcaggtgattgatgtacctttctgaaagactattttatttttagagtttaagataatttttttctctctctcttccattgtgattttcaggaaaatctttgctttattttaagaaacacctgtagtggattgcccattttgcctacttttaaaaattgtatttacatatattttttgaaagcactgcagagaagctagactgaccaaaatgactcaacttgcatagtcataggttagtgtctgtgttttgctagagttcaccatggtatatattttgttttattatcgctataaagtaatgaacaggatggtgttggggaga

SEQ ID NO: 40336 - DNA, 1138 bp, Homo sapiens
ctacagtagtgtacaaataagaactatattccaataaactggccttttagaactcaaaaacataatagagagcagaagtgtaactagccttttatatctgacaaaactgtgagagaatagatttgagaagatctgaaaaactgacttttttagaaccaattaggtgttcagaacataaggatgaagtgaaagcctagttagacaaatgatactggtgccaaacagcagggtcttattttcataataattatatactagaggaaagaagggcacttctaggtcttcacagctaaatcaaataattggaatgaatatattgatctaacatcactttgaaaaggttgttaaaaacatgctcaaatttttttcctatttagatttacaaagattttgttcaacacgaagggtcaatatgtaatatagaatgtaattaaagtaacagccaactgttaggtacagtactaactgcttcatatggtttaatttaataatttatgactactttccaaggtggtgactgttgtgataccagtcatacagatgaggacactgaggcttagaaagagtaaatgtttttcccaccctcagccttagcaactttaaacccaggctgtgtgacttgagatttcgtggggttttttgtttatttcgctttgtttttgagacaaagtcttgccctgtcactcaggctggtgtgcagtggcatgatcttggctcactgcaacctctgtctccagggttcaggcaattctcctgcttcagcctcctgagtatctgggactacaggcacgtgccaccacgtccggctaatttttgtatttttggtagagacggggtttcaccatgctggcagggctggtcttgaactcctgacctcaagtgatccatcagcctcagcctcccaaagtgctgggattacaggcatgagctaccatgcccagtgagatttcgcattttaaactactgaccatttctttaaaaactgagtagagttcttagtgactgtaagtctggtagaatgcagcagcttccagatccattgtattttcttcctactgataacacttgccttttaacaataccttccactgagataatggcaaaattttttggctgggaaggatggctgtttatgtga

SEQ ID NO: 40337 - DNA, 1032 bp, Homo sapiens
tttggacatgctaaaaactgctttactgcaaagaaaaatatctagtatccaatgaactcttcacaaaaatattttcagtatacagttagtactcagttgaagtatattgctggctagtttccattccagaagtgaatcataaattccctaggtttactttttaaaaaattatataagtgatcccagtgatttttttttagaagaccaaatactacaataatacataaagcaaaaagtcaaaatcttttttcctcccattcctacatcccagagataatcactgcacactattttctctattttctctttctcatgtgtgtgtatgtgtgtgtgtgttagggttatgtacacacacacatatatatgtatatatataatttttaaaagagaatgaatcagtatcctattttgaatttattcaatctgtagttggagaaatagatcatttctaatattacagtgctgtcaatgatactgcagtaaacatgcttatatacaaagtttttctacctatgtatttcttctgctcaactaaataacttcccagaagcagaatgtctgaatcaaagggaatatacatttgacattttgactgcctccaaaaaggatgtaccaatttccccttccatcaccaacatttgaataccatctctttccacctttgccagcactcattttggtcagtctaataaatgaaaatatgcctcacttttaattttaaatgtattctattattagtaaaattaaactttttctgtttaatggtcatttggatttcttctgtgaattctgattttgtctttttctgttggggagtcagtgtgttttaaatcattgttgctcataataaccattgatgctattactattaatagcatcaattattactattattgctatcagtaatagcatcaaacacacaaagatcaggggttctgtaggctattggtgtctacttaagtacaatatatggatattatcgtggccacattgaaaaaccgagcaggtatcatagagaccacagctacccaa

SEQ ID NO: 40338 - DNA, 1057 bp, Homo sapiens
aaactcccatatcatataaaatttcagggaaaacagaagcaaaggagagcttgggggtggggagaaaagacaaatgtgctctatgtcctagtaactcttagactgagtaaagtgttaataccatacccagatgttttatttatgaagtttttattttaaacattttttttaaaaattagccttgatattctccagaccaaagcaatcattaagtgactttggggattctccccctgttcacatccagttgtctaaaggatgagatttttcatgtatcttatagtcactcattcttcggtctgaattttagacgatcacagaaacggtctttatgaattattttgataaattactaattatcttatctactgactgaaatcagtggtgttacattttcttgtccaaagctgaaaatgtgtatacacttaaacttgcacatttgaattcatttgctgaccggaatggtcaaatctctccacctctagtcagagtataattttggttgtaattaaatttttaaaatctgctgatctctgtagaatcttagaggcttgatgatgatggtgttggtgaaaataagaaagaattgcagtaaagtcttgtctggtgacccagagatcaccatgacttgaggcacaaatcactgtggggaaacaattttttgtgatgaaaaggcagcatttgaatactcctgttagtagcagaaatatattatgaaaattaagattattgtctgattgaaacatgaaacaactcatgtctttattagtaacatcataagatagttacatttatgtgctgttagaatatgttgatttttatcaggctttccttgttttgatttatggctgttcctgatttttcatatgtggaaatatacctacctcttccgttggaaagaacatttaaaattaaataaattttaattaaaaaatcaaggagtcttctaatgtaaattttaatgttaactttcaaatccactagtattttttttgcttttatgacaaatagcatacaccaaacatttctgtgaaactatccttctctttcaatgtgt

SEQ ID NO: 40339 - DNA, 1071 bp, Homo sapiens
ataattgagtctttattgtcttaggcagttcaggttgctataaaaattaccatagtttgggtggctcataaaaaacaaaaaattatttctccttgtattcatgtcaggatacacggagaagtcggcagtctgcggcctggaagatggcccttagcagaacctgaccatagtaaatatattagccaggagtggtggtacacgcctgcaacctcagctacttgggagactgaagcacaagaatcacttgaacccaaggggcagaggttgcactccagccggggtcacacctgggtcatactactgcactccagtctgggtgacagagtaagactctgtctcaaaaaaataaaaaaatgccttcaaatatttccctaaaacacatttctcataacaatagagagtgagtccaccacctctaccttcttaactcttacttagaaatcctgcctttcttagaactcctacctgtctgctggtaatttgaaataagggtgcctgtatggtcaggttctgatggaattttgaaataagggtgcctgtatggtcaggttctgctgagggccctcttctgggctgcagactgctgacttctccttgtatcctgacttggcaaagaacagagagaagcaagctctccctggactgttataagggtactaatctcattccagaggcttctaccttcgtgacctcatctaatcctaattacctcccacaggccccacctcctaatactattacactggtagatagagtttcaacatacgaattttagtgggacaaacattcagcctcactgaaggtcaaggtttaaatattacttaatccttgagcttcattccattcattcccagttgcagacaggtaggctttctaagaaaggtaggatttctaagaaagagttaagagggtagaggtgatggactcgctctctgtgattgatgttatgagaaataggtgttttagggaaataattgaaggcactccaacctgtatctgagtgtaagggaaggttccttggagaaagtgaaatagaaattgggtcctaaaataggaaaggaataataatgg

SEQ ID NO: 40340 - DNA, 1054 bp, Homo sapiens
aggagaagatggatgtcccagctcaagcagagagcaaatttgccctttctctgcctttttgttctattcaggccctcaatggattggatgatgcccacccacattggtgaaggcacagcttctttactcagtttacctatttcaatgctaatctcttccagaaacacactcacagaaacactcagagataatgtttaccagctatctgggcatcctttagctcagtcaagttgacacctgaaattaacttccacacgaggaccctgaagtgggactgaacatgataggcccaaggaatggcattactgcccaaggggctggagtagaggggacaggaacagaatggtcagtgtgagaaggctagagagataagtggtgccagatgttttatggccttatgtgttacaaacaggagtttggcttcatgcccaagtgtgatggacaagaagccattagagggtttcaagcatgagattaacataatgtaatttgtgttttcaaaaaaaaaatgcctttggcatcttggtggagaagtgactgcagggaacaagaggaaagacagaggaaccaactagctaagttcagataagagatttccttttgtctccctccacactgagggcctgttagtagcaccttcactgagaagaggaagaatgtcagagttttaaatggccatccacatagagatatcaagtacctactgtatcaatcagcaacttagaaagtattggaactagagatataaatttggatgtaattggcatatgatgttgtctaaagccctaggacttcgtaaggcttccagggagtgtatgtagatagagcctgagacatagtaaagaaaaggaagagaaaaggcgaagggagagaagactcatcaagaccagccagagaagggctaagaaagctaggagggagtgatatattattaggaggtgagtgaagataatgttgcaaggaggagagagtaatctattgtgtaaatgcagctgggaggtccagtaagatgaagaccattaattgaacattggatgtgttataatgcatatca

SEQ ID NO: 40341 - DNA, 1026 bp, Homo sapiens
taaatttaattatttatcttttgataataacaataataacaacaattaacagctaacatgtattgagcactcattccaattcaggaacagtgctaagagctttagatacttgattaaatcctcattaccttaagagttagatgccattgtcatcaccacttgcagaagtagagattgatgcttaaagagttaagtagttgcccaaggatacccagcctgtttggcacagtgggagagcagtgggcttacttcagaagatttaaccaccaagccacactcctggcaaggtggtgatcttggccactatgccagattgtctacttccaggaaacaccattgaacatgagtgactgcagtatatcttataacagagttttcctggaaaccaatcgaactaaatcaaaagagtaacacttcatgaactgctgtctcttaacttctgtaacaaactactggcatagctgatattggagttgagttgttagctaaaacttccaagtgctccttccattctaaatgtctctgttgtttgctaaagtgatttttttttaaagactacgtaaaatccacatgtttccttcaaatttggcacttgtaatctgttcctaactagtagtttgtcaaatcacctggaatttcagaactattatataaacaatttgcatgctgccttcagaagtttttgaagttgggtgagcataataaaccttttgggaccgggggaaatatcagaatttctgtttttagctcctccttttgaaagtttatgtctgtgcgtagtacattagtgtagtcatacatgtattaaatcaataaataagtaaacaaacatttattgtgattgtgtgatcaaaaaattatagagactattgatttagtcacttttctatgtgaagcttgattttctctcttgatagggataaggtctgtattaggcttgtctattgctatgtaacaaaccatcccccaaactggtagcttaaaacaatatcaatatttcattttctcacatagttgcaatttggg

SEQ ID NO: 40342 - DNA, 1023 bp, Homo sapiens
caaacaagcaaagaaaatatgttacttgctgaagccactgactcaatcctgtctgtttaaggttttaaaacagagaatttattcaagaatctcagcttctgctttgcaaatgagttgaaagcttaaggatttgaccccaactttcaaagtaagtataccttgtcaagtttttttccatctcttgctgcctacattcagtctttttcaatgatacttcatgcttctaagtatgtttctgccttcttcctaattaatattgaccgagttcccaagtgtgttgggaacaattctagggactgtgtggatggaacacagaaatgaaaatgttcccgccctatcccttctgcttgacttctggctctaaatgatgccattcattctatccgcctgttggccccacacgcaactttctgtcattcacactatgccaagagatcatcaatgcccttttgtcctgcgtccctcggagccttgcaaagcacagagcacagcagaactgtcagcagcacaaatgccacttctgccaaacctgctcttactgtgtcctctgatgaaccagcagcctttgcagctgtcttcccagagtgggtttatgaatataaggcctgccgtctttcctctccagttctgtctgcctcagtactagttagaatgactaaaccagacagagtgcaaagcccatgtctcccagtgggtaactcagtccactggtctcttcacattcagattctctcatcttacacctccaaggacaacatggtatagttttgctttccttttgatgtcttgtcttgtctttcttttttcttttctttttttccttttttttctgcccttctgtgtcagggctctcaaatgtgtgttcctgtacctcaaaaatacatagagatgattgcaaagaaaaataaatatacttcttctttctccaaacatgcgtaagtcatcattcccgtgttcataaacacatgctgtatctgcctcagcattcttgccagacatggatgatgttttactttcccttct

SEQ ID NO: 40343 - DNA, 1024 bp, Homo sapiens
gttgttgcttgacttcttaaatatggcattgatgaatttaaagtaggagcatcagttattacttctgattcattaatggccagaattttgtgtttggtgtaatagttgtgtcaccattcttgttgctttttaaaaatcaggctaatcatgtggtccatgtctcttcaaagcttgacctgcacaaatgccatatttctatttggaccacatattctccattttgcattgagcagtagagtacagtggaaagggaataagaatactgattattctgaacagtttagtcccaagagaatagcgttttaaaaaagaaaaacaagatttggagtcattgtgggttatttttggtgggatggaggatcttaaaaatgcctaattgtgagagaatcaattgctgaaagtgttaaaatttctgaaaataaatgcttaattacatatacaggaattaaatagtttggaagagggttggattatcattacctttacaatactgtataatcagaagttctctgaacctcaattgtatatctagacataaaaattgttttctgtataggatgttgtttggtttgtttctgagtgtttaaattttgcaaaaacaaatgttaaatttgtgcttcagtacctagataaattggaaaggttaatgttctagtttctggaaggtaagcctgggagacacataagcaattcactgctataatttagttgatgtaaaatgacggaaactgactcaatatgtcaggtttaactctgcccaaaagcagcagacatgtaagcagatgtgcaataaaaaatgatcttgatccatttcactaatgtgtgcttgacattttttactatattgacatttattatggaaagagttaataattattttttctgatgtgctacactagtggccagtatatggttaagttgatgctgtatttattctaagacggatttaaaaaggcagttttctaaatatgaacttgtgaatttttgtatgtgtgtttgagtaaattgagaaatgaattttata

SEQ ID NO: 40344 - DNA, 1050 bp, Homo sapiens
tgagagtagtaatacctatcatgcaggcttactacaaggcttatatcagtttgtaattcagtacttatatctctaagaaaagttatcagtaatttaaagcaataaagaacctaaaaacctctgcttttcattatcgtatactaaaaaaataccctttgagtttctgtttcagtcgttaattttctaattaatttttcataaacgactatttccaagtattctggtggacactgagatacaaagatgaatgaaacacagtcctgttccccaagagactagtctagcagttaagattgacatgtaaacaataataacagtgtgtgatgctttatcataatgattgaagttttgtaggaggagagagaaggtgacatttgagccaactgtaaaagagtgagaagacatttgaagtggaatatattccagaataaggggaatagtaaaaataaaggtagctgtgtgatcatggaaaaaacactgtactctaaatcaaaaagaccagatttttgttatctctctgctacttatctaacttgttaatcagacaaattatataatattctttgagtttgttttttaatctctataatagttaatatatgctttcttcacagggtattgcaaagattaaatgggataatacacatgaagtacttaggcttttagtaaatttgtttgcccacacattagggctaaacattttagctttcagtgcattttgtactctggctctattgtttcttttaaactttatttctctttaagtttcttccttaccctgaattcaggcattctttgcttattgaagagaacagcctgcctttacttaaataactgaaatcttttttaggtccatgtatttgtacaaccaaaattctttctaattgtacgtctcctcagctttaatgtcatttcctcagtgaagccatcagtatatacaatcttccatattgtattttttcttctgtgcatccatagtactttatacattgttttatcattgcttaagtatatttttaaatcttccccatcagaattttttgaggggag

SEQ ID NO: 40345 - DNA, 1069 bp, Homo sapiens
attttgaccaaaaacataggttatttttctttgaaaagaatttgataattatctggctgggcatgatggctcatgcctgtaattcaagcactttgggaggccaaggcaggcagatcacctgaggtcaggagtttgagaccagcctggccaacatggaaaaaccccgtctctactaaaaatacaaaaattagctgagcatggtgttgcatgcctgtaatcccagctacttgggaggctgaggcaggagaatcacttgaacctgggaggcagaggttgcagtgagttgagatcatgccaccacactccagcctgggcaacagagcaaaaatccttctcaaaaaaaaaaaaaaaaaaaagaatttgataattatcaaatacaagtgatatttgttatacatttattttatgaaaacatgattggaaaacttaagtacaaacatgagtaatgagttttatgtatcttagtacactaagaaaatttatctaactgaccaattatagataatttagataattatagatgttatgggtaatctgaatttttgagaattatagatattctgaattattatcatcaaggtgagaggtatctgaattgtctacaattagtaatttatgctctttttaagactatacaggcatactttggagatactgcaggttcggttccagactaccttagtaaagcaaacatcgcaataaagcaagtcacaagaaatttttggtttcctggtgcctgtaaaagtaatgtttatactatacgtagtttgctaagtgtgcaatagcataatatctacaaaaaaaaaccttaatgtaaaactattttattgctaaaaaatgctaatggtcatctgaaccttcagtgaatcatctttttatggtggagtatcttgccttgatgttgatgactgctgactgatcagggtggtgctttcgtcactaagcttaattatttctagcttttgatttaaagtgagagacatgtgactttttctttcacttgaacacttagaggccactgtagggttattagttggtctaatttcaatattgttgtttcttaggaaat

SEQ ID NO: 40346 - DNA, 1089 bp, Homo sapiens
ggctcctgcctgtaatcccagcactttgggaggccaaggcgggcggaccacaaaatcaggagctccagaccagcctggccaatatggtgaaacgctgtctctagtaaaaatacaaaaaaaattagccgggcatggtggtgcatgcctgtaatcctagctacttggaaggctgaggcaggagaaacacttgaacctggaggtggaggttgcagtgagctgagatcatgccaccgcactccagcctgggcaatagagtaagactctgtctcaaaaaaaaaaaaaaattcaaaaagattgtgtggcaaaaaaaatgtttaaatgttctttccaaattgtagtgataacaataaaagaaacatttagcttgttaaggtgatttactttaaagagaacaatgtataagagatggtaggttttatttttaaatcaattatacagcttttagttacaagttagataacatctttattttatagcttattttggtacttcatttagattctaataaatttgaaatgtgtggaaatggacatgtgaatctaagcaaaagtttgaacctggataccaggtgtggcatgaggccaggcatttagcttgcctaagagaagaaatgatatatacatttcacaacaaccctcttgcttcaagcgagctctcaatagccagagatttcagggaaaaacacacttcaaacaggccacagttgtcttctgcgggagcctctgctatggggtcagtcagctggctaagtgagaggcaaaaaggccacagggttcctcccacatagaatgaagctacccccttgcttgggtgcggagaccactgtaccaagagacagatgagaaagggaaaagaggtctggattttaattattttccctttctcctttgtctcttatgcggacaaaaatattttaaatcactttttagagcagatcccaaagaactatcttcctcaggttcattacacaattggtgtgtgattgtaatgaataaaattattgttttagaatctcttccatttcagtttttcacttaaactgatttctttctccagttaacttgaattattaagatttttataccataa

SEQ ID NO: 40347 - DNA, 1022 bp, Homo sapiens
tattgaaatgtcataaaaccttgaagaataaagatggtgtcagatttatttgctaatttcaagggtgagagtttaaaagtgaaatttttgtactcttgccctgatcttggctttaggtgtttttagctacccattttctactatttgcagtgattttaaaaatttaactttcccattatatatctgaacaaagcacatctctttttttcttgaactcttctttcttgctctcttcattatcttagttaatttcatggctatcctcctgaacactgtactttgaaatccaaaatgagtttttctttattattttggccctgacactcaaattcattcagttgtcaaaacttattccttttaactatgttggtcacatttcccctacctttgggttctcactgttactatgcagttgaggtcactgttatctgttccttctgggtagtgtcacagtagtgttttaaatgctctttctcctgtctacttctgtttctttaagctttctgtaggaagtagttacatcttccccctgtttacatatttataattgcttactctagaataaaggttaactttccttagcttccacctgacagcctttttgactttctaatcttatatctgttctgctttactgctacttcaagaagtgtgaagggaattcctgtccattttttctagttcatacttgctaggagtttgtcttggctttggcattttagttctcacttttcttgagcactgtagactgtctactccttggttattaaatagagaacaacagccctgatctccttttaagcaagaaaagaaaaatattctaaaataaaggacacagcatacaacaggtataagacatacatataagtgatattttacacttgtacagttgcctttgctggtcttcttcctcagtgttctttcatggctctggctgcacagttgcctttattaattccttgatgttcctagaacctaggaaaaggaggctaccacctcctttggtctctgattattaggaa

SEQ ID NO: 40348 - DNA, 1060 bp, Homo sapiens
caataagtagtttttagtatgtttatgaatttgtgcaactatcatcactgtataattctagaacattttcatcaccccagaaagataccttgtacccattagcagacacttcccactctctcttatccccagtccgtggaaaacccctattatgttttctgtctctatggatttgcctcttctggacattttgtataaatacaatcaaacaacatgtgaccttttatatttaacttattttacttaagtacgatgttttaaaaatttatctgtgttgtagcaggtaccaacacttcattgttttttattgccaaataatatttattgtgtggatataacacatttattcatcagttgatggatgttggggttgtttttacctcttgtctattaggaatcatgctgctgtgaacactcatgcctaagtttttgcgtgggcctatgttttcatttttcttgggcatatacctagaagcggaaatgctgggtcatctgtttaattttttaggaactgccgaactgcacagtggctagctgtaccatttaacttaaccactaacagtgtgagggttccagtttctccacatccttgcaagcacttactaatatcaaccttttttattatagccatcctaacgggtgtgaagttatgcaacattgtggttttgatttgtatttcactaatgactaatgatgttgaacatcttttcatatgctttttggtcatttgtatatcttctttgaatacatactcaaatcctttggacactttttttctcaattatttgtttttttataatgttgcaagagttctttatatattctggatattagtcccttatgggatatatgatttgcaagtattttctctccttctctgagttgttttcacttccttgatgaagtgtcgtttaaaacaaaaacttaatttttttttatttttgagacagggtcttattccattgggcaagctggagtgcagtggcatggtcatggctcactgcagcctcggcgtcctgagctcaagtgatccttcccacctcagcctcccaagtaactg

SEQ ID NO: 40349 - DNA, 1130 bp, Homo sapiens
gactaatgttaatatccacataataagtttcttgagagcatagaaattggaatgactgagtgtcagagaagattagtaaagcctcataagactaaaatagagttaatttgtgggagtaactagaacgtaggttcaacttatggaagtctttagaagtgtgtcttagtcatatttagtgatctgaaactgaattcatgatttcatgctctaacttctgcttctcagtgttttctatttctgtaaattattatctttgacactcagattcccttacactagaattaatcagtcatcaagttttgttctctttctcaaatgtttcttatatctttccacttttttccagattcattgctacaacctagtctatatcatcttttaattcttttcctggatttacagtaattccttaaatggcctctttttatctattctttgtttaccttaaacattcttcacactacaaccagaatcatttcattcatgtaaatttcatatctttgtggaagcactatatcctttaccttcatagccttgattttacttgtaatgatataatcatttgtgtaatgtctgtcttccctgctagattgtgtactcgaggagagcaggcacatgtctgtcttcttcactactatatcaccagactgatgatatcatagtagcccagtttggttacgcacatattttctgaatacatgcaagaaagggggaagagaaagggaggaagcaaataaacaagcagattatgaagacagtagatttatatatttttaatccaagttgaagaatttttttccctttgggcaacaggaagtataagttgaaaagttttaaaagctagtatgacactagatttgctttttagaaagggaactttggttgcagtatggaggatgtgtttgttgaaagagatggaatcatggataattgagaatccatccaccaaaaatttcctgtataatacagccaatatattcagtggaaaatgtgttgaagagaggatgtagttcttcaaaaacactgaatatatgtgaaaaagatttccatatttttctaactccttttctattccatttacttctcaatcattttagtagtttcagtaaagccttgattaatggtagttt

SEQ ID NO: 40350 - DNA, 1034 bp, Homo sapiens
tatattctttctgcattttgaagttcataaaacttctttgatccagaatatgagcttggagtgtttttatcactatagtactggctctttccaactttcacctattatttatatatgacatacataacaacacttagtttatatcctgagattgaattcttagacagtttttagagctactttgacaacatatccctagtttgcccaggacagttctggtttatgattattttcctagtgtaattgttagtatcccctttcattctcaaaaatgtttgcatgataaataatatgaccactatatttagggctccatagaacactattttttaaactaaaagtcacaacctaatgcatcacaaccagcaattgaacaaaaaaagcaatagaatccttaaactctagagaatattaaattttgagagaacaggaataaaaacccatataggaatgaaaagtggctagagaagtagggagtagaatggtgtcatgaaagctaatattcttgtgggtcttctctgtagatgtggagggaacttaggataatgaaaggacttgtgatgggcgagaatcaagcttggtgtccaagtctttagtgaatgtgagaggggtgagcaagatggtgagaaatcagagcaggggcagcaagtgtacaagctgctcacctagtctagagctttttgcagacatgctagtcagttttttttttctcatgctgagcttgagtgggtcctcagactcctccttaaaatgataatccaaccattagcagccactaatgattgattggaattgtggcacaagaaagacacctgtttttccttttttgaggtagtacatgatatacctttatttcatgagctgttacggagcagggattttaaagacaagagtgagggaatcatgatggcattaggaaatcagagggtgattgaaatgtctgatccaaagaaatatatagtttggaatatttgagcatattccatttgccagggttgtgagtgaactagtgtactcaaagagaaagccacatt

SEQ ID NO: 40351 - DNA, 1028 bp, Homo sapiens
caaatttttctccttttgtctttaaactttttaatgtaatttttaaactattgaattaatcttttatgactttcggatttcagatcctgcttagaaaggtgttttgtactttgtgattataaaaaaagagtcttttgtattttcatccagtgcttttgtagtttcgtttttttgtttgcctttgaaccatctagaatttatattggtataagatataaagtaagtaccgtatctaaagttgttttttaaagatagctatccagttgttttaatacctttgtttaattatcatctcttcatgtgatgaaggacttttcaggcagaggtaacaatattaacacagtgcctgggtacttagtaaaaacggagtaactgatgagagtgttggttattgttgtgttggtggtgatgatacagttttagggggtataggtttgggatgggattcttagaaagatggtagatttaagcgtattcatagcttgtggggacataactagtagagtgtaaaaatacagcatagaaggaatgaaggactggaaagaaagagaaactccagagtacaaccaatgtgggttaactttaaacatgagagtggaaaaatggagtaaggatgactgataaaaatataggtaccataaatatgaaaggtcgatagatttaagaaaaaaaaggaattaacccgtttatgccagaggttgcaaatgttttttgtgaaaaatcagatcttggcgatgaccttgagcattaggatataaataactcccgtaagcttagtgttccagtaatggaacactaagcataaatgggttaagggcatctaaatatggaggtagttgtgttctaaagtactcaaggagagcgagagacagattttgaatttttattttctcttctctttctcttataggtcacccttgcaattatggatatttaaaagggtcagacagtgtggagggggagttcccctcctcactcccccttggtgcttgactccaggaataatttataaactgtggaattttttt

SEQ ID NO: 40352 - DNA, 1048 bp, Homo sapiens
attacaatgtactaaacaaatatcaattttactatttttcatttctctattctttagaactgagattaagagggcttttaaagtctcaaccaaaaagtttagaagtcacagaagaatcttctaccttttgatgatgaagatctttttgcatggtttctgcttacatgacaattttttcagttccacagtgctgtgcaaaccaaggactgcctgtatttaaaagtgggaatgtatgacgccttagaagttagacataaaaactgctcttgaaaggagcttgaaaaatacttgaattgttacaagcttatgacggaaacacattttagggtgttgattgtacaattggaaattctctgatgaatttctatgtaaaaaatgtttatgaaagtaaaatgtctactaaatacacaattaaaaatgtgctaatttgaagctcatgtatacaatattaaaactcattagtaatcacaattgtttagaacttaggccaagaaagtatttttggggtaggagtaacgtatcaatgatgttgtttagacttacatacgcatggatatgatgaaaggcagactgacttttagttttattattgttttaaattccctttgtatttgcccaccttagggcttgcactggggtgaactgctcccactgtcctgccattggtacaccactggaaacatcactgaagaagcactgtggtggaggtggaggatgacacgaaggcagtgagacagaagccaggtatgtacataggaatggcagagagactgattagaagatgagctgaggcagtcacaatggaaatgaacctattttaggctattggtctttgtcatgatgaccaagtttaattcctgcctgagatgaccactgtctcttacaatttctccagcaatctatctctttcagacccatccttctgtagctggcactgctgattattctaaatctcccctgaatgtagccgtgaacctgctgaatgccctttaccctatcactgacctccagctctcccctacccacatttgaccctcaaggagatttg

SEQ ID NO: 40353 - DNA, 1050 bp, Homo sapiens
tagatccttgaggaattgccacactgtcttccacaatggttgaactaatttacgttcccatcaacagtgtaaaagcatttctatttaaggagatgatatatattttcactcatatattttttttattttttatttattttattattattatactttaagttttagggtacatgtgcacaatgtgcaggtttgttacatatgtatacatgtgctatgttggtgtgctgcacccattaactcgtcatttggcattaggtatatctcctaatgctatccctcccccctccccccaccacacaacagtccccggtgtgtgatgttccccttcctctgtctatgtgttctcattgttcaattcccacctatgagtgagaacatgtggtgtttggttttttgtccttgcaatagtttgctgttcactcatatatttaatctttcagtttaaacccatttccactcaacctgtcattggcagtgacctggaaaagcatttgtgtgaatgtgtcaaaaacagtatggagtttatcctttctgctcttctcttaactctgcaaacactccttttgggacttttaagttgtaatatatatttttattttgaaacaataaaaaacttacagaaaatttgtaagtccatttcaaagaatattttttcctgaaacacttaagtataagctagtaacctaaaacctcatcactcctgtttctttaatttccttcaaacaagaagtctcttacataaccacaatataatcattatattaaattgaaagtgctgtcataacaaactatcacagactgggtggcttaaacaacagagatttattttgctcacagttctggaggttggaagtccaagatcaatgggtcagcagctttggtttctcctgaagtctctctctttgactggcagatggctgccttctcattgtgtcctcacatggcactccttatatctctctctctgtgtccaaatttcctacttttataaagaaaccagtcagattggattagggcccacccaatggcctcatgttaacttagtcgctt

SEQ ID NO: 40354 - DNA, 1035 bp, Homo sapiens
tcaatcatgttttgcattaactaaactagagaattacactgagcattttataattaccactctgcattttccagccttccatggtagcaataatctctgcacttctcctaggggtgtagtattgttcttgacttactattctgtatggaaagagagatagcctctgcatgtccatatttttctatagctcttactctgtgagttgggaatctaatgtgagtatttttctagctgctgaaatgtattcaaacattatggtcaggacctggggaaataaccatgtaatgggatgagagtcacacgcagccaattgtgagggagactcaggtgaaaattattatcatgacatgtggctctgggaatataatggattgagtgtgtgtgtgtgtgcgtgcatgtgcacacaggtcttcttattggggactaaagttagatacttcataagacatagttcttatgttttggggtttgaagaaagtaagagaaatttccaaaggaccggaaaaaaaggaaaagctgcgaggacttaaaaagcaattaaagcaaaagtaatgagggattccaacaaaggtaggagccaaattgtcactgctactaagaaactgtactttggtctggtgaaaagacgtatgtgggaagttgctaaacttgaatgtcccaggttaagtgtaagaaacttcaaggtgatttaagtcatgatagaagttggtagcctatcctggcttgtgtttgatggaaaccaaatccactttggtgaaaatatctttattttatgctctcatgttttccattgatcaagatcagccaaatatgaacccataaagaaagattaccaaacatgcaaagaaactaaaccatatcaatgatagttagcataggtaacctacaatacatatgaaccctcaaagagttgagacatgataatcataaaatatagttgcataagatgtaggatataaaacaacatattatgaactatttaaaggaatggaagatggaacaacaaaaaatgtacatgcaataaagcacttaaaa

SEQ ID NO: 40355 - DNA, 1026 bp, Homo sapiens
ggaagcaaaaggtatcgtcttgattgctaaatggggaagtaatagaacagcagtagataaggggctctttgcagaatgctataaattattttttcaaaaatgagtgtggaagtcacagctttgttaatattgtataggatacagtctaacaaggatatcagttctcctactcctggcagcagaagcctttccttcagctaatggagcagaacactaatttggaaagcagagagaaagtaaagctgccctgcttgacgccgaggtgccacagtagagtccacttttccagccaacttctccctaccccatgtcgtctgtgtctgcactggacacatttccacttgtggcaccttggaaaccactggtctaattgctctggtctctacccaatccactgcatttcacttggttttgctcactgacacctttaagaatctgataaaagctttgggtcctattcctttaaaagagtgcatctgcttgaaattttctgtgctgtttcaaagcattcatggactgctccaccatcaccaaggcacataaattcctcagacctaagccctttctaaaagtcagactgcatctttttcacactaaacaaaataaaaataaacaaaaacaaaatataagtctaaccacctaaacacactataccttcatcattttaaattagttttggaggaaactgaaagaaatctaggttctggttttagctctgcagctagtagctggattgccttcagcaagtcatgtaagacatttttgggcctcagtgtctctgtctcttaaactctagtgttctgtgttcagctgtagtcttctgtaattctgtgagccaaagtgagaagtcagtagtcctctctatgaccaaccatatgctgtttgcatccatttattcatttttagcttatgagggaatggcctttcctttcactcaggctagatgtgaatgttgtagttgataagcaggtcaatattgacatacttatatgtaaaaagacactttctgctgttaagtttgaatca

SEQ ID NO: 40356 - DNA, 1051 bp, Homo sapiens
gatgtatgcctttatttttcaatttgtgcaaagattcagtgattttaaagatagagctaataccctgcttggcaaatatttttaaatgatattctataaatggtaattaatttacaaattacctaatcactttccagtgtgtgtaattgaattgagaggtaaaatagtgttttgaatttgtgatactagaaactaaacaaagttactatgcagttgtcataataaattctagtttttatacaaaaaataaattgttctgtagtaaagattcttgtccttaagctttggctaaatatctgatcatttcctaaatcaaaactctgaatatttttgaggtttttgacattttacctaattattctctaaaacgttcatatcaacctatatttcatccaagtaacttttcttatcagttagtaattgtaagctctgcaagaaaatggctatatctgggttttgttttctttttctttttattattatgtaccttttcaagtaaatattttttaataagttagaaaaatgtgtttaatggctgccatttgtggacttccaagtacttttcttttttctcctacctttttttatttatacgctgcttgtgcatatgcatgcttctgcttaagaaaaaaaaaagcctcttttcactgcttcaccattttgaaggaccaggtacacagtgagggtatgatttttctactaagaatattacaagctgaaatttgtttttttacttttgactctaggcttttccaacacacagtttttttgctgcatttaatctgtttatatggtgaattacctgtaataattttcaaatgttaaattaacattcttgagttaaacttaacttggtcatgatatgaaggtcatgatataaattcatattttgttttttatctgtgtttgtgttcagagtctagataagtaacagatgttcctcttttatttagttatttatttttattatacttttagttctgggttacatgtgcagaacgtgcattttgttacataggtatacacgtgccatggtggtttgctacaccaa

SEQ ID NO: 40357 - DNA, 1090 bp, Homo sapiens
tgaaaatcatttgtaaaggcaataaatatttgagacattgatcatttgaaccatcagctgcttttcattgagtccccaaaatatgctaatgtttttagcagaaatcagagcacttaaaatagaaggctttgttcttggtatttttattttaaatagcagagttaaatctgtttatattacatttttgtttcactaatgtagttagactgacgtctacaatctttggcaggggcaggatggaatatatctaggattttctagcagagactaaattgttcagtatatttaccttttttaaacaagcaaagaccttaccattgttttttttttaccacctctaggcacattccaccctctcatcccacatttccccattactattatgtattatttttcctggttccacttaaaaacacaaaaatccattattttaaatattttcatgttcattacctaatacatataattgtcaggcttttttttttcttgcatctcacttcctgtagtattcctgtcactgatagtttgtgaatgggaaactctcttagtctttgtacatctggaaatgtcttcattttgttcacagtctttagtgatggctaagctaagtatagaattctataccccttttcgctttgaagatctatcactcattgcctgctgacatctatttttgttgataagacagctgttgtaagactatttgctatttctttgaagataaactgtctcctttctttttcctgctggcctgtaagattttatcttcatgcttgatatactatagatttacagtgatgtcttcagtgtggagttttaaaaacttattctacgtagtactcagaatacatgtaagaactcctgtctttaagtagttctataaaatgatcagctattatatattaaatttccattatccccacccccatttcctcattccgaccttctattagacatatattggtgatgtagtttgaatatttgtccccatccaaatcttatgttgaattttaatccaagattttggaggtgggtggggcctggtgggaggctgtttgggtcacaggggtgtatctctcatgaatggcat

SEQ ID NO: 40358 - DNA, 1037 bp, Homo sapiens
tagccagagagattccgattcaatagccctgaagtagagcccaaaaatctgcattaacaagcatccaaaagtgtgtatgatagggaatttcaagaacgaaaactgtaagaaacacgtgataagagaatatacaccaactaaagtgagaaatgaaagaattttaattataacaacatctagtcacaggtccaaatagcttaattattttcctcttttcttcactgctccttattaacctgcacttaacacagtctgtattgcactaaactgaatagttgtcatcaagtttgtgtttttttattttccttctctctttaccctcagatgtcttgtagaatcctggtgttacctctgtcactcctctttctgccattggtgtgaacacccggcatccccacatctcctgatatccgggcttcttgcttttctcagggatgtgcagcctctgtagtcctctctctcacggcacgtctgatgtggtaggacagtcgctcacgctgatgtcagacactcaagatctagtctggactgctgaccctcttctaggcagataaccctctatggatcccagtttcgttatctatgggatgaagggttgggttaaattacatatgtaagtgtttttaaagttcgtttaaagtagaggcacagagtcatttttgtctgttcccagctgttcctgatttattcacccagtctgcataatataactgtattccttaaatgttatagaaccttatttcttgtgaacatcctagaagtgtttaactgaggaaaaatatagataaagtcagattacatagggttgttgtgtgtgtgtgtgcgcgcgcacacgcccgtgtgctctccaagaggatggagttgatgccgtaagacctccctaacagctgccaggaagggacaggaatgatggggttagggtgccatctggcccttggctcttcctgcctctgagacataggtaactctttcatgtggaggctagtaaaggaagaaccctgtccgaagggctgtttgtcacagaaacttgaaatgtt

SEQ ID NO: 40359 - DNA, 1006 bp, Homo sapiens
ggggatggtttggggatgattcgtacacattacatttattgtgcacattatttctattgtaggttggtgcaaaagtaattgcaatttttgccattccttttaatgacaaaaaccccaattacttttgcatcaacctaatattgttacattgtaatgcataatgaaataattatacaactcaccataatgtagaatcagtgggagctctaagcctgttttcctacaactagacagtcccatctgggggtgatgggagacaatgacagataatcaggtattagattctcataaggagtgcgcaacctagatccctggcatgcacagttcacaatagggttcaggctcttatgagaatctaatgctgctgcttatctcacaggaggcagagcttgggcagtaatgtaagtgatggggagtggctgtaaattcagatgaaacttcgcctgcttggctcacaggccagtattggtctgtggtccaggggttggggacctctgctgtacagggatgattactcacattttaagtgtcttttttataccttggaaccaaatactgaggctagcctcttcaaaatgaacagaatgtggattaatgaaatccagctatcagagatagctcattttaagggtgtggtgacaaggaaagaagctaagaattctatcatttttaataaaaaatagtggccttcggaagtttcaatgaaattcttcttaggttttaaagctgccatttaaaaatattttgttctacctcggaaaaatttagcaaacatttttctcttcaactcaaggtgctcttcggggaggagatgccttttagtgcataaagtctgtgaataaaactggagtatattttccagtttcaataatcagacctctctgcaagtcagttaatgagttaatagcagatataaaatttaggagattgtcaggactgacctgatagattttgttggttatatttattttatctaggtgcatacaaatcaaattcttataggaga

SEQ ID NO: 40360 - DNA, 1035 bp, Homo sapiens
ttcattcttcagagtagaatcaaaatgggtcgaaatgacctcctaaaaaaagaaagggaaaatagatcacctagtacaaaatatgtttttgcatcctaggctctgaggataaaatgtggttacatgagtaatgtatcagaaccttaatgctgtttaaacatacggatgggtgcgttgtgtgtattttgtatatttaaaattgagatttttgtttgaacagtgtctttcatttggtgtacttcatggtgatttatcataatagactgatttaaatcatttgaaatactgagacatatgaattttaacaataacttccccaaggctagagaagtcagcaggagctcaaactgctaggtagacattttttttgtttcaaactcatatgcaagtgtaaaacttttatgaggctgctttaacaaggccctttgggatttaaggttatttatcaagctcttattaaaaatgaaaacttttctatgtttagccctgtaaagcaaaactgatcctaacaatactgtaagctggaagaacaaacattgttctctagactgacttgaaaataaagtcaggaaactttggggtctctctcccctgacattatgataatagaatagtgacagcaaagccagtatttcaaagtctcccctttaattaggaaaatttagctctaccatgcttataatttaggctttgacatgacttattaagatgacttccagccctagaatcaaactgtttcactgagcactccagtgtctccattagcgtcaacttgccccaggactgtgttgcctggtacaagatctgggagcaccttttcatttgtggtatctgcacttgttgatgtatctttggcttatgccctttcccaccgagatgtggggcatgagagagaggttgtttctgagattagtgtgccagaatctctccatacataacccagcggaagagctggagctgctacaggaaaagttttgtaatcttgaaatatgttcagcttttttgtaggtatgttcaggtttgatgagtctgggt

SEQ ID NO: 40361 - DNA, 1034 bp, Homo sapiens
ctaggcaaagaattcatgactaagccctcaaaagcagaagaaacaaaaacaaaaataggcaaataggacttaattaaactaaaaagcttgtgtacaggaaaagaaataacttagtgaacagataacatgaagaaggggagaaaatatctgtaaaatatacaactgacagaggactaatatccagaatttacaagaaactcaatgcaacaaaaaaccccaaataactccattaaaaagtgggcaaaggacatgagtagacatttttcaaaagacataccaatgttcaacaagcatgagaaaatacttaacatcactaatcatcaggaaaatgcaaattaaagccacaatgggatatcatcttacaccagtcagaatgactattaaaacgtcaaaaaaaagaacagatgtttgtgaggatccagagcaaagggaacacttgcacaatgttggcaggaatgtaaattggtacaacttctatggaaaacaatatggagaattctcaaatatagaactaccattcaatctagcaatcccactactgggtatttacctaaaggaaaataaatcattattatcaaaaagatgcattcatttatttgtttattccagcactactcacaatagcaaagatatataatcaacctaaatgtccatcagtggatggctggataaagaaaatgtggtatatataaagaaaggaatgctctttggccatgaaaaagaatgaaatcatgtcttttgcagcaatatggatacaactgggggccgttatcttgagtgagacaactgagaaacaggaagtcatatactgcatgttcttacttacaagtgggagctaaataatgtgtgtacatggacatagagtgtggaatgatagatgttggagagttggaaaggtgtgaggggggtaatgagaaattacttgatttgtacagtgtacattattttggtgatgaatacactaaaaacctagacttcaccactatgtaatatgcccatgtaacaaaattacatcttaccccataaatttatac

SEQ ID NO: 40362 - DNA, 1030 bp, Homo sapiens
atcacagagtttgtttctagattaatgaagtcaaaatagggaaattggcaaacatacaatgtgtagcactatgaatctcatatgatcatggaactctttttcatgagaaccctaggtccagagaatacacttttgataaattctacaagaatatcctgtatgtcagtggagtgaatgtagaaagagatttccctgttattaattggaccaaagttggaaaataagaatttaaggaagaagattggagaatgtacagttaaccctctgtcaccatgggttccacacccatggttttagccaacctcagaaagaaaatattttgggggagaaaatccccacaaaattcaaaaagcaatacttggatttgtagcacactgattcctatgttgaatccacatgaatgaagtgatgtgtaggcattgtattaggtatcataaataatctagagatgatttaaagtatacaggaggatttgcataggttaatccaaatactatgtcatttttacataagggacttgaacatgggtggatttttgctgagggcagtcctggaaccaatcccctatggatactgagggatgactgtatattcacagagggaaaccattttctgtcggctgataggtgtcagtgtctgccaaatacagcttgggtacagtcgtgcaagaggaaaagattggaagaggacagtcatacgttggtaatttccaagagtacctgtacatcaaaggaagagaatttatatttatgcatttaaaattaatatactttaagacacttgaataatgaattatacttttgctgactctctctctctctctgtctctctctctctctctctcccccccgaccccgtttctttctctgtcacaataacctaacaccagagataaggtgaaagctttatttatttgtgtattcatagattcaactaactgatactgtgttaggtggtaggtccgcattagtaaataaaaactacaaaattgctgcagttgtggaacacatactctaataatgggacttac

SEQ ID NO: 40363 - DNA, 1047 bp, Homo sapiens
gtgcatttccgttgtatgaaggatagttgtattatgttaggcgtaattatgaccttattattgtttttatttgaagattatgtatgatctcaggagatgtgtatgggttcaagttgacaaggggtcgacttgtgatggttaatactaagtataaacttgactggatgcaaagtattgactctgggtgtgtcgatgagggtgttgccaaaggagattaacatttgagtcagtgggctgggaaaggcagatctacccttaatctgggtgggcaccatctaatcagctgccagcatggctggaatataaagcagacagaaaaaaacatgaaaagactaggctggctttgcctcccagcctacatccttctcctatgctggatgcttcttgcccttgaacattggactccaattcttcagctttgggactagcttccttgctcctcagcttacagatggcctgttgtgggaccttttgatcatgtgagttaatactcctcaataaactcccctttatatgtatatatctgtcctattagttccatccctctagagaacccttactaatacatttgcctgatggttaatattgctatatttactttttaaaaaattgttcatttgttctttttatgtttattttcgcctgtcttgtgtcatttaatcaagtgtatattgcattaagatataccttatgaactgcgtacagctggatagtttaaaactccagtaggtgagtccttctattttaatagtgaatttaattattcacatttattgtgattttgatgaatttggacatagtttgctgtcttttagattggttgccctctctgtgtcatttctttcttccaatgatttggaagcaaaaaataacttttttatttatttcaaaatgattattcgtgattaaccttaaaattttaatacacatttaaatttactatttttttaactgtcaatatttagatttaattagtattcatactgttcactggaacaaggaaagacttggagattcatgtttgtcttcttgctccctccccaacct

SEQ ID NO: 40364 - DNA, 1034 bp, Homo sapiens
agatttacatatatatatgtctatatatcctattagttccgtccctctagagagccctgactaatacagattttggtaccaggagtggttctagaggaacagaatattaaggatggagttcttttgttggttttgaggtttctggagttggctgtttaatatgattacatccaaaaatgctaaggactctacttctgatagcatggagaatgctgatagtccttggcatgaactgtatagagagttatgcaaaatacatacatttgacactcctgattcaccgctcatgagaggcaaggagtttagtaactctatacataatgcctttggctgtattaaggaacataatgaagttggttggttgctcctaagttcactggacaaagtgatgaaagaaaatgatgaactcagggattctaactcccagcttcagaaacagatactaagcctcaaatctgctaagatggccttgagtgagaatcttatctcctgtagagaaagagttgaaattgtggaaaatcagacaaaagcttttatcatgtgagtggctgacctgcaatgaaaagtgtatgcacagcctcaccaggcatctactgttaaagtgaagggattaattgggaaaaaatgggaccctgcaacttggaatggggacgtgtgggaggaccctgatgaagctggggacactgagcttgtaaactccaatgaaactttcttgccagaagaaacagcttccctacccccagtagtggcaatgtcccctccccaatccatgctgtcatcaacctttccacctttgtctgagaagatacaccctttactgcctgaggcaacaggcctccccttatggcctcccctgaggcagttgccaggcaagataatgttgattcttctcaggagccacccccaatacctctgtttgcttctagacctataactagactaaagtcctggcaggcccctaaaggtgaggttgagagtgtgacctatgaggaggtgcgttacactcgaaaataactgcttgagttttctaatgt

SEQ ID NO: 40365 - DNA, 1572 bp, Homo sapiens
aaaaaattccccttgttggaaaacacattcaaagccgattctagttctgcctggagtgctgtcaaggtcctctaccagccatgcatcaaaagcaggaatgaaaagtaagttgtgcatttgttttctctttccacattatgttttagcttttgttgtcatgttggtgttaagaaattaatgaattaaatgccactataccatttccctacttgaagcttctaggagccaatactgctaaatattatatgtttaaaataggttgaattattacagatgattcatgttaatatgcagaaagcttgcttttaccaaaaattattgtttttttcttgtaatctaagctgtctgtacatatggctgcagtgctaaatcagacttcaacagtgatgaatatttaccaataagcactttccaggcatcaggatacaataatgaacaaaccccagcccctacctcttagcattgttgttctaatagggggaaggcagaccataaacaaaacagattcttacgtctcttactatgtgtcaggcactcatctaagaactcgtagctcatttaagcctaacaacaacctgtgtggtatgtaccattatcatccccactttaaagataagcacactaagacactggtagtaaatcactctagtgaaaaatgaagcaaggtaaggtagttggcgaggggtaggatgggagtaggatgtcattttatattgcaaagtcagggaagattctttagataaggtgatatttaagcaggtaacttgaaggaagtgaagtggtgagccatatctgatggaagatcattcccagaaaaggaaacagcaggttattttaattgtaacagaatcaaagtttgtacttgtcctgtactcttagatgggtttgatcaaatttatcctaagaacggaagggtcttagtctttttctggaaagtaaataagacattgaaaaaattaattaggtttcttatgcaagtagtaccagtcataaaatattcaaacactaagagatatatacaaggtaaaattatatcccgctccagaagtaaaacgtttgttgtctactcttccacttccttttctgttcattttgcacctaaacatgtgtattttttacacttaaaaaaagcccatgtcttagagattctttccattgtgagtgcttgacattttatgaaatggaggtactataaattatttagccagttttcttttaatggatatttggtttattacttttttgctgttataattagtgttgtgatcttgtatgtttgttttctgattataagttttttatattagaggaatttctagaggtacaattgttgagtcaaagggtatggacatttaaaattttgagaggtaatatcaaagtattttgtaaaaaggcatcatgaatttatattcccacctgaagtttttataaatgtccattaccctgcactctcacccaaatttccatttagatttttgcctatctgatgtgattctaaaggaaacaggtttacttgacactatccttatattttattgagacatgttcaatggatgcatctcagttttatgc

SEQ ID NO: 40366 - DNA, 1028 bp, Homo sapiens
gggaagggcctgaagttgctgttaggtgtgactctgtagctggccatccattatggggacactatgcttttctaattgcagataatttccatgaaaacctaaaatattttctgactgattttgatagtaaatatacctcacagttttctgaaatcagttttactttttcttttattgtaagatttcagattgaagatcgggagtaggaacttctgaaactttctaacatatatttagatttttcttttttataaaagtaaaacattcttgaaacacaatcagggaacatgaagaacataaagtgttccctttcctgccttgctatatcatactattcagggagcaatcagtattaacagtctgatatgtgtacttcattatttttattctttccatatacaactatatatatgtacactcacaggtgtttgtctatttgtaaaaaaaaaaaaaaaaacagtatcacatgattagcgtttttctgcaacctgcttgcttcacagtatgtatcatgaggattgtttttattagtttaaatataggtctggctctttaatgactggaattttgctgtatggctgataagactgaactgcaatgaaaataatctttgcctgtgtcttttagtacttctttagaaatggatctttctaatgtaatataagaatttgtatatttgaaactcagataattatcaccttgcaaaaaagttgtactaatttatcttttatagtgggcattcttggtgtgccacccagaccccatactgggttgatgcacccattcccagctgctgacagcgttggctgataatggctcacagctgcccgcttctccacagacttcctctttagatgacaggtgttgccttgcccagaagttacctgtccgccacagtccctccctgactcaccccttcttggtcagcccgctgccagtgatttgatcctggggcacagaaagctagggactcttgtctcaaggtagaacaaactctgtaggtgggattcatgctgtagaactccccc

SEQ ID NO: 40367 - DNA, 1025 bp, Homo sapiens
catacctttctttatttggaaaaggaaagagaaagcctttttgatagttgaaccaaaccacacatataaaagttttgaggattttaaaaaatgttttgatcatatagtgctgtagacaaatgtgctcttataaatcttctaattctgaaagttttctatgcttatttctatgtgccagatatctagaatcttatcacccagtcaccaataagttttttgaataatttctggttttaatttgaattatttaaaatttgaaacatgggtcagtttcaaatgactcctatgttttaaaaacatggtacttagtcactaaatctattagtgtttttatttctttgactctttagtttgcaaacaagttaaccatgatatgtctttattccagtttatttgttgatatccaaaaattatagcaatctttgagtatagccttgaacttatccttatgtaaatactttgattctgtacctcagagctgacactttagggagatccaaatggaagaaaatgtagacaatactgtctgatgtttggaaggaaatttcttgccttcttttgtaagttagttattctctgtttaatatgctacagcacaaatggagtattgacttgttctaacatggtatttttttattcagtaggggtgaatagttaggtttggtgtggaaagtgtatcaaggattggagaataggttttaagaagaatggagcaaacctgaatacattaaaatatattaaaatccacatcagtgcagattctgagggaatgagcagtccgtagaaaagtctggcatgtggatatgtctgccttttaggtaccgtgtgtgtattttttgcttatcttgccagttagagttattatgagatacacattgtaaaaattgatttctgttcaaacaggtcttggtttgtccagagcgtgatcgcccagtgtctggtgcagctctcctctgctagaagcacttttagattcacgattcaaggtcaggatgacaaagtgtatatcttggtaagaaattatt

SEQ ID NO: 40368 - DNA, 2128 bp, Homo sapiens
acagttccacatggctgaggaggcctcacaatcatggcacaaggtgaaggaggaggaaaggcaggtcttacagggtagcaggcaagagagcttgtgcaggggaactgtcttttataaaaccatcagatctcatgagacttattcattatcatgagaacatgatatgggaaaaacatgcccccatggtttaattacctcccactgggtccctcccatgatacatggcaattatgggagctacagtttaagatgagatttgggtggagacatagccaaaccatatcagaaacgtcttttttttttaattttaattactcagcctcaggtatttatagcaatgcaaaaaccacctgctgcacaaagggtgatagaagggctgagataacttctctgccctaacacaactctggctgactgctaaactctgcatacacacaaaaaatggcagggagtatctattatatgtattttcagtaaggattgaaagcttagggggacctgtgaatttgctgtgactttgattgcattcctcaatccacatacaacttgggtagcagaaggtaattttcgtaagaagccttactggcttgaggtgtttgagtagagccttgccccaaattatttgctgacagctaacctatgcaggtacagtggatacttgctagggagccagactaaaaaaaaattaaaactgagtagagacattagtggctacatactgtggggagatacatttcacagttcgagtccaggccagtcaattgactgctatcccaaccaataaccaacaaccttcagaagagcaacacaaaatccacagttgctacaacatattgcacacaatgtcctgcttctgtctaaaaattattagatgtgcaaagaaacagaaaataatgtttcatactcaagaaaaaaaggtcttaataagcaggtacttagtaagcacagatattcaattgagcagacaaacatgtggaagcagctattataaatatggcaaataactttttaagaaaagctttgaacagatagcaaatctcaataaattagaaaaatcaaagaaaaataatttggtaattctagaattaaaatgtactgtaaccgtaaagaaaaattcactagatgatctaaagcacagatctgagatgacaaaagataaaaaaaattattgaacttacagattaatccaaattaaccaaacaaaaaaagtctaaaacaaaatgaacagaacttccagtttgtgggacaatatcaggtgttccaacaaatgtgtaaatagggtctcaaataatgaagagaaattgaaagggtcagaaaaaaaatttatacaaaaaactggctgaaaacttggcaaattattttaaaaatattggctttcagatctaagaatttcaatgaacctgtagtaggataaacacaaaaacacttcactcaggcatgttgtcgtcaatctgttgaaagattaagagagaatctttaaagtaaaaagagaaaaacaaaacctcatatgtaagagatttcctaatacaattaaggtgaacttctaatagaaataatgacaaccaaaagacactgaaataagatatgtgaagtgctggggggaaaaagatgtgacaaccaacagtactgtatctagcataactatcactcaaaaatgaaggcaaaataaggatgtttccaaataaatacatggaaataatggattcctatcgtacctgctgtacaagaaatgataaaggaagttcttcaggctgacacgaaagataccagatggtaactggaaactacaggaaggaataaaaatcagggaaaatggaaaataatgtgggtaaattaccagaaaagcagactcaaaagaggtaagcacaaaattcaagccacattttctttgcagtttgcccattctctaaaattagaactttagtttcgagaaggacaaaaatgagagactactcaagaggagaacctcacaaaaataggagacgctaaatgttgtgccctcacagtgagggtgaattggaaatagaacagccctgtggaattgtagacagagatcaatcctttgggacttgagggaatttcaagtcttgaactttgtttatttcaccttgttctagacatttgccag

SEQ ID NO: 40369 - DNA, 1043 bp, Homo sapiens
ctctaggcctccaggcctgtgatgggaggggctgctgcaaaggtctctgacctgccctgaagtcactttcctcattgtcttagtgatttacatttggttccttgttacttacgcaaatttctgcagcagtgtaaattcaagcaggcttgactgtaacgccccatggaagtccgaaatccagcaaagcagtcaaatcttaaagctccaaaatgatctcctttgacttcatgtctcacagccagatcacactgatgcaagtggcttgaatttctcctttgacttcatgtttcacatccaggtcacgctgatgcaagatgcaagcaggcttgaatttccccccagaaaatgggtttttcttttctacctaatcgtccagctacaaattttccaaacttttatgctctgtcacttcttgaatgctttactggttagaaatttcttccgccaggctgggtatggtagctcatgcctgtaatcccaacactttgggaggccgaggcaggtggatcacttgacgtcaggagttcaagaccagcctggtcaaaatggtgaaaccttgtctctaccaaaaaatacaaatattagccaggcatattggtgcacgcctgtaggcccagctacttgggcggctgaggcatgataatcacttgaatttgggaggcagaggttgcagtgagctgatatcgcaccactgcactccagcctgggcaacagaatgagacccggtttcaaaaaaaaaggaagaaatttcttccaccagataccctaaatcatctctctcaagttcaaagttccacagatatctagggcagggacaaaatactgccagtctctttcctaaagcataacaagagtcatccttgctccagttcccaacaagttcctcatctctatctgagaccacctcaccctggactttattttccatatcactatcagcattttggccaaaaccattcaacaagtctctaggaaggttcaaactttcccccatttcctatcttctgagccctccaagtctctaggaagtttcaaactttccc

SEQ ID NO: 40370 - DNA, 1024 bp, Homo sapiens
tatactaccaggccatatacagattttatcaattgtcttaaaagaatcttttagcataggtttgtttgaatcaggagccacacatgtgattgaggtaatttggttgttgttgagctgatttttaaatcctgattacccatgtctgataaggatagaatcttattttaaaaacaagcaaacaaaaaacacttctcctgcccccttgaaagacaaagtgagatgttctgtgatggcagttacaaaggaagtacatatcaaagcacttgaaaaaaaattttctgcttcaaatagaaaaattctttcttttcaagcattgctattacaataccaatattagtttttaataaagcccttagtttttggtaacatttaatgagtgtgatcagatttaacttgtataaaatagtactctttaaaaaatatttttaatatcaacttggagccatgcaggtatgttttactgtaagaaagcattaaactgccagaatggcaccctttgtagaccatactggctttctgagttctcttcctcctggacctgaataaattggcaccttcctaggtttctgtgtctgtctcttacctctcatgggtatgacaccatccagtttcccacctgggtcaggctctgagacctgccatttgtgatgtgcctgataaggatgtcagtgcaatggccagagatggcacactgtggggcccactttgggagtgtgcctggataaaagtttgagccaggactgaactgacttatgaagttcatgtgtgcttttgtttcctcagcagagacttttgaggaaggctgcagaatctgtccaaatactgcagctagaccaggaaaaaatggaataagtgtttatgttactgaaggttaattcagtgtatgaagggattcatctcagaagtttttaaatagaagagctgtaggcatttacggatttttttactagttgcatgtgtttgaggctgggggaaagaataggccatagagaaagaccccagtatgaattgtgctgttgctctt

SEQ ID NO: 40371 - DNA, 1066 bp, Homo sapiens
gatatattctctgatttgatgtgatgagaaaggtacatttcacttctgtgagattctttccccaaatccataccaccagcctaatcttgagacaatattagactaactcagattgaagaatattctgtaaaatacctgatctttgcaaaaatctcaagtgtctgaaaaataaggaaatattgagaaactgttatagaccagacgagactagggagacatgatgactaaatgcaaagtattatcataaattagatcttggaacagaaaaaaaggatattagtggaaaaacaggtggaattcaaagtgtgtagttttgacaaatctaccatggtaccataaaatagtaagtttaggtccatctgggtgaagtgtatatgggaactaatacactacctttgtaagttttctgtaaatctaaagttattccaaaatgaaaagtttactaaaatatagtaatagaagaaattatagaagaaagttgttaggtgatctgaccattaagacacgtaaaccaaaataaaaggcagtaacaccaaaaaaatttgtaacagattaataagcatgaggctaatactcttaatatagaacacatttttacaaattaataagaacataataataccaccctggaaaatagtcactaatcacaattcacagaagaaacacagtagactataagtagcaaaactagatgaatctcaccagtaatttaagagttgccagttaaagcagcattgaaaatacttttacctattactaatgcagaaatggaaaaatgatagtattcatttatgaaaagggtgagtggaagaattatagattggcacagcctttctgaaaagaaattcaccaaataggtgttgggttttaaaatatgcatatagtttgtgcttatcatctcacacttatataggattctttccaaggaaaatagatatgttcataaatattctaacaggaacattcatcacagagttattgataatgaaaaactcaaaacctaaatatctaacagttgagggaatcatctcaaaagttttgatgtacttatggaatagaatattgt

SEQ ID NO: 40372 - DNA, 1010 bp, Homo sapiens
ctacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgag

SEQ ID NO: 40373 - DNA, 1025 bp, Homo sapiens
ttgtaggtaattctaacccacaggacttactctcctgcccattgctctgtcaaacatagggttctttgaggaggttcaggatgagacagacctattcgtttggggtggcagtttttgaagcaaatggttcttaagaaattacttgttatgcccgaaacaatatttcttaattttgtagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggtaatgggtttagtgccctgataaagcagaccattatttacaagaccaagccttagtgtctgagcaaattgacctaaagtacaaattctaattctaggaatgtgccttctcatttatatgtgctttggatgtgaaacaactttttttttttaagagcatgatcattaagctcatgattcctaagggtgtggaaagaatgaaaagatactgtcattttttggagtgtccatattagagaaataacaatgtccttccaaatttattgatttaagacattttcagtaattgaaaattgtttcctttgttaacttagcagtgattaaagatattggggttgggtggggaagggtaaagatttgaaaagaaacattttgaacattttcagacaggtttttatagctcggcaataatttcttgttctgaatgaacaaacaggtgagctttggcagaatattgatgacgcctgatagttctagtctttgtgacagttagattttaatcaaagtattctttttgacacaattattttttcagctttattgaggtataagtgataaataaaaattgtataattcaagtcatacaacaccatgttttgatatatgtatacattgtgaaatgattaccactatcaggctaat

SEQ ID NO: 40374 - DNA, 1023 bp, Homo sapiens
ccaatctaggaacctaacaatttaaaatgtattgcaagaattcaaggaatatagtaataaattaaggaagaatattataacctctaaaacactaaaaataatacaaaaaacatacagtttaaaagctaataggccagacgctgtggctcacacttgtgatcccaacacattgggaggccgaggtgggtggatcacctgaggtcaggagtttgaggccagcccaacatggtgaaaccccatctctactaaaaatacaaaattatccaggtgtggtggcaggtgcctgtaatcccaactacttgggaggctgagacaggcgaattgtttgaacccaggaggtggtggttgcagcgagccgaaattgtactattgcactgcagcctgggcaacaagagtgaaactctgtctcaaaaaaaaaaaaaaaaaaaaaaaaaaagctaatggaagaaatagaataactctgaaatacttgattaatgcaaaagaaagataaaggaggaacaaagaacgtaagagcttaactcctgggataaatataaaactaatagcaagatggtagacataaacccaactttgctggtaattatgttaaatgtaagtgaactaaacactctaatagcaaaaattgtcagattggatttttttaaagctccaattatatgctgtttatatatatttttattgttattatagagatgaaatttcactatattgcccaagctggtctcaagttcctgagggcaagtgatcctcctgcctcagcctcccaaactgctgggattataggcatgaggcaccattcccagcctacaattatatgctgtttataagagacatactttaaatataatgacacaaaaagtttgacagtaaaaggatggcaaaagatatctcatacaaagagtaagcccaagaaagctgctgtagctctattaatataagagaagcacacttcaaggcaaggcatattagtagagatagtgataaatgggtcagtcattaaaagacacaattctttctatg

SEQ ID NO: 40375 - DNA, 1087 bp, Homo sapiens
tttcccagtttttattttggaaatgtgtcgattcctaaaccccaacctaaaatatcattattttcaatacttaaatattagcccatcattttttatcttcagatgtctataattggaagcctatatagaaatggttgatgagcctatcggttgaaccactgcagagaatagagtgatggtcttagggcatcctgtactttgcatgctcctcctggaagtaaagagtaagacagagaatagtaataatcacccattccagaactggttgcacaacatcacaaaagcttgtccagacttattagcaagttaataaaaaactagacttctttctaagtacttataatttaggctgtggggtagttctgttatgatacatttgttttaaaatattctgcttctttttaaagtgagttgtatgtgtctttgttgtagggacgtgcaatttttgccagtggcagtccttttgatccagtcactcttccaaatggacagaccctatatcctggccaaggcaacaattcctatgtgttccctggagttgctcttggtgttgtggcgtgtggattgaggcagatcacagataatattttcctcactactgctgaggtattgtaaaatcctctaagtttaccaagggtttaaaataccaagtgtgctcagcctaggttgtctaatgttttatttatctagcatctcagcttactctctgaaagaagtaaagtctgaagaacttcccagtggagtataaggggtgggtagcatgttcatactgactcacaaacgaaaggttcttcttcagtagtcattagaaaaattgtgtttttgatttcttaagaggaacatttttgtgtcttcacacatcagatcaagttctgtgacagtgatgggacaattaaaaatattgtttccagggctgggtgtggtggctcatgcccctaatcccagcactttgggaggctgaggcaggcagatcacttgagcccaggagttcgaggccagcttggccaacatggtgaaacttcatctctactaaaaatacaaacattagccgggcatggtggtgtgtgcctgtgatcccccctgactc

SEQ ID NO: 40376 - DNA, 1068 bp, Homo sapiens
tccatgagggttggaattagcttcttccaaactcccattaatgttgatgttttgacctccttccatgaatcacaaatgttcttagggacatctagaatggtaaaccctttccagaggttttcaatttactttgcccaaattcataagaggaattattgtctagggtagcaataactttaggaagtgcattttctatataataagacttgaaagtttaaattgcctctctatgtatgggctgcagaatagatgttgtgttcgcaggcatgaaaacatttttctagtacagctccatcagagctcttcagctgactaggtgcattgccaataagcagcaatattttgaaaggaatctaattttttgagcagtaggtctcattagcagacttaagatattcagtaaaccatgctgtaaacagatatgttgttacccaggctttgttgtttcatttatagagcacagacagagtctatttagcataattcttaagggacctatgtttttcaaaatggtgaatgagcattggcttcagattaatgtcaccagctgcattagaccttaacaagggtgtcagcctattctttgaagctttgaagccagacgttgacttctcctttctagctatgaaagccctagatgccatcatctttctacagaaggctattttgtctccattttaaatctggtctttaatgtaaccaccttcatttatgagcttaggtagatcttctggataacttgctgcagcttctacatcagtactttctgcttcaccttgcaggttatgttatgttatgttatgttatgttatgttatgttatgttatgttatgttatgttatgttatgttatgttatgttatgttatgttatgttatgttgacagctgttttccttaaacttcacggatcagactctgctagcatcaaacttttcttctgcattttctttacctttctcagcctttatagaattgaagagagttagggccttgctatggattaggctttggcttaaggaaatgttgtgactggcttaatctatccagatcactcaaacgttctcccta

SEQ ID NO: 40377 - DNA, 1036 bp, Homo sapiens
gatatcacatatacagaatatctatgtttatatataaaaggaaaacaatatatgagagatttattcagtatttcttttgaccatattagtctattagtatcagaagtgagtggaattctaaggcatttgcaaacatgaaccataattatctgtttcagaagttacttatgtttcttgcacatctctggaaaacagttggaccaaaatactcctatctagaaaatgcaaagtttatacatcttgtcatgtatgcctccttaagagacatagttttatttagacatttttcatcagagaggctaaaactgttctcctctgactgggctgcactgagagcaaaattatcagatttttatttcctctttgactaatcaggttactgacagggtcagactttttcaaaacctgagtattttgcttagtagtaagtggcctggggttgttcatttgatctctgttgagtatactttttccagttctttttattgatttagaattgcacaaggaattcttagaagggcagtggatagacttgagattttaacccaaaaggctcaatttgtttgtaataatctgctggattattgggttctttttagtaagtattgttttaggtgcagaaatttcttgtgttgttttatatttctcagtgataccagaataaaattattagtttaaaaataataaattattgagcttccacacatccctatgttagtaaactcagtaaactaccaaaattacccttcctaaaagataaactacctacaatatagctttgttaatcagattatggaaatttgtcaattttgcagagacgaagttgcattcttgaaaatttaggctgaaatataagcatacttgttaattcaaaaaaagttccagagtcattcataaatggtttaatgtgaaaggaagtcaaaacaattattagaactacatagacggcatcatgttttgtccctaaaaattgttaggaatgaagcagagactctgccagtagaattctaattttagtagtatgtcagattaaatc

SEQ ID NO: 40378 - DNA, 1099 bp, Homo sapiens
agtacctaataagtaatgttgttagatgagttatcagagatgatgtctcacttacctcttctggcttttatagaacgaatggtttagtagtaattgttgttttttaagtgccaagccacatgaaattaagattagaggcagatttttgctcactttattcattttcattcactatagacccatgatgttttgaaaggttatattaaacatccatgaaattttaccatggcataagtcttcctaaatctgcatatatatttgaaaagctttgaagtattttttcacaagggaatggtttattttcaaagacttgtatagctattctaaacaccttttaatgtgccagatatatgatcttttcttagcatgctcttcaatatttttgtaaagttagattcagaactgcaaaacaatatagtagacttcattttatttgtgagatggttgttaaagcaagttgacaataataaaaatgattttattagtcctcaacagggattaaatattctcccttttaatgtcaattaatttatttcttcaacaaatattgactatttgccatatggcaggttttgttctaggcactgcagatacaaatatattattatgagtataatcagactcacccacacagttatatcaactaatacctaattatatgttcatggtgagacacaggctataaaattctgacacatttccacctgtttagctactgtagttgttggatcaattcttttaattttatgggcagcattttttgtttatttaccatcttgccaaaacatgggcagcaaaaggagcagttagtggagacaaaatgtgaaatataagtagctccaaaagagaagtttagcagatattgcaagtaagaagttaattcatttaaggagaaacaaatactaaccctaagttcgttttctctccagttttagcctatcaattatatacttgtttttaaaaaatgtttattggttgcctcagagtttatagtatacatttataacaaatccaaatccacttttaaataatagtatgctgcttcatgaatactgcaggtaccatataacagagtatttccagttcttccctgctggcc

SEQ ID NO: 40379 - DNA, 1075 bp, Homo sapiens
tcaacatcactgattgttagagaaacgcaaatcaaaaccacaatgagataccatctcatgcctgtcagaatggtgattattaaaaagtcaagaaacaacagatgctggtgaggctgtggagaaataggaactcttttacactattggtgggaatgtaaactagttcaatcattgtggaagacagtgtgatgattcctcaaagatatagaaccagaaaaaccatttgacccaacaatcccattactgggtttatacccaaaacaatataaatcattctattataaagatacatgcaagcgtatgttcattgcagcactattcacaatagcaaaggtagtgaatcaacccaaatgtccatcaatgatagactggataaagaaaatgtggtacatacacaccatggaatactatgcagccataaaaaggaatgagatcatgtcctttgcagggacatggatgaagctggaagccattatcctcagcaaacttacacaggaactcataagtgggaggtgaacaatgagaacacatggacacagggaggggaagaacacacactggggcctgtcgggtgtcggggcagggagagcatcagggtaaatagctaatgcatgcggggcttaatacttaggtgatgggttgataggtgtagcaaaccaccatggcaaacgtttacctatgtaacaaacctgcacatccctcacatgtatcctggaacttaaataatatttaaaaaaaaagaagattagatggtcgtaagtgctcagccttatttctggactctctacactgttccattagtctctttgcttaggattgccttggctattcaggttttttcgtggttccatatgaactttacaatagccttttctagttctgtggagaatgtaattgatagtttgattggaataacatttaatttctaaattgctttgggcagtacggccattttaatgatattgattcttcctcttcatgggcatggaatgtttttctatttgtttgtgttgtctctgatttccttccgcagtgttttgtagttgtcagtatagaggtctttcaactctctggt

SEQ ID NO: 40380 - DNA, 1011 bp, Homo sapiens
aatagaagcagaacaggccttcgataagatttgatatcccttcatgttaaaaactctcaataaactaggtattgatgtcacatatctcaaaataataagagccatttatgacagacccacagtgcatatcatactgaatgggcaaaaactggaagcattacccttgaaaactggcacaagtcaaggatgccctctctcaccactcttattcaacttagtattgaaagttctggccagggcaatcaggcaagagaaaaaaataaagagtattcaaatagaaggagagaaagtcaaattatctctgcttgcaaacaacgtaatcctatacctagaaaaccccatggtctcagcccaaaagctccttaagctgataaacaacttcagcaaagtcttaggatacaaaatcagtgtgcaaaattcacaagcattcctatacaccaaaaatagacgaatgccaaatcatgaatgaactcccatttgcaactgctataaagagaataaaatatctaggaatacagctagcaaggaaagcgaaggacctcttcaggaagaactacaaaccactgctcaaggcagtaagagatgacacaaacaaatggaaaaccttccatgctcatggataggaagaatcaatattgtgaaaatggtcatactgcccaaagtaatttgtagatttataaattcaatgctatttccattaaactaccattgacattcttcacagaactagaaaaagctactttaaaattcgtgtgaaaccaaaaaagagcccgaatagccaagaaaatactaagcaaaaagaacaaagctggaggcatcacactaccctacttcaaactatacacaaggctacagtaaccaaaacagcatagtactggtaaaaaaaaaaaaaaaaaaaaaaaaaaaaaaaaaaaaaaaacagacacatagactaatggaacagcatagagatctcagaaataagaccacacatctccaaccgtctgatcttcaaaaagcctgacaaaacca

SEQ ID NO: 40381 - DNA, 1106 bp, Homo sapiens
taagcaatcattttttgcacttatcatgcataaatccttaacagtataaaacataatataccattaatgcaatgaaaaaaataatgtgttcagggtaactggtggcatcatatcagcgctcaaaatgtttcagattttggagcattttggattttggatttttggattagagatgctcaacctgtatctttttaagttagcatttgattgtgggccagatgctattgtaaatttttccattttttttcagaaaagagactcccaccataatttagtaatatattctaagagaattttatcacactgacagtcatcccttggttactgtgtagccacagaaaccacatactatttaaaaacacatatgttgccttggtttttcttagaaataaagtcatcactagaattaactctaactagagatgcacttctggtttctttttattataatgtttatttttaagaagttttatccaacagcagaaagtgctttcatcagcttgcacaacatttagaatgcattgaacctctcattactcaaggttttaatgctgggtacatttgccaattagtatggactacattttagaaccacatgcttgatttatttattgtaattatttgaactatacttatttatagaaatagttgagaaactctgcagtttgagatcacataatacagttaatttctaatagttttttatacttaaagtgccttatcttgtgaaacgctcatgtaaggttttgaaattatccaacttcctcagtagcaacattaatcaagagattgtatagataataccgtaaggctatataagaggaaaggaaatgcagtctggaataaagtctatctaaataagacaactttaacaaacagacgctgctaacaagttaggtgcacttaaacgctgatgaaataaggggagaaggagtttttattattgggaatcaatgaaaagttttgggaaaaaatgagatacgaacaaattttgaatattttatatcaatccagaatgaagaaaactgttttttttttaaatgtggaattgaggagttaccttagttctttgtaaggaaacagggattgacaagtgtaaacaataa

SEQ ID NO: 40382 - DNA, 1063 bp, Homo sapiens
acaggtaacacattgctgaaggtggtttttatatttctcttatgcagttgtctagtttattttttattgggtgagaaaatgaaaacatttaatgatttggaaagggtagccaactttgagaagaattttcctgtaaacacaatgatgtttttaaaaaatttactctctttaggaacatttgaatgaaataaaattttgctttctaaactgcgtgctcagacagaccatgtttatcatatgatactgcaaaagcaaatgatcaggaaatgccatcctgaacagaataaaacaggttagagtggcttttagtcacactttaagtatattgtagttgaaagcacacttttctagcctccagtctctgttccaacacagttgcaagtttaggtcacttactttggatagtgtattcagtttctgtatttgcacaaagataaatataatatttttccctacctttgggtttagataaccttagattgaaattcaggctctatctcactagcagtagatccttgagcaaccactacaggccctgccatggcgactgtaactgctttgctgtctgtttttgactccactctttcttactaaggtactaagcctttgtagaccttagtttttttcatccatggattagagagaacaacagctatttgaaaagattgttgtgagggttaaaagaggtagccaactcaatatcaaataagtgttggtgttaatcagggtgttactcagggttctccgaagaagcagagctgataggatgtgtgtgtgtgtgtgtgtgtgtgtgtgtgtgtatgaatgaaaatataaatataaatggatagagggagaaagaaggagagggagaaggcttgttaaatccaaaatcttcaggtaggttgtcaggctgaagactgaaggaagagttgcagttgagtccaaaggcagtgtgctggcaaaatttatttttgctagacaggaggtctgtctgtgctattaaggccttcagccatttggaggaggcccacccatattttggagggtaatctgatttatttaagtccaccaatttagatgt

SEQ ID NO: 40383 - DNA, 1061 bp, Homo sapiens
accacacccagctaatttttttctactttttttttgtagagatggggatctcactatgttgcccaggctggtctcgcactcctgagctcaagcgatcctcctgccttggcctcccaaactgctgggattagaggcgtgagtcactgtgcctggccaggaactactattatgtctcttgtttatttcatttaaaatggaaggaaatactaaatctcatagagtttgtgaaaaagatgtccaagttcaggcctccttaattactcatccataccttgaggatctgtgattaggtctgtgaattttaagttaaaagcctctgatagggggctaaattggttcttcaccagaagcactgaccttggtctctgaaaactgattcttaaactcagaggctttcagacaatactgaaatgtgaagaataaaagtcaatattcatgtagcatgtgcatattagtgactttattttaaaactttgtaccataagcatttatataacactttataatttacgtaggatgcaaaaacacctggtctcatttttttcttcccaacaacccagtgaaacacacataacatgtactatgtgttcagtaaatagttgattagtcttatttagcagatgcaataattgaggcaaatctccatttaacccttaacaccttaaatatttgctcaaaatcaagtgttaaataatatctacttgtgactcaaacttgacaaatggtataccctttagtcttatgttgctattcagtcatatttgttggtgaagtgtgcatctaaatttctagtgtatggcttattacaatctattaaataccaaaaatgtactgaatagctgcctacaacaaataattgtctgtcctaaaatgtcactagtaccaagattgagaaacctggtcaagatgaaagtactttaaaaaatccccataaactctggcacttatgctgatatgtagatatatattttggtcaaaccaaagttgatcttgaatgcctggtttaaagtcaatgaaaaaacttgttaatagtggattagtttaattaaatgatttcctaa

SEQ ID NO: 40384 - DNA, 1050 bp, Homo sapiens
aagattttcttgaactatatccttttcttgaactatattttgaggacagtgtatctgtatataagattctagaatgacagttattttcactttgataacatttcagtcatctgccttctattattgcttttaggagaatttatctgtctacctgtctttaggtaattcctttgtttgacgggggctgcattcaaatcttctgtttgtcttgtccttctttagtggatgtgtgtctagatgtggcattgttttttgtttattctatttggaatttgttgggttttttaaatctgagaatgtatgtctcgcatcaagtctggaaaattctcagcttttcagttatcattgattattgcttattctcattctctttctttttatgtccttcaaacatgattagaaatatgttagactttattacatccgtataaatctaaatataccttttgtattttctaatgctttcttttctgttcagcatgatttgtttttcagataccttctagttcattaattctctgtttagctgtgtcttgtctgcttttatgcattcttggttttttactttatttatttatattttttgtttttgaattttttcaaatttgcccattttctggataatgtatgtttcttgctaacatttttgagttcctcttttatttctttaccattttaaacaaaactaattttatattctatatttcatagatctatcacatgaagttctgtttctattgtttttgcctgatgttcaatcatgattcctcatgtgttttgtaattttagactctgaggtcatgttggctagtacttcatttgtgggaatcctagggagcctggggtcacctagaaagattttgcttcagagaggttccacaggtgctgccattctgagagcacctgaagttgaattatgcccttggagcttcccatccagtgcaggtccagatccataatccttatctgtaatttgaaaattaaaaatgctcagaaaaccaaaattatttttgtaaatcatttcataggaaaagttgaccatatatagtc

SEQ ID NO: 40385 - DNA, 1058 bp, Homo sapiens
ttatatatgcagtacaggatgaaagaggccaccagggccagggcacctaagagaagtagaaattgtaaatttgtgaccagatcactttgctgcagcatgctgaatcatttagccattttcccatcagtttccccaactctggaagaatgattcatgtcttaaaggtatatatcagtctagaaaatcctcataataagaaaggtataggttatgaatttgctacatgctgatctataattaaaatgataaatcagtatactgatatatttcagagaacattcacaggtttgaacatttcattaaaacatcattcagataaaggctgacttctccagatctaaatatttagtcacattagtattttagtggaaaagtcttttgaaaatttgaaggtaggaggttttccaatatgatttctaagatgtggaaaatagggggaagattccatgttataaaagaaagcagctgaaataggaactggtgttgaattattaatatgaatggtcataagagctgaacatttattgagcagttactatatagcacgaactgaactttatattattaatctttcatcacttaatgggttcagggagggtaattaactttcatggctttttttttttctctttgtgagatggagtctcactctgtcacccaggctggagtgcagtggtgcattgtcggcccactgcagcctcccaggttcgagtgattctcctgcctcagcctcctgagtagctgggacttacaggaatgcaccaccacgcctggctcatttttgtgtattttttttagtagagatggggtttcttcatgttggccaggctggtcttgaactccttccctcaggttatctgcccaccttggcctcccaaagtgctgggattacaggagtgagctgctacttcccctgtccaaactttcatagcttttaaccagtacacttaactgccatctgtagattagtaatatactttattgagagaggagagaaaatgaaccatattaacctaaatggtctaatctctaaaacacccaccttgcttgcatagctt

SEQ ID NO: 40386 - DNA, 1040 bp, Homo sapiens
atattaaatgaaaagtatccagtcctttatgaagacttcattaaatgttatctaatcctccttgctttccaattaaaagaaatcattttaaagtagattaaactttatttggaccagaggattggagtggagtagagcttccggcagagtcaggtgcttaggaagctgaatgtttattgcaaaaagtttacacactcatgtgcatataagtaatttttcagtcagtagagtgtagaagcactatcatatgagggagtctggaaaaaagaggagagagctttgtactcaagaggactggttattactaattgaaagtctgaagacatatttcttttttttttgagacgttgtctcaccctgtcactcaggctggagcgcgatcctggctcactgcaacctcagcctcctgggtccaagcagttctcccacctcagcctcctgagtagctgggaccacaggtgtgtaccaccacaccaggctaatttttgtatttttttagtagagacagggtgtcaccatgttggccatggctggtctggaactcctgacctcaagtgatccacccgccttggcttcccaaagtgctgggattacaggcatgagccatcgcacccagccctgaagatatatttctaatgaatttaagagaatttctgtaaataaacccataggtaattagacaatatactttaagattttttcatcagataatctagggatgtaaaatgtgaaattaatttgtgcttctgtgcattcgattcaatctggagacatgctataaatatctccgaaatattgacaagtgtagcataatctaagtttatgcattaaattgctttattttacatatatttgtgaccatatatatgtttcaaaaattttactgttttatttttatagatttagggggtacaattgcagatttcttgcaggcatatattgcatagtggtgaagtctggccttttagtgtagccactacccaaataatgaacactgtacctggtaggtaattttttagccctcaccccctcccaccctg

SEQ ID NO: 40387 - DNA, 1110 bp, Homo sapiens
gctgctcgggaggctgaggcaggagaattgctcgaaccccaggggcagaggttgcagtgagccaagattgagccactgcactccagcctgggcaacagagcgcaaccctgtctcaaaaaaaaaaaaaaaaaaaaaaaaaaagaaagaaagaaaagaaaagaaaaatgaataggtcagtacaaggcataatagtgtggtatatttagaaagtgtaccatatgcataaaaaggtatcagcctaactgtggaagcttcagagcactgtctgggtaagaatcaaaataggaagggattaaagctctgttattggaaggtcccacaaactgcctacccaagtaggaggtataggtgatattaataggaaaagttattctaagggaacctctaatattgaagaacttcagctgtctagctgtttggtggcctgtctttctgaaagttgtatcttttgaaacatagatgaaataatgagtacaagatttagtcattaattttgaacagtaagggaaaatagactggtaatgctataattgcagaactcttgtgtgaaatagctctgttatcttgacattcaaaaaaaccagagaattcttgagcaaggtagatgagcaaatggaacttaaatactttaagcaagaatttttaaggtctaaattaattttggtaattgccaagttttagaagagaattttagacattctgtcagagctagtcttgaagaattattgataaatgagagtcagtggtgaaagaagcctagaaaacacagttcctgatcgtttcaatgtggaataaaaagccctggatttcagattttgctattatttgcattgtggtaattttacataattttggtttcaaaacatatcatcattttccttttttaatttaggaagaagaaaaaactggcatgcttgctaatggtaaatattatttatattcatgttttagttggcaaaaaattagtctgttcagaatttcatctcagtaattctgaatgagtcactatctgtgtttgtttttaaatatttctaaggcattgaagttcctagcttttctcaataatgtgtttctatcttgaatccattctgttatatttaagattttttt

SEQ ID NO: 40388 - DNA, 1038 bp, Homo sapiens
tatgtctctcatatatatgtatatgatatgcccaggctgaagggcagtaacacaatcatagctcattgtaacttcaaactcctggactcaagcaatcttcccacctcggctttctgagtagctgggactacaggtacatgccaacatgcctggctaattttttttatttcttgtagagatagggtctctcactgtgttgccaggctgatctcgaacttgcctcaagcagtcctcccaccttggcctcccaaaacgcagagattacaagcctaagccaccactcctggcctgataggtttactatacatgatactgccacatctgtaaacaaccccgactgcttctatttcagtacctacattcacaccatttgtggatcagtgttaagcacaattttgtaaaatgatagaatttctgtatctctagggaaaaaatatacatatgggcttttggtttccccccctccccatgaaaattgagcctgaattcatgtcataattaagactctgcatgatctgactggaaccctgccttctcgtgtactgtagccataggtaatcattcctcatctcctggaaacaccataggcctccctgcctctgtgcattatctcatgcttccttgccattagaatgcctttcctctcatccttcttgcccaataaagcctagcatcaccactttttgcagtccttcactctatcttctagctctcttgtcacaattagtttctccttcattttgatgtcagaacaccatagtaacacttacacattgtgttgatagttgtaacctataggacaactcctgcggttgggagctttgcgagggtaggaaacacttctttgtccttgtatcccctgaccctcaacattaaatgataaatttgtttaataaatgcatgttaaagtagatttgacagttacttctctgttctttttaatactgtaatttaaagaaattccttattgaaaaattcagtgcattttttataaattcttatgcaacatgctgaactttgtagtgaagaattatgttt

SEQ ID NO: 40389 - DNA, 1028 bp, Homo sapiens
ttcaacccaaatggtccaaaaagagatagacaaaggggtaaacaatgaacccaagagtgccaatattccctgattatgtcccatccaagtggtgggaggagaattcggcccagtcagagtgcatgcaactttttccctctcagacttgaaacaaattaaaatagacctaggtaaattctcagataaccctgatggctatactgatgttttacaagggttaggacaatcctttgatctgacatggagagatatgttactgctaaattagacactagccccaaataagagaagtgccgccataactgcagcctgagagtttggcgatctctggtatctcagtcaggtcaatgataggattgcaacagaggaaggagaacaattccccacaggccagcaggtagttcccagtgtagaccctcactgggacacagaatcagaacatggagattggtgctgcagacatttgctaacttgcatgctagaaggactaaggaaaactaggaagaagcctataaattattcaatgatgtccactgttatagagggaaaggaagaaaatcctactgcctttctggagagactaagggagcattgaggaagcatacctctctgttacctgactctatggaaggccaactaatcttaaaggataagtttatcactcagtcagctgcagatattagaaaaaaaacaaaagtccaccttaggcccggagcaaaacttagaaaccctattgaacttggcaacctcagttttttatcagagagatcaggaggagcaggcagaatgggacaaacggtataagaaaaaggccactgctttagtcatggctctcaggcaagtagactttggaggctctggaacatggaaaggctgggcaaatcaaatgcctaatagggcttatttccggtgcagtctacaaggacactttaaaaaagattatccaaataggaataagctgccccctcgtccatgccccttatgtcaagggaatcactggaaggcccactgccccaggggatgaaggt

SEQ ID NO: 40390 - DNA, 1776 bp, Homo sapiens
ctcttcctcttcttataaagccacccatttccttctcatgataacccattaatctatttatccatgcatggattaatccattcatgagggctttgccctcacttcttttttttttttttgagataataacacattttaattttgtcgtgaacttagcagaaattttatattcataaatttgacagtcttgggttttttgccataatttttttaaattttactttaagttctgggatacatgtgctgaacatgcaggtttgttacatatgtatatatgtgccatggtggcttgctacacctatcaacccatcatctaggttttaagccgcacatacattaggtatttgtcctaatgctctgcctccccttttcccccaccccgcaacaggccccagtgtgtgatgttcccctccctgcgtccatgtgttctcactgttcaactcccacttatgagtgagaacatgtcgtgtttggttttttgttcctgtgttagtttgctgaggatgatggtttccagctttgtccatgtccctgcaaaggaccatgaacttattcctttttatgtctgcatagtgttccatggtgtatatgtgccacatttttttatccagtctatcattgacgtcttccctcgcttcttaaaggccccacctctcaataatgccacactgatgattaaatttcaacatgagttttggaggggacattcaaaccatagtaagaggtatttacaaagaacagtaggaaaattggagactgtgacttaggttatatgggggagatgtgagggatcaagaatcaaggagagctgtgaagatgggggaccatttgctaatagctagggaagagtgatggaaatggtaagtgagtattctagaacagtactattcaatagaacttactgcaaagatgtaaatattctacactggccaggacagtagccactagaccatgtaactactgggcacttgaaatgagactagtctgcctgagggtctaaatttcaaattttattaaatactaattaattcaaatttaaatgtaagtttagccccatgtggctagtggctaccatgttgggcagtgaagctttagaaactctgcaaagcagaaagtaatatgcaccctaaaagaaatgtgaacaatgacaatgggagaacagttccctgaatgcacagctcaccctctgtgtggatgatgcttctggagggttactatgagtagtcatgactctgtgactatatgaaaactgactgataatgctaggtgactctgccaggcaactgcttcatgacaaatcagtgtattgaatgcctaaccagttctgtcctccatagttagtcttatcacacaattgtccagaaatgacccaggacacatgtcatttcctttctataaggtagtggccaaaaagtttccttgggggagttatacattgtaatctcctttgacaaggttggttttgggaagagcagctgttaattctgaagaggggagactgacacagaacatgtacagtgtctgactgacctcctagatgaggagatgctgatgccctgcttttttctcctggtcctatgctcattatctccatataatgcccactgttgagccactggagaaaagcttctctgctgttgcttcagcctcttcccttctcaaaccagaccaaaacccagctaatcgtttgctggtgaatgtgattctttctcttgccttacctctattaaattaaatgcattaagaagacaatgcctcccaggggaagacagaaaa

SEQ ID NO: 40391 - DNA, 1018 bp, Homo sapiens
ttcatcctttctaaaaagaaatgctcagataagttgagagtaaggttaaatatatgagcagttaagtactcatacatgattacagcattctaagagttcaaaccttaaaaattatcagtgctagaaatcgacaaatatattcaagtatacaaacattcaacagatatataaacttagtatccctctacatgctgatatattttcaaataatgtgctttcttttcattgaactgtggtatgatgagaataacatgtcctcgggaattagagaacttagtttgagactatggatttctcaatcatgattttgggtaaaaaaattagctgctttatgtctcagttttgctatgtgtgaaaggaatggctgggatgataattgttagtattccttttagtttccaattcatatggtcctattatataaatatttagcttaatattgggaaactagttttataaaactattatatcttttggaatatattctgtttatttttggatatatatatatatatactgtatctgtggctttacaaagaatataacactatcagtattattttcaacttgttgaattatgtgaaatttatcctttaaatggaactgtgctttagttttacaggataaattttagtattttaatatcagaaggaagctatacttagtaacgtatttgctactttatagtgaatagtaaaagacattaataaaatttctttttcatgatgctcttaattgcatggcattaaattattttgttttgaaataagtatagcagtctattataatatatggagatcattccaagtccattcaaaatacatttaaatcctcgagaaaacaattgtgtctttttgaataattttattcctactgagactcagatacaataatatgaggcagtttattactctgcagttcactgagtttatacaaggctgaatcaacacacacatcctatatccatatttttaaatcatattaattacatcactagaattacttaataaaaagacga

SEQ ID NO: 40392 - DNA, 1072 bp, Homo sapiens
tgccccgcccaggactccctcctatgtgggcgtgagcagcagcacctccgtgaacatgtccatgggtggcactgatggggacaccttcagctgcccacagaccagcttatccatgcagatttcgggaatgtccccccagctccagtatatcatgccatcaccctccagcaatgccttcgccactaaccagacccatcagggttcctataatacttttagattacacagcccctgtgcactatatggatataacttctccacatcccccaaactggctgccagtcctgagaaaattgtttcttcccaaggaagtttcttggggtcctcaccgagtgggaccatgacggatcggcagatgttgccccctgtggaaggagtgcacctgcttagcagtgggggtcagcagagtttctttgactctaggaccctaggaagcttaactctgtcatcatctcaagtatctgcacatatggtctgatgaagcctttaagttaaatgacatttggatctgtctaacatattttctttttcttttttaaaagctatgtggaaagaaactctctgtggtttataaaatgtacatataatagaaaatgaaggctcactgggttttttgactttatcatggtgagattgtaattatctatggtatatatgtatgctgtatatacatagcacatggagtatcacggcccctattgttcccctgtttcatccagttgcacggagtattggcatgcgtgtagtatgtttaagcaaagttctcagactcttttaaaaacaagatggtaaacttaaaacttggcaattatactatccagaagaacacttataacttaatttatcagaaaaatgctctaaacggtttcatacttgatgtattgataaccagcagtaaccagcatgtagagtcttgtgatttctgttattcttggacacagtgtgagaatctaaaatacaaaagccagttgaagtcttagtgttagtcctgaggtatttgtaatcatgaaggatcagctttttcattcctgcttattatttaccacacatactatatgaccttgggtctata

SEQ ID NO: 40393 - DNA, 1056 bp, Homo sapiens
gtttgaccctataaaattttttactcaggaaggtacaaaaatttcttctctttaaatacttcaggaaaaacataaccattttactaaataaacttggccatttgatagcataaattagggcagtgataaaatgtggaaattgttcaaaggcatcttgtataaattatcgccttggctgcactcctgcaggaggtgccttttatcttttctttaactagccaggaaaggtctccattactggagaaaatgaaggctttttaaaaaatgtccagattcagctaataaacattttataactgtttcctgcaaaatatctaaaatcctttctggaacttgtagtgtgaaacagcagcctcaggaaaaatatcgattgctccaaatcagatcacttgtagatatgtcagcttcagagcatctctttaaagcttagggttatatatttgtgatgatcaataacttctccctaagaatttagtttatggatttgtgtttgaatcataataaagtttacactgctaaagcaaataatgcagtaagatacatctctgtagtcagtttctaagtccagtggttgcttgttaattatcttagtaaacttccctcaagactgctctataatcactttagtatttttaatatttaaaactacaattaaactcatctatgtggtaataagaagctgttttatattaagctgtgtcttaacattcttttgcatttaaaatcgttgtatttctggaaagtcacaaaatttagtattggtataaattgaatagagggtgatcagctaaacaggacccagagttcattagtccagtgttaaacatacccacaggcaacatgtggtttggaactgaccaggtctgccaaactgcccagaaatcaatacactagtacagaaaatactatcaagtggcatgaacttggatttggcttgtagtttggccacagatatgatgactggtttggaaaaaaaatctcttagaatgaaacaatgttaggattaataagggtttcagaccttttgtaatctcatcctttctttgtgagaaactg

SEQ ID NO: 40394 - DNA, 1050 bp, Homo sapiens
aaatatttagtcaggttgttgaggttgggcagaggcttctgataaattcagcttttccttctttgatatagattattcttcattctatgcacaaataccaaccgcgagtgcacgtcatccgtaaagactgtggagacgatctttctcccatcaagcctgttccatccggggagggagtaaaggcattctcctttccagaaactgtcttcacaaccgtcactgcctatcagaatcagcaggtattgttctcagaattggaatctttgtagatttttcatttcaggtgaagagagaaagttagctatccttctcactctaaatattatgaattataaagcatttgccatatatgacattcaaagtgtatatatatgaataacagttctttatccatgattttccaagtaagtctgctctaatgttgatttctttagacaaaccatgtcttgtgactgacagtgtaggtttactttccattttgagcttttgaattatatcttaattaaaattagaatgtatttttattgcctaaaaaatagacatgtagaatattaaaaatgaattgtatcatagagcatgggacttgatagcttactttatttttaaactacattctaaaaatagttcagaaacatttatcctgtatagtcattttggtacatatacaaaagggctatttctttcaagatatgctttaattgtgatagaggatgataaacttgcttatagtctgagagatcagcaatggtagaatacttatttcataaagttagaaatagtgtgagaagtgaaatatttcctttctatatgggtaaatgtatatatttctctaaggctatgtttatatgtgtcagttaggtagagaattgaatcagaggcaatatgtaatccatgctggaattccagctggttttcataagaaatatccatgtaatataagccgatgtggcctgtggtagatttttttttttttcaatttcagtggtcagcagaattgttctgggtctccatttctctttacatttatatacatttcaattacaaatttaa

SEQ ID NO: 40395 - DNA, 1031 bp, Homo sapiens
tccctaaaacattccagggatacataaagttcttatagataatactgaatacatattatttttcttgagcaatcttcagattactattgatagttgcttcttaacatgcaaacaaagacatacatcagccatttctgtatcctactccaatataccccacttgaagtcttttttgaaatatggtaaggatattttgaaaagtaaccttaaaatatatacaactatatggagaaatctccttgagagaacagtcttcataaaacaagaacctgcttttcattgactagtaaaaagaaacccaaatgaatctttgtttctttaattacaactcagtccaatcttctgaaattagctatgcatttatttttgtttgtttaatgtaaagtaacttttctccaatttttcttctgcttagaaatttgtttctaaaagatatgctaattctccctgggagtttataagtgtcattgttttgtcccttgttgtttgcttaccagtggcattttgtttcttaccttggagaagaggaagggttctcccttaaactcccctgctccccaaaatatcaagtgaatatcactttctaatgagataaattaattaagaaataaagagggagggggaaaaacagagttaacattaatggttgctatgatatgattggtcatttgctgctttatatttatattaaaagagtgtgttaaagagtatgttaactaatgagacaccaggtggggctcaattaactgcttctgtaggctgagacccttttttgtgtttcctttgttggacctggccctgtgatgatgcctgcccaaaaaatacgaatttataatgaatgcacatgaacgtggtggtgggaggacgagcatgggccaagggacccagcttccaggttcagccttaaggattcagaagtctcttgcttgtgtagaccttagttttctatctataaattggagtattaatgtcagttttttcagacttaaatatatgtaatgtaatgtcacacagaaccctgcatatcaaac

SEQ ID NO: 40396 - DNA, 1075 bp, Homo sapiens
tgtgtttgataatagccattctaatatgtatgagatgatgcatctttgtggttttaatttgtatttctctgatattgaacattttttcatattcttgttggctgttcatatatcttcttttgagaaatgtctatttaaattctttgcccattttaaatagggttatttctattttttgctattgagcttgttatttttttaaatatgggcattttgagtaataaatttccctctaaacactgccttcaatgtatcccatgagtcatggtggttttttatttttttaattttcattaatcttaaagtactttctaatttcccttgggatttcttctttaatccattgggtttttttgtttgtttttgtttttttttttagcagtgtgttgcttaatttccacatatttgtgaattacctaaattttgttcattggttaatttctaattttattccattgtagttggaggacattctttatatgatgtaaatcctttttaatttatggaggctggttttgtggcccaacatgtcgtctatcctgaagaatgttccatgtgcccttggaaagactgtatattctgttgttgagtggagtgttatttagatgtctgctgggtttacttaaagtgttgtttaagccttttattttcttcttgatcttctgtctccttgttcaatcgattattaaaagtgaggtattgaagtttccgattgttgttattgaattgactatttctctttgcaattctgtcagtttttacttcgtgtatttttagattttgttgttatatgtatacatgtttataattgtttttcttatttctgatgaatttattcttttatcattataaaatgttcttcttcttaaagtctactttgtccgatattaatatagcaactccagctctcttttggtaactttatgcattttattcccttcaccatccttgtattttcttgctttggttcttgaaatttgtttttcttttccgctgcaccccgctcccttggagtgctgctcaggctgcaccccgctcgctctgagctctgggctcctgctatgctaatgccgcc

SEQ ID NO: 40397 - DNA, 1047 bp, Homo sapiens
aatatctacaaaaacacctatagctaacatcacacttgatgaaaaacttaaaagctatcccactaagatgaggaacaaggcatgctctcactactgctttcaacattgtactcgaagtcctagttagtgcagtaagacaagaaaaggaaataaagagcatagtgattgggaagaaagaaataaaactgtctttgttcacagatgacatgattgtctatgtagaatatccaaaaattgacaaaaatgctcctggaaataataagcaattttaccagggtggtaggatataaggttaatacacaaaattcagttacttttcgtgtatatcatcagtgagcaagtggtatttgaaattaaaaaaaatactatttgcattagcacccccaaaagtggaatacttgggtagtaatctaacaaaacatgcacaagatttatatgagaaaaattgtaaaactttaattaaagaaatcaaagaactaaataaatggagagagattttatgtggatagaaatattctgttttcaagatgtccgttcttctgaacttcgtctatagattcaatgcagtcccaatccaaatcccagtaagttgttttgtgggtattgacaaacattttaaagtttatatggagaggcaaaaagacccagaatagccaactcaatattgattgagaacaacaaagtcacaggattgacactacctttcttcaaggcatactataaagctacagtaatcaagaaagtgtgatattagcaaaagaacagacttacagcaactgttcttattagcaaaggaacagtttacagcaaaactgtaaaacttagaggataacatgggagaaaatgtagatgaccttctgtttggcgatgacttcttagttgcaacaccaaaggcatgaaccatagacgaaataattgataatctttacttcattaaaattaaaaattttgctttgtgaaagacactataaagaatgaaaagagaagccacagactgggagaaaatatttgcaaaagacgtatcagataaaggactgttaccaaaaa

SEQ ID NO: 40398 - DNA, 1042 bp, Homo sapiens
tcaaaactaacagaatttcatggtatgttattctttttggataaaacattacatttcagcattagcattctttaaaactatgacaccagattaatttttttattttaagtaattgaaatacaagaaatacaacattgatgcttgtgtatactttcattgataacggaaatgtactgtttatcttatttttatttatctgtatatttaaagttcttgcaatgtacatttatgctttttttaaataaaatcaaaatttaaaaatagctattttaaaactatattttagaaagggttctctatttactctttttcgttcttcctgtctcatcaatgtatttattttggttaatatcaaggatatagttataaagaatttccagctatttttttttgtatttagcttggtgaattttatttgtgtgttctaaatctttttattttagaaaagctctgtagagtgtcccctgatccaaattcaggttggtttttattgagaagggtaaggaacgttcctgtccctgctgtaagagcaaagcctgtgataaggatgattattataggaagataaagaatataaggtcccactccatatttttgcatagattttgagtttgtacttgtgttcaaatggttttatctttctctctaccaatctggtgcagtaccatcctcgttctttctctgaaaactactttttttgtttaaggctgagagaagacaatttatctccatacttttcttttttgatgctaaaatttctaaagccagccctatctgagaaagcacattcatgcttgcttccttccttccttccttcccttgtttccttccttcatttccttgtttccttcctttctttcttccttcgtttccttgtttccttcctttcttcttcgtttccttgtttccttccttcatttccttatttccttccttccttcatttccttgtttccctcttgttgctcaggctgcagtgcagtggcacgatgttggctcaccacagagatcttggcaacctctgcctcctgggttcaagtgat

SEQ ID NO: 40399 - DNA, 1067 bp, Homo sapiens
acagaacaaaaaaaccaagattaagaaagtaaatattctttttcgctatgtaattaagtgaagattaaaaaataattgcaaaggccgggtgtggtggctcaggcctataatcccagcactttgggaggccgaggcgggcggatcacaaggtcaggagatcaagactgtcccggctaacacattgaaaccccttctctactaaaaatacaaaaaactagctgggcgtggtggcgggcacctgtagtcccagctacttgggaggctgaggcaggagaatggcatcaacccgggaggcggagcttgcagtgagccgagatcgcaccactgcactccagcctgggcaacaaagcgagactctgtctcaaaataaataaataaatgaataaataaaataataattgcaaaaacaattatcaataccaaaacctgtttatatttgtgtaagtagatagattgggaccaaataggtctgcctggtttgccatatgcctgagtggctttgtagtactgcagtgacgcagaaatctcattgtatacacgttatttacaaacctgtggaaatcatctgcatttgcaatattttcatccttaccctagttgaccatgtctgtattcacttgattgagatagctttttttttttcccaaaactggaaagtagtaaactaaggtaacatgttttaatgttaattgtaagtgtaataaatgataattattatttgttattttaaagtatttcagacaacttttaagaggtgcagaatcaccaacacgcaattcaaaattgaacaggtaggttgtatgttttgtttttgaacttgctgatgccagtcattctatgatagcatcattgtctttattagctatttttctgaatgaatatgtggttccattgttatatgagttcacaaggcattttactagtgaattgtagaactgtattctatatggtgatctgaaaatgcctgaaattcttttagaaaaattttaacaagatacataatgtggccttgttaatctcataatgaatatatattagttttgattaccagctttattggagactag

SEQ ID NO: 40400 - DNA, 1042 bp, Homo sapiens
gcctcaacttcctgagctcattcatcctcttgcctcagcctccgaagtagctgggactacaggtgaacaccaccatgcctggctaatttctttgtagagactgagtctcactatgttccctaggctggtcttgaactcctgggctcaagcgatcctcctgcctcagcctcccaaagtgctgggattacaggcatgagccaccacacctgacctttaatcaattttgaaaattcctggctgtcttttcaaatatcctgccccattttctcttctttaacaactccagttatatgcatgttaactcatacaggaatggcaattatattctgttgcctcacaaatcttatatcctgtattccagctttttttttttaactcccttttttcccctttatgtttcagtttgaatgattaagaagtaaaaggtaaactccttattaacacatcctgaaataaaaagaaaaagcaattggtattttggctatcataatactaccatcttttattttggaataaacattcatttgttcaaactcagttctgccactagtttgcagcgttcatgatagaaatattgtttaaaaacattgattgggactaaaaaaagtcttcatttttatttttatttagtaaatcagatctcaaaataataaaagacttttggtataataaattcaatattctttaaggaaactattagaagtgtgtttagtgttttgaattttagcaaaatttgtattggtatttatgtatttacatattttctattaatgtataaaaactggttgattgcatttctcttttattgagtagttattttattctcaaatattttttaaaaacttagatgaattagattgcttctaattgctgctgttagtattggctacaattagaatgggactgaagcttttatgaataattatatattaaaattattttttcttattcattccctcatttgttagaggaatttaatgatagaattttacgaccagaattatcaaatgatgaaatgctgtctcttcatgaagaattgcag

SEQ ID NO: 40401 - DNA, 1033 bp, Homo sapiens
attgtttctaccttttgtctgttatgtacctgttagcatttgtatacaagtttttttttgtcggatatatattttcacttatcttgggtatatacataggagtacaattgctggatcaaaaactctatgtctaacactttgagtaactgccagactattttccaaagtggctccaccatttacattcccatcagcagtgtatgaggatctcaatttctccacatccttgccagaactatttataatctcactcttttattctaaccatcctagtatatgtgacatgatattccatggtggctttgaattgcatatccctgatgccaataatgttgagaacttttatgcttatttgccatttgtctgccttctttgaagaaatgtccattcaaattccttacctgcattttaactgggttatttttttattactgagttgtaaaagttacttatatggatacatgtcctttatcagataaatgatttgcaaaatattttcttcaattttctgaattatactgtggctcttatctgcgtcactatcctggaagataaatgggtcattattatattcattttatagaaaggtattaactttgtcaaagtgttagcaaatgttaatgggcaaaagattaggccttggtcatcttattccttctacaatgttctgttcatgattctgttgcctgcataatgtaaattggaagtttgggaataatgaaaacaaagaatcatttagggtctacaattttttaaaaatcaaagtttagtgacaaacccattattttaccattttaattctgacctgaattccctaaagtggaacttacaaataaaaatcttactgagtattctcagaaaacaagattttacaaaatgtttgaaaactataacatcttgtttatttgataaatatgagagtaatttataagcgagtaccaagtggccaagggcaaatgaagagtgatgttattttcaatgaggtataatactagcaaaaatatcgcctcttactgaacatgtttgatctggg

SEQ ID NO: 40402 - DNA, 1030 bp, Homo sapiens
gtacaattaaatttttgactatactcaccctgctctatcaaatattaggtcttactctttctaagtgtatcttttagaagattatttgaaacaattttttttttttttttagacagagttttgctctgtcgcccaggctggagtacagtggcatgatctcagctcactgcaacctccgcctcccaggttcaagtgattctcctgcctcagcctctcgagtagctgggactacaggaatatgccaccacgcccggctaattttttgtatttttagtagagacagggtttcaccgtgttagccaggatggtctcgatctcctgacattgtgatccgcccacctcttcctcccaaagtgctaggattacaggtgtgagccactgcgcccggccttaaaccttatttttactttatcctataccatgtgtatttgctttgtcttcatttttttaggttaaaaaattagtgaataatttttgatccatcgatcagttttgctttctttcattttaatgcttagttatcttggtttgtagaaattagaaatgaaaagacagctatagaaaaaagtcatgttctggccatcagagaaatgcaaatcaaaacaacaatgaggtaccatctcacaccagttagaatggcaattattaaaaagtcaggcaacaacaggtgctggagaggatgtggagaaatagaaacacttttacactgctggtgggactgtaaactagttcaaccattgtggaagacagtgtggcgattcctcaaggatctagaactagaaataccatttgacccagccatcccattactgggtatatacccaaaggattataaatcatgctgctctaaagacacatgcacacatatgtttattgcggcactattcacaatagcaaagacttggaaccaacccaaatgtccatcagtgatagactggattaagaaaatgtggcacaaatacaccatggaatactatgcagccataaaaaaggatgagttcatgtcctttgtagggacatggatgaagct

SEQ ID NO: 40403 - DNA, 1033 bp, Homo sapiens
aatctagttgtatttctaagtgtgaaagtatactttcttctcagttgtagctattgatgctgtaatatccccttctgtagggttaacagtgggaagcatggttgatacaattatctttcctattctgccaagaaagttaacaacaccgtctttgagttcaagatatcatcattctttcttttcttgcctttgattagggaagtgttctaattctagggccctccaaacatcaggaaaatgaaagtaactcctcagttgaaggttgtcagaatttctgttttacaaaatgtctgagtttcagttcatttaatttctttttcaaatagagcacacatttttttgttttaacttttagaatttattttataagtattttaaactatttaaaaattttgtattaattctattgcttctccaaaattattcattgttttatttctttgaactttctttggtgttgcttagaacataatctcagtattgtaaaaataagactgtagtcgtgtatgtctgcaaggaaatatatgttacaatttagttaatagtgattatgtcttgatgctagaattatggtagatgtttgttttattttttgtacatgtctttttttctgcaatgaaatgtattatttgtaaatgaaaaaagaaagtagcttaagtaaacagaaaaaaggaaaattttcccttggattgtagaaggtgaaactgtatttctctgaacttctgaatatttgtttttctccttattgaagggatgtgacagatgatgaatcctttgttgatgaactgagaataacattacgtttttttgcatctgtcttaataagaaggattcacaaggtatatatttttaatgagaaatttgggaatttggggctttatcatttaatgaaagagatttaaaacaattttttgtgagtacatggcaaatgtacatatttgtggggtacatgagatactttgatacaggcatgtagtaagtaataatcacatcatggaaaatggggtatctatccctcaagcatttatcattt

SEQ ID NO: 40404 - DNA, 1028 bp, Homo sapiens
ccctccagttactgtgttagctctccttttatttagaaagagaattatctacatttaccaatcccacttcctcacctccatctcactcctcaatccgttgtagccttttgccattctaaaattgtttttgcctggttaatcagtgcctcttttattgtgaaaactaatggacacctctcaatttttattttacaaacatttggtcatgttgtccacttcatttctgtagtatttttttttctgtttgtttgttcgtttgtgtttgaccttgccagtttttatgactcgacccttggttttctttccaattcttctaattacttgattcctttatagatttcttttcctctgcctggttcttaaatatcttatgctcatttcttttttaactctgtagattctccctgggtcatgtcatttattcctatggcttcagtgatatttatgttgataatttctaaacctttatccttagcccatattctctccagagattgagactacccaatatttaggtgcttgtggaacatttctgtgtagcgtgttttaaaatatctgaaacttaacatgcccaaagagaactgattttttatttttctcttctgcttgcttttatgtatttatttatttagacggagtctcgctctgtcacccagccggagtgcagtggcgtgatctcagcttactgcagcctccacctcccaggttcaagcaattctcctgcctcaccttccctagtagctgggattacaggcatgcgccaccatgcccagccaatttttatttttatttttagtagagatgcggtttcaccatgttggccaggctggtctcaaactcctgacctcaagtgatctgcctgccttggcctcccagagtgttaggattacagttatgagctactgtacctggctccttctgctcacatctaatcaactacttaatcctcttgatttttcctcccagtgtctcacaaaataattcactttttaagatctctaagtctcttccctagtttaggccatcac

SEQ ID NO: 40405 - DNA, 1074 bp, Homo sapiens
cagagcagccctgaacaagcttttaatgctgatgaaagtgacctgttttggaaaaaatgtcacaaaggacatttattagtaaggaagagaaatgagcaccaggatttaaggcaggaaggtgtacgcaaattcttctattttatggatatgcagttgggttccttgtctatgaagtgtctaacccccgagctttgaaggaaaaagataagtaccagctgctagtcttgtggttgtataaggaggcctggacaacaagaatcattctttctggattaatttcattgatgctttgtccctgaagtcagaaagtaccttgccagcagggattgcctttaaaaattcttttgatactggactatgcccctggccacccagaaccccatgagttcaacatcgaagctgtggaagtggtctacttgtccccagacataatgtctctaattcagcctctaaatccaggggttcataaagaactttaaggcattacacatggtactctatggaaaggattgtcagtgctgtggaagagaactccaatagagagaacatcatgaaagtttggaaggattacaccattgaagatgcagtcattgttatagaaaaagccgtaaaagccatcagacttgaaacaataaattactagtggagaaactatgcccaggtgttgtgcgtgacctcacaggatttacaccagagccaatcaaggaaatcatgaaagagattgtggatatgacaaaaaaggtctttcagcataaggatcttacagaaattcaagagccagtagacatcacaccagaggaattaacataatataacttgataaagatgagtgctttggaaccagtgctagacagtgaggaagaagactttgaagaaacagtgccaggggccaaatgcagtggctcatgcctgtaatgccagcattttgggaggccaaggtggatggctcacttgagcccaggagttcaagcctgggtaacacggtgaaaccctgtctctacaaaaaatacaaaaaatttagctggatgtggaggtacacgtctgtagtcccagctacatggggggctgaggtgg

SEQ ID NO: 40406 - DNA, 1025 bp, Homo sapiens
ctgcttcttaacaggtaacgccgcagcgcggagcctgggcggcggcttttctccgaaggtgcagacgcccggcccgtgctgcttaaccgtgcggaggccgcgtagctgcgggactggggaccagtggggagagcgagctccgcagaggagcggcctcggggagcacggcggagcgtcgaggccggaagcacaggccggtggggtggggttgattgcctcctttcccgaggcttcgtctcctgagctacctttttctcatccatttctcaaaacgagttcttcatcttcgttgcttttcaaaagtgaaatccgtgtgtcggctcaaattgagactgtacacaggcagtcaagtcagctgacggaggagtgttcaaggtccagttcgtagccgcaattttaggcagaatccgcacacctgcagcgcgttcttccatctccccacctcccaccccctcagcttgcagctgaagcttttcccgcagtattgttgaataaaacagacgatcataaagatttgttggacagaaatcagaaagcaaagtggtacccgtcccaacatccttagaattttttatttttgagacggagtctcgctctgtcacccaggctggagtgcagtggtgcggtctcggctcaccgcaagctcctcctcccgggttcacgccattctcctgcctcagcctcccgagtagctggggctacaggcgcccgccaccacgccaccacgctaccacgctaatttttttgtattttttttttttttttttagtagagacggggtttcaccgttttagccaggatggtctcgatctcctgacctcgtgagccgcctgcctcggcctcccgaagtgctgggattacaggcgtgagccaccgcacccggccacatccctataatattcttaagaggacttgatgccaccctccccaaaaaaacctgaaatattccgaaaggttaaaattgataaattcaattgacattttgaaatcagaagattctgcccccgaaataaacttgttttact

SEQ ID NO: 40407 - DNA, 1051 bp, Homo sapiens
tgtataggagcatattctattgcagaagaccttcctatgaagatcatggaatcaaatacgggacattgaactaatacttggactttgatatgaatttctttaacaattttctctgcagtgcaagttattaaactaaagctactctattttcaaaatgtgttccaacagaaatccttcataactcctagcatggtatcttaataaagaataaagttcttttaaaaatctgctctaagtagatttttccccttttttaaattaaggatcccaacagtggtattttgaaatattctcttgaatttgtgcatttaaattttattgcagtggtatagatgaatgccactgatggtatccttaaattttatttctgctcaccaaggttaatcatgattgtctatatcttttttatagtgatcacttttgaattgtgttcagatatgcagtttcaggtgtaatcatcagagctggttagtcaggcattccagatagtggttcttttcagaacctttttaaaagggttggttaactacctcagtagcagaggattgaactataccctgtctgtactgtacatagaaaatctttgtagataaaagcaaggcttgttaaatatgatatgagggtaagattttaatataccaaatgtaacattcttagttgcctttagtttcagaggcttgtaagacttcctcatgaccatcataacaggccttgcttttgtcgtattttgtggctgaaaaagcagccttgcttcttcagatattgtagttatttggatgtataatagtttagcaagatgttacttttgtaagacatcagatgttcaaaaaagtgcatccgaacttgtactaaatactgcagtgtccctttataaaaagtcagactaaaactgacaattgtacagcgaagcctgacatttggatattttgaagttttttcataaatcatagaaattagtatatggctgtagtttagctttttaggtaaaaggtatgtttcattagtgcatttcttcctgctgatcactgtaaacatgtgaatcagctttcca

SEQ ID NO: 40408 - DNA, 1240 bp, Homo sapiens
cgatggatggattttgaaaatgaaatgagtattaaaattataacacagtagtgcaataagaaaacaagtaggtgtgtaatgagttatactaattagggagacctttttagagaatctgtaaataggtatctgcttaagactgaaggaaacttagttgggtaagaattgaagttagctcctaaaaagttagttactgatttcctagaagaggggtaattgttcttgaatgtgagagcaataatcactgtcaatactattcaaggttaattttctgttgattgccctgtttggaatttaaaggaagaggatgcttctacatatttctgttacttcataatcagggaattgatcaagttctagtttctgcagttaattgtccagttggacaagttggcaagctctgaacctcaatttcttcagttctaaaatgggatcagacaaaattatgtaatagctctggattatgtgattatccaagtgacccatgcttgttctgggaccaaagaaaatatactttgtaggtttgatgatagtgtaaatgaaggaagactacaaaaagagttagttttaatgctctatatttcaaacacctggatatactaaacagtgtaaaataacttctttttatttctttcagaagacgatatatggttaatttattaaagtagaatgtaagtataggagattatattagataatgtgattagagcagttacatttggtacttgatagagggagatactaaatagaaggtggaggatgtcagtatatctgttaatatttgaaaaggagtacaaactaaaagggatgattgcatgttactttcgtactttaacttgctacagtctttttttttttttttttaagttttaactaagcacgtattcctacataattctcactgtattcctgtgagttaggtactctatcccttagtttgaaatgaggaaactgaggctcagaagtcaacttccttggggtcattcacatagtaagtagtggagttggatttgaactaaggtagtctagtctcccataattttccctcttaaccactataccaggatttctcatctctgtcctcctgacattttgggctggataattcttggtcttgggggctgccctgtgcgttgtaggacttttagcagcatccttggcctcttcctgctagatgccagtagcaccccctttctcagttatgaccgtctaaaatgtccccctggaaagaggtggtggc

SEQ ID NO: 40409 - DNA, 1028 bp, Homo sapiens
gcgtttcactgtgttgcccaggctggtctcgaactcctgagcttaggcaattcgcccgcctcagcctcccaaaatgctaggagtacaggcatgagccaccgcgcctggcccaagttttttaattgaaaaaatgtgggtagggaggaatcagcagtttattttatagatcctgctaaatctttgtgttatttatgttgttcagagaccacatccatcctttgtactttctacctaccatgccttggctaacttgattagcatcagggctagtgatgatgggtaagaaggaaaaaaatggtgtttctgtagataataatggaaacagttattaataatttgaagcagcattgttaatgttgatggttaatggaagtgttgcctatgttacagattagctgtcttctctatatttctttgattattgttgccttgatggaatgtttccattctctgttgtcttgcctttgcctcctacatttcttataaggattttggttcctctcaatggtgtattttcttggtagaactaagaattcaagtttctgttagaagtttttttagaattaggtattttcttatagttaatagctcctgattttagaacatttggaaaataccagttccccccctcattataccaaaatctgtcacccccaaaatcactcctgtttttgcctttacacacttggtatttctttccacctttttctggtattttaattgtttttgttaattactagaattactgattgcatgaccaatttgaaaaccactgatttgttgctaaggctggctacttgatgctagattataagaatccagggaatgtacatattttaaagtaatttattgtgttcttagtttaattttacttgcaaaataaggcattataatctacttgtccataattctgtgcaatgatggattcagccatagctctgctacattcaggtaacatgtttctgctgttaaaagattattagtctggtagaagagaaagacatgaatgctatatgagaaaacaaagt

SEQ ID NO: 40410 - DNA, 1173 bp, Homo sapiens
ttttttttgtatttttagtttgttgaccaggctggtctcaaactccaaaccttcagtgatccatttgcttcggcctcatgaacagccattttgatgaatgtagttgacaaggtaggttcagagatattttaataataatttagcaaatagtgtgtttagcatgaaaacttttacttcagatatacaggttcttagagagtttatagaacatgaaagactactgttacagtggaatccagtggtgcaaagcgtaaaggaaggatgaagggagactggattagggttgtcagagaaggctttgcaataaagaggtttgagcagcacagtgaagaaaaaaggtgaatctagttgaagcagtgttttgtggaaataaaacttgtaataaagtcagtgccaggagttagttcatactgggctaagctgcatagcaccccccaccccctttttgagccctgatgtgggtggcatgttgtaagtggctgaataatgaagattatttgaataaagacaataaaggccaggaggagggtggcagcaatagaaaggagaaagatcggagattttggaaagagaaatgaaaggccatagtggtatgctgtaggttgtattctagtttttatcaagaattgaaagtgtagttggactgttcatgatacgtttggtaacttgaatctccattcagtgataaatgccttggatgaccgtcaggatctgaaaaacttttgatagcctgagatagaaagtttatatctaccaagatggaattgactaaagttaagtatttacactagtttaacaagctgtggtgtcagtaatgtgtggttgccaaataacctagggtaacacagacaatatgtaagagtggtatggtgtctagaagtggaaaattagtaataagctccagtttattctagactcctgtttcagtctgcgtttacagtattgtgttagaatgtcactcttcagtgacacttgtcagtatttcttggaggtactttagtttgccattatcagggaagcaatgattagccaagcatagaaaacaactgagtcatgtgcttgtgtgccaggtatatgaaatgctgtcatttgggggaaagaaataggtttatttaaggaagtagattttggcttattgtaaagaagactttataattaagaaatctttaggcc

SEQ ID NO: 40411 - DNA, 1053 bp, Homo sapiens
gattacaggcatttatcaccacacctggctaaattttgtatttttagtagagacagggtttcaccatgttggccaggctggtcatgaactcttgacctcagaagatatgcctgcctcagccccgcaaagtgctgggattgcagacgtgtgccactgcacccggccaagtcttccttttctatgttgtgtgaatattccccactggtttgcataattgagtatgatggaagttaaacagtacaaaattatgttacttgaaagaatataagcctttacaaagagaatttgagaatttagatattttcaaatcatgtctgatttttctcttcataaaagagtgctttgtgttttagagggaattcagatttactggtaacctttgagttgtcaaaattttagtttcagcagttcaatttgaggggaggggcattttagagctctagaaagaggtaccttagaaatcctttagtttgtttttatgatttgttttttgagacaaagtctctgtcacccacgctggagtgtgtgggcatgatcttggctcactgtaatctctgcctcctgggctcaggcaattctcctgcctcagccacccgagtagctgggataataggcgcgtaccaccacacctgactaatttttgtatatttggtagagatggggttatgttggccaggccggtcttgaactccagacctcaagtaatctgcccgccttggcctcccaaagtgctgggatgacaggcatgagccactgtgcctggcaggttggtcttgaactcatggtctcaagcagtcctcctacctcggcttcccaaagtgcaaggattactggcatgagccaccttgcctgtcccaaaatcctttaatctcctataaaagagtagaatatttttgccaagtagcaataaagtagcagtaagtgaaaatgcagaatgatccagtaagcaatgaggtatcataactacagaaagctaatacagtgggctctctctactgtgggtcctgcattcacagtttcagctagctgaggattgaagatactcccaaaaaa

SEQ ID NO: 40412 - DNA, 1038 bp, Homo sapiens
agcctatacttctttctatactttgcctagaataaggaataaacacctaatgctctgagtaaatatgagttgtgtaaattttaacagttactttttgggagttaaaatgtagaggttatgtaacgttgcagtttcataaagtttttaaaagtcgttttggctgttacttttttctgaaggacccatgctatcccatgaaatatggcacgtaaatgtcaaataataataggagattttttttccctgtagctcccaagtttctagacttggtatgggaagtgtaatttcttctgaggttggcacaatgcccagaatggcagtatgtacctaggagtggggtttatagggaatttattgggtgagagatccagatttgaaagatgctcaaccaaattaggtacaatcattttttaagatggtattaacatagtaatacatcctgtcttgaaagttgctgatggattggtcttaactttttgttgtccattaagcacactattcagtaattaagtggagactagaaagtaatttgaacaggaccctggacttctgataataatttaggagtataacaagtacacatttaaggggaaattttaaaacagacatcacaaacctgtttttataagggaacatgccaagataattggaaagatttgagcaagatggatgttaactgctaaatatatgggtgtggtctagtgaattaaatgtattaatgacgtttgaacttttcaaggcactcttggaaagaacaggctacacacttgatgtgaccactggacagaggaagtatggaggaccacctccagattccgtttattcaggtcagcagccttctgttggcactgaggtaaagcaactaaaaacttgtaccttttgtagtaaaagcacaggtatctggtttcctaaagcaattctccatggtttttacttaatatttaatttacagatatttgtgggaaagatcccaagagatctatttgaggatgaacttgttccattatttgagaaagctggacctatatgggatcttcg

SEQ ID NO: 40413 - DNA, 1115 bp, Homo sapiens
aaggcacttcagaatatgcaaaaaatgtatcatttgaaggcaataatttacaaatatgcattacttcactgagatcaggaaacttttgtccttgcctcctgtagtgaatataactgatgtacaaaaatgtgtacatttaaaaagtatacaatttgatgggtttttcataggaatatactcatgaaaccatcaacataatcaagataatgactatatccatcactcccaaaaatattctattgttggcttgattttgaacatgttaagtttaaatagcacatgttattcaaattgggatttttgagtaggcagttagatatagaggtccacagttcagaggagaggtctgactaaaataaaattgggagttaacatatggaaggcatatttaaagccataagattagatgagatcaccaatagagaaaaaagtccaagagttgaaccctgtggcctttcaggattaggacattccaggtttattcaaatcctagagaataatttgtgccaagggacaaaaatcaggacgcaggaatctgctgccaagttcaagggccatatttgttaggaacagaaactaagtagaaaaccaaggatgcctggaatgaaatgagccaagaaaaaaggataagaaccaagcaaaacttgctggaaattgccttggatttaatatagaccattggtcaacatgaaaactgaagatagtgtctgatcatgactttgcaaagtaacagacgaagtgatcttcaggagagaataagatgaggaatttaggaagtatgataaggctttttcatcagacactgcagattgggagaaaatggagctgaccatggacaagttataaatttgcctagcattgataaagtatcagctgaggctgaaaaccaccaattttaacaaaaatcagcatatttcttcagtattgtgtggtgcttatctccttgggagcagaaagcagagactggattaatccaaaatcagggataaactgaccaggaggagcagaggaataatgggccaagagtactgaggatgcaagtaaaagtgctcaaattactgtattgaccttgtaatcccaagctgatcggggaaggaaaaaaaaaaaacaggaga

SEQ ID NO: 40414 - DNA, 1361 bp, Homo sapiens
ctctgaagatgcaaaggtaagagcttagttaagcttagtttccaaactaaaggagtaaacctgttgatttacaggaataggaactgttgcatcgtttgaaatttacttttttttgttagatacacgaaaaaacttccagaacatctgggagaatatttaatggaaaatcgcttggttaaaacctgacacttttaacaggtatgtgttgttttagtactttatgattgagcatagcatttaatccacacctagactaaatcaaattttttttgtcagtgaacagcgttctgagtgtggacgagtagccagtgaagataatgaatgtcgaatgtgactgactagcagcttcattttgaagtaggttgtatggcttaaaagttctgtagtatttgtactataatacttgccttttagcattaccttggtttgtagtcagtgtcacagaagtgcagtttaatgtattatgtgtacatatacaaggtctgattggtctaatcaatgatgaaacctatcccgaagctgataacctgaagaaaaataagtacggattcggcttctgagattaagaccagtaattcagaggtggagtaaattttgttgccgtgattttataacagttgtgttataaaatcctgggttttttttttttctgccaacagtgagggtcgctgtctgcccattgatagaggccagattgtcttggaagttccaaagttgcaacgatttctgtaagtggagtttttctgtttgcttagagatcagtgaatattgtgtccttggtcttatctgtgatgatcttatcccgaacctgaacttctgttgaaaaaaaaaaacttttacggatctggcttctgagatggaccgttataaggacaatatttttttttaatacttttaatgcttttacatatgttgtaatgtttgtagtcttgtaagaatctcgtgtttttccttttctagggctagtgccacgaggtttacttgactgttgtgtgaaaagctgataagaaaaccatccagaaaaaagctcttcgttttacaaacatgaaaataaaacatgtaattttggattatgttcctttttgttattacttttaaataggtcctgaaataacatggggagcattaaatggaaaatccactaaccagccttgtaatcaaattactgtgagtgaatgtttcgggtttgtgcagggtacaatgtaagggtttttggatcagtgtaagagtggagagacaggaattagaagtaattgttactaagcaaatcatggaatatttagttttgatgtaactataattttgaaagcctggatgcttaagttgagaaatgggggaatgagatacagaaaataaggagc

SEQ ID NO: 40415 - DNA, 1030 bp, Homo sapiens
agtgcttgtccctacacatacaacgccagacttccgtggattgttgatgttagtgattttgtgttgtctttcctccctgtttggttattagctttatgtattatgttttctaaggtactctcgacccacctcatgatcctactccatagctcctaacctgttaaagcagagaaagaacttgaggttataggggaaaaaaagatacttagctggtaacattaacaacctaaagcagcaggatctgacttgatagtggcagttccagaaaaaaggaaagggctttctgaagactaatttcctccattttcagaagtcttttttcatttacttttgggtttttggccggactgagatggtcaaggataacagaagtagttaactgcaagtatgaatagggactgagtctgaacttagttgaacaatgctatacatttactggaaaaacagctgacataaaactaaatataagcaagaagatcaagtttaatgggaataaaactgagaaagcaagataaactagactggtgtctaaagtttgatgttttcgaaaaatatgacaaaagaataaaacaatgctttcatgatttacctgcaaatcctgagcacaatacagcaatagctatagcgccaaaccctaataatggattttgttccacctgcaatattaattgttaaagttatttttagtgactaataaacagagttcatccaagagtccaaacaaataaatacaaaaacctgttacagtcttactaaaagtatattccacatcagacacagctattctacagaataagacaactaaacaaaaagaccattccagaaattaaccagggcacttggcttaagtgaaaaatgtgtccctcaaatcacagccatagtatatgcttaatataatatgtgcccactgtttcctaataccaataagcactctagcatgaacttttgaacaggccaagtcagcatactacttaattttaatttctattatcactctaatttaagagcttatagcatcaatcctgaaaat

SEQ ID NO: 40416 - DNA, 1086 bp, Homo sapiens
gtgtattatcttagtcctcagaataaccctgtcgaaaaatatactgttacctccactgtgtatggatattaaggagaccaaaattgtgtattataaggtcatgttcatcacttgcagctctgtgcccttgtatgactttttaatcttttgatgtttttaactttaaacttttgataagtttggaagagacttttggatgtgggtacctgaatgacttcaacactgcttgtttacaagagccacagtctgtttcaattcttcagcatcttctcaggtatgatgttttccagggatcatcaagtgtgcttctgcttatcaaaatggctattagcatttttgctgcccagtagagtcaacagtccagtagctgccttctgcctctagacttttcccaaaggtatgccttaaaaagtgattatttgcattttgaggacagagggcatagattaagccaatgcccaaggaggacagtctttgggtcttcagaatattatcactgatgaatagcgcacatgtctagctgcctctagctcacataaagccttataaaagcataaccttttttagttttagtttgagaaagagcatcttcttgctctctgtggtaagtgaaggaaaatacctgcctttgtgcagcttcccagagaccgtaagtccttcatttgcctcttggtttcggttcacaatctcaaatacatatatgtatgtgatgctcccatgctaggcaagacacccacacattttagctctgacgggcattgttggtgaagccaaacatgccagagattagtctctagaagggatgtggatggttatgaacaaggtggttttctttgattgccatatagtagtcagtggttctttcctggaatcagaaaaatttactcacatgtacaatagggaatgtacggaaaaataagccaactgggttttcttagcattgagggtagactttgctaatttatattttatattcttaaacatggctggaggctttttacattcaccagccatgatttaagtttttgctgtggactaggtctaggaaatagcaagatgatttagaaagtccctgccatcaaagaa

SEQ ID NO: 40417 - DNA, 1076 bp, Homo sapiens
tggtcatacaggaaagacaaaaatctgtagttttaatacttgggtactttgtggcatgttaaaaattatcccaatattgaatgttataataccatgaattagaaggagaatgtgtgacatttcatagttacaatgcagctgcatctcatttttcaactgggtatattaaagaatttatctctgagtaccttatccagagctacagatttaaaagctaagataaccaaatattaattacatcatacccattcataagagattcttggtcatattcttgtttttttccattgttgattaaagcttgaattggcactgctcattgcaacgtgggtaataaaaatagcttctggtttgctaatgttttagatattaaaattttaaaggtctgaatttattatgttgcttcagagttaccttttcgaatttctagaaaaggaacggctgtagtagatctctctgggaatggcgacccctcctcaatttgtactgtaatgcgaagtgatgggacttctctctatgcaaccaggtttgtagcctctgtgagggtcaacatttggttctaaatctgttgctttcagatgaaacactatgtacaattaattatgcattatcggattccacagctgatgacattattctataaactgtaaaactgaagtacttcataatcaactaaaagtattttacaatggcacgttggcaggaaatgtatactaaaagatgaccatattagctcaggggtttccttatgctgtaaagaacatcttacatgcacataaataccagaactcattgggatttggtaaagcaggctgagggagaaagcagccatgtcacatttttttttcccatccatctctgtgactgacctttgtggaagggccaatctctgttcatcagtaagaagtgggtttatcagcacctttatttctgggacaaagctaataggaaagagaagcactgctggcaaaagtgtctcccaggccagaattttatattaggtcacaaatcacttttgtaacacaaagtcatgatactttgttgttttatattaactaccataatttgttccaaac

SEQ ID NO: 40418 - DNA, 1026 bp, Homo sapiens
cccaactaattttttgattttttatagagacagggtctccctatgttgcccaggctggtctcaaactcttgggctcaaacagtcctcctgcctcaaactcccaaagtgctgggattataggtgtgagccaccacacccaacctattttttaattttttaaataacaatagggtcttgctatgctgtccaggcaggtctcaaactcctagcttcaagtgatcctcccacctcagcctcccaaagtattggaattacagacatgagccactgtgcctagccatatataggtgtaggttttgtgggtttttttgtggaggtgaagtctcactgttgctgaggctgtacaatattttaaatatttcaggggaatctgtcttcaaactccacagaaacctaagaatatatttctttctatgcagtttaatataatttcctgcctttagagactcaaaaatagtggaagatcaacatctatgttagaggttatttactgatgggtacacatatggaaggaataagggcaataaggtacttctgtgaataactaaaaagtcgaataataatggtgttgctttcattagtgttcttttgccgaatagattcactgggaaactgcatttaaagacaaaagaaggcaagatacacccactttgctatttgtaatagacgacaagaccattagagtattcagttgctcttttccttctccttttgcaggacagaaaatatgcaaagcctaaaatggcagcctacaggttattatatatgcaaattttatagactctgttttcattttaaaattacatttgtcactttggattactttcaaaaacaactgttagcataaatgaggaatttttttgagctttaagcaaatgttgatgttattctgtttctaaaagaaaatctgaatgtcaacaactcaatttatttaataattgaaagatgcctttgcttgccctgcaatgtcacaaatagcgtaggtggtaatacagagactctgccccatcgttatttctggtcacc

SEQ ID NO: 40419 - DNA, 1046 bp, Homo sapiens
gttttaatgcttaaataacaaaatagcaaaaaacaaaaagtttaaatttatatgagcctcctgccaattcaggaaatggatgacattggttacactgttttgtggaaacacaaaattgatttcaaaaccaaaagattcactgagaaactaattttaactgctatatatgttatgatttttaactttctaaaaataagtataaatatggggaagacctgaaagatgcaaaagtaaaaatagttatgtggggatgtataacctttcagatttttttgttcatttattttgtggtttttttgtcacttaggctggagtgcagtggcgcaatcttggctcactgcaacctctgcctcccaggttcaaaggattctcctgcctcagcctcccaagttgctgggattacaggcgtgcgccaccatgcctggctaatttttgtatttttagtagagacaaggtttctacttaataacaatttttgtcaaaattaaaaaacacgaataacaatttttgttaaaaattcacctcggtcatgtgagcacttagtggaatgttcaagactggaagttaaaacaagactatttctggccgggcatagtggctcacacctgtaatcctagcactttgggaggctgaagcaggcagatcatttaaggtcaggagttcgcgaccagcctggccaacatggtgaaaccccatctttactaaaaatacaaaaaatcagctggtgtgatggtgtgcacctgtaatcccagctactcaggaggctgaggtgggagaatcgcttgaacccgggaggcagaggttgcagtgagctgcgcaccactgcactacagcctgggtgacagagctaggttctgtctcaaaaaaaaaaagaaaagaaaaaagactatttcaataaatagagattactatatagtacttcatagttgtaatgcttcagtgtataatatacttacgattttcatttaacacatgtcatacagcaggtcaatttaaaaactgaaattaaaattatataatattagaattggaagggactttggagt

SEQ ID NO: 40420 - DNA, 1033 bp, Homo sapiens
gaaaagtgtgtcctctagttctcttagtcccttgtttgcttctatgatgacaataataagagtaattgttttgttttacttgttttagtgtctgtttcctctataagcttcatgaagacagaacatgtcttattcactcttatttcctcagcaccagcaaagtgcccgaaacataagtgtttaatgtgtatttgaagaatgaatacctgagtatctctgttgtgatctcatataaaatatgcagcttcactgaatgagttcataattttaaatctatggagatgacgtggtgtggtggctaaaggaactccatcttggatgctaatctgccatgttgacttttgattatccccagttccaggaatacctgtaagatttctattttatctactgtttatagtacttaagggcaggatttctattttatttactgtttatagtacttaaggacaggatttataattcttgcccttaagcaaatgataggctatgacatagcattcttgattttttctaaggggttgacttcggttgtcttagacatcccttctgaagcatggttaccccttctctatggtatataccatagagaagccctgggtcttggggtagataactgcacaaggattcatcatcttgtctcttagcttcctgagatatgacttctgttcataaatccatattaaatgtttctttctgagaagctgggtttgtcagctgctttcttcagtctctcagcatcctcagtcttttgagggtagatttgtatagacctgcttaccatggagcacttaataatggtgggaaggattagaattctagcttcactatttgtgtaactaactcttggcaagtcagctgtaagatgatggttttgattccaagtttacaggattgctgcaaggattaataatgatgttgaagattataataactactatttatgggatacctcacttgtacggtgccgtattttgctttgctttatagggctattaataaaatgtaatgagataaagataacagtgcttaa

SEQ ID NO: 40421 - DNA, 1050 bp, Homo sapiens
tcaaaaagagaattcaacaaaattactgagaatgtatggaggaaataggcagcataactttgcaagtcttttggttacttaaatacctaggggcaaaattgggaatcaagatctagtattcgtttggattttgacctgtattttgcactaattttctttttctcaccctttagatgtttcatgaatcacgtatcctgcatttgtgggctgccttgttccttgttgagttgttgcaagaggtcccaattatgacatgcagcaatgccaataccccttctgtgaatacaggttatttcaagctttcgtcagtggcaaccactcttaggcagcagcaactggttttggaaatttccctgatgtcagtaccacctggatgtggacctttgctacctgtattaataccagtggcctcattttgctgtatcattacaatttggcttcttatattaatgtttgaaaaggattaaagctggtattctagaacatgcccttcactggttgtgtaaataaaactgtagaatgacacttcagatgaagttagtgtgattttaattgtgcactacaaccgagctgtaaccagttactaattttagaatgtaatcccaggacaatattaagcaaatagcctgcagtgcttcctgtgaaatagtgaaggaggagggcatttctgtattccaggacttcttggggtttcagaatgggtttgtatgattttttttttttttgtagttttatttattctatcagtctttttaacaaatgtttattgctgcatttttttttttccagtgtatcattgttttactgcccttgtagtactggaatttagttggaagaataaaacatttacttctattttgcttgtttcttaatgtacagatggggttagtatttgaataaagttggtgttttaaaacgtaagcattttccaggaatcagtgaagttaattttctaagatttgagtgctgtttcaaaacactgagttctgattctaaatgccttcttctgctgggcgcggtggctcatgcctgtaatcccagcactttggg

SEQ ID NO: 40422 - DNA, 1749 bp, Homo sapiens
atttatgtaaatggtatctttaactggatatgtcttgccacttttttttcagtttaaataatgaaacaggcagtatctaaaatgtttaaggaacttatttgtcctcccagagtctctcaaaaattctaaaagttcttctcctagggaaataaagtgagaaaataagtgacaggattttgtagatatggtggttatctacgaaaaccaccagtattaaattttaaaaagaattattgtatgtaaatctttagctttcttttttgtgtgtcataaagacacggtccctctatgttgcccaggctggtctcgaactcttggcctctagtgatcctcccaccttgacctcccaaagtgccagggttacaggtgttgagccaccacacttgaccaatatctaacagttcttaaattaatgcatcattgtagaattgaatgttaaggctacactccactctatcagtctttttattgccacctaaaaatttcatttttgtttaatcttgctttggattttggttagtaaacttctagggatgtagtttcacattgataacctgttaacttgggagctatggagtatggaggtgtagtgaggaagtctggaaggggagtggaaacccctaggcagggattttctggaggggccagatggtaattattttgagttagaaatctttctgaaatgaatcatagtggcctaaaggatgtgccagatataattttactcatttgtgtgattgtggttcaagataattgcactgtggtatagtggttcttatttattgaggacctgtcatgtaccaatcactttacatggtctccccctcaccctaccctccagccccaagattcagaatgctgtagtattcttaggttttattgagcttaaaataattggccatggccatttaatgtatgatgactttttaagttcccatctactttgtcattttgttgacctattatcacttcagactgttgtgtgcttgaatatacataatctcccaagccccttcttatttatgggcttggaaaaggcataaaggcagtaaaggcagttggaaaagcctgttagtgtaatagttctatgtgatgaataaatgagctttaagtttggaactcttaagaatctgagtaaaataggtgttttggttcacagactccttgaccattattttgactgaaaaactttatttttgctagtcagtgctcagcaagaatattgttgaacagctgaattccagttggtgtgtatgtgctaagtgaatgtccccatttatgctgaaatgagttcctaccaaaatgtcagttttctggatattatttgaaaggagtattttgggtagattggtctactaaataatgttggaaagccaacctcttttttaatgtgaaagtttttatcttgccaaattttaacttttttattttagaacaaattctgtacaacataaaacaagagtataaacgaatgcagaagagaagacatttagaaacgagtttccaacagacagatccgtgttgtacttctgatgcacagccacatgcatttctcctcagtggaccagcttcaccaggtaataacatttcttgtcatttacaaagtttattatttagagtgggaaaagtctaatccaagttgtctttagtcatttaagctactgtatctcctctgagttttaaaaaaacatttatacaagtaatgcatgacatcttaaaaaataatatggtacaaaataaggagttacc

SEQ ID NO: 40423 - DNA, 1044 bp, Homo sapiens
tataattttttttttttttttcttctgagacggagtctcactctgtcacccaggctggagtgcagtggcacaatctcggctcactgcaacctctgcctcccgagttcaagtgattctcctgcctcagcctcccgagtagctgagattacaggctcgcaccaccacgcctggctaattttttgtatttttagtagagctgtggtttcgccatgttggccagactggtcttgaactcctgacctcaggcagtccgcccacttcagcctcccacagtactgggattacaggcatgagccactgcacctggccagaagccaatacatttgttttgtgatttttttgttgttgttacatagttttctgattttttttttcacatttgtttcttggctccatgtgttatttttcttctatccgtttgagagttgtgagttaaaactcctttccacctgcttatatgacatatttttatgttttgaaaaataaggatttttcagagtagactaaggctaaatagaatatgcaagatacttaatactgaagatgttcagtcatcatatcaacatcttttttttgagacagagtctcactctgttacccaggctggagtgcagtggcacaatcacaactcactgcagcttactgcagcgttggcctctcaggctcaggtgatcctctcacctgagtctcccaggtagctggaactacaggtgcatgctacatgcctggctaattttttgtggagatggggtttcaccatgttgtccaggctggtctcaaactcctggactcaaatgatccacccatctcagcctccgaaagtgccgggattacaggtgtgagccaccatgcctggccaccacaatatcaacatttttaaatgaaaaatcttatcttagttaccatagcattagcacctctttaaataactccattaatttaacctaaatctaaacgttctctaaagttcatcattaggatcttgaattatggaacctcttgacttttctagttccttaaataatgacaagtattcaagtacat

SEQ ID NO: 40424 - DNA, 1042 bp, Homo sapiens
ttggactcctggagtcaagcaatcctcctgcttcagtctgtcgaggtactaggactataggcacacacaaccacacttggctcccattattttctgaaatataaaattatttattttctggttactatctcatagtgtgaaagataagaataattacacagttattacttttctcacagcatccatctaatatattttatagtatatctatattatatctattattcaaattttgataattatacaaccttatttataagaaggagtattttataaataatgcttttttttctttgtaggttacttcctcagaatgttggcctcctgtatgttggaggttatgaaagaccctttgcacaaatcaaggtatgtttgttcattttcagtgtacttttcctggatgttctcttatctagaatccatcaaaaccttgctaataataatcaacatataaaaatatcgtgttccagcactttgggaggctaagacaggtggatcacttgagcccaggaggttgagaccatgctgggaaccctgtctctacaaaaagaaaaattttttgtcattagccaagttcagtggcatgtgcctatagtcccagctactctggaggctgaggtgggaagatcacttaagccccatgagtttgaggctgcagtgagccgtgatcacaccactgtactccagcctgggtgacagagtgagaccctgtctcaaaaaaaaaaaaaaaaaaaaaaaagtgaatgtgaggtgataatttcataagcttttgcatatttctgctgaagaaatctttcagcttttcaaaggaattgattattttaatattcttgccatagtaaaattgactttgaccgaaacagttcagtgattcatttagaagagtacatttagagattaatctttgagatcatcccttttgccattaaaaaaatgtttacaagtcgggtacggtggctcatgcctgcactaccagtgctttttgaggccgaggtgggagggtcagggctggaagattgcttgggcccagaagttcgagact

SEQ ID NO: 40425 - DNA, 1128 bp, Homo sapiens
tgcaaaggacatgatttccttcttttttatggctgcgtagtattccatggtgtatgtgtaccacattttctttatcgaatccactgttgatgggcacctatgtcgattccatgtcattgttattgtgaatagtgccacgatgaacaagtgagtgcatgtgtctttttggtaaaacaatgtcttttctttagatatatacccagtaaggggattgctgggtcaaatgatgattctgttttaagttctttcagaaatctccaaactattttccatgatggtcaaactaatttacgttctcatcaacagtgtacaagtgttccattttctctgcagcctaaccagcatctcataccagtcagaatggctattactaaaaagtcatttcatttcttttttttaaaaattttactttaagttccggaatgcgtgtgcagaacgtgcaggtttgttacataggtatatgtgtgccatggtagtttgcagcacctattgacccatccttgcctacgttccctcccctcgtcctccacccctcaacaggccttggtgtgtgttgttcccctccttgtgtccatgtgttctcattgttcaccttccacttatgagtgagaacatgcagtgtttggttttctgttcctgtgttagtttgctgagggtgatggcttccagcttcatccatgtccctgcaaaggacatgatctcattcatttttatggctgcatcttattcttattcttttcttttttctctttctttcctttcttgtttttttgtttttttgagacagggtgtctgttacccaggctggagtgcagtgatttgatcacagctcactgcagccttgacctcccagactcaagtgatcctctttacctcagcctctcgagtagctgggaccacaggtgtgtgctactatgcttggctaattttttaattttttgtagagacgaggtcttactatgttgtccatgctggtctcaaattctgggctcaagcgattctcctgcctcggcccccccaaagtgctaggattaaaggcatgagccaccatgcctgatcccgttttcattttttgatcgcttttaattctgctgttccctttctgagcaggtgtaaactctagagtag

SEQ ID NO: 40426 - DNA, 1043 bp, Homo sapiens
aaacagattcttctgcaggtcatctacagcatcaggtttagataagattgaaaacagacttgggttccagtttgtctccatcagttccagtttgttctcaggcattgcagtttgtcctattttatgtccaggctttcttcccaactgtctgccctgctgtcatagactttaggctcaccatcaaacacggggatacaggcttttatagacttcttcacaagctcccattaatggtctctggttagaagtatttttctgatcctccaactatctccttcaggatctttactccctcgcttctaccacagtagtataaggcctaactcttataataaactcctgattctatatcactggatggttctgcttcctagattaaagcgtaagtggtatattgagctgacagatttgagaaagaggagccatgattaattccatagggaagaatgtgggatgagtggtttgggaaaaaggttgaggtttataattgttcacagccatttgagatttatatgatgtatgtatgtgcaggacggactgataattaaatgggaatgtgatagatatcaccattcctgcttctttcaaattttgatgcccaccccctgccccaacacaatattgcttttggattactattttgccaggcaaaggaagttcctagagcttttctttatctctttctactataatgacccttaacccatgtgtaagagagtgcctatggggattctgccggttattaagtatgtctattccaattatacattcaggaataggagaaagtaccacagggtgagtctgtggactgactgggtctgctatgggtcaaacttgtgttaagacttcacccatcacctgatttctttaagtcttcactttgatgtgttgtgtcatagtagcgtgttgtgccccaagagttggcatcacttccctggaatcagtatagagtatttctgaaaggtctggatattaatttttctccatgacataatcattctagtacaggggtgcccaacccccaggccagaccagtataggtc

SEQ ID NO: 40427 - DNA, 1037 bp, Homo sapiens
tattgctacttctagtacactgccacattattgatttattttattgattcaacaatcctgttgaattctgttagttctcatcattgtctaattttacacattgaccaggacctctagtattgaattaagtattagttctagttagataagggagaagacatttataccttcttctcaacctcaaagggaatgtaactaaattttctccattaagtatgtttgtggtagatttctgttagatatcctttattgtgttaagaaatttctgattctgttcttccaataattctttttaaaatcataaacaggttttgggctttaacaccttttaaagcattaattttaaggcagtaatgcctcttcggtatctactaaggttatcatgtcattttcatttttacaccatttatgtagtaaattacactgatttttctcatgttgacccatccttgcattcctgggataaatgctacttgatcatgatatatataattttttaagcatacttttggatctaggtataattgcttcttgaggatttctgccaccttatttcttacagttcatttttctctctttttttttttttgagacagggtctcactttgttgcccaggctggtgtgcagtggcacaaacatggcttactgcagcctcgacctcctgggttcaagcaatcctcgcacttcaggtccccaagtagctgggactataggcgcgcaccaccacgccttgctaatttttgtatttttcgtagatacggggttttgccttgttgccgaggctggtctaaagctcctgagctcaagcaatccgcctgcctcagcctcgcaaagtgctgggattacaggtatgagccactgtacccggccaatttttctcattttttatattcagaataatgaaggtaatattttttattgttgaaaaaattatgtaagttgcacataatccatggtaatgcctatccatgatttaaaaaaaccaattaaatgagtgatttgtgctgaaaaatagaacagtctcttaccaaacagt

SEQ ID NO: 40428 - DNA, 1030 bp, Homo sapiens
ggggatgtataacacacactgaaacatacacaaatcataagtttgcaacttcagaatttatttatttttttgcatgtgaaggtccggttgttctatcaccacttgttgaaaagactattttcgtttcattgcttttgctgttttgtcaaagatcacttgactgtatttatgtggatctatttctgggttctattctgttccactgatccatttgtctgttcttttgccgatattatactgtcttgattactgtagctgtatagtaaattttgagtctggtagtgtcagttgttgctcttattcttctccttcaatattgtgctggctattttagatcgtttgcctctccatacaacctttaaaatcagtttgacaatatttagaacataactttctgggattttggttgggattgtgttgaatctgtagatcaaattgggaagactgacatcttgacaatattgagtcttcctatctatgaacatgtgctgtctctccatttatttagttcttctttggtttctttcgttggaattctgtagtttttctaatacagatttttatatgtagttgttatgttatccctaagtatttcatttttggagggtgctaatgtaaatgttattgtattttaaattttgaaattcacctggtatataggaaagtgattgatattttttctgtataccattgctggtatgtgggaaagtgattgagttttatatatttgtgtcctgaaacctggctataattgcttattagttccaggagtttttgtttattcttttcatactttctgcataggcaatcatatcatttgtgaaaaaagacaattttatttctaccttcccaatatttataccttttacttgtcttactttattagctagaacttcagtatgattttgaaaggagtgctgacagagaatatctttgtcctgttctgacattaatgagaaaatatttgattgttttttgattcttcctctcatattagccaaacatggagggctgggtaactggccaatgt

SEQ ID NO: 40429 - DNA, 1045 bp, Homo sapiens
agtttttcactagaaagacagtgttcttactatgtttttctttatacttagcttatgtaattccttaaaatcataggatatttcttttttaaaagcaattcttgctaggcgtggtggctcacacctgtaatcctggcactttggaaggccaaggcacttggatcgcttgtgcccaagagttcgagaccagcctgggcaacatggcaaaaccctgtctctacaaaaaatactagaaaattagtcgggcatggtggcacatgcctgtagttccagctattcaggaggcggaggtggaatgattgcttgagcctgggagtttgaggctacagtgagccaagattgtgccactgtacttcagcctgggtggcggagtgggacactgtctcgaaataaataaataataaaagcaattctaatttttagaattttgaatagtctcctctcctcactttcagttcttattattgttttttgtccttaatgtctcttactgaagtattttcggttgtagaatacaaaaggaaaacacactttatagcagaattggcataacatgtaagaccttagtaacaccagttataggataataactacaattgacaggttattgctgtggagatttttatctttgctaatgggatggtaaaatagtgatattacgaaccttacagcattttcagggaagtatagatcatttattttaagaatggtagcttttatgaagttttaaacaaaatttacagctataaaacatgcatactaattttgtagaaaaataatagaatttcatatgtgtatctttaaaatctcaaagatgattctgattttaggaatttattaatattgctctataactctttgttttgtttaatttgatctgttaaacacaataaagggataattgttcagtttttaactttaatatacagtcagaatacaacatccaaaatagtaataacaagctgtttttcaaattgcgattctatttacatttccagtttgaaggccaattcaaaaagaattatttgaacagactatatatgac

SEQ ID NO: 40430 - DNA, 1041 bp, Homo sapiens
tgactggagttcaaactaaaaatcatagctcaggaacttgtgttccaaagcctgaaaatttatgtgtgcagaagaatccctaaataccaagtgctaaataatttctctggtgtttctgcagatgcagaagctatccttttgtaaatcccgtcctctaaagctttttcttccttagtcttttaaatctgtttatacacatgtgtgcatagaaaatattttcttttgattgatactctacttgatttaaaagaaaaggtctgatactaagatgtgtgtgtgtgtgtgtgtgtaaaataaatacatcttcaccctgggataatacctattgtgtttaaacattaaatttaaaattctcaacttctgggcagtcagtgaaaggggaaatataatttcagttatcattattacatgatcataagagtaaaccatttcttttttctgaattctaacatttattagcttaagtcagcttttctcaaattgtaagtatagaataccaattctgtcaaattttaacagatatcaggattaagtttaggaaacaatggactaaataagatgaacagatttatttatatattttatcataactttaaatatcctaatatatatcttgacgttctaagagaaagatacagtggtttcctaacttatttgccttgaaatacccttttggtgaatatcagctttgcaaaatgccagcctaagtccttaacaacatgatgggttgtgtgtcttccatgccatttttgcagatgatgtcatcattgctttttatttgatcttcccttttgttgatttaaattccttttgaaacataatccaaggcaaagcttacttcttccaagtagcttagattctctctatccaccaggaattgctgcttttgaaaagcatgtgccagagggtcttgcgaactaagtattcctgttgtctgtgtgccagctggcctggcatttggtctaggagtctttcagatacacagtcagtccagactgaggctgaatttatttttcctagtgaaacctgagtccccacact

SEQ ID NO: 40431 - DNA, 1029 bp, Homo sapiens
aagtttgtattcctaacttaatgtctcaagtttgtatgtctaatttaatggtggaaagggaaggtggagaataggcttcagtgtaagaaaaaaaatggaattctttaggaaggataagtggatttttagaggaacaaataggaggtaagaaatgtttgtttttatgggggggaatggtcttttccatcttcttcgtggccataaactcctggagaggggatttatgatagttttactctcagtcttctttctgggagtgaagccacctagaagaaaggatttatggtagcttaattcccggaagtttctgcttttagtcagataaggaaagctctgaacagccacctttctgcatttgttgactctcaaatgtcttctggttaaaataatcttcataccagctctggggttccgagtgggttctcacagctgcctgagtgtcctcaccatatggcagccagctttacttatagcaaatgatctaagagaacacccaagataaaagtagtagtctgtttataatctaatctaatctagcccaagaggtgacatacaatccacttctgccatattctatttgttgtaacatataagtctagcccaaacttaaaggaggggaattaagctccatctcttgaggttaagagtgtcaaataattttgtggactttcaggacatatttttcaggaccatatagctttatacttaaaaaaaaaaaaactctgctattatttcagtagtgtcttgggaagaatcattctattgtatggaacattccattgtataagtgcatcatactttgaaaatttctgtgtggttgtaaatttagcttgttttgaaagttttgcttttataagaataccatgataatattattctaaataacttttttgaatgagtaattattcatctgatagcttattataggagtttattgctatggtctgtatactctagaatacatttatggaaatatgcatacattttctttggagcaaaatcctccagtatatttattattgtagcagt

SEQ ID NO: 40432 - DNA, 1041 bp, Homo sapiens
gtaatacttgttgaacacttaatgtgtattaggcattgttctgagtactttacatagaacatttatctcatttaatactcacaacgctgtaagatagcattgtgaataagtagctttttcaaggtcacagacacagttattgtaagtagcaggactgagatttgaatgcaagtgatctggccccagagcccagaatcctttttgccaggtcatgtcctcattattttttcaatattttgatagttatttttactgttttatgctaatagatgaatttttctgtcttaaaatatattttttctgataatgtcttctgtcttcctcataaaacattaaaaagaaattaaaaagttctccctgtgagaacttttatcccaccccttgggataatcaatattaagagttggatgtttggtttctcgagacattataccttcatcttcttacctgctgttttctttccttactttctgatcctccatataatgggatatgatataggctgttctcttataaataaataatagaaaaactctattatttttttttcaaattgctttgtgatggtaattcaaattgcattgctcctttcacttaatgggataataaatatatttgcagacaatatttactgctttaatagataactgttaagctactgtaagctttagaaggtctcaaagacaatacaagacactagaggaaagtaaaagtacaattcctactctcagcaggaaaatgaagtacaatttaagatgtagtaagagatataacaaaactatgtatagtaccagacaactaagtaagagatactaaagagctaataaagagcattacttgatactgtatatgaaatatgactgcttgttttgattttaagagtgtgatattgggtgttcatagatggatttttaaattttatataggaaataagtaagatatatttagtattgaatattgatatttagtattgagtagtgctgctgaccagatggaagaacatttgctttgacccatctcagcagtagagcttatctgtta

SEQ ID NO: 40433 - DNA, 1026 bp, Homo sapiens
acttgcagataactatttaactaataataaattatttgtggataattgattaacagcttggcacaaattcaatttagagcttcagcacatatctcatagccagataaattcccagttgattaaataagtgtaaataaaatttattttctgagaaaacaagatagcagaataaattaggttaggtatacctctggcacatgtttcctcagcattctttggatatttaggtagttggaccttgggtttaggagaagaatatggattgaaagtacagatttgggagacaatagtatgtgatagtaaagacagggatgtggacaggctgttgagtagaggaagcaatggtgactgagagtaggggaggtgggagaaaaccaggagaaatatctgtcattcaagctaagggaaagtaaaaatgtctccaaagaaaggttaaatcttatagagaattagtaagctaaggagtgaaaagtgtctgttgaatttagcaacaagatatttgggattgggttgggatgttctcagtttttgtatagtatagagtagggcagtgggagtaggttgaaagtgatgacacttttcctttaaacatttcctctctttcttcctttggctgttgttaacaaatgtctctcctgagggagattccaagacagcaaagagaacattattaagagttagtgaaagtaccttatttcatccaagagacaggtatggcagggctttttatctgtcagtgtctgcctgcctgcctgtctgtctcacattgaaattcaaatgtgagataattggcaaaaattgttcattaacttgtgtatttggaataaaaatgaagttggacttttcctatcagatagtgggactttcgatttggctgaggttttgctagtgagagttggtcaaatgagttttacatagcaagcatttttgtgtagattaaatcagccaaaactgcagttttgggattttgatgaaaatagacttcaagcatttgataaaataaaatcattttatttagccataata

SEQ ID NO: 40434 - DNA, 1005 bp, Homo sapiens
acatctcttgacataatgaaggtatttttggtttgagactttatttttgttaagtacagtcttttctgattcttatattgatataactatgtattcaagtaatggactccttgtaattaattctgatagttctctttgggtttataactgtggcacatgtccgatgctgtgcttggccccttacattcctaagacaccttctttattcatcttttgagtacatgtgttactaagttggaagagtatgacttacaggtatgttgcttactccttgaactgatgtctgagatcatttctttgaatacaacgatgaatgtattttcctcattatgaaaatatgcctgttgtacgtatattcttgtatacattttctctttacacacacacacacacacacacacacacacacacacacacagagctctctctcacataaattgcctccatcttctgtaatatttactaaatttctgtctaaaggatcactcatttctgttgtgatagccatgcagattttaattttaaggctagctgactctgtttatgaaatatatttctataaacatacttttttaactttcgatttttctttattttcacaaacagaaataatttgttgaaaagtgaaaataaatgtcagtgactttaatactcaattatagtatgttcacaataattccagaccgaagacattgctatttaaaatttatttttaaaattaattatttattttttatttttataaatagagatgggtctcactgtgttgcccaagctggtcttgaactctggggctcaagcagtcctcctgactcagcctcccaaagtgccgggattactggcatgagtcaccacatctggccactgtttagaattagtgatctttccattataaagatttaactattttatgctgaagtggccatattttcaaggagtgaaaccatctcatacataacaatgaaggtagtcagctgtagacttggaatgagatcacatatgggg

SEQ ID NO: 40435 - DNA, 1048 bp, Homo sapiens
taaataggggtccagtttaattcttctgcatatggttagccagttttcctagcacactttatcgaatagggagcccttttcccattgcttatttttgtgactttgttgaagatcgattagttgtaggtatgtggctttatttctgggttctctattctgttgcatttgtctgtgtgtcttttttttgtaggagtaccatgctcttttggttactgtagccttattagcatagtttgcggttggttgtaatatgatgccttcagctttgtcctttttgcttaggattgctgtgtctatttgggttctttttttggttccatattttataatagttttttttcttctgtgaaagaaaaatgctgttggtaatttgacaggaatggggttgaatctgcagattgctttggacaatatggacattttaacgatattgattctttcaatccatgagcatggaattttttttatttgtttgtgttgtctgtgatttctgtcatcagtgttttgtagttctcctagtacagatctttcacctccttggttgggtgtattcctaggtattttatttttttgtgtggctgttgtaaatggaatcgtgtttttcatttggctctcaggttgaacatcattggtttatagaaatgctattgatttttgtatgtagattttgtgttctgaaaatttactgaaatagagaacatatgatgtcctctcttcctatttggatgccttttatttctttcttttgcctgattgctcttgctagcacttctagtactatgctggataggagtggcgagagtgggcatccttgtctggttccttttcttaaggggaatggttccagcttttgtctgttcagtattatgttggctgtgggtttagcatagatggttcttattattttgaggtatgttcttcaatgcgtagtttgtttaggattattatcatgcaggaatgttggattttgtcaaatgcttgttttgcagccattgagatgatcatgtggtttttgttttgaattctgtttatgtgttaaatcacactt

SEQ ID NO: 40436 - DNA, 1028 bp, Homo sapiens
gctggggtggggattacaggccagagctataatcagccgtgggagtggtttttctaaactctgataattttattgccatgcttaaaattctttactatatctccattgcctttataatctttagtatgtttcacaggtttttttaggattttgaccctttcattttctccaactgcatttggcatttcttaccacagctcatattctagccattctgatttatttatagtttgccatatgtgcttttttgattaatatatttacatttgcacagattgttcctactgtctgcagttccattgtataaatatccttttttattgagagttgttcaatgactaaggtttttattctaaatattaatggtcattttattataccaggaatgtagaaattggtgatttggctcaattgatagttgttttcaaaaaaattttaaaagtagcatgttttgtggtgggcaggcctatgcaaacctattctcaaagtccaaggaagcaaagaaaccaaagaaagagactgacaaatccggtttcttagaaagatatatttaatagggacttaaaaagaaaccagtcctgcttgtcaggtggcagtgagataagatggtggatccccaccattactcccaaggccagggcttataaaccacaggaaacaggtgattcagaagggttaagtagaacaagtaagtacaatcacatcaaggttgtttttacctttgggcaggatttatagttaggacatgctcttacacaaagaacagtagataaactagaaatcttagaggccttcccagaactggggttaatcagaagtcaacataggcagattagcatccaagatggagttgctttggcctccacatagtaaaaaatttttttggaaagaactcctaccataatatacaaatgagattaaagtgatttttttggcatatatttttaaatgtatcaaatgtataacctgggtttttgataaagttcattgctgagaacaaggccatattgatgaacacaaatatttgg

SEQ ID NO: 40437 - DNA, 1031 bp, Homo sapiens
ttgctttgttctcatctgtaaaacgaggaataataacaatacttattgttaggagtaaatgaatgaattatgtacagtattttaaacagtgtctagcatgtggtaaacatacacaattagctttaattattatggcttcttttgtttttttcttttcagtgaagtctaacttaaagttgtcagttgaaaaggggatgttttaggaatgaggaaaagatgtaaaatatttatcataaaggagagctaatggtgtgtggtaggattgcctttgatattggtgattatgaagtatagtgtcacccatcttttgtgctgtgagatttgctctaggaagcctcagctacatatgtgtaggcacaaagaagtcaggtggttaagttcattgaggtctggatttttctcaggtgagtgtgactgggtaatgggggcagagcaaggaggttaagggtatttacaggggactaattatgttgatccactgtgggctctgatgttggataagaaggaaagggaaccctgaaagagctgatggaaataggattggacttctgaggcagtagtaagagggagagaaagtctgatgggatgaatcttcttatttatttatttattatgtttattgctcatgatttatattttcctaatagaatataaacactatgagggcagggcttttctgttttttgtttgtgtgtgtgttttttttttccttttcactaatgtaatccgtgcgcctagaacaatgcctggtacatagtacatacccactatatatctgttaaactaaatgaagtaaaagaaacctaaatcagatgttggtggaggtggtgagaagtggtcagattctggatgtattttgaaggtggagctacgggatttgctgatggattggatgttgggtgtgagaaaaggagaataggcaaggataacctaaaaggttttggtcttgagctgctaaaagaatgatgttactatttgctgagatagggaagaccatgaagggagcaggttttagagtttgagtattaaga

SEQ ID NO: 40438 - DNA, 1054 bp, Homo sapiens
aggagggagggagggaagaagggagagagggaaggaaagaaggaaagaggaaggaaggaaggaaggaaaatttaaaatatttattgtgacagaaataaaaatttgaaattgaaaaatataagcacatttaagacaatctcccagaaagtaaaatttaaggatggagaatttgaaaagaaggaaaagagaaagaagatctgtccaggaggcccaatatttcaaataggaatttcagacagagaaaacagagtaaatgaagagaggaaattaacaaaaaaataatttatgcaaatacatcagaactgaaaaacgtgagtctgcaggttgaagtagctcactgagtgctcagcacatgtgtgaaatgagtcctacatcaagaaatgtaataataaaaagagatgatcattaacacctttttaaaattgcttcttggctttttgcctaagatcaagtacagtgtctcttcttatcagtttaatatctgatacgtcctttgtctgaggacaatatattaaatggatttttggagcagggagatggaataggagcatgctccatccactccacacatagacctggtattgcagtacctccaggatctgtgctctctcaccccacatgctataaactaaaaaaaagaggctgggcgtggtggcttatgcttgtaatcccagcactctgggaggctgaggtgggttgatcacttgaggtcaggagtttgagaccagcctaaccaacatggagaaacccagtctctagttaaaatataaaaattagctgggtgtgatggcatgcccctgtaatcccagctactcagggaggttgaggcaggagaatagtttgaacttgggaggcggaggttgcagtgagctgagatcatgccactgcactccagcgtgggtgacagaatgagacttcgtctcaaaagaaagaaaagaaaggaaggaaggaaggaaggaaggaaggaagaaaaaaaattaaaatattattatttatttatttttgcagtttaaaacttatgcattgtttatttctggaattttcttttaatatt

SEQ ID NO: 40439 - DNA, 1044 bp, Homo sapiens
aatgtgttattaaattcctgggcccccttggcgataataaatctttctctggtattctgctgaagaaaattaccctgtatccacgagatccaatattatcctgctcagttagttggctaaaaaaaggggagaaggggggattggagagcaaaagcaataggtgacatttgtagagcaattactctgtgctaggcactgttccaagggcttagcatttgttaactcatttaatcctcacagcaaactatgaggtggttaatgtggttatttatcttcattttacagatgtatgtccaagattatagagctagtaagtagtggacccactgtagaacagaagccagagtcagcctccagtggctgactttcagccaccatggtctattgcttgtgtaaacagacatgcaaattcataaatgcatctccagtttatctattcaaatcagaacccacaacactcattttgaataaattttactgcagcaactctgcctgctgacatcagtagaacccatgtttgccctcctcaggcatcaataaacagcaacagaaaagggatgcatataatttcatatagaagctgctatttatattgctttgcaggaattaacaaagctgccacttgaggtagaggaaagacagattcatttcaagctctgttccttgtgtatatatgtgggtgggtgggtgggtatacatgcccacaggcacgtatgtattcagtttctactgttgacaccttgtatttcttgctcatggtattttgcacccttgaattcatttatttgataaactgtgataacttgctgaccgtttatcttcccctccaggctttaaactcttttgttttcccactgcattccccagcacctaacatcttatggtcagcatttcctctgtgttaataaatatttgttggctgattattcttcttgaatctaataaactaactgaataatggcagcaattaaccattaaacgacactgactaccaatagacattgttatgcttcttcctagacttctcagtcctttatgtggagc

SEQ ID NO: 40440 - DNA, 1048 bp, Homo sapiens
aaagtcttctccaactttcattcaataagtatttatttatcctttcattcatcactcctctgaaaatcacacctctctcagagcctttctccccatgtctttcctcactaacatctagttaggtgatactgagtccttaggtttcgtcctggcctcttgaatgtcttctcttttagattctttttttttttttaacttgagatagggtctcactctgtcacccaggctggagtccaatagcatgatcacagctcactgcagccttgatgtcccacactcaaatgatcctcccacgtcagcctcctgagtagctgagactatagtcacacataccacgcttggctaaattttttttatttttattttttgtagagacagggtttcactttgttgcccaggctggtctcaaactcctggcctcaagtgaccttcctaccttagcctcccaagtgctgggattacagacatgagtcaccatgcctggcctcttttagattcttaactgagcctagctccatactaggcacagggtaggacattagtaaatcctctcccctcccctcccctcccccactccttccctcctccccttccccctcccctctccttcccccctctccttcccccttcccctccccacccctcttccctccccatcccttcccccctcccctccccacttccctcccttcccccctcccctcccctctctcctcccccatcccctctcctcccccctccccccctctcctcccctcctctcctctttttttttcttttcttggggacagggtctcacactgtcacccaggctggcatgcagcaatgcagtcatagttcactgtggccttgaactcctgggctcaagtaatcttcctgtcttagcctcccaagtaggtaggactagaggcacatgccaccactcctggctaattttctttcttttctttttttggtgacagtgtctcactaagttgctcaagctggccttgaactcctggcctcaagtgatcctcctgcctcagtctcccagagtgctaggattaca

SEQ ID NO: 40441 - DNA, 1072 bp, Homo sapiens
tgggaggcattgtgaaaatacttccttcctttgctttattctcagtcctgtggtatttttagagtaatgcctgtgtgaaggggagcaactgaaaactccaatttcctgtgtatggcagggtgcacacacacacacacgtaaaataccaacataccagacaaacaaaaaacaaccacacaatgtgagggatataatcttttactctttatctgatgtgggattgtctttgatgtatgagtggaaagattaagtgaagacaatacagatagctggttaagggccagtgtactagcatgtggatatagtaaattttttcatttcataggtggggaaactttttgctttatggtttttttttggaatggacttgtgattatggatagagctgttgtgtaggatcacctcacagtagttgtctgtggtagttgtcagtagttgtctatggatctgctactgtagtagcagtagttgtctatggatcatgctacttgtctataatctgtcaatagttgtctatggatcaagctacttgacccgtgtttgggtctgctctggccaaggaagtagggtcttatagtacaaagtgaagaaatgtgtataaagcacctcctttggcagcttcttcatcagggggccattgacatgtgcagcaggtggtgggagtataagagactggtgcaaaagtacccactgcctccaccagaagtctaagagttacctatccatgccattggtgtcaactgcaccttcccactaatccactcaaggtttcatgtccaactcaggcccttctcgtaagctatagatacacagaacttatggtgactcaacatcttcatttcccatagagtgaaaaaaatctctgtaagtataaagacaaaactcatcagttttcttctcctcccctaaacttgcagtttaccctagtatttcatatctcagggatagacagcactcaggcacctatgggagtcattttttatttcttggtcgcttccttgctccatccctgccctgaaacacacaactcaatacacacacagaaacacatatatctaatcagtcactgttg

SEQ ID NO: 40442 - DNA, 1031 bp, Homo sapiens
gttgctggcctcaagtgatcctccctgctcagcctcccgaagtgctgtgctgtgcctggcctcctggtgtgcctggtgcctgggtgtttttattgtgcagctagggttgagaactcctgaaccagagaaggatgtggggccttatgaactgtaggtggggtgaagagagtgtttattttgtttatgtctctgttcatgtattttcaaaaacttttcatgagggttgaaatagcaaacactgtttatggatatttactgtctttaaaaagcctcagttgtgaacttttacttaaaattccaaacacagcaagattactgttacattttgaaatgtgcaaagatatgtaagttaaggtttgtcaagaacaataggggcgggtgccagtggttcatgcctatgatcccagcactttgggaggccaaagtggaaggattgcttgagcctagaggttcaagaccatcctgggcaacatagtgagacctcatctctaggaaaaattcaaaaatgaggtgggaggattgcttgagcccaggaggttgagactgcaatgagctgtgattgagccttgcactcccacctgggtgacagagtgagaccctgcctcagaaataagaacaggatatgtctgaaatttcccaagttgagtatttcattgtacccttctcattgagccaagttcttttagctaagctttttaagacagtttgttgcacataaaagcagagaatcttgaggctctcacatctcatattcaaattgccatttaaaaatcgttcctttgctcctttgtttttattacttttccccttgcttgtgacattggtctttccttgaggaaattgactcctggttttactgcactagtggttcactctctctgcagaagcagcagagggcactactcagaggttttcctgctcctggaaaccgagacggtgccctccccgccctccccttgcagttagttgtataactagtttgaagaatttaatccttggccggaatcctaattcttcctttggacgcggct

SEQ ID NO: 40443 - DNA, 1025 bp, Homo sapiens
tcttttaagtcccaacaaattcttcatttttgtatttgttgtgcttttctttctaaattttattattgttattttagttttcatgggtattgaagttttattttaataaaatccagtttaccaatttttgggggagggtgtcatatctaagaaatttttgcctaacgcaaagtcataaatattttaccctagaagtttcatagttttagatcttacagttagaccaagaccaattttgagttgatgtgagttgaattttttttttttttggcatatggatgtccagttggtccatcagtcatttggtgaaaatgactgtcctttcttcttggaggtggctttacctcttggtgaaaaatcatttgtctatgtaagtgtgggtttatttccctgtctgttccagtgatctgtttgtctatttgtctgtctttacaccaacactcacagtttggactggatttctaagtttctctgagatgggaaccatgttttacatattttttgtctaaccaacatttaccaagcaactactttgggcccattaacccacatatttattgtatgcataaaacagaaaccctaagagcacaactgaaagagaaaatgtggagttgaaatcacaatttaaggagtatttaatattttgaaacatttgtgtttggcaaataaagtgaaagggaatatcaaaggttttcagtgaacttgtgcatctttggaattaaacataaaacagcatgtcagttgtctctttttactttgtaaattttgttttatcttatttacttattttcattgacagattatagttctatcgatttaagttgttatttcttttcccttctttctttgttttagagttggggtcttgctattacccaggctgttctcaaacccctgggctcaagcagtccttctgcctcagcctcccaagtagctgggaccacaggcatgtccaacaaattgttgtttctttctttttgagacaggttcttaactctgttgcccaggctggagtgcagtggcac

SEQ ID NO: 40444 - DNA, 1047 bp, Homo sapiens
ctcttacagtgcagagtgacagaatggacacagaaaaacataggtgggtcagaacagatctcagtttgaacccagtagctactggctatagggtctctgggcaagtgatttgacctctctgcgctctgtcttctcaaatgtaaaaacgggtcaggcgcagtggctcatgcctataatcccaacactccgggaagccaaagtgggaggactgcttgagggcaggagtttaagagcagcctggcagacaaagcaagaccttgtctttatttttttattattatttttttttgagacagagtctcactctgtgccccaggctgaagtgcagtggcgtgatctcggctcactgcaagctccgcctcccgggttcacgccattctcctgcctcagcttcccgagtaactgggactacaggcgcccgccaccatgcctggctaattttgtttttgtatttttagtagagacggggtttcaccgtgctagccaggatggttttgatctcctgacctcatgatctgcccatcttgggctcccaaagtgctgggattacaggcatgagccaccgcacccggcctcgtctttatttttaaaaaagaaaaagaaagaaaaacggggagtcgttgggattcaccaagaaaaaataggtggctggcatgcagtggactgtcagtcactgtcaggtgcttccctacctgccttcaggtggcttaattggcagggggtgtttaacagaatacagatctttgagttgatggaaaccttcaatctctggtccgtaatagttaaaaatgtaaaagagtccttagaccaagaagtctgagaaccacttccccgagtcatttctaaagctaaattcagattcaccaggaaatcaagtatggtgaaagacagtgactatacccattgctcacctgatgtatggactcttaatacagcaccaggatcagcctaaaatgtactttcagagcgttcgtgaaccacaccaatcaaaatgacaagtgacactcagaggtcacccaaacccaaaataagaatcagcaaaattcc

SEQ ID NO: 40445 - DNA, 1095 bp, Homo sapiens
tttctgatatagttctacagtctgatctgactacatatatatgaatggattttaaattggtttttaaaattttttacctacaagaggttactcttcatgtaggtccaaaaaagaagaaagaaaaattcatggaccatatttctcaaggtcactttctttctttttttttttttttttaaagacagggtcttgctctgttgcttaggctggagtgcagtggcatgatcatagctcactgtggcctcaaccttctgggcttaagcagtacagtcctcccacttcagcctcctgagtagctgggaccataggtgtgtgtcaccatgcccggctaaattgtttttttttttttttttgaagacagggttacagggtttcactctgttgcccaggtggctcactgtagcctcaactttcctgggctcaggtgatcctcctacctcagcctcccaagtagctgggaccacagatgtggggtcttgctgtgttgcctgggctactcttgaattcctggactcaagtgatcctccctccttggcctcccaaagtgctgggattacaggtgtgagctaccacgcctggccctcaaggtcactttttattcgatgtctacagcagaccattcctatcagtgtaatggattctaggtttcaacatttgtggtaccaggccaccaaagcctttgggtttgttgtgactatagtagccttactgatgttattcctctacttgccaaacaaaaaaatgttttctttgggaatcttgatgcaaaaaatagttgagaggctctggtttagaggatattctgattcctaaaatcattaactttctaattcacagcttgcatttgaatctttggctgtgattggaaatgctctaaccctcctggaagtgggtcagattgcagtgtgtaggtaaggttgctttgtaattcctttatgaaaacttttcacaacctgtttggttattttgatcacacagccaaaaaataactcctgttgtatttggttttcctcccccaagttttggagaatctgtaaagctgttacacccatttcatgagcagttcagtgattactctgggtcccagattctacg

SEQ ID NO: 40446 - DNA, 1028 bp, Homo sapiens
caccgacaatgaagaaggagaaggtgcgtctttcagaaacaaagagaccggttagaactcacattagtgaacagtaattgatttctcttttgaaagctagctcagtgtcatggccaggtgataaatcacgtttggtaggctcaatcccagtctgagaaaatggtttgcctttcctttgtagtatttctcatgtgattatccctacagctcatcaaccagcaggtatttctcaaactactgtcatgtcctattctcgcttttggcactgctatgccctggtggtgcttcacacacagcactgtctcttcacagccattactgtgtatcccatctcatgggatggtgtaaacgctgtgcagtctgggtataccaagctgtcgtggagtccagttatagcttttttagggaaatgatggtttcagttattgattgtcatgtgtagtgaggaatgagactaaataatcccaagagaaatcgcatggcatatgacagtatttcgtgcctttgttgtccatttttcaaccctagtgaatcctttagggagtgttatctggtattagttgaaagcattgtgttggaggtgcccctgtaacagagggccccattcctgctgctgcttaatcagacagaaagatgtgagctggcctcgctgataaatgagtcagttacatagttataaaatctattttaaaaaatgtatatgtatatttttataatgctgtattagaacaaaaatagcaagttacaaaggaataaataagaggtgccatttatgtaaaaattaattttggaatctagttgcaaacaaagtcaattaccaagaaagcataaaattaagaaaattaaaatccactgagaatgtaatatgctgtctgcttttaaatagccagactcgttttgtaactaaggaacaattatttaaaattgtttgctaattaaataatagataatgggaaaaaaaaacccagtaggctggttgcagaggcttgtgtctgtaatcccaacactttggaaagccaaggtgggag

SEQ ID NO: 40447 - DNA, 1050 bp, Homo sapiens
gatcccaggaggttgaggctgcagtaagccatgattgtgccactgtactccaggctgggcaacatagtgagacactgtctaacaacataaaaaataattttttatagaagaaatatagaaaccaaggaagaatgaccaagattctcttgggccactgtctttcagcgataatagtgacaaaaatagtattaaagaattggataataaaagattgatgaattttttatcctacaaagaatatatattcttgcaaatgtctctgggactatttttacaattcccaataagaaaacctgaacaaaattctatactctgattaaaacaagtggaaactaactccagaaattttacaaattccatgtggctgtctctgttgtttctctttttttttcctctcccagatatatttttacaccattaaccttggcatttatatctcacagctgaagcaaacattggtaaagtttcatttatttatgtttaatacttctttatgtaggtggaagatacatttcagaagggtcaagaaaaagacaaagaggatcctgattcaaaatctgatattaagggcgaggataatgccattgagatgtcggaagattttgatgggaaaatgcatgatggggagcttgaagaacaaggtttcagattatctgtcacttcattcttgtttttgaaagcataaatattttatccaggaaattacatgttcctaataaggaacccaatataatcttttgaaacaagttggttactgtgcttaagtgcaaatgaaaacctcagcagctgcatgtgctatcaccacctccactgaggcagaagtccctggtgtctcatagattcttctcacattgatgttttagctgcctcgtgtgctagatgcagtggctcagtagtgaagcctgaaaggagatgatccctaatggaaaagggctttcaacaaaaggcaaattgttctgtagtgtttaaaataccttttattcctaattagaaaaatagtaggtgtttgttgtagatgatttggaacaaacatgtagaaaagaaatagat

SEQ ID NO: 40448 - DNA, 1003 bp, Homo sapiens
tctttatctctctctctgtatgtatgtattttagagactgggtcttgctctatcacccaggctggagtgcagtggcgcaatcatagctcactgcagcctcaaactcctgggctcaaacaatcctcccaagtagctgtgactgcatgtgcatgctaccacaccctgccgtttttatattttttacagagacagggtctcactatgtcacccaggctgtctcaaactcctgacctcaagtgatcctccctcctcggcctcccaaagcacagggattacaggtgtgagccactgtgcccagcctgtagtcttttaaaatatattttaatacatatattagtcctatttcattttttcagtcattcttatgcttttttctttcttccttttagtctgattagaagtagattctgatttttaaaagttcaattgctctaatgctatttataggactttgcagatattttggtgcagccaacgttggaggagaacaaaggaacttcagatgggcaagaagaggaagcaggcacaaacccagctctcctctcccagaattcaatgcaggcagtaatgctgatacaccagcaattgtgtctcaactttgctcgatccctctggtatcaacagactctgccgccacatgaagcaaagcattacctcagcctgtttctgtcttgctatcagactggggcatcgcttgtgacacacttctaccccctgatgggtatggtagtttacttttgttatgcccctgggaaatgaaagcaaatgcaaatagatgctgttgctactctgtaacaatcacactcatgaatttcctgttttcgcataattccttattggagtttccttggcttaaagaactgaagctgattcaagaaaattgatttaggattctgtaataagatggattttcatcagtgtacaaatgggccaagaaaaagatggatttttattgtttggatcctttggggtgagggattaagaaaataaggacaaggactta

SEQ ID NO: 40449 - DNA, 1088 bp, Homo sapiens
ttcatttattcaaaaatatcttgtgtatttactgtgtataaggccctgggctatgtgcctagggaagcgagaaggaaaatcaatggggaatctacttttgaaagagatcactgttgtatctgggtgaatgattgtgccgaaaggaaatgtgagtcaaaagcatttggagccccgtgcatggaaggaaagaagagtcaatgcagcatgtcagcctatccaccatctgaattctgtctctgcagcccatcagtgttggatcgtttgaatgctttgcttgaacccggaggtgtcctcactattagtgagagaggaatgatagatggatccactcccacgataacaccaaatcccaatttcaggtatttgtatctcttacatttctgcctcagaatctgacagcctcagtagcagaggtagacgttcagtaggacttccttatatattttatttataaactgaatcatggagaagttcacccatttattaattcacttaacaaatacttactgaggctttactatttgccaggcattgctgggctctggaaacacagcataaacaagaggggcaaggtccttgccttgcattggtgacgaaggtgggaagcagagataccagtcatgatccttttgcagtaatttaggcaacacatcacagtggcttagatgagggtggtcagatgggttggtttgctgatggacatgtgggttgagaaaaagaagaatcaaggatgacacctatgtttttggcttgagtaactgggtaaatggggttgccattcattgagaaagggaagactggtaaaggagcaggtttaatgtggggagggtctaccgggaatcagctgtttactttcagacatacatcagaggtgtaagataactagatggagatgttgatgggcattcaatatatgaatccagttgtttcaggagactacacttgcttcctgttctgctgtctgtaggtgagttagaataatgaattagtacagcctactctggggaatatctgaaggttaaatttttaaagttctcagcactaaaggtacactggatatatcatacacagttccttaggaaagtagg

SEQ ID NO: 40450 - DNA, 1039 bp, Homo sapiens
atacactaattgcaagcctttttttttttttttttttttgagactgggtttcactcttgttgcccaggctggagtgcaatggcataatcttggcttgctgcagcttcacctcccaggttcaagtgattctcctgccttagcctcccaagtagctgggattacaggcataagccaccagttccggctaattttttgtatttagtagaaacggggtttcaccatattggtcaggcagatctctactcctgaattcagatgatccacctgtctcagcctcccaaagtgctgggattacaggcgtgagccaccacgcccggctagcaagcctgttaaagctgcttcaaaatttaaaagttaaaagaacagactaaacgttctcctaccttggggtctcacaatatagagtagcttgctttagaggacataatttgcttatctatccaaatccccatgatcacataccttaaagcagtattgccctccagtagtaaagaactaagtcttcaccatctttacaggcaccaaggtgagaagcaggaggaggcagacaggtgatactccgtagaagaggaagtttttctgttttgttttgtttttaaataaatgtcaaattacaaagcattttgtctagaaagtataatcgtataaagagagaatattctgtgtttaagtgaaaataaaaatacctgtttgtaaaactagaattcccactgtaaggaattgtaataacgtgtgcattttagtttgtggtatttaaaatcctgtctcgctgaatgctcacagtagctataggcaggaggtgctgtcatggcatcttacaggtgaagatccaaggcttaaagttatggagtgtcacaggtagcagagccagctttccagtttaggccctctccagtttgtctgctgtttccttctagtaaacttcactgtttgaaaataaatgaatagatacatagatgcatgcactagaagcagtaacctccttgttgaaatgtgaacatgtggctggcccatagcacatgtgactttcacagccctt

SEQ ID NO: 40451 - DNA, 1056 bp, Homo sapiens
ctagtacaagagattttttctctacttgtaaagaatatttacatagaggaatacttttttaaaaactttttttctttctttctttctttctttctttctttctttctttttttttttttttttttttgagatagagtctccctctgtagcccaggctggagtgcagtggcacgatctcagctcactgtaacctctgcctcccgggtctgggttctggttcaagcagttctcctgcctcagcctcccaagtagctgggattacaggcaagcgccaccatgcctggctaatttttgtattttttgtagagatggtgtttcccatgttggccaggctggtcttaaactcctgaccttgtgatctgcccacctcagcctcccaaagtgctgggattacaagcatgagccaccatgcccggcaaacttttttagtgaggtgtaacaaacagtaaagcattttcccatgtaaagtatcacctagaccaagatttagaatatttccaataactcagtaggtctcttgacagtggaggtaatcactaccctgactactgtcactactaattgacttctgtctgattatcactactaatctgattgaacagcattttgcctgtccttgagtttcacctagctgacaccatgcagtatgtactttttgggttctgggtttttcactaaacctgatgtgagattcagtcatgccattatgtgtatcaggacttcattcttttttttctttttctttttatgtggtaatccactgtatgacgacaccatagtttgtttatccattctcttggttatggacatctggatcattttaattttttagttatgaacaaagcttctctgaacattcctgcttatgtctttcgacacacacatgttcattggtgtttggggatactagaagtcatattgctgaggcatagggcaggtatatggttaattgtaataggctgtcctagttcttcagatttctacctcaccagccgcgtatgagagtttctattgtttcatattctccatatcccttggtgttcccggtagacactt

SEQ ID NO: 40452 - DNA, 1050 bp, Homo sapiens
taggcaatccagagtataatagtgcaaaacctccttccttactacaacactggccctttttcggggaacatggtttatatgaaattcatgtttttgataaaaataattggagtgggcattttgatatgtgagagaagagaactggtacataaaccttctgggaatttgttttgattcagcttttttccaaacccacctactccacttcagttttaaaaccaatatataacaccattttgttctcattcctcataattttatgttcatatttcatccagttttaatgttgaaagtatgcagaacaagacagcttgttcaacaagtggctgttttcctactttatgcccttctctgaaagaatgtacaactgtgggttattccttgaacttctgtgtctttcagcctattccagagccaaaaggaggtcggcttatccaggttgaaggctactggattgcggtgggagacaaggagcctacaatagatgagacgtacattctgacatcttctgtgaagctgaacctgagagatatagtccgagttgtctctgcagggtgtgtgggcttttttctcgctgccccgaacttgatacaggcataggcattgatgacattttggtctaacttccttaactttcaaagagctttattcttattcattggccaactgaacaattacttacaaaagtcagtactataactttttcctggtagaaaactttgtttctagttgtgcaactttggagggagcactatggatgcagatgattttatctatctttaaagttatcttttgttattttgctgataaataccacagattattcagtaaatggctaaaagttctacttacagtttcttacaaatgttgccagcatagttggaattgctttccttagtattttttgaggaataatgtttacaaagatacttctcagtgtataggaataaaaatgttcttctgcttcttgcattttccagaaatgtaaaaaggggaaaaaaaaggaaaaaaaaatgctcttttaatgatgctgttaaatgatgtcgtcat

SEQ ID NO: 40453 - DNA, 1099 bp, Homo sapiens
aattagaaatgggcatctcctcaggctaggcgcggtggctcacgcctgtaatcccagcactttgggaggccgaggtgggcggatcatgagatcaggagttcgagaccatcctggccaacatggtgaaaccccatctctactaaaaaaaaaaaaaaatacaaaaattagccaggcacggtggcaggtgcctgtaatcccagctactcgggaggctgaggcagagaattgcctgaacccgggtggaggttgcagtgagccgagatcacgcactgcactccagcctgggcaacagagtgagactctgtctccaaaaaaaaaaaaaaaaaaaaaggaaatggcatctcctcattctgatctgattggttgctcccctcctttcctgctaccttgtctggcatggatggcagagagtaatgagttggtaggtcacttcctggaatgggtgaagattgggaactctttttgttttgtttttaaattttacacacaaatacaaagaggggaaggattgagaacccttactggtttcccaaataccttttatctaagcattgtcagaagaaagaagaaagttatcaggtatgcccagacttaagtgggtcaataaattctgatgcctttgatgtctttggcctgtggtcttttctttgttttttcttttctttcttttttttaaagggatctgctgaattggtgtaataggattgcccatagctttgacagttcatctttatcagcatcattaaatatttttcaagaggtaagatatagttttccagtcttttttgtcttggttctgtaaggctgttgacttccgttgttattttctgtcttttgattgccatcagacttttttcttttttccaagtatggtttgttattctttttttgttttttttttttgagacgaagtctctcgctcttgtccccaaggctggagtgcagtggcgtgatctcaggtcactgcagcctccaccttctgggttcaagcgattctcttgcctcagcctcccgagtagctggggttacaggcacctgccaccacccctggctaatttttgtatttttagtagaaacgaggtttcaccatgttggccag

SEQ ID NO: 40454 - DNA, 1050 bp, Homo sapiens
atgaggtctttgcagatgtaataaagtcaggatgagataattagatagggccttaatcaatatgactgtttctctttcgcccaggcttgagtgcagtggtgcaatctcagctcattgcaacctccgcctctttggttcaagcaattctcctgcctcagcagctgggattacaggtgtgtgccaccatgcccagctaatttttgtatttttagtagagatgtggtttcactatattggccaggctggtctctaactcccgacctcaagtgatctgtccacctcagcctccgagagtgctggaattacagccgtgagccaccacacccagcacaatatgactgttcttatgaggagagaaagacataaagggaagatggccatgtggcgatgacagaaatacatattggagtgataaatctgtgagacaaggaacagcagggattgatgatgacaaccagaagctaggaagaggcaaggaaggattctcccctataggtttcaaaggaatatggccttgctgacaccctgatcttggacttccaaactttagaattgtgagacaacacatttctgtttttttaatttgttttttgttttgttttgtgtttttgagacagagtctcactctgttgcccaggctagagtacagtggcacgatctcggttcactgcaccctctgcttcccgggttcaagcgattctcctgcctcagccttcctggtagctgggactacaggcacccgccaccatacccggctaatttttgtatttttagtagagacggggtttcaccgtattgctcaggctggtctcgaactcctgacctcaggtgatccacccacctcagcctcccaaaatgctgggattacaggcgtgagccactatacccggccttgtttttttttaagtcagtttgtggtattttgttatgacagctccaggaaattaatacatgtaagaaaaacattcagtcagggactgcccatattaatattttgatatataatcttccaaacttaattttttttttttttttttttttttttttttt

SEQ ID NO: 40455 - DNA, 1014 bp, Homo sapiens
cgaaattagccgggcgtggtggcgcatgcctataatcccagctactggggaggctgaggcaggagaatctcttgaacctgggaggcagaggttgtggtgagccgagatcgcgccattgcactccagcctgggcaacaacaatgaaactccgtctcaaaaaaaaaaaaaaatttttgtagagatggggagtctcactttgttgcccaggctggtcttgaactcttgggctcaagctatcctcccaccttggcctaccaaagtgttgggattgcaggtaggagccaccgcacccagcctaattgcttaggttttatagagtagtttaggaattgtttctctttagctgaaaatacacatttcagccgatacatgtaattataaataataacactgaggttatccttttaattaactctgctttgagaagggctaactgatcagttagcagttgccttatccttttaattaactctgctttgagaagggctaactgatcagttagcagttgaatatgacagtgtagtaatttcattactcaaaacagtaaaaactcaatatgttaagcatacagacatacaaatatgaagactttttttccttttctatttttgttggctaattattgggaaattgatgaattttgttatagcaaaggaacggaattggttagtatttttggtgggaagagaagagctgagccaccttaaaaatattttttcctggccgggtgcagtggctgagctcagacaatctacctgcctcggcctcccaaagtgctgggattataggtgtgagtaaccacacccggccaataaaaatgttttttcttggctgggcgcggtggctcacgcctgtaatcccagcactttagggggccaaggtgggcgaatcacgaggtcaggagtttgagaccagcctggccaacatagtgaaaccccgtctctactaaaaatacaaaaattagccgggtgtggtggcgcatgcctgtaatcccagctactcgggaggctgagg

SEQ ID NO: 40456 - DNA, 1044 bp, Homo sapiens
cgattcttctgtctcaacctcccgagtaactgggattacaggcgtgcgccaccatgcctggctaatattttgtatttttagtagagacagggtttcactgtgtgggtcaggctggtctcaaacccctgatctcaggtgatccacccgccttggcctcctaaagtgctgggattacaggcatgagccacagcgccctgccctgaagtattttttttgatgtatctcaagcccaattgttctggggagtggggccaattttgctcccagggacaaatctggagacctttatggttatcacaactattcattatgggggtgctactagcatctagtgcatcaaggccagggacgctgctaagcattctgttatgtatgggacaaccccttacaacagttatccgtcgtaaatggcagtggtgcaaaattaagaaagaaaccctgccccagactggttgtttactttctgctcagggcttgctatttcagcaacactaaactgcctgcaatgaccacaggttgttaccctctactattgttgactggagtcacctcccgttgttaatgtctgttgttattgtctgggccattccttgctgttacttgcctcattgactttgcatttcctttccttagaaggctacatctctcttctatgccctgctcagttaacttgtttgttctggaagactgcttttgaaatggtcttccccaggaagacttttctgactttaccctttcctcttcctcttaatctttgtttcaactaactgattctcagtagttgattgagagtatgtccagagaaggggattgtgtagctgtagtgtccaatacagtgtctgatatgcagtaggcagtaaatgtttattgactgtattaacagattaaggtactcccaaattgtgatacttttgtcaatgaaaagtgtcaaactctaaaatattctaagagatttattctgagctaaatgtgagtgaccatggctcatgacacagccccaggagatcctgagaaaatgtgcccaaggtggtcgggctacagctt

SEQ ID NO: 40457 - DNA, 1034 bp, Homo sapiens
ctctcacatctgatctttccgtgtgttaaggcagaagcaaggcacggtgggctgagactcacacgccccctctttcctccccggcctaacgcactcttctttctgtcccaccacgtgctgtgttcgcgagtccccatcactcctgcatccaaaccgactagatttttgtttccatttccctcccggaaaaggcgggacagcgaagactggcgtttccgccgctgaggggctgaggccgggagggcgcagcgtagccgtcccgagctgatgacgtcaaacgccgtgtgctcacccacgtgtggtgcccctctcccggtgtaggcgctggagctgaggacgcctttcctgcgggcgtagttgctggctgctcgggcactgggacctcggcggcttggggacgctggccgcgaagtagggagcgcaggtggccgctcggggtgagggccctgggtcatggagcacttcttgctggaggtggcagccgcgccgctgcggttaatcgcagccaagaacgagaagagccgcagtgagttgggcaggttcttggccaagcaggtaagacgtgaagggagagggaaagcgccggaacgactgggtcgccccactagtaagcttcctgcgctcccccgccgatactcgccgctttaagtggggagtggtgcagcctcaggtcaagctggccccctcctgtgggctggcgcaggtcgtggaggtttccgagcgtgtttgaggcgattggaaggagtcttttgtttttatctgggggagccttccagtacccttcccatcgcctctcacccctatgcaagcgctttggctgcttgtggcagaggtggccttcccaaaggaatgtggtttgtttttctgaaattgaggttgcgtttctgccgttttgacaagtgtacgtatcacctaagtgtgcgtagtgcagccactcctgttagtttggggaaccatcgacaaatactgattgcattcctgctgtgcgtaaggaacggtgtggcgctgtgagaaagtggatagataaattcgtt

SEQ ID NO: 40458 - DNA, 1089 bp, Homo sapiens
tgactgtaagctaagatgaaggccaaaaactgaccatccggcaatttggaggccatttgtgatttcgttgagcacttttgggggagcagtagaaacaaaaaccaatttgattgtgttctagagagaataaggctttttgagtgaaagggaacagagaagtagatcagtagctggagggaaacggtgtcaaaagaggtttcatttggttttttattttaagtaggaagaaatcccaacatgtttgtactctgtggtgaagattaccattgctcacccacacccagttttcctctttcctagacacacaggaagactaaatttgtaatcaggtaggccatatgactagatctagctgatgaaatgtgaggtgaggactctgctccaaggcagtcaaaagtaggtataagctctttatgctttgtcccatccacttagctggtgtcaaaggactctagagtgatgaagctgtagcctaggtccctgagtcactgttggaagagagccagcaaaatccatctgactcaaatcagactctgacatgatgagaaataaacttttaagttaattaagcactcaagatttggtgtttctggatgtgaaggcaatctggctgcaacatctgtcaccccaacatcgccaggttgattgggctgatctggctggctcagtgggtgtcgtttccctccctcactgctccacgtgtgtccctcctgaagctgcaggcttggttgaagaggacgaccttccctgatagaggaggaccgttcttcattcacaagtatatacatagctgtgctgcctgctagaagctccaaacaatctctcaagatgtggtgttttatctgttagcacagcaaagcctaacctgtcctaatacctgggctgaagggaaagttccaaaagagagagaaaacttgatgatacaggagacagaagttcaattgccttcagtatgcaacagaggatgggatctactaaccaaatggccagactcaataagtcacatcctaatctgaaaatgatggattggggctggatgatctctgagatcctagcctatgtcacacaggtttacagtccttgaacttg

SEQ ID NO: 40459 - DNA, 1055 bp, Homo sapiens
ctagttcacttacccttcaggttttgagtggttcagcctaagtttggcacagtcctagatgtgggatctgaatcattgctatgatttctgtctttcagatggtgtaaggatcactagatttcccttgagagtaaaagatcgaaagcattcacagcaccttctttgcttgggggaaaaataaaagcaactagtaattttcaccattaattcagtaagattctaagaagtgtaaacttgcttttctcaccgttgttgaaaacagcccactcaggtttcttaatcacatcagtgaatacggttattttggcactttgggaacactagtagctggacctggtctgtccagagatgacatttaattggatggtttaagttgtaggaccccaaaagatgggcttcacaatggcaaaccattaaatggtcatcctttgaaccatatatacactacctcttggttcatcatcctgacttccgtcattcctatgggactaaggataatactttgtgttcgggcagaatcattccctgtgtaccaccagcgcggtgtgcatctcttgggccaccaccaacagttacacaagctttgtactttgtaactcccaggagtacaactcacatccatagtttttgcaaatagattccctagagttgtgtggtgtttgactaagcagctcttcacagtgatcttaggagaaaccaaagaccccatcacccagatatgatgctgatggttacaaccagtattaaatcacagaagtcacaaaccagacgccttcaggggcctggcaaataatataaatgagtgaagtaggttgtatataggacagtaggaagtgatggggcaagcacctgctccaccaaaaggcatctaaattcaacaaaaaacaagaagccaggtgcagtagagtgcacctgtagccccagctactcaggaggctgacacaggaggatcccttgagcccagcagttcgagacaagcctgggcaacatagcaagaccccatctttaaaaaaataataacttgggaggccgaggcgagcagattatgaggtcag

SEQ ID NO: 40460 - DNA, 1050 bp, Homo sapiens
ggtgagggaggttatgagacatggccaaaatggcttttataaagacccactcctgttataacagactcactccctcattaatccattaatgaagacagaaccctcatgacccaatcacctcctaaaggtcccacctctcaacactgctgtcgcaaggattaagttgccaacacatgaacttttgggggacacattcaaaccataacagtgagcttggatagatgaactaccaggaagcaacaatttatttcaaccccagcccccaaacatgatcctcccctggagttttcccttacagtaaatgacaccctcattcatgtaattgcagaagctgaaattctcaaagttacccttaactcttttcattctctctcaccccacatccagtccattagcaaatcctatcaactgtacctctctgtacctttgaaattcatgccaaatcaggccgtggttgccactcttatgcttcctcactagtccaagccatcatcatcactcacctagactgttacaagagctacccaacaagcctttctacatctcttctgacccatattctatgcaaaaacaaatattgttattgtgaactgcttttaagttggaagagcaacttaggtcagtataaattaaatgaatgcctattaaagattataggtatgtatgttttgagcagaagaagggaaattattttatgtgaaagtttgtatctctttatggtttgtatgacttgtccttatgtttctgtgatattgtatatgtgagtatgtgtttttatgtgctcatgtgtggtttccttactgatggaaagacagagaccccttcatgtttattctcacagtagcccacactgtgcctggtgcacctggtcaatacaccatgaatggcagcaaaaggattattcttggctgggcacagtggtcgtgcctgtaattccagcactttgggaggccgaggtgagtggatgagcccaggagttcagtcaataccagcctgggcaacatggccaaaccctgtctctaccaaaaaaaaaaaatacaaaaaactagc

SEQ ID NO: 40461 - DNA, 1126 bp, Homo sapiens
atcaaaaataattaaatattcaggaataaatttaagaaaagaagtgcaagacttgaacactgaaaattacagaatactatagaaagaaattaaggaaacataaataaatggaaagacatccaatgttcatagatcagaagacttgttaagatggcaaaactatccaaacctatatagtcaacacaatccctatcaaaattgcagcatttttgcagaaattgacaggctgattttaaaattcatatggaaatgcaagggacccagaatagctaaaacaatcttgcaaaagaggaacaaaattggaggactcacacttccttttttcaaaacatcctataagatagtgtagtcttgaatacagtacacgtatgctcaaagttttcaacaagggttccagaacaatttgatgaggaaagaacagtcttttcaacatatagtgccaggacaacaggatattcacacacagaagaatgaacttggacttataccttacaccatatacaaaaattaactcaaaatggatcacaaaaataaatgcaagcaaaaattctaaaactcttagaagaaaatatagggatacatttttgtgaccttgcgttaggcagtggattcttagatataacaccacaagtacaaaagacaaaagaaaaattagataaatgggacttcataaaattaaaaacttcatgcttaaaggaaaccattaagaaagtgaaaagatggtccacagatgggagaaaatacttacaaatcatgtatctgacaaaggatgtgtatccagaatatataaagaattcttacagctcaatgctcaaaagacaacccagacaagtaatggacaactaaaatatgcatttctcagaaaaagatatacaaatggccagtaagtgaatgaaaagatgttcagcatcattggtcattagggaaatgcaaatcaaaattatagtgagttaccactttacccccactaggatggttaaagtctaaaagacagtaataagtgttggtgaggatgtggagaaattggaacccttatacattgctggtgggattgtcctgctacagccattttggaaaacagttcctcaaaatgttaaatacagagttaccatttgtcccagtatat

SEQ ID NO: 40462 - DNA, 1809 bp, Homo sapiens
ttgcaaaaggatgggaagttgctctagcccttgcatggcattctcaggttatctattcttagtttagtttccttttccaaaaatgatgtttattatatagtcttcgaatggaacatatcgctgacacctactgccatgtgtttatagttaaacataactagcctcccttcttacaagaccaagaggttcatccagaatgtttccctttagaagtcctaagaaggctctcctggttggctttccagcccataacagtgatagattttgcagccttcttagtctagccatgtggagaaacctgatgttttgggtaattcacccctttaaacatgtgctttgtgttttggtggtggttgtttggggctgcggtgtcttaggcatggagcttattatatccatataaattacagatcgcagacactccgcctcaaatagcattggatttatgatccctagctctccctttgcagtgccccttctcctcatgtctgctgtgcaacctgacttatggttgagcctgcttcaagttcttcctgccagtttgtccccttttccgcagtctgccttggtagctgactgggaggggccagcatgtgggttatcccattgtctgtggctgtacacaagaggctctcagtgggtctctttctacggacaggaccctgccaaagtaacacttgtgcttcctgtccagtactgactaacgcagtgctattcaaaaggcaggctagaactagggccatcagaatgaacacgttttgagcattggcagatatacttcctcccttcctggcctgttgttccccatcactcaccagattcagaaggtgcagtgctccttgggagcaaggctggggcgcttagagagagggtcccttaaagaggaagggggctaccctggctcattatgaactttttgggttctgaacctaccactcattattctgaattgtgcagcacatgtctgtcacctcctagtatagagtggccttgagaaagtcacctactccttctaggtctcagtttctcatctataaaaggagtagattactcttcaaatgaccttcaaaattgcttccacttctaattttgttttaagacactattgactacacttctcctaaaaattgatctttttgacgtgattgggctcttgagacttttttaccctttgtcctgatctgattctctccatgaatcaattttgttcatctcatctgtcactcttcctctgtatgctttgtaacctgcatttcctctacttctggcacttttttgccaatggaacctgcaattctactctgcaaatagctagggttgtttcctccctcactcccagccaaaatacagcttttatagtagtatctctgagtagggagttgggctattgagaaaaacatgctatagcccaaagtccctattttaaaagagatagagattggaatgatatgttctttttagggtgtggatgttttaggctccaatgaccataatcaaaatagatctataaccaagccgtaaaagggtaatatatgtgaattttctcataatatgaatcctaacacaaaagcagttacaatactttaagcgtaaattacatagtctgcaccatgattttttcaaaatttgtcttacgaacctcaaggaggaaaatgtaccccactggttaggaaagaattattttctctaggttccataacatagaaggagtgttttatttcctcactgccttgtgcctgggaatactgaaatgatagattcagccatgttttaataaaattcctctgtaagaatattagcatggagaga

SEQ ID NO: 40463 - DNA, 1032 bp, Homo sapiens
ctgtatcttccagtgcttctgagcacacctgtccagagagctctcaaaaaggtaatcagtgttcaagtttgagaatcctattctagcatggctaggaatgcttttcagttaacaccctaaggatttatatgtaagtgagtgcctaaggttgcttactgttttgttttcttaagaatctaatatattctcaagggaattttacttacactagggttaatcactttttcttcttgtgaaactagtgaaatccaaatgaatgaagtttaactcttagccaaaaacttagcttgtggttagagtgattttctacagtacagtaactttttttgttacatgttctactattgctgaaaaatgatatatttccaagagggagaaaaggatattgtgagtgcagaagacggttgtataacctgctttgcttatctcaaatggctagactttagtatttaattaaagaagtcttgcctctcctatcaagttagtcattattttgaaggttgaacgtgggttttgtaagtgactaattgctttgtatgttccttttcaattacaataagaagttatgaattctctacatttagaactgctaaaaattatttagatttacctgttgaataggtttattctttaaaaaaaaaaaaaggaatcgagaaaaaatttccactgtaaatttttggattctccaaggaatttgtaagaaatctcccatgaaaaagagagtgatagcaatttgaaaaggataagtagttgcagtctgaaaactcagtaggtagtgtgaaagcacattaatactgaaccataatatgtaatgtaagattttagtcattaagaaaccactatattgctgtcttattgttctgttactttaaaacacagtttttacctaaagacttaaaacccaccaatggtattataaatttccttttggtcaaaaaactgacagttgtactgtagcaaagctagtcatttgaacagtggccttttcatttataatggttatagtttttaatatgtcaaaatcttagcaag

SEQ ID NO: 40464 - DNA, 1070 bp, Homo sapiens
ttcctgactttttaatgatcaccattctaactggtgtgaggtggtatctcattgtggttttgatttgcatttctctaatgaccagtgatgatgagcattttttcataagtttgttggctgcattaatgtcttcttttgagaagtgtctgtctatatcctttgcccactttttgatggggttgttttttttcttgtaaatttgtttaagttctttgtagattctgggtattagccctttgtcagatgggtagattgcaaaaactttctcccatctgtaggttgcctgttcactctgctgatagtttcttttgctgtgcagaagctctttagtttaattagatcccatttgtcaattttggcttttgttgccattgcttttggtattttagtcctgaagtccttgcccatgcctatgtcctgaatggtattgcctaggttttcttctagggtttttatggttttagatcttacatttaagtctttaatccgcatgtggtattttttttggaatctgtatttcaaatagccaaggagtgatttgcaatttcctctctctatcatctgatttataaaaggaacgtagtaatattatgttcatagaatagtaatgtgcatggagtaggagtttatctttgaaaatgtaaattgcaaaatcattttcttagcagtgaaagatgttaatatggggaatacagctttggaattctccatgtcctggacttagttagcagacatgttattctccagtgtagacaaaggctgattactaagaactaaagatggttatggtgggcttgtggggttataagtacctttttcttttcctgttgaacattttctatagtcttaatatattataattaaaaatagtatatttttcatttttaaaagcactgcagttccagttaaacctccgattccatgtattatgggaaggtgcagatatataaatccctcctagatgcaacttaaaaaaataacacacaaattgagtatcaggaaccttacaatattttgctctcctctcagttccacctgtaaacacctttcagaggaaaaggctacaagtc

SEQ ID NO: 40465 - DNA, 1027 bp, Homo sapiens
ggctttggtgtacatctgccaaagtgatattctcatgtagaagaaaggattgggtgatagtccaataaatactttaccacagggaacttatgtgtcttctggggtctggccaaagtcatgagtgcaagctcccaaataaaaaaaaggtggcttctcacctcctcatgatcccagcttcctagcatagcactcttctctattttagcttatcaattccaaatgtgattgaaacaagtatgagaaattgatgttgcttcagcttctctgtgaactgaaacaaattcttgttgaaacatgatatctcctgcctcatggatcaaagagggatggtctggaagagaagcccccataaatatttgaggcttaatgaaggctatctgttgaataatacacctgtattattgtaaaaagttttaatttggcctcagagatactccccactaaagcagacaacaaaaaagtgagaaaatgaggctaggaattaataaaagatgtcaagaaagaccatttaaggacttcttagagacaggccataaatgtggttttgaactttttggcagctattatgaagacggaaagagaagtgtcatgggaatcaattttcaaaacttaaaagttctcttaaaattctagcagaaaaatagtttgcagctctacacaggtattggctagcattagtttaaagtggttgacatgcagccctactgcacacctctttatattccctttgtgtttaggattagaaaaactcacatagtatgatctatcatatgtctacttctggattatttcaagattgataatctggtttgtgtattatcttggtcttcatttctctttccttctgggcctgttgttcatctactggacatttcttttcttattaacatttctgctaaattttaaacagagaaaagaaaaataaatacacaattccagctatttgcagaggtgatttcaatgctttgtcagctaaagggaatttcaagagagatctttctacatcagtctactcataatagaactc

SEQ ID NO: 40466 - DNA, 1075 bp, Homo sapiens
ttaaggtaatgctagctgctgtaaaaataacttctcagttcaacaacatgtacatcattcagacagaaaattagtaagaaatgcaggacttgaattgcatttttggccaaatggacccaatagacatgtacagaattttccatccaacagcagcagaatgtaaagtttttctagagtatacatagaacattctccaggatagaccatatgttaggccacaaaatttaagattgaaattatgtctagtatcatttcagatataacttcaaaccacagtggtataaactagacatcagtgacaggaggaatcttgaaaaattcacaaatatctggaacataaacaacatgccccagaacaaccaatgggtcaaagaagaaattaaaagataaatttaaaaaatgccttgagacaaatgacaacggaaacacaatataccagaactgatgggatataggagaagcagttctgagaggaaagtttatagcaatatatgcctacattagaaaagaagaaagatctcaaatgaatagtgtgacattacacctcaaggaactagaaaaagaacaaactaaaaccagattagtagaaggaaagaaataaaaatcagaacaaacataaactaaatggataatagaaaagccacaggaagaatcaataaacttaagagttgggtttttttttaagtaaaattggcaaacccatagatagtctaacaaagaaaaaagaaaactcaagtaaaaccaaaaatgaaattgaagaaattacaacagacacctcgggaataaaaaggatgataagtccctattacgaacaattatatgccaacaaattgggtggcctagaggaaacagataaattcctaggaaaatacaacctaccaggattgactcaggaagaaatagaaagcctgtaacagaccaatcacaaatagattggagaagtaatgaaaaacctctcaacaaagacaagcccaggaacagatagcttcacagctgagttctaccagacattcaaagaattgataccagtacttcttaaactcttccaaaaaaatagaactagaaggaatacttt

SEQ ID NO: 40467 - DNA, 1033 bp, Homo sapiens
ccgccagcttgtcttgtgcgccctgtaacccactgcatgaacccgagtggcacttcaaccggattttcttgttggcacttttatctttcactgcttctgacttgcctgttgaggtttatgactaaggttgtgattaaaaattccctttttaggtatgaaaagtcttttcaattactttgtgttcctttttttgttttgttttgtttttgttgtgtgtggactttctgggttttgtaaaaatgaatcttaaaaaaatcttaatattatgtaagagttagataaaggttaagtagctaatatattctctcatcagggcatagaatcaacgtatgttcttggaagattaagtgtgtcaaaatgcattttatgatggaagcactgtcagttgtttagaataggcatggaaaagcccttttcagaatattgtcataaaatcagacttggaaaggttttcgtttattcagtctgtattcccctatctgtctgtttaatctctgcatattactgtccttggagcacggagaaacgtgagctacccttggaggtttatagtcccactggaagggaactaatgtttacgcctgattatatgataggagctttacatgttcttattcagtctttgaggaaaccttataaataagataataactttttcagagaaagaagctggggttctgagacattacccacttaggggcacccagaggaaagagcaagacctccagctccatcaccagtaatttccagcctgtgagcttccctccacactcagtaatttaaaaaacaacttgatttagggacatctagtaaatattctagaagttcagaggcagaaaagctagtttgcagctgaagtactcagatttcccactggctgagtgggaaatcagacccgagccttgacagtgggcagaatttgtatagaggagccaagagaagaagagtttccacactgtataagccaaatgatggaaggtgtaataacaaaggaagggtgagcacacaggtttaggagatgctgtgtgggcca

SEQ ID NO: 40468 - DNA, 1034 bp, Homo sapiens
gtgtatttgaactatgaaagtaggtttaaaagttacacttttctttaatgcccattgatgatttctttctttttttttttttaagacgaaatctagccctgtcacccaggctggagtgcagtggtgtgatctcggctcactgcagcctctgcctcctgggttcaaactgttctcctgcctcagcctcccaagtagctgggactaaaggtgcacaccaccatgcctggctaatttttttgtagagactgggtttcaccatattggccaggctggtctcgaacttctgacctcagatgttcaggccgccttggcctcccaaagtgctgggattacaggcgtgagccgctacgcccatccagaacaacaggcactggggcctactggagagtggagagtgggaggagggggaagagcagaaaaaaaaaaacctatcaggtactaggcttagtacctggatgacaaaataatctgtacgacaaacccccatgacgcaagttacccatatcacaaatctgcacatgtaaccctgaaggtaaaagttaagtaaataataaaatattttacatttatttaaaaattctaaaatggttgtattttaaaagtaaaaacaaattttggttaggatttgagcttattccatttttcttctaattttccaaattaaatgtaaaatgagagcatcccaggtagggggaggtaggggagaaaccaaataattttcaagtcatatttgaagagcaggtatgttctctcacgatttacagtgcaggtgcattttaatttaactgctttaaatgatgataaaaattgttcaagtagaacaaagcaaagttttagaagtgacttgtaaacagccattcttaattttttcctgttttctctccacttatgtgacttgcatgaatttctgaagcagtcctttcaaatgacactgctccaaacatgtgaattgcattcatcaacaaaatccagccttttcctttgtaggacaatgtggggtcacggggcaaggggtcttttctttgtctagcctg

SEQ ID NO: 40469 - DNA, 1074 bp, Homo sapiens
ctctaatattaatctcttaaatgaaattaaaaggcaaaagaacatgattgagcttaaatgatcatttcttcctgcagtgattcttggattgttttctcatgtatttgaaaaaaaaaaaatgaagaaaaataatggaaaatggaagtaattactccagctaaaaaaagcttggacttagatttctttttatgataccaaatgagaaataaaccaggcaaatcagaaggaagttaaagaagcaaatataaattcaacaagtgtcctaattatcctggatattggaatatttgattttccttacaatcccgttctagaatgcctgccgcctttcaacactttcaagagaatttcaacacttacagagtatttatattgttaacagtaattttgctaccaaaaccttcagaataactttaataataaaatgacactgaaataatagactatacaaactctatattttttcagttggtgttaaaataagtcacattttgataccagtacaagatgtcttttaaataaggatgtcatcagtctgatttttatagcattaatgttttatgaagaaaaagttcaaaatgaaagcattaattgctgtgattattagaattctatcatgactgtattgtagtttttgctctatttcagataagcaagatctaagaagttatcaaaactattctttaaaatgctaaagcaggtaactttttcttccattattttttcctcctaccactgagttttgtaatgaattccttgtgtatacaagcaatacaggtgaatactaaactgttatttttagcttcttcaaaagctattttagaaagcttcctggaaataaatgtcttctgtcatttaatttaaataaaaggagtgttaattgttcccaaatttgattacctagctgaaacagatattggattcagcatagtaatagtaaaataaaattggcagagaaaataactgtagactaggataaagcatgactcctccatagcattgttgcttgtatgtacatctgtcactccactgaaagggacctagtcactttaaagaggccttttatctcagcac

SEQ ID NO: 40470 - DNA, 1093 bp, Homo sapiens
tagaatgtgaaggataaaaacttcatgatattttcccatagccacatagaacccttcccagccttttttcatccttcctacacaaaaagaggatagaaaatgaaattttctgaaacttttattttaccattttatctgcttcgctaattatccaagtacagttacttaataaaaggattatgttatttgtatgattacactagaagtagatgagagttccatcccagcccataattatatttgattagtgtacctaagatgcaaaatgataaaccaagaataaaaattctcattaattgagcttccatcatcagctactaaggtatgaatttttccatcatgtgtaatattatgtggtatttgtttgtaggcaagaactagttgcagaactggaccaggatgaaaaggaccagcaaaatacatctcgcctggtacaggaacataaaaagcttttagatgaaaacaaaagcctttctacttactaccagcaatgcaaaaaacaactagaggtcatcagaagtcagcagcagaaacgacaaggcacttcatgattctctgggaccgttacattttgaaatatgcaaagaaagactttttttttaaggaaaggaaaaccttataatgacgattcatgagtgttagctttttggcgtgttctgaatgccaactgcctatatttgctgcatttttttcattgtttattttccttttctcatggtggacatacaattttactgtttcattgcataacatggtagcatctgtgacttgaatgagcagcactttgcaacttcaaaacagatgcagtgaactgtggctgtatatgcatgctcattgtgtgaaggctagcctaacagaacaggaggtatcaaactagctgctatgtgcaaacagcgtccattttttcatattagaggtggaacctcaagaatgactttattcttgtatctcatctcaaaatattaataatttttttcccaaaagatggtatataccaagttaaagacagggtattataaatttagagtgattggtggtatattacggaaatacggaacctttagggatagttccgtgtaagggctttgatgcc

SEQ ID NO: 40471 - DNA, 1033 bp, Homo sapiens
gtcccagctactcaggaggctactcaaggaggatcacttgagcccaggagtttgacgatacctccttgagcttttttactttatgtgtttatatgtacagcatataaattttgaattgttggccaggcacagtggcttatacctgcaatcccagtgctttgggaaactgtggagggaggatcacttgaggccaagaggtagagaccagcctgggaacgtagcaagaccctggctctacaaaatattttaaaattaactgggcatagttgtgtgtgcctgtagtcccagttactcgggaggctgagatggaaggatcgcttgagcccaggagtttgagggtacagtgagccatgatggtaccactgcactccagcctgggcaacagagcaagaccctgtctttaaaaacaaatctcactgtgatggtggatatgtcctttttccttgcagttttttgatttatctatttgtatgtacagcatataaattttgaatcgttggccaggcacagtggctcatgcctgtaatcccagcacttagggagactgaggcaagagggtcacttggggccaggagattgagagaagcctggtcaacatagtaagacccatttctacaaaaaaaaattagtttttaaaaaataaattttgaattgttgtattctgaattgaaccacttatcatattatctctttctctagtaattttttggaccctaaaatacattctctctgatattaatataggtaccttatttggggtagtttttgcctggttttctttttttatcctttaactttctgttttctctgtctctgtaaattagatatgtctcttataaatagcatttaattcatcctgacaatctgatttttttttaaatatcttaactggagagtaattcatttacatttattgtggttactgataagtttgctctcttatgttttatttctctttcttttctttcaagttttgagttgaataaatttattcttcattttattattttctttctggtttgggagttatata

SEQ ID NO: 40472 - DNA, 1032 bp, Homo sapiens
atagggatcctagggctaaggggtgctatactaagatgtactgtactagtttctgtgtatagccacctcactttcaataaaattctctatttgtggcatattaaatagggaagttaatctaactttataatgaatatttaggtggcctttctgccatattgtatagtctaccaagatcactttttgtaatctaaaaaattcaactctaagctaataaagctggtttattggaaagcaaataaaccacctgacggacctttccagtgaaagagccagaatttgttaaaattagtaaagaaatacgaaactttggcagcctaaattagaacatatattttaaaattacatgttcagtttaccatgaagcagtaatgtaatgctagtgtatcatgctatgcatttttttaaatcttgggtattttacacatgaagagaatggtgtcccataatgtgtaatattcaaaactcgtgaatctcaaaatttctaacatttaggttaagagaagtctccaggaaaatgtagtgttgattcttacatgaagacagtcttcaggaagttttaaagtagaaaataagagtagtgtaagtcaaggaaaactatgagcttaactgataagaaaaattacaggagtggctgtctgggacctaagccagcagtctctggaagaaacccgggataacttttaaataccagctcaggaaatcagttgtacttaaaagagcagcttttttgaagaggggctctgttttaatgacattactgtaaaaagaatggaactgacccctaagttgctttctatttgcggtgggcaggagtgcagatttagtatgcactggcaatgtgatgtattcttagaagtcattctaaaaagtggaatttgttctctattataagacatgaacgttccagaattcattacagaatgaaatactcaggatagcatatgcaggtttcagattccttgatcaggcatctgtttacatcatgctgtcctcatttctactactttttccatttacactaccatgtat

SEQ ID NO: 40473 - DNA, 2096 bp, Homo sapiens
tgacagactttgtgtttactgtgaatgtaccctaaactttggaaaatataataaatatttggtactagaaatatgtataagtatgactacaaaagcatatacatttcacactttgattcaataattattatttaatcattggattttactttatagcacacttcaagaaacacctaacttgaacatgtattcctgtgtttgtgtaattaaaacaaatacgacaacttactttttaacgcctttcttcctctcctccttcgttcccccacccccatcacagatcagtgatttcacttaggtagactgtttctatgaatatatttgaaattttgcttcctcattaccctgcagctttgtctctgttctttttatttttttctgctaattaaaaccagtgtgtaaaacatcttgtatttggtagttgtttgctctttaatctcgccttttctgagcatggatgaaaagttaggtagttctgcatgccattctgcatgaaatgttattaacatgaactatttgaaaatgagtctatttttgtagttaatcattttccgtgttactgtttgtggttgtttgcatgtatactgtatatatgtgtttttgcagcctattccaagcctaaacggggccaccgtaaaactgcttcatttggcaacattctggatgtccctgagatcgtcatatcaggtatcatagaccacctgagttggtctaatagctgtggaaccggaataatgatccctggtacttgtaaaatgcttcttgctccaatttttacaagacatgaaaatggataccttgcatgcagtaattagggagacagattgaaaaactacatttattctgaagcagtcttgaaaagatacctctgatctacaataagtgaggataaaatagaagagaaagtaaacctttttggagaagggagaacaccaacccagaattctaccaacttcctctctacttttaagtgagcacatgagctaaacccagaccttttttgcacccaacagaaagaggaaacaactaattaaaatttgttattttccttggctcctttccttcctcagttactgctttttgggtcccctctagactttctgtcctaacctctttctgttggtagcaagtgaatgtgaagttgagagaagagagttgctaaatagcattttgccttaacctggaaaacaaaaagtaaagctaaatgagatgtgctgttttgcagggtatcttgccaaagaatcatgtaaaatagttggtcaattctgatttttgtgtattatcaggagaatctcataaattacatgtttttatacctaacttacacatggtactttagtgtctaaaattggtaaactgctttatttcttatggtgatcatttcatagaggaatatgttaccatttttaatagaaacttaaatggcatattgaccttcagtattgattaatgtattatcaaaattatcatttatttatccctttaggcttttctctacctctttacccaaaatcttgataaggaaatacatattttccacacacgttcatgagtgcgagttggatgaattcttcagcatgctgtcctttgcctgtgattgtgtttttagcagtgttgataattctagttgaatacctaatggttattttctcctctactaaactgaaaactatgtaaggatagaatccatatctttgtgcattattttgttgttgttgcttattattgattgtatcagcagttgctggctcagtgcttcacatattaagcatattaacatagtgtttaataaatacatttattaaataaatgaacagacctattgagcatctcccctggtgagaaactagcatacaaaaatatgaattatactattcttaggtgccattttgtctgtataaaactatcttatattaattttcccctggttatcaaagtggtttcttattttacaacatcattactattgctattcaaagagtagagttaacccatttttcacatggtaatttttatttattgaatctggactgcttcagaaattaacaaagagatcattttacatggagatcagtttacctccatgcggaaaggta

SEQ ID NO: 40474 - DNA, 1061 bp, Homo sapiens
gtagtgtgccataagactgctcataatttatattactttataaaagtctttatctgtttgaaaaaatgtggtaatgtatattgattttacttcaatgtaggaataacatttaatagatgtactattaaatgttaatatcatggcaattatccactcaaaattagtagatattttcatcctttttatttagaagaaaaattaaaaggccaggcatggtggctcactcctgtaatcccagcactttgggaggccaaggcaggcagatcatgaggtcaagagatcaagaccatcctggccaacatggtgataccctatctctactaaaaatacaaaaattagctgggcgtggtggcacacgcctgtagtcccagctactcgggaggctgagccaggagaatcgcttgaacccaggaggtggagtttacagtgagccaagatcgcaccactgcactccagcctggcgacaaagtgagagtccgtctcaaaaaacaaaaagaaaaaagaaagtaaaaaattaaaagcaggactgatggagcatatgtatatgtagaaaaatacccagtcatgtgttctgatagtgcttgcattcacattgtgtcttttgttatatgcaataaagttctttttagtttgtgcctttctttcgcagtgctgcatggtgctgaaccattgccatattatactgctgcccacgcaatgagttggtgtttacagtgttcccaaggagtggcttatcttcacagcatgcaacccaaagcgctaattcacagggacctgaaaccaccaaagtaagttataataatgtgacacccctcagcctcttcctccttctctctcactctcaccaccccgaacccactctctaattcaagctcattattgtacaggagtttctcttttctctatttggcttactcagtgtttacttttaactcaccttcatcatttagtcatttatctaagcttgtattttagatgttgtctttagtgggatttttatttttggtaacctctaccttagattagcatacttctagaatctgttagcctataaaaatctc

SEQ ID NO: 40475 - DNA, 1033 bp, Homo sapiens
gggtgctgtggaaagcttccacaaataatataaacagcaagggagagctctctggtctgtgtgatggcttccactgaaatatcttgccttattatctgttgttaatggattagccttgaatgcagtgattttcaaacattgaaactacctggagggcttggtaaaacatggattgcttggccttaccgtcagactctataattctgggttgcaccctgagaatttatatttctaataaatatccaggtgatgttgatactgctgaaccggagaccacacttttagagccactggcatatgctttcactgtccttatatctgctttccttctggaacgtctttttcttttggcttctctgactctctcctagtttgcctgctaccatattgactgttccttcctgttccttgcccattccttctcctctcttgtgatctaaatgttgaactgcttcaaagctcagttcctctactccactatctccatattatttttggttacctcttccaactgattgactagaaaaactgactacatgctaatgactcccaagtttgtatctctttgtctgacttctccatagatcctctcactcacgtttctaccttcttacttgatatctcctcttggatatccagtaggcatcttaaacttcatatgactaaaaccaaactctgagttattaaaaaaaaatctgcatcattcttatccctcagtaaactgttgtccagtctaggtgttttccttgattcagctcttttcctctacacctgtcctgcctggatgcagagcatcagcaaaccctattgactctacttctaaaacatttcccagatctgcccagtttctgcactaccattgaccttgccctcgtagctattgttgcttgtttggactgctgtaatggcttcctaatgggtctctatttacatatcctagcttccctacaatcctttctttaagagctataatgattttgtttaatgtcacataccatccttacttccttgaattttttcagttccttcacat

SEQ ID NO: 40476 - DNA, 1024 bp, Homo sapiens
atcccagctacttgagtggctgaggcatgagaatcgtttgaacccaggaggcagaggttgcagtgagctgagatcatgccaccgcaccctagcctggacaacagagggagactctgtctcaaaaaaaaaaaaaaaaaaaagatgatagaagaatcctaggattacctccttaaaatgtctgacttagtatgatatcagactggagtaaacacagaacagttaactatagaccacaaatttaaaactgaatatagtgtaaattaaacacttaagccataatttgaaaatagagttaatcacagaaggttccattgagtagggacaagtttaaaactaggttttgaataaagtgaccatcgtgggttgggaaagtcactaagatgaattttctttgtagttgttcctctgcctaaagcgctgttcccccataacttaagatgactgactcctcaccagtcaagtcccacctcaaatgttattaacacttccttagagaagcattccctgaacaacctagatcttttgtcatttctattatctttcatggtacttaccagtaactgaaattgtgtctctccttcagcaaaatgtaaggcgctttattcacttttgtaaccccaatgcctagaacctagaaggttctctatacatatttgttcaatgagtacatgaaagtatcacagcataatcataagaattaaatgcccatcttgttctcttatattacatgtgataaaataggagctgagttatgcgatttggctaaggcaacacgttagaaatgagatccgagtcttgttttaatgtcgactctattatagttagcagatacttttgtttagcagggataaaaaatgctgtaaagggccagatgctatgagtaagccacgtatggtaggtctttactacagagtgctaaaaagacactatttacaatggttgcttttgaaaagggagacccataatgctgacctcaactatagtgtaggaacaaagctatagtattggacacataaaattactg

SEQ ID NO: 40477 - DNA, 1026 bp, Homo sapiens
taatcactccatcacttcagggatatgtatatatagagaaagatatataaatgtagatacagatatggaaaaatactttttctagtatttgagcatatattgtatttgggaagtagaaaatcatcagaaagtggtgactaattgtgtatataagaggatgtgaggcaggaggatcaggatgtgaggccctggagttcaaggctgcagtgagctgtgatcgtgccactgcactcctggatgacagagcctagttacagagcaagactccgttttttgttgttgttgtttgtttgtttgtttgtttgtttttaaaaagagagagagggagaatgaaagaacctgggacagttttcagctttctgactgggactggatgtgccgttagttgaaatagtaaaggattgggaagagaggtgataaattcaattttaaatatatacaggggaggtacctatggacaattcagatgaaaagtttaataaactgatagaaatacaacctagtgattaggagagagtttggtcttaaattttatacttatataaattttcaaaaattactataactaagtccatctatttactttttaaactttagagttagagatttttcttaaagaaaaaagtatacttttttcccttatacaaaagaattttttttcaaatattgttgatgccaagtactgtactcattacatcctatcctacaaccttttatattttaaggtgctatttttgaatgtcagcatgcatcttaaggatgtgtttccctaaaaatattaagaccatcaacatttcttaaagccagctttttgtttgcctacttttggccttattttctttgaaaattcaaagattttttttttcctcagagggtcattttttgttacatttctaccattatatcagtcagtgtcaaaggatttgttcttccccctcgaatgctgttttagtgttctccgatcccttcttatttctgctgtttgtcttcttgttctcttccctttgctgctcagatttggaacat

SEQ ID NO: 40478 - DNA, 1031 bp, Homo sapiens
cctaaaagctgcccttgtatctttgcatgtttctctgaggtcccctccaacaatggcaagttggttcctcccacagttgaaatttctctgacttctacagcatctctgtttgctcttaagggctcgtatgactagatagtgcccactgggaagaatccaggataatctctttattttaacgtctgtaaccttaattatatttacagtactcttttggccatggaatttacatatttacatgtttcagagattagggtatagacatcttcgtggggtcactctgcctactttgctgtgctttaaaattgtctttttccctacttcatgctaagaaattttcctttacaaatagttaagcttaacctgttggcagggggtagagggaggcagtacatagaccttatgaataaattccattctgtaatttaaatacgtgttttgtaattgaattttagttggaaattgattaagatcaaagatcacatatgagtgcttgaagctcaaaatctgtaaaaatgctgattggttcaggtctgtacataaacccaccattcttgttactgattatttttcaatttaaagccttatactaacaaacccattccacaaatttacttttgtgcctgtcattagacttttgctttactctttcatcaaatttatcaattttgtttttatgctgttgagatttaccactttgaactctggaaacaaattttgaatttcctaaggtcttcttgtcattgtcatttgtgaagattccaaatatgattaataatttgcttcatggcttagtctgttttatattttatttatttgttatatcttatatccctgataagacttgaagatctttaagggcaaaggaagttccatctgttttttcagttgaatttaatttttatttttgaatacttctagaaactctagtgaaaatgaatctgttaattatttgttagaaaacctactaaaaatttatgttcaaaaagctctgttatatacagtatttgttttctcctacatctttcaat

SEQ ID NO: 40479 - DNA, 1052 bp, Homo sapiens
aaacatcatttctcttccaccgattttttcaaatacttattatagaatgaaaatttatgttggttttaactacagatcatgcttctctccagccaaagataatttgacagacgtctatcacaaaagaatagctcataattgctacaggttcaattacccttagttcctgtacttatttttttagctaaaattgcatatgtatcattcttaatattattagccaccctgtttttccaaagccaagaaattgaaatgttgtgaaattatgtgtttagcattttttatgtatgtctacatactctagaaatagaattgctgtgttacatgatacactgcactgcatgtataattatggccaagtatttcattatttaagcaaatttgtatgtatttttatgtgtttttcctatagtacaaagatgaacacctgtggggaagagtgagaaagctaaaagttgtatattttaaaatactaagctcatagtaacacacgcatttgttatttcaaggattgctaaaaatgaatttcttgctgataacgtacaataggaaaagcgttccatgaaagagcatcattctactattagcaggttttcccttgactgtattccagagatatctttatttttcctttttgtatttacctaatggatatctaacaaatttcagtggatttaaaaacttgatatatttgctgaaagatcattttatgcttgttgacccatcttacctcattgtactgttgaaaaatacaggtatatttttccatccattctttgtttaaattcagttagaaacatgtaaatgtagaaaaaatgaatggtataaataaatgactttttaaatccaaagtgaaattcattatcttggttaagttcttttctgtgaaacattgtgttttgggtcttaatcaaggtcaatattccttgattccatgctatttcaacatacaatttaatatcacgttatttaaatatgcaatcactagcctgttttcataatttcataaaaatttcagtaggtctgctttttttactacatgtattcatttt

SEQ ID NO: 40480 - DNA, 1028 bp, Homo sapiens
cataatttattgcattacctgtctttttctcatttctcatgaaaactgcatcaagaaattgttcttatctgccaacctgcacttagatacaatgaattagggaacttgttggcttcagaatgcgtggttccaagtagcttctttctgtgcatatctttcactttctcaccaagcagatggcagcatagtggcaagttatggagacatgcaggccaatttattctgccatgcactaaaaactgtgctagaatttgtgggcaaaataaaagcaagagaaggaaactaacactttttgagagccatattatataccaagctctgtgttagtgttttcatatacactattttattcaagaaatccttgaattagcaagagagatatgttaacacataggagtacagtatgtcttataagtacattttttctttttagaagggtaatgccataattggattagtcatttgaactttatgcagtataatatttctatcaaaaagaaatggtgggactttccagatacagtaaatgattatgaagaaggtattgaggtgagaatgaaagttatgattactggatggctgacctgaaggaggatgaagagttccaattcatatgtaacctcattagataagctgctttatctctctctagttaatgactctccaaggggttcataagccagctgtgatggcagcaggagccagcttcacatattgtaggtgctagacacaaccaaggatttctgcctttataacagctgaaggggttggaggtgggttggtttgatatggagggaggatacaacttaactatgttttaattcaggcaaaatgggctctgctcaagcagttaatatctgaacttgttgtgattatgtgtaattctgtgaccaagtttaaatgcagcttaagactaaatctttatatgccaaggcctcattaaaaagaaaattaataattaattcctttgctaatgttaaaattgaatgacctgaaaaatgtatctgagaattaaccatggctataat

SEQ ID NO: 40481 - DNA, 1047 bp, Homo sapiens
taagtatcgatcaacaggtcaatagattttttaaatgtggtatatatctacataatggtatactattcagccataaaaaagaaagaaatctggttatttgtagcaatgttgttgagcctggaggacattatgttaagtgaaataagtgaggtacagaaatacaaatactactacatgttctcacttatatgtaagggctaaaatctttaatagaagcagatagtaaaatagtggttactgagaaggttaggggagagaggaagatagaggttggttcacatacacaaacttatagctatataagagaaataagctatggtgttctataacactgtagtgtgatatagttaacaataatttattttatattttcaaatagctagaagagaggattctgaatgttcccagcacaaggaaatgatattaacaaatgtttgaggtaatggatatgctaatcaatctaatttcatcattacacattctatacttatatcaaaatatcactgtgtacctcataaacatgtaaaattattatgtgtcaattaaaaagagtcactttcatcctatgattaccattttgtgtactgtttgaaaacaatttaattgctatgtttgacattgtataacaagaattatttcaaattctttagttatctccttctctcattccactgactgtggcatttttctcaattcctccaaaatatagtttttcttctaactagtgtaaaaagataaacctgcttatactttaggtgagagtttacattgctaataattaattagtattcttgttcagtatcttctgctccaagaatgagtctttgttgtttttgttttttttaatttcacttcagctgatgagtgtaatggaaagaagatgggctgtgaagcaagagtcttgttttcactttccagttctgccgcagtctccttgtataaagtagaacatatgtataacaaaagtatttatacaaaatataatttaaaatatttgagacaataagattatttgagaaaatcaatgaagttactaagtttatttag

SEQ ID NO: 40482 - DNA, 1022 bp, Homo sapiens
aagacacctgcatatgtacccctgaatctaaaataaaagtttaaaacgatataaatttaacataaaaataaatatgaaattagtttctattattttgatgaatttgagccagcatttcttatgtttaaattaatactctgcacaagttaattgctttaaatctgccatatcacgatgttgatcatatcagtttatttgaaattcaaaaatactctaaatcatattttttacttaattgtattgaaattttaaggcattttctgaaatagctcttgcttttgtcttcagaatttgagatgtattaatccaatgtgcacaataaacaatgtttttataaacttgtttacttttgtcatgcacatatatattaccatatagcacaaaaattaaatttaacattataattgagttcctataaattgcatataaaaatatataagccacttagcaaagagagagatggaatttgtaatataagtatgtatcagataaaagattacaagtatacaaagctcatgttctgtagataactgttcattatttatagtacttactagaaatataatttgcctgagttggggtgaaaagagttatagttaccattattgtacttattttattttattaacatttttatcaaattattgcttttctcaagtttttttgtttattttttgcttgctttattcagttctccttgtcaccttccaccgggtccactgagctccactgtactacacttaatcttagccatgatgctgacaagcaattgagcttcactgtaaatacactttgaaaccaattctgtgagaatatttttaaacaagtgctattactaaaagtcttatcaaaagtcaagtacctgtttcccgtgatatcagtgaacaacaaaaaagtcaagcacctaacaatgtcaggtgtgtagcagttgtatagtatgtatttttctgagaaaatagattaatatattatttctattgaactgaactgtgtgaggcaatgtggcatgttgtctacatttg

SEQ ID NO: 40483 - DNA, 1096 bp, Homo sapiens
gcgggcagatcacaaggtcaggagatcaagaccatcctggctaacacagtgaaaccccgtctctactaaaaataaaaaaaatagctaggcgtggtggcacgtgcctgtagtcccagctactcgggaggctgaggcaggagaatcacttgaacccaggaggcagtggttacagtgagccaagatcgtgccactgcactccagcctgggcaacataatgagacttcatctcaaaacaacaacaacaacaaagtgtaaaaggctttgaacagttgtacatttgactgcccactacactttcaaagtgagatacacatgaaatccaagcaatttgtaacatatgagatatgaagagaatctgaaactttcatgtataccttgcatttgcctcgttttctgatgctaaactcattgaagaggttgtgagaaatattttattgggcaaccttaaaatataagttatgtgatgattatatattatttttctttcttgtattaaaatacttttattctagtagtagggtagcagtaggcttgaaagttttagtgctcaatgtactacatgaactattttttaaacactactttaaaaaggcttttaaaggtacatcaattataatgaaacattatccaatatgttttgggtaccaaggatagtacttgtgcctctcttgtaggttatagcaagaaagattcattatatgtctctcatatactggatacatgttcagatctctatccagccatttctggattatatcaagaaatgaattagataatttcactatgtgtgatttgaattttaatgatctctttctaaatagaaaattttccatttgtctatttaaattttcacaaaatacaaagaaaaataatgtaatttattgttactcataccacaataagaagctaataaggattcaaagagtgtagtttccatgtctgtattttaattgttatagatagataggaatgggattaaaaatttaaaaaaaaaatgaaaactgtggatgattattactggttaagttatgggtctaacaggttattcctttttgctcctattttcccactactattctacatctttgctggtggt

SEQ ID NO: 40484 - DNA, 1034 bp, Homo sapiens
gtttctatgtaataatgcatctagagaaaaatagacataaaagacatatcagagaaattggacactgaatttagaatcaaaatgtttgaatcccaggttgatcaagttgttttttgaccttgggcaagtaatgcaatctctttatcttattagttaatctcagtattacatgaagcaatatatgaaaaaatgttttataaaataaaaacctcattcagttatgagttagtggtgttgatgtagtagaattgaattctttgctataaatttaactgtggcaaagtgcagttttggaaaaagtaacaaaataatgctgattattatacaagattaatgttgtcttcagtctcacaatatgtaaccctctcaataaccgggactacaaaagaataataaatcgttgactattctttaaacaagtaatgttgacacttttaaataccaatctctaggcaaaattttaccaattaatgagttgtattagatataatcagtttctaaaaatgaactttgaattctgaagacactatctcccaataaattaaaaacttattttattgccagtttttgtattatatgtttttaaaaatgatgctaagtgttcatgtaaaattttattcctgtacactttgagaaattgttatttaataaaatgttggtatcctacggtattatatgtgtgcatatatttatataaaatttaatatttatttaatttaacataaaatttgattatctctctgtacatatagatatagctataaggagagatatataatatagagatatatagagatatgtaatatgtattacaatatataatacatatgattttcttctctatcagactacaggacctcttccatcattgcactcaatttatatcatgttttgaggttagatagtataactttggaagacaattattttaaaggggaaaattgaaaagattctaaagatcaactctctgtagctgttttaagtttttaagatatattctgtatctcacctccattaaacaaataaaagaatga

SEQ ID NO: 40485 - DNA, 1049 bp, Homo sapiens
acatgttctttactgtgtctaatgtttattctgcacaaacattatatacaggagaactgtgtttttaagagctgaacataacaattggatcatttccctcctttgtaaatttttccaatgagacaattactactccaaattcaaacagctctcttgttgattttcaagattatttactaggacatcactgtgtatgtattcatcctctaatatgcctcatccttcattataataaagtgtctcttcttttcaatccctgttccatctgatttcttttttttttccttctccatcttctcttatagtgttttagacactggcattaaatgttcatttatctttgagaaaattctacactattcctttaatggaaagataaatagtaatttcaaaataaaaattacaaatcatacggtatggcacattttcataatttgaattctggccttttttatagagctaagaaaataaatcacactttgatcaatgctgaaggttatagtctcttttgtaacatttggacggtgacttgtataattccagaattaccactctcaatcaatactgtaaaggaactcagccaagatgtttataagagtacttaatcagttaaagttcttaatctttattttttctgaaagctgaagtagttctgttatggtgtgtttcaatttgagaaagagaaatggagaccaataacaaataagaatatacaaataatatatagaaatagtttttgctgccaggaagatagattaagggtgaagaggtaagagtgaacaaggttaaaatactgacacaacttgttctgatctttagtttttaaggattttctgtcattatatactctgttgcagagacaaaaactatatgttagatctgtaaaagaacatacatattcaggaacctgtgaatacaactcatttaagcttatatgttacaagctgggataaagttgactagaaaaacaaaacactgatacataccagagttcacattaagcacacttttttattgcagccactttctttttcttccttttttaaaaa

SEQ ID NO: 40486 - DNA, 1078 bp, Homo sapiens
ttcatttagtatacttttattgtcattttttaaaatttacaagttatgtaacaactttgatgcaaactagccaatacattttcttagataaaaagtatagttattttaaaaattgagagatcctgttatattttacatatgtaaatatttcgggaagactaataaaataaatatactgaagtatatttcaatttttgtaacttttatgcaattttattcgatttagaaagtagaatagtgcttgtcaaagtgtggatctggatattataacttggatttgcatagacagtttgcagtttatactgaacagtcacattcattttctcatttaaacctcaccacatcactaagatgtggaaaatattattatttttctctttcaacatatgaagaaactgaagctcagagatattaataagtaacaaaattggataagaattcaaaaatcctgtttaccaattcaagtcttttttcctcactccactacttctctaaaatttgttctggactttacccagtagattttagttactaaaaaactaatgaaactttattctatgtagggtgaccatatgcccgatatgcctgggataattgttttttttaattaacactgcttctttttgctttgaaaaatgtttttttttatttggatgataatcctacttgtaaaaaattcttctcatttggaagtaaaaaattcaaagacataagatttacatgcacatatatcagaatatagaaatgtgatttacttgcattactatattgcttaatttaaattttctgaaagcaaatatgtaaaatttttctttcagatgatttcatgtaaaggggaattcaagtaatcatacacttataatttttatgagaacttttcctaatagcagctttttaatagtttctgttaatgttaagaggtctatcattattttaataatatataatttatgaacatatgtataatttaacaaatgaaacaatacattcaattttatagcatcagcaatatttaaattctgtttcttgatcaaagtttttgaaaactgcctttattttcgcagacaagtagcatgta

SEQ ID NO: 40487 - DNA, 1103 bp, Homo sapiens
agcagtgcagaggaagaagcggaaaacgcccccaggatgcactgcagtgcagaaggagaatggttagtgcccattggaaaatgtatctgcaaagcaggctaccagcaaaaaggagacacttgtgaacgtaagtaatgtgtcctattaaaactccactttgcctttttaaatttcagtatcagacattttaaactttaatagttatttgaatacgtgaatctgctctgtaccagaagcgcaattcagtagatcttaaacaaagtcaccgttgaacttagtgattgccctacagtagcatctgcactaagtgtatgtaatcaatataggtgataatgaaatttgttactaaaatttaatgtgtcctatgcttaacatggaagtcaatagttgcacgttgggctatggagtttagagaggagtctgggtagttggacatatagcctggcaagactgaggtgacatttaacaggatttaatgagatgccattcctcctgtttttaaacccatattgtctgggcccttgagtagcagtaaataggaggttaagagggctgtgaataagagctctagtgacaggcagggcataaacgaatatatttacaaacttttagaattatcttatataaatactataactttaatacaaaattttcaaatttcacttacaaaatctctgtggttacttctgagaaaggtgtgtgttttttttttttttttttggactaagtaccaaaatgaccacatttttgtgaaagtgggccaaagtaaagttttaattattatagtacaccaattgcatgttttgaaacaatcatgtatgaattagtaaacttttttctttgttttataaaaccgttttttttctttcctagcattatgtggctaaatatttaaaactatgtcatatggaccttcaagattgatagatattctgtttctaggtttcatgaaaataaattataaagttatgttactagtgtctctttttaacttatataaaacataatacattaaaaataacacatatatctatatttatttttacaccagagccagaagcacaggttttatacttggaattcttagttgagctaaaggagac

SEQ ID NO: 40488 - DNA, 1061 bp, Homo sapiens
ccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacaacctctgcagcacctgttgtttcctaactttttaatgattgccattcttacaggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttatttttttcttgtaaatttgtttgagttcattgtagattctggatattagacttttgtcagatgagtacgttgcaaaaattttctcccattttgtaggttgcctgttcactctgatggtagtttcttttgctgtgcagaagctctttagtttaattagatcccatttgtcaattttggctttggttgccattgattttggtgttttagacatgaagtccttgcccatgcctatgtcctgaatggtaatgcctaggttttcttctagggttttcatggttttaggtctaacgtttaagtctttaatccatcttgaattgatttttgtataaggtgtaaggaagggatccagttttagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttagtaccagtaccatgctgttttggttactgtatccttgtagtatagtttgaagtcaggtagtgtgatgcctccaactt

SEQ ID NO: 40489 - DNA, 1083 bp, Homo sapiens
ttttttttccaggaataatttccatttgatcatgctgtataatccttttaatatacatgctaatattttttgaggatttttacattaatgtttaaaagggatattgctgtacagttttcttgtagtgcctttggctttagtatcaaagtaattctgacctcagaatgaattaggaagtgtttctactcttcaattttgagaaaatttgaaaagcaatggtattagttctttttaaaatgcttggtaacattcaccagataagccatcaggccctgggcttttcttctttttttaattgcatactgacaaattatagttgtatatatttatggagtacagagtgatgttacaatttttgaatacaagcagaatgattaaatcaagctaagtaacatatccattgtctcaaatatttaatatttttgtgatgataactttagaaatttactcagtgatattgaaatttgcagtactcaattattagctatattcaccatgttttacaatagatctcataaaaattagacttatttctcctaattgaggctttgtaccttgtgactataatctccacatttttcctatcccaaggcccatgaaaaccaccattctattctctgcttctatcagttcttttgttttagattccacctaacagtgagaacatgtggtatttatctttccatgtttggcttatttcatttaacatgtttttccagttccatctatgttgtctcaaatgatagaatttcttccttttttaaggctgaatagtcattcattgtgtatgtatgccatattttctttatccatttacccttgatgaacacttagtttgatttcataacttggctattgtgaataatgctgcaataaacataggtgttcagatatctttttgatacactgatttcaaatcttttgtgtaaatactcaaaagtgaaattgctgggcttttctttaatgggagaaattttataattaattccatcttattattgatctattcagatactttatttccttgtaacttagtgttcataggttttgtttttctaggaaaccatccattggtatacaggt

SEQ ID NO: 40490 - DNA, 1025 bp, Homo sapiens
taaaccttctcatagaatactttctgctactctgtgttccaaacatttttttcctttattatcttttaacaataagctatttgaaagagttctgcttccagaaatggtaagttagcttattcggacaactgaagaacatcgaagcagttgtaaaatgactaaaggagttggaaaattatgaacaaagtatctgacaaaagggactggcagagctatcttgctagtgagcgcttgcaaggctatgatatgaaaagaaagaaagaccagggaggtgtgtgttagacattagtcttacctttctccttcaatgcacttgccagtttggaaggagtgactgagaggcttagaagctatacagaacttctaggcatctcatactattggcaaattccaaacattggaattagggcaacaagtaagtattctggtaaataaactaggctttcagttggaacaccgaagaactttatactttgaaaataagcataaagattaacagagactagatctcacaaagcctgacctcacctgaaaatcatttccatctgtgattagtttgaggcaatatacttctggacttattcctggtaaaggcaaagttcattgtggacgaagaaaaaaaataattgcatcttcaaatgatttctagatatttccacatataatgttgacacaataataaacagtaaaacacaaaagtaaaaatgactgattaaaaaccaaggaaaaaacctaaatatatcacaatgagatgcagatattaaagataacagacacaaatttataaactactctgataatatatttaagacattcaattataagctgacatatttaaccagaggactaaaaattttagcaagaattgaatgaaaatttaaaactaaaataaataaaattaaatatttaacttatggctttaatggcagattagatgcagttataaagaaaattagtgaactgaaaaatagtcaaaagaactatccagaccgaaacaaagagagaaaaaaggatggaaagagcat

SEQ ID NO: 40491 - DNA, 1033 bp, Homo sapiens
ggctcattgtagcctcaacctcccaggctcaggtaatcctcctgtctcagcctcctgaatagctggaaccacacacacacacgcacacacaggtgtgtgccaccacacccagctatttttttgtattttcttttgtaaagacaaggtttcaccatgttgcccaggctggtctcagagtcctgagctcaaacgatctgcctgccttggcctcccaaaatgttgggattacaggcatgagccaccacatctgacctacaaccactttttaatgtgagacttaaaaatcttagataaataaggctgtgaagcaaaaccagtgatttttttttttgtttttgatttgcaaaacaagtgactgacaattattgagaaattaaagatagctatgtgtaggtcttgcccctgcgggtttggaggtttccagttgtccatctgtgttagttgtaagtgttctgggcagaatagtattgttgccccaatgcttgccctagcagagctggagtttgtgaacgtgctcagatgtgtgtctcctacaaagaagggaaaatgaaccctcgtctgagcctagaacaagttttaatagggcatgtctgacatttcaaattgtttttctcttgctgacagtctgcccccaggtgcatctagggccttggtcagcttctctgttaccagtggctcactttataaaacagcccacagggataagggctgaaaatatagccacttggctacatcattgactaattaagtaagttaactgtggatttatagcatcttttcaggatgttagtgttttgtgagccagtggaaaaaataagcttctatttcttcatttgtaaaaccagagagttggattagatgaatctctaacgtcctgtccagctcaaatgtgctttcctctatactagggtatagatttttgaagagcctagctgacttcagcatcacctcaccctttggtctccagtattacttctttacattttacttcattagctatttcttaatattaaatgtctgaagagtgtggcac

SEQ ID NO: 40492 - DNA, 1050 bp, Homo sapiens
ctcatgttccatagctttgttccaaaattctaaagatctggtctgacctttaaggggcctgccaaatgctatacagaatccctatgtgccacagacacctaaaacaccagtaaatctttcggctcagtggcagagcagctttcatagcagcccggacctgttgtggagccttctcttattattactgattactcaaatatggcagcttttcaagctacttgataaataggtcagaataacatacccaaatgaggtgcatgttgcctccagagtccagaaaagccagctagatgctgtgtctctgtattagtggtaggcaagagagctatcactttggaagggatatcttgaaatactactaagacccctagaaaatttaaaagatggcaggcctctgaatttttttaggactctttcttcactctgtcgcacatgtgtcttaccatgcatagggtatttgccacttactgtatagtcagcatgtaatagacagcataacattctatggactagaagtacaaccaaggtccctgtgaacgagattatgatagcgtgctggagacttgacagagccctgaggtaggatagtagggtaggcaaatgcttcaagtagtctttgctaacacatatagagaaaaccagaatttgacagatcaatagccatgtaccagatgccaggaaatatgttgattcgctccatcagtaaaaccacatctggtacagcatctgcactcttcaaaatccatctgttttgtacaaagccaaagagacaacttgaatagagatatggcagaaatgatcaccttcttcttgcaagtccttgatggtgactctaatctttgcaatctctgcaggaatgaaatgttgcttttggtttactttcataggtagaaatagatagttctaagggtttgcagttaacctttcctaccattatacccttgctccacagattagagaaccagtgagagaatctgctgagtttgtctgttctaactcagcatttcaaaactggtagaataaccatggcatgagttctgggatgagtgg

SEQ ID NO: 40493 - DNA, 1050 bp, Homo sapiens
taagtggaatgaaagtaccgttctcttctgtaggttatgtgagaagcagcaaaacattttgtaaagagcagaaactttggagccggacgccctgggttctaatcacggtcctcccaccagctgtgtgattggcagcacattgccctctgagccttggtttaattctcttgaaaatggggaacataacttctgtctttggggtggtttgtcaggattagcaataatatatgttaaggtctggtacatggtagacatttaagaattggtagctataataattgcacatctgaaattttttttctttttctgggataaggctttttttctgcccctaatataatgatggctcaaagacgagaggcaattttacctgagttccaatcctcgctctactgtttaccagctatgtgaccttgggcaagttacatagtttccttgtggctcagcttcctcatctataatttacatttcctcctttgcttgaaaacttaaggttttatacatatataatattgtatgtattagatataaagttggagattgaacaagtctgtgggttattttctgagtaccattgaatgtcatttacaaaaagtatttttttcttttgctttgaagtaacaatactacaattgttttcttttttgttgcatttttatagtaatttttttatatcctacatttcaaatataccactttttacataaggttttgttttactccagtttagtatcatcaggtagtcttatgcagatgttcatatgatgccatctttatggctcacccttatgttaataaaccatagttattcctcagagacagagaatatataatcatagccactgctcagagataaagatcaaataatcgaagacatctcaaaagtaaaacaaacttgtaggggagactaaagactatgtaggggacttcaacaacccattctcagcgttagataatctagacagaaaattaacaaagaaaccttggattggacctaacagacattttcagggtatttcacccaacagctacagaatacacattcttctc

SEQ ID NO: 40494 - DNA, 1026 bp, Homo sapiens
tgccccctccctttttacttgcctcctccctctttctcttctctcactcacctcccggtctaaaaccggggccggcgcctttaagagggagcgttggttaccctgggggcgggaacccctcggcggctcgcgaggcggcggcgctcgtccgcgatgctcctcactttcagctccagctcccgccaccgccgcctgtatcgccgccgccgccaccacctcctcttcgttgtcctccttcctcctccgcctggcagcgttgttctctgcagcggaggagagaagtgctatgtcaggaaagttccgggagggactacatggagccatgctccctgggctcttccgcgggcgcccgcgcgctgcccttcgcttgaggtgaggtgaggctcgggatccccggcccgcgatccccggcccgcgggacaggtagccgctcggggcggggagcgcttgcatccgctgcgctgggcagggcgagcagtttggcggagtgcggggaggaatgaggctggagagaccgaagttgtgccggagaagcttgggttttcgggagggtttttgcagctggactggagttatttcggtcggcgccacacggtggggacccggcggggactcggtttctcccgggccgcccgcccccctcccctgcccgtctgagcggttaggccttctaggaaaacggtcggctgcagaggggcaccccatgccggctcctttcctgctgggctgttctggttgagaattcagtgctgggagtgagaggaaggagatgagctccacttgaacttttacacggtggtctcgctgcttgagggctgaaatttaccttgtttgcgagagcgaaaggtcctttcgcgctccaacagttaagagaggttccctcttccatgtggttcagcttgcggcgctgtgtgttgcatccttggccggttttcaacgtcgccctgatttcagtcttttctcctctgccccttttcggaaacattcttctttttaataataaaatatgttgtggaggctcagagt

SEQ ID NO: 40495 - DNA, 1035 bp, Homo sapiens
tcatctgttccttccttccacaggatgtctcaagtgtttcagcattaattataatagaatgatacttgttttcgattaaaaaatacttatatcacgtttgggacattttcttctatttttaatttcctaagggttttttttttttcagtcgagaggattttgaatcttcttagatttttttgtgtcaaataattatttattttagtattgactattaattagaaaggaaatctgaatacagatgtgcttggagtggaaggaagatctaccttacctgggaataggaaaatagctttgagatttggaaagtgaaaaagttgagaagagtgtttcaggcctagtttgcaatataaagatacaagagtgtgtgatgcctttgaagaatggttagagttcactgcagttatgagaaaatgtgaaatgtgaatttgggagaagtgagttgggatggagagtgataggggtcagatcgtaaaggcccttatttttcttgctaaggagttttgttttattctgaagacaatgggaagtcattaaagagttaatggtcaaaagtgatgttagatttgaaagtagcctggcgggggaacaaagtgcattttatctaattagaagagaccaaataggaggtatttgcagtcatttctgcaagagacattggcttggactagggtgatttagtagtatgggggagatgtgagtgagtttgagagagacatatgatgcagtgtcaacaggatttggtcattgattggtgtaatgagtaagggagagggaggtgcaagtataatctcatttttggcatgagaggtaggtagtgttggtcattgaaattgaggatatgggagtagaactggtgataggtttagtttcagataatattgaatttgaggagcatgtaggtcatttaagtggagatacctgttaagcatttgggttgggaaatcaagaaaaggtcttggtttacgatcacagctttggaagtaattaacttgtaggcagtaatggaagttagaggagtgtgtgggattactt

SEQ ID NO: 40496 - DNA, 1050 bp, Homo sapiens
gtaccgctaaaactcagagagtttctaagtccttgtccagtgggcctcaaaaatcattttgcaaaaacaggagctcaatacaagcatctaaacctctgattagattcccagcgttgcctcccccagcagcagctgcaagggattgagtgcccactcagcatattaaaatgtcttaacccaacctaccattttcagtttgtgatttttcctattatttgagcagacatggaagggatctgatcacttgtagatgttaacaatgcaagctgacaagggggaaaagttattcactccataaagaaacatgaggggtaagttgttcaccgtgttactttcatccttttttgggatgaggaaggtccatacctaatgttgctctgtggtaaatgcttggatgggtatttgtggccaaaaatgcagctaaactcctgtgtacagaaccacttaagggtttcatttctaggagaatactcacagaaacaatacttgacagtgacaaataatgaagaccatgctcctaaactcctgaactcacaagaaataagactaaaagcagtgagaagtaaacaataaattccttctgtaaagagttattaaatccttcagtgtctggttcctcctacttgtatcagagttccatcttaacactgatggatgataatggacttgacatgcctctcagccatatgaggatgtgcataatggtagtaatataggccctgagaaactagatgctcagctacctaaatgagtccagttctgttagaacataaatgatacacacctttctggttaataaatgcaggttcttctacaactatgcacttaatatttagtgatgccctaaagatgtctatgaaacaagtttggtgacttcttgaatctacttttcctgatttacttaatcaaaggtacttgccagtcagcaggttgaaattacaacgtgtccactggtcagtgtctatgttgtaagaatctatatggcgcacaaggatccggtcattattgtagtctaggtcattgcctccaagaacataaagcttcctttgt

SEQ ID NO: 40497 - DNA, 1048 bp, Homo sapiens
tgtataagaaaatatttgtgagtcagatgtttgtgggttttccttacctattattattttcttccatgctttacaacacattttttaaactaccttgttcttaaataattacacggacctgcttctgtgtactttcacagaatctttgacagttaaaaattgtatgttatataaaaatttgacaagcttctacagttaggaaaagcctttagaaatctgccttccccaaaccgtatgttatcatagcactcatgtctccccatgtctaaaaggtaaatagatacagaaacctcaccaaaagttgaatcatctgtactaaaccactgcttttttatccagactttttatataaatcttttattttccaaaaaactgatcttttacctacccctcttagagttaaaaatattgcctgtcaggcaagagtatagtatgccaatataaataatatgctttatttggttagaaacagttggtttgggaagctagcaacatagcatattctttacaaatttaataaggtgtattttgatactgtgataacctgcattgtaaattaccaaatggttggaattgaccagtttatacttattaaaatttttgatgtgccaatggctatccaattcattgcatttgtgaattgtgcttttagaaaaattgtggacattttagttttatatacatatttatgagttatttgtgcatatgataaaattatatataataataaaagtatatatgtaacttacattgtgcccttgattattgaaaacttcctttttataacagattcactgtttggaagctaaagtaaaaatgagccatgttaccagaagtaataatttctatcttattactgatgtttttatactttgtggtaaaactatggaaagttaggttttcagatgctgtggtagctgaaagagtttgatgtacatgtggttaaagtgtgaagaaaatatgaaggaaaaagtatgaaaagtaccctagtcattacctaattgctattttgtttttaaggatctaagaagtgttattgcattgtaca

SEQ ID NO: 40498 - DNA, 1051 bp, Homo sapiens
tcaaatttgagtgaaaaaactagagaggctgtgtgtgaaccaccctaatgcagtatgttgttaaaacaaatattctggcctactaccttgtgtggttatgcaggcccataagaagtttggttctaaagattctgaacagaacaggtatttagactagtgagataactactaggcacaataaatcatctaaaacaccttccaaatacagggaagtactagagaatgtaggaggagaaacaatattttattttcaaactttgttacttataagaagttaaaagaagaaaatgggatatatactgaaattgctacacaggtctattttatggttacagaatttttgttttaatacttacgcttgtgatacaagtcttcccattgtaatcataccatcattgtccttaaataatattccatgaatgcattttattacccgtgagcattataatatttcggaaggttaatgaacttttacatgtcatttttagcacacattttatatataaaaatcatactttaatacatcttaacatctaggtttactcacaatagatataaagcattactttttaagaagtgttgtgctaagcctgctggatggatggctgaatagatggatggatggatgatgggcagacttaatttgtaaatactgaaatgaaaaataatgaaaatgttaatatatttgctttcttttcttttttcttaaacagggaagcctatagcaaacttttgtctcaccttggacagatgggacaagatgagatgcagagactggaaaatgataatacttaatatattttgtgattcatcctgtctattaattatcagtatctaaagccacattgttccactctaattcctacttttaattaattgtataatgttctgtttaaaataatttctaggattttttttccttttatatctgtaagtaaaaaatgtataaataaggaactgaaggttaattagcaactgtgtaataggatccttggaactttttacaaaactgcattctaccttgatgaaattttagttaaactaaattaaa

SEQ ID NO: 40499 - DNA, 1059 bp, Homo sapiens
catggtactggtaccaacacagatgtccagaccaatggaacagagcagaggcctcagaaataacatcacacatctacaaccatctgatctttgacaaacctgacacaagcaatggggaaaggattccctattgaataaatggtgctgggaaaactggctagccatattcagaaaactgaaactggatccattccttacaccttacacaaaaattaactcaagatggattaaagacttaaacgtaagacctaaaaccataaaaaccctagaataaaatctaggcagtatcattcaggacatggggatgggcaaagacttcatgactaaaacaccaaaagcaacggcaacaaaagccaaatatataaatgggatctaattaaagagcttctgcatagcaaaagaaactatcagcagagtgaacaggcaacctacagaatgagagaaaatttttgcaatccatctggcaaagggctaatatccagaatctacaaagaacttaaacaaatttacaagaaacaaacaaccccgtcaaaaaatgggcgaaggatatgaacagacacttctcaaaagaagacatttatgcagccaaaaaacttacgaaaaaatgctcatcatcactggtcattagagaaatgcaaatcaaaaccacaatgagataccatctcacaccagttagaatggtgatcattaaaaagtcaggaaacaacagatgctggagaggatgtggagaaataggaacactttcacactgttgggagtgtgaattagttcaaccattgtggaagacagtgtggcaattcctcaaggatctagaactagaaataccatttgatgcaacaatctcattactgggtatatacccaaaggattataaatcattctactaaaaagacacatgtacacatatgtttattgcagtactgtttacaatagcgaagtctattgtgaagtcatcaatacttggaaccaacccaaatgcccatcaatgatagactgaataaagaaaatgtgacatatatacaccatggaatactatgcagccataaaaaaggatgagtt

SEQ ID NO: 40500 - DNA, 1039 bp, Homo sapiens
caagaaataactaagagcagaactaaaggagatagagacacaaaaaaaccttcaaaaaaatcagtgaatccaggagctggttttttgaaaagatcaacgaaatagaccactagctagactaattaagaagaaaagagagaagaatcaaatagatgcaataaaaaatgataaaggggttatcaccaccgatcccacagaaatacaaactaccatcggagagtactataaagaactctacacaaataaactaaaaaatctagaagaaatggataaattcctagacacatacatcctcccaagactaaaccaggaagaagtcgaacatctgaatagaccaataacaggtattgaaattgaggcagtaattaatagcctaccaaccaaaaaaagcctaggaccagacagattcacaactgatttctaccagagttacaaggaggagctggaaacattccttgtgaaactattccaatcaatagaaaaagagggaatcctccctaattcattttatgaagccagcatcatcctgatactaaaacctggcagagacacaacaacaaaaaaaaattttagatcaatatccctgatgaacatcaatgcaaaaatcctcaataaaatactggcaaaccgaagccagcagcacatcaaaaagcttatccaccacgatcaagtcggcttcatccctgggatgcaaggctggttcaacatatgcaaatcaataaacataatccatcacataaacagaaccaatgacaaaaaccacatgattatctcaatagatgcagaaaaggcctttaacaaaattcaacagtacttcatgctaacaactctcaataaactaggtattgatggaacgtgtctcaaaataataagagctgtttatgacagacccacagccaatatcgtactgaatggacaaaaactggaaacattccctttgaaaactggcataagacaaggataccctctctcatcactcctcttcaacatagtgttggaagttctggccaggacagtcaggcaagagaaagccataaag

SEQ ID NO: 40501 - DNA, 1034 bp, Homo sapiens
tatctgttccctttaatcttatgaatgtatgagtaagcctgattcgggttgtctgaaaccttttatctttgttgtaaaagataaaggcgaatgtgaaaatgtgtaaatatagaagatgtaaattacaggaaaagctatagcaattcaggcatcttaattttagagaaaaatgtaagtgagaatttataagtttaatagtaaaatacacattaataaatatattggcattcatgcttataatttattagtgtctacaaaagttttctgtttccagatttagatttttgccaagataaatgtctgatatagacatgggacaaaattctacttaggaaaaattgaagactttctttgctttgctgccttgttgatttttgtctccatgcgcagatctgtattctttccttttgtctaggtttcaaagactaggaagagtatattgctacagtgttgcccatttatttgttaggaattaggataggtaacttaatgatttcttcatgttaaaggattagaataaaacagagaaagagcaaagtataaactttggagagctccaaggtgttttaaaatgtgttggggttgggatagcataaccatttgagggaaggagttaaccactgaaacactgtactctatttaccttgacagttcctaactggggacacctctgctgttcacttacaaggttgcaagactgctagtgaaaggcacagaactgttgatgaaatcacctttcatattaaggagaaggcatctgtgatcttaattgtagctcagttatttctgaaaaggcatggtggatccatcaacttctctcctctgtagattttgttttgttttgtttttctcattcttcatatctgatagttttctgtttccatgtataaagctttcaatcatccctgtctctttggccattcttccccattttgctttgtaattgaaattcaagtcatgaccctttggtgccaagtgcaaatttccccacttttcccacattgccaagtagacttgatcatctctctcattac

SEQ ID NO: 40502 - DNA, 1009 bp, Homo sapiens
taaaataaatatacaagcctaagaggtcttagtcctctttttagtaacaactgcttgtagagtgagagagcatattcatgaccacttctctgtttattttttctagggtttttatttttattctacttgccactttcttcattactatctcacatagctagttataataagcccttgcttttctcttggtagccatagtctttcctgtcttcgtccttagcataaacctacacatacgtcgtgtgtacacatggcatatgtgtaggtttatgagatcttagtcctcttaggcctgtgtatttattttattttccctcatcttaacgtagtttttgtccaagctgcccatcagtggaaatgaagagagatgtagttggtgagctaagtcttttcctaaggaagcttcaataagcagtatcattaagtatacattttttcattgggctttcagttgtaaggtaagagagttcaaattcagttggattacttttacaatcccttccagtttgggaattctttaatagtaatgaacatttatattatgcattaaagacttttgctgaaataatttgaaataatttctacttaaaaaatgatattgttagcgtattagtaacatttgaagaaactgaaatgcaaaggtgctatatagctttgggaaagttataaggtaataaataaccagtctgtgttcttcttcattgtgtccttttttatgacaacttatattcgaggtatttcaaaacatttttagatttgtggtttgtatgaattttaaaaattttggacattacataacattttatatttaggttaagaccatccccatcctctctaccctgactaatgaatgggttagaaatcaggtttagtggccaagcacggtggctcatgcctgtaatcccagcaccttggaaggacaaggcaggcggatcataaggtcaggagatcgagaccatcctggctaacacggtgaaacgctgtctctactaaaaatacaaaaaattag

SEQ ID NO: 40503 - DNA, 1046 bp, Homo sapiens
ggcagaaggtgctggctgttgatgaagagtgaagagaagatatgcaattgtaccctaagagaataaaagactgaatggactagggaaatgtcataggaatgctggccaattctaagagcctacttgaagtctgtagtcataaatgtaaagtggtatcagtcagcatggttcttcttcagccatttaatactggtacatgtggggaaaaggccaagagtttgaattaaacaggtgatgatttttccaggcgagtacacaaatcaagaaaggagcaagagttggtagtataaatgaatgagtataataatggaccatgcaatcaagtgtcctaaaaagggacagggaaggcatggagacaaggagggatgaggaaatggttgtaggatcagtggattttaggtcctgatggaatcaaagaattgttggagttgggggagaagaggaaagttggaaagctagtttggagtcaaaaattggggtactttacaattgaaattactgagattgtagttactggtaatgccaaggtcgctgggtatcagcatgggagtgaatggctgacgtagaatggaagatagattcattaaatcagaggagttcaagaaatcaagagtccatgacactggagaaaaataatcacaaaagattatggcaggagtgctgttggagagcatgatagtgagctacagtctacaaagaatgagaggaggaggtgaactaggaagtagtaggtaaatgcaacaaagatagtgactgatataacctgatgatatgaaattcaaagctagcaattttagggaggaagaggggagaatagtctagaagcagcaatgtggaccaaggagtaatctcaccctgttggtagatcaagtggtatacggggagtgggaaaatagacagccaccccgtttcagaaagctgcataggagttcttaataaataatgtattggcaaacaaattaatatcatacaaaatgagtttatgggttcccaagaaaaatcacaaaataaaacatatttgtttagcatggttaactaaggaattc

SEQ ID NO: 40504 - DNA, 1069 bp, Homo sapiens
gtattttaatttaaaataccacgcataagccagttgtacttaccttcctcttggtacatccatgtcctaaagccctcaggagaaaattgttttaaaaattgttttcatgtctagattttaagtaaaaatcacttgtcatgtgtgagttgcaaaatgcagaccttcattctgaagctgcctctttctcatttggatctgacatattaaaaagcatataattaatggttgacattagtagttaacattaactttatgatgcttaatatgccatcattcatccatcaaacaaccagaaatgcataatgtcttggcataaaggttttaattatataaaatgtttctcatatgatataaatggaaaaagctcaaaatgtactttaagaagatttttgtaagcatttattaagggtgttagctgtatttttatttctttttaggagtatgcatcaacaattgtgtcaggaacttcaaagggacaatgtggacctatttgtacagtcttcattatcggctaaagagcgccaccttgctgcagttgccagtgcactgtggagacatttcttttcatttttgaagagtcagagaatgtcacaggtagtgcctttctcacaacttgcggatgcagctgcaggtcagcattaattattaatttgctaatttctctttttgcagactctttgtcagtattttcctttattttcttagtaacaaactcttgtatagcaaacattttgtcagccagaaagatgaaacaaattacatattaataaattgggatcctttggcttatttattgctaaaaattaaatgattatttactaaaaataagataattttctatcctgaaaatattgaatatacataagcttttcttatgcatgtaatattttggaaggtaaactagcatttgattacgtgtgattcaagtagtttattttcaaattgtatgagcagatacataggtataagatgaagttaatttgtgtaaagagcaaaagaatataaaataaataccacttcaatcccaagaagatgagatcagaatgacactgaatatataggatgttat

SEQ ID NO: 40505 - DNA, 1033 bp, Homo sapiens
aaccccgtctttactaaatatgcaaaaattagcggagcatggtggcacgcacctgtagttccagctactcgggaggctgaggcaggagaattgcttgaacccaggaggtggaggttgcagtgagctgagatggcgccactgcgctccagcctggcaccagagcgagactctgtctcaaaaataaacaaatgaggccaggcacggtggctcacgcctgtaatcccagcactttgggaggccaaggtgggcagatcacgaggtcaggagatcgagaccatcctggctaacacggtgaaaccccgtctctactaaaaatacaaaaacattagctgggcgtggtggcgggcgcctgtagtcccagctactcgagaagctgaggcaggagaatggtgtgaacccaggaggcggagcttgcagtgagccgagatcttgccactgcactccagcctgggtgacagagcgagactccgtctcaaaaaataaataaataaataaaataaacaaatgaaatgtagactgtcagaccaactgcgtcaggaattaaaaacaaatagtaaatattatgattgggcccaatgctgaagttgcagaaagatctttagtgaggccaagacattagtaaatttgtagaaagatatacagataattttggtggtagtcaacattgggaactacttacaataataacaaggaagtggatccttgttactactgtgttataaaatacagtgaaacgtaactgaaaaacttaagtaattttatactcataatcatctacaaagtcaagactaatgaaaatatgagggtaaattctaaaaatgatgacttcttactggtatgttttcataccagtgctagttactgtttttgggacacaggcaagcaacttcattttaggcacttcaccccttttattgtatgtaagacagcattattataggcatgcttggtttgctaggttcatcactggattcctgatttgttgttctttcccagtcttgcaaactaagtcaattttggagcataggaaaat

SEQ ID NO: 40506 - DNA, 1863 bp, Homo sapiens
taacgcttaagcattggcaaaatgtatagatatagatatacaaatgtatagatataattatgtatctatatatgtgtagtatgttgtaatgagtaatatagattcgtatatgtgcaaagtcacactgcacatactcatcaggttgggtttttttaatgaaaatatttcagagacaactagcattgtaacattagcacagtgcagttaaagaggatgtttaaatgtataaatatattaggcaatccttaataagcattagattatctgggaacaaaccatgaggaatatatatgttgggtatataagttggttttctctcatttccagctaccttaaagactttacttttggctctaactttttgagatgacatgatcctctatgacctgttccttatcaatactatagttacattatacaaatgtatagttacattgttcttatcagtactacagttccttatcaatactatagttactggcacttgactaaaggtaataccgtctactagtaataccacactgtttgtgaatcccttcatgtaccatgcaatttcatgtcactatgctttactcatgttattttaactttctgcaactctattatttttttaattaactaatatgacttctgtaacaggtaatggcatgtcttctccaggaagtcttctttgaatcctgttttttactctttacatacctctgtctcggcacttaactgtacattctttgaaaggaaggactatatttgataacatctagtacaatggctcatgtaattaacagacattgacgtgttcattaagatgatctgaactattaggtagaatgattcctgagtctgattgtactcttcgactctaggtccagatttccaaaaatattttcgatagtgttacttcaattttctcttttcatatcaaattatatcctcctgttataattaactgtccctcgtaactttcagtttttctcccccaaaatttggcaatgacaggctgctccttcctttccctcacaaaatgcgaaataattagtgttggctttttccttcataaagtaactgaaaatgcacattagctcttacctggatgtttacagaagcttcttaattagtttcttttatctttagtcagttcttgttctgacccattctgtttgccattacctgattaatctttcccaaagcacttttttcattatatcaccctccagttcagaatccttcagtgtcttcttaccactttaagaatgaagtcttgatttttcttttaacagcaggattaaccatttttgtatctctagcatcagacatagtgactagcactgagtaacttcttctgaagtgaatgaagaaaacatatgactgaacaaatggaacaccatttgtattcttaaatttattgccttccaatgctactataaaaattctctattataatcaaagtggttacgtttttttcattcttcaaacaccttgttcttttatatattccttttaagatgtaaattatattacacttctgcttttctggcttgttatccacttggattttatccaaagtccttacatggctcacaagatcttacatggtctggaaccctgccacctctccagttcatctgctgttcatctgtcacccattgtgcttcagccactttggactcctggttgttgttccttgagtctgtgaaactgtgccaggcccagcacctttgcactttttcttctcactggaatattcttccccatatacctgtgtgtttccctcccttacttatttagttctttgctcaaatgtcaccttcttaaaagatgtttcctgatcattgtacaagtacaatgttattgtacaaagttcta

SEQ ID NO: 40507 - DNA, 1684 bp, Homo sapiens
tctttggctctttacttttaataaaatgactccaaatttcttttttgaagcaatgcacgctcccccacatagcatatagccactaaccacatgtaaaatgtggtagaatgattgcagttgtcattagagggtagcagtgactatgtactactgttttcgaaaaagactgctgggatggtgagagctaagctagtttttagaggatagttttattaattagctttaaaaggtggtctccataggttcataaacataataccttacatctagggaaaactaaaatgaaacttttgaaagcagcaagaactgaataaagtttattgagaggaaatatgataatatacataaaatgtctcagcatatgtttcatataggtgttctgtgctggataggtagaaaaataaagtagtttttcttaaaattacccttatctctgaaattcatttgtcctgaaaccagtccagaatttcttagattgttgggaacggcttctaggagacttaaaacagctattttgtctaagtctgcctttgtactattgtagatactaccctgtggttatatttctaataaaattctttgttcctcccacctcccaccccaagcttcccaagtgtgaattcctttaggtcaggtctgcatctttttcatctttgaatctctaattcctacatagtgcttcttatatgccctttagagcataatatactatgtaataacatagtgggtaaaacaccacaacagcaatccttttattatgcttacagattctgtaggtcaggactttgaaaagccaagggcagctcttatctgctctaccacgtctggagcctcagctaggatgattcaatgtctggaagtaactctaattcaatgtctgtgagtaactaaaggccgagactagaacagctgaagctggaggatccagttcctagatggcttcttcttcagtaatacatctagtttctaagctagaatggctggtggacaagcttagctggaactgttgacctgagtgctgtctgtggcctctcgaacagggtattctcagggtcattggacttcctacattgcatttcagggctctaaaagtgagtattcccagcaaacaaggcagaagctttatggccttttattaccaaaccttatagccacataatgtcatgtctgctgtgctctttggtcaaatcagtcacaggatctctcagaatcaagaagtgtcaaagaattgtggccatattttaaaaattacacgtttttcagcaaacagtggaatagccaaagcaagacagagatagagatgcagggtgggggaggattgggaggaggaagaaaattaaagattgtgaggtgttcttaatatcatagtaattattggctccagtgctgctaagttagatagattggtggtctcttccaaaatgaaaatgagggcatattccataaatattttgttcacactgttgcttgtattctaactttcttttttagtcaccaattcctaactgccccccggcctgagctcattcttttttcttctatgagaattcaatacataacattttggataagatctagtgcatgtgtgcttgcacagttataccctatccatttacatttgaagaggaagataattgtatttgaaatcccaaaaaccagtataacaacttcacatattttataa

SEQ ID NO: 40508 - DNA, 1047 bp, Homo sapiens
caaactagtctgatgaatgcagaggatacatgctccagtagaaagttataccagattatgaaggactttgaagttagggccagagtgtagacctgggtgaggaggaaatcaaagactataggttttaagtagaggggtgtgatgagagcagttctttatacccttcatatgctgttctgtctccctgaatcataagatccttgacagaaagaccttacctgtttctttcccttaatccgtctgcttgaaatgctccttgatttcttttctgcctggaaagtttatttcctttcgggtgtaagtgaaatatacagtttcccctattaagggtttccaggttccccaagaggcaagtgttgtccttcttgtttgccctgttcatatttgtatcacccagaacatttaccacttgaaatatctccttcactagactgatacttattgagggccgggaatttgtcttattcataattataacttcagcacttaggtatccagctaaaagtgcatgacgtgtctgttgaatggtgattatatagatggttctggcagtaatatgcccaatgaattgaaagagaactttaagcaaactttaagcaaggaaactaggtaggaaatcattgtggtaataaaggctaataatacaaaaatgccaaagtaatttttaaaaatacataaaggtaggagagtacattagttttgaagtcatgactgggattgagtgataaagggaataaaggaaaggaatgatctgatgactcaggttggtcctgtatgtagtcaggcaataatatttaaccaacattttcagtaattaggaaattttaggaattatgacttagacaaacctaatagcttcttatacttaaatacatcttttacttatgtttaactactgataaaatgtttcactgttcctgtggtccaagatttctctcattggtgctcttgaccttatcaccctaaggatatcaaaacactttaatatcatctcattttttcttcagtttcagccatataaatgcagaggttggaaattttcaatga

SEQ ID NO: 40509 - DNA, 1035 bp, Homo sapiens
taattacttatgtggattttatattaaagttatatatatgcatatatacaaatacacatgaaatccaaatgtagaggaaggatttagttttctactacatgggcataaatcagtacaggttgaatatatccgtgtactaaaatgctattatatgaaaagcttgggactagaagtgttttggattttggatttgtttagattttggaatatttgcatatgcataatgagatattttgaggaggggacccaagtctaaacataaaattcagttatgtttcacatacatcttatacacaggctgaatgtaattttatgcaacattttgaataattttgtgcatgaaacaaagttttgactgcaacccatcccatgaggccagatacaattttccacttgtagtgtcatgttggcactcaaaaagttttgaattttggggcattttggattttgaattttcagattagtgaggctcaacctgtagttttcaagctgtttttcaaacaatagcttttcaaaagaaagcttatatgcaaacacaagatgcagaactaaagtcaagagcagctctggtgcagtctgagagccatgctttctcttagcccttccttcccctgctacctctcagaaaagtgtattattacccagagatacgttacagatattctgagcaagatcatgagctcatgtctgaggtggcttttactgaagcatttgtaattttgtgcccataaggaagttttggtcacattacaccattttttaaaagtgactttctttaaatttttgcagcaaagtcatagccttagctgcatcaaatgctttgaaataaaccagtttgctctgaaattaacatagataattctattaataacaccaatcacctatacaaaacttactgtttttcagatccacttaaattatgcagatatgttaaatacactcagacacaaacttgatgtggataagaacaatggttatgatatttattgcctttaggcacttttcacatagcagttttacctttgaagtacatgt

SEQ ID NO: 40510 - DNA, 2554 bp, Homo sapiens
ctaagatgattgactttaaattgttgatcataatctcaaatggccatcagctctagaatgtttgcttttctgctctccaaaatgacttaatgacttacttcagaacttctcttttttttttttttttttttggagaaagagtgtcactctgtctcccagtgcaatggcagtctcggctcactgcaacgtctggctcctcccgggttcaagcgattttcctgctttggcctcccgagtagctgggattataggtgcctgccatctcgtccagctaatttttgtattttttagtagagatggggtttcgccatgttggccaggctggtcttaaactcctgacctcaggtgatccacccagctcggtctcccaaagtgctgggattacaggtgtgaaccaccgtgcctggcccggaacttctctttgacataaaatttaatacgtactcttctccaatccattcgggttaacatcttgcctcataaatcattgaaaaatagaattggtcaggtaagaattcctatctttacagctttaaatctcccaacacatctgcttcatattcaacctctcagactattcttcttttatgttagaagtgtcactttctatcaagagctaattccttccctcgtgcactggatcttaactcttctcacctgttcaaggactttattgtttgtgtattttcacttaaatatttacttcctcacctcctagatgtcctcagccatccatagttgagcttcttcatcatagtcttcatcaagccccaaactgctctgggaaggccgtcaatgacttccatattgtttcttccaagggttcttatttcttctttttgtaacctctgagcagaggtcaatcctgttcaccattgtcgtttttctgaagtacttctcttggcatccgcaatgcctggtttcctttttacttcattgaccacttgtttttgcatatattctccacttgcttcatatgaaaatgttataatatcaaatggctctcagttatggatccttttatcattgacccaaatttatgtcaacaactctgactttaatcccttaactctagacccataggtcagattatctgcttaatagctctacttgtataccctggacactcacctcataagttcttcctttagtctttgccatttcaggaaatagcaccattgacctatttccttatgcaaaaacctgaaacttctttctttcatactttaatgtaatttaccagcaaatcccactgaatctttttccaaacatatctttaaagtttcagtcttatagtttcgcacagtcgcctcctacctggtctccctgcatctcttcttaacccctctattcactctttatgtataatccagagcagtgtttttgaaacaatcacatcatgtcacttctgtgcttactcttttccagtagcttcccaacatatttaaaatacaatccaaatttcttaccaagaccagtaaagcctcaaatgagatatgatgtcttcctgtctagaattttataataccaagcctactaataattgaggaactttccactcattttctctgccttgaatgtttttcttccaagtctttattgactttcatttaatcatgtagttcaattgcagcccttcaaaaggcttttccattcatagcagctaataaaataatgatgcttatcctttaccaattactttgccacattactttgctttgtttcattttcacagcagttacttctgttcaaatttatcttgttttagtgtccttttcttttctttccaaaaatgtaagctctaccagtacatgtgctatctctgacttacttgttgtcctatgcctagtacgttaaaacagtgcctagtatgtggtaagttttaaatacaattgttgaatgattggaattcagtgtgttatttaaaaaatatatgcatggttatatcgtcatagaaaaagcatctatgttttttctacttccttttcctcctgttatctcctaaaaggttaaaatagatgtactctgacaatcctttggttttagaaagaacaactcctataatcctataaaaagatttgaccaagtacttaagtatgaccaagcactctggatttgtgtacatcttaatcgttacatcatttttgccacttctttttggtttgggttccttttctggtttctgggtttccagtaccattcaattatgaaacacctgtaatttttaaataattgaattaaaagtcgagttatgtgacttctgttatctgaatgtgttaatggtgtttaaaacatgtttttggaagtatgtgttgtgttgatttagacctagtctgcatatgagaatgggtatgattgggtgacacatatttattttctttttagctgcaggttatatacagcacaatatcaagtgaaaatgtttatattgccagagcccatttaccttctcataacttcagtttattttttagggtgtcattctagaagaacaattacgaatgtatcttcactgttgtttgacactttgtgatttctgggagccaaacattgc

SEQ ID NO: 40511 - DNA, 1031 bp, Homo sapiens
gttaaataagcttaattgtttattagagaagctaaatgtctttccctaagccataactctacttgttgggaagaagcatcagaacccagatctcagttttgttcatgaatcatttatggaggctctttggtgaaacaggcaccgtggcgtatataccatgtgggtattattctatctttcagagagctcttagacacttgaaagcagataaacattaaacttaacaaggtaagtatgatgatgtaggtatgcctagtgtgccataaaagcgtaaagaaaggccacttatctagtaagggagttaggaagttttctggagaacttgtagtttgaagtgtattttaaataatgaataaagagttaaggccttgtccaaaaaaaattgtgcattgctgctttttacccatatttgggtcactcttcattcattgaaaaggttttgtaccaagatcactgtgttcttctttacctgtacactatttctgctagtgaccctgacgttattgggtataatcgaactgtcctttcaatttcttaatagcctcacttcttattagattttcttttacttgccttatctacctcctcccatggttatactctacagcttttcacttttcatttttcttttcattttgcccgttaccattgaccttttcatttttctgtcctcttccatttcctcactttgtttcttaaacaatatacacaaccaattatttttaatgaatattccaataagtccattaaatgaatatgcctgcttctaatctctgctttagtcctttttttttttttctgaggcggagtctcgctctgtcacccaggctggagtgcagtagcgctatttcggctcactgcaagcttcgcctcccaggttcttgccattctcctacctcagccttctgagtagctgggactacaggcacccgccaccatgaccagctaaatttttgtatttttagtagagacggggtttcaccgtgttagccaggatggtctcgatctcctgacctggtgatctgccctcc

SEQ ID NO: 40512 - DNA, 1949 bp, Homo sapiens
atcaccactaaagaacttattcatgtaaccaaacaccacctgttccccaaagactattggttgtggggaaaaaagtaggtcaggtgaccagccatcctatcctggtttgcatggcccagagtttcagtgtgaaaccaggaaacatctgagcaaaccaggatgagttagtcaccctagaagtaggaataatatgactaatctaagaaacatgctctatgaatttaggtctagcataaagtcaaaatatctttcctatgggaaaagaggcgattataatatttatgaagaagtagttctgtggttctctgctattccttcagttttagtgttccttgattgtatcaaattatattctataagtagtataggactatgtgttggatttctggaaaccaattttgtgggagcagtagtaggtagttgtaaagaataatatatttggatagaactgtcagtttgattatatctattttcctcccattgaggtaaattgaaatctgaccatggtcatgtactttgacttgatctccaacagtgacagtggtgaaagagtccatttgctgtatttaaacaaaataaaaatcttccaaatatacagcagccttcaaataaaattagtgtacacttcattatactttttgtttttattttttgtttaaagagacagagtctttcactgtcacccaggctggattggagtacagtggtgtggttatagctcactataaccttgaactcctgagctcaagcacttcttctgcctccttctcccgagtcattaggacaggtgcatgccaccatgtctggctaatatcttcattttatagacagatcttgctgtgtttcccaggctgatcttgaattattggcctcaaggaatcctcctgcctcagcttccaatagtgcttgggattacagatgggagccaccgcacccagcctgaccactacagctttaatcaagcaaataatgttttgaattcttttttctagctagagaggatctgccagaaacagaggtggagttttagtttagtaaagagaacgtatattgctcaattttacttacttaagtacagttttttagaggtaatcctatttaatatttgtgaatgctaattgtaaacgtgtgttctacctttgggaacagcattattgttttcatatgagaaagatttttcatcttttgctgcctgctttttaaaagcctcattgttttctgagatcacagaagtaatttttagttttataaaggttatggaagggtatttaaaaagtaagcctgattttaaaaaattattttgattttttaaacacattaatttggagagtccaggagtagaaccaactcagaatgtgattagatctaaataatgtgggacaatagtctttaaataactaactaaaaatcagtgtttcttgagtagaaggatcgtaactgggatattgaagcccaactctattctctcctaaaaataaatccaattaggcaaacttctggtaacagttactgtttagactgtgaataaattttcttcttgtgatggtttctgataggtaggctagttatgcataaataaatgagtctttgttaaattatatataataaccagttgttaaattgccatttcttttttcttttttttttttttgagatggagtctcgctgtttcgcctagcggagtcagtggcgcgatctcggctcactgcactccgctaggcgacagagcactccgtctcaaaaaaagagctaaaagagtgaatgtgcaccttattagtccaattaaagatttgacctatgtagtatgcccaaatgtaatatgcgtacatttgattgttcaaaataaagataagacattctttagaaaaggactaaagcagagattagaagcaggcatattcatttaacggacttattggaatattcattaaatagctcatattctctcc

SEQ ID NO: 40513 - DNA, 1027 bp, Homo sapiens
atgctaagagaatttgccactaccaagccagcactataagaactgctgaaaggagacctaaatcttgaacctcaaaatataccaaacaaacctctttaaagcataaatctcacagggcctatcaaacaataacacaatgaaaaaaggcactcaggcaacaactaccacagtgaatagaatagtaccttacatctcaatactaacgttgtatgtaaatgacctaaatgtgtcacttgaaagatatagaagggcagaatggataaaaattcaccaaccaagtatctgctgtctccaagagacttaacacataaggactcataacttaaggtaatggggtggaaaaagatagtccattcaaatggaccccaaaagtgagcagaagtagctattcttgtatcagacaaaacagattttaaaacaacaacagtttgaaaagacagagggacattatgtaatgataaaagtatccaacagaagaatatcacaatcctaaatagggaacatacacaactaacactggagctcccaaatttataaaataattactagacctaagaaatgagatagatggcaacacaataatagtgggggacttcagtactctactgacaacactagtcaggtcatcaagccagaaagccaacaaagaaacaatggatttaaactataccctagaacaaatggacttaacagatatttacagaacattctactcaaactgcagaatatacattctcttcaccagcacatggaacattctccaagatagaccatatgataggccacaagtctcaataatttttaaaaaattgaaattatatcaagtactctcccagaccacagtggaataaaattggaaatgaattccaaaatgaaccttgaaaactatacaaatacgtggaaattaaataatctgcttctgaatgatctttaggtcaataatgaaatcaaaatagaaatttaaaaatcctttgaactgaatagtaatagtgacacaacctatcaaaacctctgaggtacagcaaaa

SEQ ID NO: 40514 - DNA, 1050 bp, Homo sapiens
gagaaaacctttatagacacactcagaataatatttaaccaaatatcttggcatcctgtggcctgttcaagttgacacataaaattaaccattctatttgtagttgtacaatagaatgaggaagatatctgaactgatacggagtgagttgcagaatgtattgttaaatgatagaaataaagttcaaaactataggatgatgttaccttttgtataagaaattaggaaaaaggcaatgtgtgtgtgtgtatatatatgtgttcaattgtgcacaaataaatactggaaagacaaactattgagattggtgggtaaaaataaagatgggtgggtgaaaatggagtggaagggtttgatgtaattatttgggtagttctgactttagaatcgtgttaatgttccacatgccctaaaattaaatcaatctgtatgaaaggtgcactcaatggaatataacagaaacaactgaacttaaatgtattttaaatgaataacactctttgaggggattggcaatgttaacccaggtaacttaagaatgtactattttgacactatactataaggctaaagacaatcataaagaattgtaaatacttaggagatttgttttttacattgttatgtgaggattagcaattttaaatctattatatttgtattcttggactggacaaattaataaatacattgtgggtaattggagtcaggtttgtctgtgttggggaattgagttacacatatggaaagaaggaaagccagcatgaagcacattatgttggattagaatttgttatagtatgcaatacttctttttaatatataggactatatataaatgtatatgtgtgtgtgtgcatacctccatttcctacctttttcactgggtgggcttacaagcaatgatactgagtaacaatatacacattgcagctatatcttagtttcaaaataaccattctgtagtgaaaggaaacgagtctttgaacaaatggctgattacaggatgaagcatggaaagtaaacatgagcctgaaacatcttgtacca

SEQ ID NO: 40515 - DNA, 1021 bp, Homo sapiens
gtagtcccagctacttgggaggctgaggcgggagaatggcgtgaacctgggaggcggagcttgcagtgagccaagatcgctccactgcactccagcctgggtgacagagcgagactccatctcacaaaaagaaaaaaaaaagagaaagtttgctgaccacggcactagatgattaaaatttttttttaagttgaaatcaaattaatctgtgctttttgttttaaaatggaaatttgtcttaaaagttaaatgaaattgcacattttcaataaataattttgtctaattgagaataaattcttagtcatctaaatcattcttttaaaagtatttgaaagatatatggcatttaaaattctgctgctgtcttataaataacacattttggttattttctataggttaggtcttctgaatcattaatgagtgaccagtgtccatgtttatgcattaaagaattatgggttctacttattcatcttctagaccacagaagtaaatggtttgtctcggaagtaagttggaaaattgatgtgttggttattgttactaacctttatattgatttaatccaatggttttaactgagaaaaatcttaacttccttttttataataaggcaataataaccaccaatagagcaataactgagtactgaatatctactttatttttaaccctaattatttttagccccaagttagtaatatgaaaaatctaagagcagtacaaggttcaacccttactttttttcaagttttgttgttgttgttctatcagaaatctttcagactaaggtatttactacccattagtaacctagaaaacattttagtcaggaaatacggcagatttagaagatttgtggagaaataaaacaggtttctattactcaattttatagcaatttcaaggagggaggaagagaagcagaaaagggaagatgagaaactttcacttcattttcagtcatgtcttcagaacagggctttattttatttcaagtgctgtaggttattga

SEQ ID NO: 40516 - DNA, 1040 bp, Homo sapiens
aaaattatgtgtttttattaaattatgtttatcatagagtgtttaatggagacagtgatttaaaggtgctacagaacatgtttatttttaagtagtataaatgtttgtagagtattatctgttattttagattacaagcgtaaagactgtttttgggaaatcaagattgagggaaaaggagttttataatttttcaaaatttagatttttttatgcattatcaatatttttacaatttagtgtgtatgtgtattagtggattaaccagatatgatagaataacttttaaatatttatttatttttgttaattgacaaaattatacatatttatcatatacatcatgttttgatatgtgtatacagtgtagaatggctaaatatagctaattagcatatgtattatctcacattcttattttttgtgtgagaacacttaaaatctatgcttctagtgattttcaagaatacaatatagtacattgtttttaactgtagtcatcatgttgagcttattcccttatctaactgaaattttatatgctttgatcaacatctaccccgcctccctcctaatcctcctcacagcccttggtaaggatcatcttactctgcttctatgagttcagcttttttagattctacatataagtgagattatgtgttacttgtctttctgtgcctggcttatttcacttaatttaatgtcctccaggttcatccatattgttgcaaatgacagcatttccatcttctcaaggctgaatagtagggtcatacactgtgtaacaaagttttagtcagtgacagaccacatatacaaggtagctataccacatagcctaggtgtgcagtagtaggctgaaaaagtttaagtacaataaatcatgttagcctaaagacgtgcttctcagaacatgtcctgctgttaagtgacacatgactgtattccattgtgtatataaaccacattttctttatgcattcatctgttgatggacaatttggttgattccatgtcttggctcttataaataatgc

SEQ ID NO: 40517 - DNA, 1029 bp, Homo sapiens
ccagtgttaatataggagcatttgtaaatcaaaaccagattaaggtttgacttgtttcatttgatttttaaattatcagctttttctccccacaaggagtattcattcaagaaggagagaaattagtcagaattacagctctggaacctgactgcctgagttgaaattcttgccccccatcctccttttattaattgtgtgcttttgggcaaatgacacctcagcctccacatctgtgtaattcttacaacttaccagaatcattggatgaattaaataaattcatatacatgaagttattaaaacatagtagtcattgaatcagtagctattctcttgatttatgacagtataagtgtctgaaaattttaaagcaaatgaaataatctttattttctgaaatttttatcatatattacagtaagattcaagatcagcttataaaaaaaactttcaagaccacatcattatgtgtattctgacttttgaggcctttttggaatgtgattaagattgttttgactgtgccctttttttcctacctgtgataatcattccctctgaagtttggtttttaaaactttatattgttaccgtgcctagcttatagataagtaatagattctgcctatgaaaatgggagcttatatgaataacaaattatggtaattcacagtgagattccctgaagtctcaacccctttcattatatttgactttaccgttttgaataatatttactctttatgaatatatctttgttaaaatataaaaacggctaagcatggtagctcatgcctgtaatcccaacactttgggtggctgaggcaggaggattgtttgaatccaggatttgagaccagcttgggcaacatagcgagaccccatttctacaaaaaattaaaaagttagtccagtgtggtggcacataccttgtagtcccagctactcaggtggtcgaggtggggggatcccttgaactcaggaggttgaggctgtggtgagacatgattgcaccactgcattcca

SEQ ID NO: 40518 - DNA, 1040 bp, Homo sapiens
aactattccctggcttgtgtactctttatagggaattgttttctggtgtttttccctggcgttgggtaatatttttcatgcttgaacagatcgatacttaaatctcagagggacacttctgtacccttccagaactctattttgtatagcttctttcttcttgggtacttttgccctgcaaatttggacttccctaaacttggatcccatatctcctcatctcaaagagtgagttgggctgtatttgggttctcttcctcatattgaagcctggaaactgtctctaggtggggagctggtacagttgtagggctcagtttctctctgggagagcaatcttatattgtcttgtgtccagagcctgaaaacttgcttgacgtaatttttatggttttcagctttacagtgggagatggagcaatctgattattttactccgtcttgcctggatgcagatgttcactgcagttatttttaagagagtactgccttaatgggccgagaattgtgaaaattgggatgatatgactttttatgggtgaaataaagccataaaaatgcagtttaatatggaggtatttacacaactgcttcacacttatgcttctattctgccacagtagtggcatgattgttcatttgaattaaactttagtttcatgtttagtatggctgtaaatttgtagcctataattctcatcatgttttctttgcttttgtttactagattgtctcttactcattctctatataatgattattagtgttttgcccatagtaactacctagataattattgctgatataaatgctgaagtaagtgagggaaagctgacatggagtgaggttgggagaaaggcagcaactattaaaaggtcgttcagagctttataaattattattaggagttttgattttattctaaatataataggtattctttcaagagttttgacttgggaacaagataaattgatatacattttaagcagattttttacttagtgtatagggggacaaaagagagcatggaaagacct

SEQ ID NO: 40519 - DNA, 1050 bp, Homo sapiens
tattcagacatggttacagaggttttgtttttgtcttgtttcactgtaatggagtggccctgtatcattattatttattattattattattttttgagatggagtctcgctctgtcacccaggctggagtgcagtggcatgattttggcccactgcaacctccagccccctgggttcaagcaattctcctgcctcagcctcctgagtagctgggattacaggcgcacaccaccacacctggataatttttgtatttttggtggagatggggtttcaccatgttggtcaggctggtgtcgaactcctgaccttgtgatccacccacctcggcctcccaaagcgctgggattacaggcgtgagccaccgtgcctggactattttttatgttttatgaaaattgtttattttcagtaggggataccatggcctagctgttagctatcagcttttaggctgttttatattttttgttttcttaatatgttacgtgatttgtaaatgttaagtattattgtttcattatcatctgatgggtccctggttcatgccaggtactttgcaaggtactgacgaatcaaagaggaaaaatatgctgctgatgagtttgcagttgtgtagacagctagacatgcaagcatacatcagcttggtaaatgaaaaggtacggtgataaaggaatgtacaagctgctgtggaagccaagggctttgtctatctgtgagctcctcactaaatgatgccagatctgggtcttcacagatgggaagaaattagctaggcaaaagatttgggaaaagtttttcggacaggaagaattccaggcagaaaaaaataaaactgtataaacaaagacgtgatgtgtgtaaaaacataaaagtttagagagcatggattaaatattaattacatatggttggatcagaatgtgtgtgagtgatgaatttggaagggataaaagcagagttggctttgtaaaccatgacagagagtatgatttttattttggaactcctgtggagccactaaaagattatagtggaaagaaccaa

SEQ ID NO: 40520 - DNA, 1033 bp, Homo sapiens
gaaacagctcttggcgtgctactgggccttagtagagactgaacacttaagcatggaccgccaggttaccatgaaatctgagctgtccattatgaattaggtgttatctgacccaccaaggcctaaagttgggcatgcccatcagcaatccataataaagtggaagtgatatatatgtgaggggacccaaatagaccgtaaggaaacaggtaagttacatgaagaagtggtcccaaagcctaaggtcctcacttctgctactcggccttctctttctcagcccatacctatcaccacatgggaagatcctgatgatcagctggcaaaagaagacatctagggcctggggtgtgaattatatgcaggcacaacctaaacgtaggtagctgtagcactgtagccttgttcttgggcatcctaaatgagaatggtaaagggaaatccttctgtcaagcagaacatggttgttctcttagttcagaaggaaaaatggccagatgtatgtactgattcatggtctgtgatcaatggtttgatagtatggtcagggtcatggaaggaatataattgaaaaattggtgacaagaaaaaatttagattagaggtatgcagacctttcagaatgggcaaaaagtgtgaagatatttgtgtcccctgtgaatgttcaccagatggtgaactcagcagaggaggattttactaatcaagtggacagaatgacttgtcctgtgaaaattcagtcagcctctttctccagccaccccgtcatcacataatgaacttatgaacaaagtggccacgttggcagagatggaggttatgcataggcttagcaacatggaattccattcacaaaggcagacctggctatggccactgctgattgcccaatctgccagcagcagagactaacactgaactcctgatatagcaccattccttggggtgatcagccagctacctagtaggagattgattacattatactgctttcatcatggaagggactgtgttctgttctttctagaataga

SEQ ID NO: 40521 - DNA, 1042 bp, Homo sapiens
cagaatcaaagtaaagcagacatgagggactccaaataaaatatttggccctttgctggaagtttcactctgggaaagcatagcatctaatctgatgtgttctttagttgccttgcaaaaattaggtcctatttatgaagttacagctactgagaaaactggggtgtctctttactttcatggctttgaccccatatatttgccccactcaaaaatttgttttggagaagtctagagatgtcataacacacagagaaagaaatgtgtgtgtgtatatcaggaagatataatgggtccccaaggtccccaggaaagaattactgtggtctgttattttgattaataagaaagaatagtcaagaatttgaaaattaatgaaactgtagggaaaattacttttcatcctagagttttaacgtgacaaagggctagaaaactgaacattatcggataaaatttggactttgtaaagtagattttttaaagctcagagaaaatataggtatgaatccctgaccaaagactgtgaaaatttagcaacttgtgtaagatgagaggttctgttaaggaaagtctgatgacttcaaatgattgaagggtagggaccttatatccaacaagatggatgtagctgtccaggtcccctcaaatgagctctggtaatgcactaaacatggagagaagggcatgccaccaataatacagtggcatgatcttacagactggaacagggacttgtgaaaaacacaaaaacaatacaatgtacttaaaaaatgttacctttttacaaatatttgagagatgcataagcaaaaggaaacgtctcttgctttaagcagatataatgatattataataactgggagaaaatagaaccattcaccttctactttgcatctccatctggagaataatttttgaagtggaggtggtataaccaatattattgtgatggaattgaaggtagtgaaaagccaatcccccaggttgagatgagcagcatagaggatgttgtaataacttgcagattcagtttgactca

SEQ ID NO: 40522 - DNA, 1061 bp, Homo sapiens
cactgtcagcagggtatgtctggacatgtgcacagaaaagagaaacacttagattgaggacggttctgcctttgtctttcaaagtgccttccgctttacaatctatacagattccttgcaaaatcaagagtcttattcatttcctgctctaggtgcatccattttaccagggcctagagtatgaatggaaagtgctcctggagcatcatcaggccacattcctcggtgccttcagcccttctaaacctgtgtagcaagccactagcctcagttctccgtagccttaaatctcgcctcataaaccatctgggcgattaaaaaaatattttaaacattaaaataccaagtgccaaagaaggtgaatttcttaagcctagtggtacactgataagtggttagctaccaactcttgggagaaaaaagctccagtttgtagtgcttcccaatttttgtcatgtaatactcccatctgtctgatttcaagctatcaatgtgaagtcacttaatgctgagttggaatgagacgcacatactttgctcttttgagatgatatgaactggctccaggtcccctctgccagataaagttattaaacattgatcccataatttctgaaaaataggcataataagctatagctggctttccctcagaggtggtattatgtgtagttaaatggtccttcaaaatctatgaaattcctatttgccatcgaatacattataagaatacaattaaaagaaattttctaaacattcaataatcatgtaagaaaattaagcatattaagaaaagctttgaaaaattttataagaagcaaattattttgctgatgtaaatctgacataaatcatatacattgacaagagcattgtatgtttatgggattataagtttttaaagagtttccctgtatttccatggctttgaaaattatatccccagataaattgtggcatttcctttgtgcatgttggtgcaattttacattatgaaattgtcatgtagattcattacacctattttccaaacaaaaatgaccataattcaaatatgtacc

SEQ ID NO: 40523 - DNA, 1047 bp, Homo sapiens
aacatggaatcatgctaacttattttcaaaggaacactgagcaataaagtatcgtggcatttatgcaaaaaaaaaagttaattttttacaccttcatgtaaggatgtcttattaagcctgtgacctggcaagtgttttgtttggtatgtacaaaatggtcagagctagttggagaatgagacatgcttttccagctgtttggttatttctctggattaactgttcaactggaaaatttttagtttttctagccaggtgtggtggcacacacttgtagtcctagcgacacaggaggtggaggcaggaggattacttgagatgggattttgagactctagtgtacttatgattgcacctgtgagcagccactgcactccaacctgggcaatatagcaagtccctttctcttaaaaaaaattgtagtgtttccacttttcttctgatatttttgtctatttcactactggataatgccaatataaaaatttgggtataatcaagaataagaggtaaactactaaataaaaaaagctttccaactgttagaagcagatgccttaacattttgtgaaaggtaaagttttgaggtttctgaattatataaaaaaacataaatgtggagatatatattatatatacacattatatatacatattatagataatatatatccacatttatgatttttaatatatacatgtatatattatatattatataattatatattacatttatattatatgtaatgtacatgtatatattatatacatatatataattatatatattatatagagagagatatatatcttgctagggtgtgtggatgctggaatataacgattttgcacttaacaggacaatgaattttgttatactacagttaatattagttttgtgttcaaaacagctgtgccttttcatgccacaaaatattttctgtctactttctgagtagcagaattaattcatttttttaacaaaacgatgtatgtcaagtgttcagtagtcacatgaggagaatgcttcctttgtgcctggca

SEQ ID NO: 40524 - DNA, 1081 bp, Homo sapiens
gacatagactgctttgggatttaattcattaacatcttctgtctggagtgctcttaaatggatttttaaataaatgagtactcctggctgttttatgaaacagtggcagatccgtgaggtcagtgggcagatctgtattaacaaggatgtggatttgtttacatggaagcaaagcaataggttataattaagaatctgacttactctaaacagtttgcatgtctgagcataacatgtaaaagattggaattatttgatttccagattgaagactatgatgtgatagctagcatgataggagccaagtgtaaaaaactccggaccctggatctgtggagatgtaagaatattactgagaatggaatagcagaactggcttctgggtgtccactactggaggagcttgaccttggctggtgcccaactctgcagagcagcaccgggtgcttcaccagactggcacaccagctcccaaacttgcaaaaactctttcttacagctaatagatctgtgtgtgacacagacattgatgaattggcatgtaattgtaccaggttacagcagctggacatattaggtaaggttacaatatataaatttgttttaaatgtctgtttccttgacagaaaagccaatctcagactttttgttaggaaaaagaaaatttttggatacaataaaaattttatcctgataagatggcttggtttgataggaaatgcaagatagatcagttaatatagggaataattatatatgtactttaataaaatagtgaggacaataacaattttatagttgaaactgtaaaaaactataaccattaattcttggtctacttgtaagagtgagaatttacatgagctgcgctctctatttttattaaggagagaagaaattaattcatttgtataatgaattcaagctagttttttttaagtttcttaattaaaattcttgattaaggaatatcgtgaaatctttatccctgataattctagcgtttaggaatagttctaccccaggcagatctattgaaaatcttttccagctctgggatttcttgaatccttgctgcatt

SEQ ID NO: 40525 - DNA, 1028 bp, Homo sapiens
tccagagttgacccatggaaaattacctctaaaggataatcaattttaaaggctgtgtatttgggggtggagtggagattcctaatgaaattaggaagccaggtatggttgctcaaacctatagtcccaactactctggaggctgatgtaggaggattgcttgagcccaggagtttgaggctgcagtgagctatggttataccaccgcactccagcctggtcttagagttttacaatggtgtgtgctacaacaaagaaactgtttacctttgctaaaaccagtgttttcaaaccttgcctgactactgaactcatttttctatattacattttccatattacattttattgttgactgtcaatataatagcaatgtttagatttgtgatatttatgaagcaactgttcacagtatacatacatagagcactgtgctgactttcccatggtgattgtgatctattatataccttcgctgagtattcacctcatggcatactttctctgtagtgagtttaatgtagatactaaattagttgtgtcactttttttctgaaactaatctttgtgccacaagtgccagttagacagatttgcagtgacaagaacttctgaggagcagtgtctcacctgtaataaacctgaatattctagtcaatgccgtaaacatgtttttaggactacttagaaatatttatttttcctcttgattgggaaagagacaaattttatctatttctttttacttctaaaaatgactttaaaaagtttaaattccactattatataatgctgattgaagtaatttaaagttgcctaaattaaagaatcctaagacctacctgctattttcttaagtttcctactaattatgtgatcctggttaggtcacttaaattcttgctgatagttcctctgtgacatttgccctatttttaaaattagataatgaataagaaaataaatatgtctaatatttttggggaaaaaagagtcctgcataatatctaaaatttagaaggaattat

SEQ ID NO: 40526 - DNA, 1031 bp, Homo sapiens
agagtgagactccatctcaaaaacaaacaaacacccagaattatgtttaactaaatatctgggtaccccatggcctagtaaggctgatacataaaattaaccatcataaatgtaatattgaaagtgacctatatcacctctacaatatactgtttgttaaaagtgagtcgctaagttaagcccactctctcaaagggagaggaattaagctctacctctggaaggaaagcatatagaataacacgtggacatatttttcaaaccactctaaccgctggtactaggagactccagtgttatactccagtgttcattgaatagaagttactgaagaaaaaaatggaaggaatggtagaaaagtaatatttgaagagagaattgttaagaatcattatctttcatgaagagagatatgagtcttcagatcaaaatgggcacttggggttttaaacaaaataaatgaaaatacatttttagacagattgtgatgtaattgcaggagatcaaaaataaagggacaagagctatcagagacaaaagatatattacctgcagaggaaaacaattagattgacagtagacttcttatcaagtaagagactcataagcaatggagtaatgttttcagagtgttgaaagaaggtaactgtcatctgaaaattcgaagtctagctaaactttcgttctagattgaggaaaaatctcaaatatgcacaataaaatttattttaaaaaaagattgagggtaaacattaagttatttaagtttctgtctttctgattccccatttataatgataggataggtaaataacggtatttaccttataggttaactgttctgttcactgttatatcccaagtgcctaaacggtgcctaacacatagtaggcatgcaataactgtttattaaatgaatgaatgagtgaataggattgttgtgaggatttatatatataaagaatttacagcaatgctacctgacatgttaataagtactcaataaatgtttgttgttaagattttatcac

SEQ ID NO: 40527 - DNA, 1036 bp, Homo sapiens
tataggcgtgagccaccacacctggccttactcttacttttaattcaaagaactgattgtatagggaatttatctcaaactgtatcatgagaatcttattgtcccagtctggggataatcagctaggtgacagtgttccaagccaccccacccaggagtttggatggaagtcttagagaaagaagagattttgttttgggcagatataccaaaaagtatatagtgacctggtattggccatgcctcctggtcagaactgagctaagccttctactggtcctgcagtatccgcagtgccactgcagagcaggacctctataccttcagcagaagtcctggttctagaagggagcaatgtgcaagacccttagacaaggaggaataaaaaaagatggggtcaggagatggcagttcaaagaaatagtgaaagtaccttgtgaaaaagaactagaaattttgaaacataaatagactaaaacaagaacacatagttgtgaaaaaaactgattggaaatctagcaaataaagtatagtcattaggaaataatgaatagatgtgataaattctaaattggacacaggattactaaattagaagagaagtctgaggaatgtactcagatttctaaaaggtatgtcagacactgctgtaagttttatacacacccacacaatctcaatcaataaatctctctctctctctctctcatttactcctaaggcaaggcagtcctactcatttaataaatatatattgtgcctactatatactagtgactctgttatttatctattgctatatatcaattgcttcaaaattagtggcttaaaacaacctacatgtattatctcacacgttttctgtgggtcaggaacctgggagtggtttagctgggtagttttggctcagggtctctaaggaggttgcagccaggttgttatctggtgcttgactatggctggtggctcagcctccaaactcagggggatgttgctacagttccccttcagcttgtgaccagaggcccctgttccc

SEQ ID NO: 40528 - DNA, 1032 bp, Homo sapiens
tttatgtgcctttacataatttgcattaataaatatagtatatttatgccattttacaagacttagacaagtccgtatgcataatgcataaagcttttgaggattttgaagacctggatttttagtcccaaagtttgggaaaaagctactgaatatattctgttggctgtcctagatattttgcattattatttctttacaccagtctgaatagggttggtggtattctcatctttacacataattaaattatggtctcaaaagattaataaattgcctgctggcacaagcaatagagtcaggatttgaactcaggtcttgtggccttggtgttgtagttaaaattataacatatataaaagcatagaatagtagttattctgatagcttggctatttacctaaaacaaggattttctttactacttactatttctaatttgtagttggtaaggagatacaacatagtaactaacatatacaacattataatccatgataaaatacagactattatgtttatgttttataaatatcttctgcaggaaaacggattttttgtctttttactatgaacaagcttagtttgaagtcttagttgttctgaatttataaatcacaatttgttattcaaattacatttagaaacatttaagtgaaagtttgtagaatcaatacataattaactgctttaagtaagtagtttatataggcctactctcaattttatactgtaatggagagcagcattgagacagataatcctcaaaataattttgacatgtaaaatgatgtgttgttgatagctaggtgatgtattcttaagtcgttagccatagccaggcatgcagcaggcctgatgactcagtaagaatgagacctcaggagaatagaactgtggcagggtcagaattgtcttgtatgctgatgtgggtccctccctgcatcagtggttgttcagaatttttagccttataagatagtaaaatatagttcaacttggtttcttaatttatttcatgagatctttttc

SEQ ID NO: 40529 - DNA, 1027 bp, Homo sapiens
attttgttagtgactccatcatcatttgttggaattctatttttccctgctgatcagtcctataaataccataggccctaaattcccgtgtattcttgggactttctgaacggtctagtattctttggctccctgtggtgatcctggcttctgtgatgctcttattgctctaggtttataatgtgttttaatatctagggatttgaacgatgcctggcatattgtagacatcactaaatatttttgaaatgaacacatttagtgggggcaagttgattccctttctttacctcttgcctccctcccccctttaaaattttcctgccagttattgagattcatttattttagcttgctttttccatggtcagttgaatcattaactgttagtaaataaatcccttctgttgctcattcagaacttgcgactagagttgctccttacagttacatagagaagcagcctgattaaaaatctgcatgccttttgactttgcaccgtgtcatagtaactgtagtgtgtctctccccatcacctgtgatttaggatgttctgtacctggtttctaagagaaaaatggttatctaagagataaatggctgtagaagtgttccctgggatatgaggaagatatcctcatatccatttgtattttaccatcacaactggatatctaaaatataataaattttacactggacacttaaaactttattagcccatgaaataaatgtatgcattctttaaaaaagatcaagcaatacagaaatccttaaaggaggaagtgaaagtgctgtgtgcccacctacccagtaaccttgttccataaagatgatcactgcttgcagattttaaaaataaatatatttaagtctacttttgtttcataaatggcagtgtaccatctataattttctatagcttccacttaataataattgataaacatccttctgtgtcagtgcatataatagtatcttgtcttttttgtaagtcttttggtatttcattgtaggaataacccaa

SEQ ID NO: 40530 - DNA, 1042 bp, Homo sapiens
tcttgagtgacagaaaagaagaaagaagtgctcttaggttatttgagaaaattttgttttagaggtttggaattttgaaagtcataggattttgttgttgtccttgtcatttatcttttaaccacccccaaaattgatttatcaaaatgagttcagggccaagtgcgcttcctttcagccctgaaacccaccgcttctgcatggatagggcaaccagcctgggctgaaggtgggagagaagaggctggatttttcttccttaaagaagaaaggtctgcacaatcaggttttcctgtattcatttattcattcattcatagaacaattgttgagtgtattttcaataaaaggttggtggcttttgttgatagggaacaactcaggttattcttctttctttcttttagggttttttttttttttaaacagagtatgttattttattgttcctgactatgacccaggatcctttgttctcctttatatgcagtgctatttaagtcaaactagaactgataaaagtacactcaatgacgaatacttcccaggctaaatgctgggctctgggaacccatctttaacaggtccagggatcaattgcatgtgattgtgaagtgcttgacctttattcagttgcttccagtggtctggatataacttgggaagttcaaaaggattcccttgttgggtgaggagggacgggcctcttacctgtaagactcttgctactgtcaggcgtggatgcgaacatctgtggcatgttttcctcatctgaattccttacccagaaactcagatttttggtccctgactttcaagaatatcttaaggatatttaagtttccttaatctttgagatgagactgctggaaccagcaacgttagccttgccagttagagatgattacagagggcactgaagcatagatttaaaaaaaaggggttcagctgttttggagctgacagggtgacctcctcaaccattctgctttcgccgaagcaaggaacttgtccccagacctagaccctctaaaactcctgc

SEQ ID NO: 40531 - DNA, 1026 bp, Homo sapiens
ccacagaccttaatgctattttctgaattaggaggagctcaaccttctgtgctctaggaaaaacctcattcagcaactttcaccagcaattatttattttattgaatgtcctttttacttaatacttgatagattaaaaagtggaaaaaatgctgcatctccttgaccagcatgtaaatatctcctcactcctgcactcttactattctccatctggagggaagtgttcaggaagaggttgtcgtgaggagatttgggtttcaggaaagggctggaacgaattaccttggcctgtttttgtatttggagatctgtgaattaatattttttagcttcgaggagacaaggcaaagggggtgttttcattacagtattcaagtattttaggaacttttctgaagaggatatatgctcagtgtcctccatgcctgcatgacagatgctaaaaggagcaaccaagggtgtagtcagcgcctagcatggatctggaacagggaggtgctgagtaaatacctgtagagcaaatgagtgtgtttggatgttggcctatgttttccaagttattgctggttcgtgaccaagggctggcaggtgctgctgcgagacattggcatgcttctctctcacccacattcctgccttgtatgattggcagctgggagaaccttacttctggattctgggtttggttgacaatgttttcagcatcaagttgtacagaatgttttgattattagagaaattagaggaatacaggaatataaaatacatcactttatttgaagagcagggagggcatttccatttgagaaactttaacagaaaggttctttattctatctgggattatcttctgggtaggggggcattcggctttctgataaatatcctctcaagttgtctgagaatatcactttgtttcttaccaattgattttattggatttttaaatttgaaaagtaatacatgatggttacagtaagttgaattacaaaggtatagtttaaaaagtttatggccttctcc

SEQ ID NO: 40532 - DNA, 1032 bp, Homo sapiens
ggtcaggctggtcttgaatgcctaacctcaagtgatctgcccacctcggcctcccaaagagctaggattacaggcatgagccaccacgcccggccgcccaaagtattatttatgttaattttgaccaaagaaacacaatcttagtactttttttgtgtaatgtgtaccttggatgtgaggcctatcagaattacaagagatatgagaggggaagctaaggagcaaggatacgtagaaccagtgctaggggatgaacatatatgtgtggggtgggtgtggggttgtagccagaagtaaaattcatggtggaaatggcatacggaaagatagctcaccttggattgatgtgccagggaccagatcttggggtgtgtgtatgtgtgtgtgtgtgtgtgtgtgtgtgtgtgtgtgtggtggggtagggtggtgggatatacagatggttcctgacttatcattgtttgacttatgattgttcaactttgaggttgtgaaaaacaatacttgttcagtagaaactatactttgaattttgatctcttcctgggctgtccatatgtgtggtgcagtactctcttctggtgccgagtggtggcactgagccatagttcccaatcagccatataatcatgagggtaaataactgatactgtatagtgtgctgtgttgccagatgattttgccttactgtaggttaatgtaagtgttctgagcacgtttaaggtaagctaaactaatgtatgatgtttggcaggttagaggtgttaagtgcattttggactatatatatatatacacacacacacacacacacacacacacacatatacatatgtacatttacatatacatatatattttaatggggtcttgctctgttgcctaggctagagtgaagtgacatgattatggcttactgtaatctcaaactcctgggttcaagtaatcctcctgtctcaacctactgagtagctgggacttcatgagtgagacatcatgtccagctaattaaaaaatttttttttaaaaata

SEQ ID NO: 40533 - DNA, 1053 bp, Homo sapiens
cagctggactctgtgccaggcctggcagattcctcctttgtcttgagagcccaactgagtgcctggaacacatgaggcatccagcagatatttattgaacaagagtgtaaggagcagttttgggattgtgcttttaaaagaaaaatggccaaactagtgtgtttccagaggaggctggtcaggagtagttagtggggaaaaaatttcatgtgaggaatttgaggatactgggcatggatagtatggagaagtaaagctatcaggtaatatactaacttttttcaaatacttaaaagtggctaatgacttagttgtcactgtagatgacaggcataagagggaggggagaagagacagagaggaaggtgagatgtatatttggagaaataatagctttcaactcagggtaaggcagaattttaagacagagctgtccacaattgggaggacttgtggtgtggcctgagctgctattctccagatgaggttggatgaccactgtcatgatagctgaggaggggtcttttttacagatggtgagatgtttagaaatgggaggtctttctagttctaatggtttcatgattttatttatgtatgtatgtatgtatttatttatttatttttgagacggagtcttgctctattgcccaggctagagtgcagtggcacaatcttggcttactgcaacctccacctcccaagttcaagcaattctcctgcctcagcctcccgagtagctgggattacaggtgcccaccaccgtgcctggctaatttttgtatttttagtagagatggggttttaccatcttggccaggctggtctcgaactcctgacctcgtgatccacccacctcggcctcccaaagtgttgggattaaaggtgtgagccaccgtgattgacttcatgattttatgttcactctctggggagaagagtagagtcattttataagtcatgaaacaaggcagaggccaaagtagagattggttgtctcgaattctgtttgctctgttgggttgtgatttatgtttaggctgctactcaccc

SEQ ID NO: 40534 - DNA, 1027 bp, Homo sapiens
ttgtgggtgggggggggcgagtgggttaaagctgggcctgagtttcttctcttgatctctctactgaccccttaaagctcagggtggggtacagggtgctaggtggctggatttgatgatactgatcatgatgaggcagcacagattactaaaacctaatgtttgtttgcttttaattggatttgtatagatcctgggtggtgatacagcagctatctcatgggaaaagtagatgaataattggtaaatagagttggtttgggagatacagtcatatagagggagaagaagaaaaatacagtttcagttgtgaggctcagctgtggaccagtggtggtcaataaatatctgctggatgagtgaataaaagaatgaatgaatgtcagaatgctgttagcagatagccaagcatggactccaggatctgtggatcttaggagtgctttctgagcaaaaaatttaaatttgtaaatgtatttaagagtaagtaggatcagaaatagtaatgggctgtgcaagtggaaactgcgatgttattttcagccacttttctgttgttagacaccttaggaggagagtatacttgtaataattagaattcaggcagaagggtaattccattgacttaggactgtgtggttaaacacatatgccttgaacagtgtgccaggctttttgtgaggggcttaagggttggtggtgaacacattgggcacagccctgagctaccagagctgccacctgagggagatattgcaggtaaacatttataaaatctcagcacttgtgaggggtgccactgtaaagtgcaaagtgcagtgaggaatttttttgcaggggaaatgaacatggtggtggtagtgatgaagaggtggttctggaagccttcttcaaggaggtgacatttactggttttttttttttttttttttttttttttttaagatggagtgttgctcagttgcccaggctggagtgcagtagtgtgctctcagctcactgtagtctccgcctcccaagttcaagt

SEQ ID NO: 40535 - DNA, 1056 bp, Homo sapiens
tagctatggatatagttttaaaaattgtaacttaattcaaactaaaataaatgaaattcaaactacataaaacagttaaacaaaatgagctaatttttattttcatatctgaaaaatactctgcagtcaaatcaggtagagttagaatagaaaatatgattttatgatataaaatacattaataatatttatcatgaattgctaggaggacagtcataattatctcagtactgggaagacatttgatgatgaagtttagtattcattcctgataaacactcttagtaaaataggactcaaagactagttcctgaacccgatggaagggtattatattaagccaacaactggtgtcatacttagtgttgagtcactaggagcatccccagttaaataaaataccaaacaaagatgcctgctcttgctattatttaatgtagttttgggagggttctgacaatgtagttgtacaacatgaaagaaatatatctttgtattggaaaggaggagacaaaattagtatttatagaaattaggagattatgtagctgatataatggagaatcaactaaaattattacagttaatgagagaattcagtaagtttacgaaggatacaaagctaacatgtaaacaagttttcttgagtatctcaaataaccagttggaaaatataatttaaaaatattaggagtatgatttatacgaaatattcaggacctacagaaataaaatgaagcaatcctaataggagaaacatttttttagaaaatggagaggtgtaccttcgttcttcattgacttgagaatgataactccagaactcaaaccccagctctaaggccttgggcaagcctcttgacttctctgggcctgaatttccttgtgtaaagtaggaacagtaatggtgagaagaaaagtaatgcatgcaaagtgctctgaaaagtggtcggcatgtagaagtaatcaaacagcaggcaaatgtggagggcaggcgtgaccagcatctggaaggagaggtttgtggtgctgtgagagctgacagttggagggttt

SEQ ID NO: 40536 - DNA, 1081 bp, Homo sapiens
ctctccctcatctgcagtaatttccagattcaccctcatcctcattctagagcacattaagtacctcacctctgctaggaagtagagtttagaatttgttttgttgaagaccacctcgtgccttaggaactggaagccatgctgggtagaggccgttctggatataacctgtcccttgcagagtgacccactctgactgcatctttctgctctacatttcagacagttgctagacctgaggtccttccttgaaccccagcttgcagagggcagatcccagtaccacatccagctcttggctagcttcattacgggagttatgttctgggggtgggggcttgatactggctggactccttcaaaagctctgtctggcctgcagaattgacattgtctaggccttctgttgttttgctccactgggaccaggtagacctgcttgatgtagatgtgaatggaattaacctcaagtttgcctcattcctttggaaacttaatgctggactcttggcctcagaaaccaggctcacaactgggccatttctccttaacaatggctatgtctgttcctggcttcttccccttcctcaccggctcatgctgttgtgagcctcagtaagcaaggaattgagcccctggaattatgacagaaattatgctataagcaccacacatctttaacagtgttgcttttttaaccagagaggggcgaccttcacctttcgggacatttctggttgggaaaatcagagagcagggtgatagcaataataatggtaactgacaattgtttctctcgcgtttagcgatttagacaatgctttctccccagttttcaggagatagaagaaaaaggaatcactgatagctaggctggatacatgataagtattcaaaacagcattaaaagtctggattttctgggatgagaagctgagcaggctagttgaaaagttggagttagctggcgttatattctgtgaggcccagggagcagtgtagttgtgaactctgtgataagagaagcactttttctatatttggggagggagaggctctttggctgaatatcataatttgt

SEQ ID NO: 40537 - DNA, 1032 bp, Homo sapiens
gggaagatgggatagtttcataaattgacttaaccaagatcttttctaaaagccaagagactactctttctgtttataactttgttcatatgttctccttttctttcttttctccccaccccagttttagatgtagcgagggcccctgtttgggggagttgatgtaatgcttgtgaaacttggtgaaactacagaaacataccatatgctcctgtattcttgagtagatattcagagtataagcaaaagacagcaaggatgtagccctatgcagagaaaggcattctcatgagttggaagtccaggtgttgatactcagtcatcaaattgtagtttgttatgggttcccacttataaatattcatttctatcacgggccaggtattaagttataatgcatgatatcttcattaaaataccaggggtcagcttctctttgaccattttcttgttcacctgtaaacatttttgagcaggttttgttcctctgttctaagatagtcttttaaaaaatctctttgaccccatttttgcagaagagattagatacattcgttgtgataaggaaaattagtatttcaacttcttgaaatagatcctcaaaatgataagttaattgcttagccttgtcagctttccaaattgaccctctctgtcctcttcagttaatgattcatgattccttttgcagtgggtctcctcccagtggagagtgaagagccatggattccaagagaaaagtggcagccccttcttcattttccgtaggcacatctctttgttctcttttcccatttttctatttaagtatgtgtcatctcttagaaacactacttagcagtagctggctcaaaagcaaagccttttttcatttaatcaataattcattatttctgcaaacttaatgaatgagtgttagtggccaggatggtatgtatacctgttatcaagtggctcaaaggctggaggcagacatcaaggctttgtaatggttaatgctgggggagggtttgaagaaccaagaaaaggcag

SEQ ID NO: 40538 - DNA, 1373 bp, Homo sapiens
tgctgttttatcacagaagcagtgataagagagtatgccaacaaatgagcatgaccgtgttctgctaaaactttattatgggtactgaaacttgaatttcatttaatgtaccatatccttcttttgatttttttcaaccatttaacaatgtaaaaacttcttagcctgtggactataatttgatgggccttgatctagactagaactcactgagttgaggaagatagttgaattgattggactcagggctttttaccaatactgtataaactgttgaattaaaataatattatgtcagagactcagaggagggaatggaagactaagtcaagatagaattcctagggtcaattgtccatagataacaagagcttctgtatgttccagaagtaaagcatactactcctttctggattttctttggcttgattgcaaactcctagtttgtattccccaagtttgaaccatcacacgagttgatgagttttccctgttctgttttttgtagccttgagctggcggtggtaccatgtgagttaagaagatatggttcttgctttacaaactcattagtctatggtttttgaaatttttctttcatccattttctggagtttctgcacctttctctacaccccagtagatagagaaagtttctcttgatttctgcaaactttatctttttccaaagattgaattaagagttgttaagcccattgtttttggcattaattgttatctgcaggcagatgctggcccagtagcttttattaaacctctcccgctgagtgatatcctcaatatgggcttgactggagaaggttctttcttctcctcctcccctatttcatttattctactctctttctaaatggagaacttgctgttcctatctcttggattttaagtgaccctcttctttttctctttttacttttgattcttgcccagtttattccagggctgacctaagctccacttctacccaccactccctaaagaggtgatagagtaggcagcaaggagggggctggggagaggctggagacaggggtacagattagtgtggaagtaatcagactcagtgttcatggaatgaaccaggtattttccttacaatagtggtagggaactgttggggctcccctcccaaggtgtgcagcagtcacagtcacagggaaccagaatgcatgactgcatctgacatgcatagcttccaggaaaaacttagcttctgagaaaggccttgcgaagagcccatcacacttgcttactaggctccagtcagttctgctgctgtgaagggaaaggaaggacctgcacaaggccacgtgacccatgttccttccctcgacagaggccctccaaggcac

SEQ ID NO: 40539 - DNA, 1045 bp, Homo sapiens
actgggaggttggagggggtgggctccccactcagccaagcttttgcctgccccaataatgatattactcctccagctcctgactccccatagcctgtgctttttgagatagcttctgtagagaagaggggaagggggtggcagtgatccttctaaggcaatgctgggacaccatggttgacatgctttagtttggtaagtgctataatgcagggcctctggggacatggtgaagtggcaccgagtccagacttcggattggggcatcagggaggacatgggatgtttgggaacaggaagtgattagaaagggaatctttataactggtaactggaatgcatggggggagtccagagagagcagcagggagaagattacttaggacttgctaagacagcaatggaagaaacaaggtctgcagcatctaaatgcattggctcatatttgaaagatcgttgttcagcttggttttggcagtcagcacttgaagatgtgtgtcacttggagactcaaattgaaggaagagattgctacccaacagctacctgtctctattccatcatcactcttgaacagattgcctcacttagccatgacagctttggggcagtgggagcccaaaacctgaattttgtgcagtgctgtctctgattactttcaagaacttttgtgctcccccacctttgataaaataatcctgtcgtttgtggtggctgcagcagctgccaggcttttctgcactttcctttctgcccttcaagccgtcaagccctgactgctgtagacctgtctttacctgcagcatatctgcctttgttcacattttagagcagctgcctgtagttagtgtaactggagcagcaggactcatgccttgctgtgaagcctgcagctattacagaggtcttcaagaaggggcttgcttaccccttccaaaattattatttgttattaagtatatttttaaaaaaagaattgtatagggctgtttttcttctgtgaagtctgtatggaaaataaatggagtgggcaatgctccagggg

SEQ ID NO: 40540 - DNA, 1048 bp, Homo sapiens
tattatactctcacatttgataaatttatgttcaaagttcttttccttctatattttaaaaatattaggccaggctggtggctcatgcctgtaatcccagcactttgggaggctgaggctggtggatcgtctgaggtcaggagttcaagaccagcctggccaacatggtgaaaccccatctctattaaaaatacaaaaattagctgggcggtagtggcgtgtgcctgtaatcccagctactcgggaggctgaggcaggagaatcgcttgaagtggggaggtggaggttgtggtgagccgagatcacgccactgcactctagtctgggagacagagtgagaccctgtctcaaaaaaaaagaaaattgatgttaatctcattcttctttctctttctctctaaattatcttagaatttgtatttaatcttaatattctcaagtttcaatatggcatgtgttggtgtgggtctttatatatcctgtttggtcctttataaactcttattatctgaggtctttcatctcttttgaattctggagaattaattatcaattttgttaaaatatttccttttcttttatgtttgtttttcttttccctcttcttccttgttccctattatccagattttggaaactctgcttctattttctatgtctctctactctctacttgaattcttttctgcttctttctggaagcattcctctctctgagcttcctttgcattgctctatgtgtgtttgttgttgttgtttgtttgtttttgtatccattatgctatttaccccatctattgtgttccttattccaacttttgtatttttcttcttaatgttttctttcagtttgtattagtaatctcttcctttatccattggaggatatttattatgttacttaaattttttggtctgtcccaataattctgcttcatgtcgtataattcagtgcactgcccttctcatagtagtggtacttatctagttattttggtttgagaactccttttaccagggatgccaacttctctgcctgggaatttgt

SEQ ID NO: 40541 - DNA, 1029 bp, Homo sapiens
gtagagactgggtttcaccatgttggccaggctgatctggaactcctgacctcaggtgatccacctgcctcagccttccaaaatgctgcgattacagacgtcagccaccacatgcagcagatcagggaagattcttagataacattccattgaaactaagatctgaaggatgagaaggaatcaattaggtgtttgggaaaggaaaggaaggatgtgggaagaatgttccaggcagaggggacaacctatttgaagtgcctgaggaaagagcatgcatggccagtccaaagaactgaaaaaggacccatgtggttggagtgggaaggatgaggagaatagaaggaagtgagtttggaaagggagaaaactgggaactaaataattcagaactttgtaaactatgctaaggattttggtcttttttctaatggcactgggaagatatggaagcattttattcaggaaaataacaatcaaatttgtattttggaacaatcactctagatgcatcatggagaacagattggaaagggatgaggtaggaatcagctaccagttagaaggctaggacactagttcaggcaagagatgatgggtgcttgcgttagaattatggcagtagaaatggagcagagaagatggaggcacctgtgctcaaatcccagctctacaatttacttaatctctctgagcctcccttttcttatctgtaaaatagggataataataatacccaccttgcagagttgttggaaggattaagtgaggtaatatatgtggagctcttaaacaatacctggaatttaataagtgctcaataaatggtagctattattattatttatttatttattttgagacagagtctcactctgtcgccgaggctggagtgcagtggctcaatctctactcactgcaacctccacctcccggattcaagcgattctcctgcctcagcctcctgagtagctgggattagaggtacccactaccatgcccagctaatttttatatttttagtagagacag

SEQ ID NO: 40542 - DNA, 1038 bp, Homo sapiens
gagaattttacatgaacattttcttagtgtttttgtctttttctgtttcagaagaaaagcagcaaacagaaagggttacaaaagagatgaatgaatttatccataaagagcaaaatagtttatcactactagaagcaagagaagcagacggtgatgtggttaatgaaaagaagagaactccaaatgaaaccacatcagttttagaaccaaaaaaagagcataaagaaaaagaaaaacaaggaaggagtaggtcgggaagttctagtagtggtagttccagtagcaatagcagaactagtagtactagtagtactgtctctagctcttcatacagttctagctcaggtagtagtcgtacttcttctcggtcttcttctcctaaaaggaaaaagagacacagtaggagtagatctccaacaatcaaagctagacgtagcaggagtagaagctattctcgcagaattaaaatagagagcaatagggctagggtaaagattagagatagaaggagatctaatagaaatagcattgaaagagaaagacgacgaaatcggagtccttcccgagagagacgtagaagtagaagtcgctcaagggatagacgaaccaatcgtgccagtcgcagtaggagtcgagataggcgtaaaattgatgatcaacgtggaaatcttagtgggaacagtcataagcataaaggtgaggctaaagaacaagagaggaaaaaggagaggagtcgaagtatagataaagataggaaaaagaaagacaaagaaagggaacgtgaacaggataaaagaaaagagaaacaaaaaagggaagaaaaagattttaagttcagtagtcaggatgatagattaaaaaggaaacgagaaagtgaaagaacattttctaggagtggttctatatctgttaaaatcataagacatgattctagacaggatagtaagaaaagtactaccaaagatagtaaaaaacattcaggctctgattctagtggaaggagcagttctgagtctccaggaagtagcaaagaaaaga

SEQ ID NO: 40543 - DNA, 1054 bp, Homo sapiens
agtgggtagaaccaaatgcccatgtggttttgttatggttatttagatcatttcagggtggggagtattttcagcaccataatatttctgtaccagggagattatagtattctaatttttttagggaaaaattgcttagctctagggatttctaaactttgaacaataaaagttaattttagaaatactttcagggtcatcattaagctttagcgtggctttgttactgccctgttaagtagttttgttggttagtatggacagtacagcaaacccattatcattcctttacagtgagaaaaatatgaaatagtccagaaagaataagatattaagtaacctttgcctgaaggttctgtgaactccttaagcgtttgaatgtatacttctccccaccccgaataagcgtattcttctgggaaaaggcaatgaaaaaagaaatgaactttcttctcagaccttgaaaagtttttagtgcatagtataatttttttcatatgatagactgagctttatgcacacaggtggactgggtggttatggatcaggagacagtgaagatgagaggagtgacagaggatctgagtcatctgacactgatgatgaagaattacggcatcgaatccggcaaaaacaggaagctttttggagaaaagaaaaagaacagcagctattacatgataaacagatggaaggtgtagtataccttttagacttaattttggtccagttttgtatttctttttattttttaactaacctaaaaatatcaaaggataaaataaaggctatattataaataatatgtgatataactgaaactaaagtcacaatttttgtttggttgttttaggagccatttattgcagtggctataagccaagctatttagggtatttttatttcttgctaaaagtcttgaaatgaaaaagatgacttttgaaatgggaaaaatatatttgtaagactattgaaaagtaatttgtagctaggatatataaggataatagagaacctagaagttttttacttaagatactttacctaatactag

SEQ ID NO: 40544 - DNA, 1226 bp, Homo sapiens
tgaaaccccatctctactgaaaatacaaaaattagctgggtgtggtggtgcacgcctgtagttccagccacttgggagactgaggcaagagaatcacttgaacccaggaggtaggggttgcagtgagccaatatcacgccagtatgatccagcctgggcaacagagtgagactgtctgaaaaaaaaaatggctttgcattttaatatttttgaagatgtcacactattagtagctataataattagaaatactgtataaaatgctcttttttagatgttgctgacaaaaatgcttctaacagaaattctgctggatgtcacagatgaagaaatttattacgtagccaaagatgcacaccgcaaagcaacgaaaggtatattttggtgtttctggttttgcttttcctggggtattttggttctgatgactattttggcctttttttgttgtccttgttggatttctaccagatatttgaatattctcttgcatgttttaactcttaaagattagattcgtagacaccatattaaagctatacaaatatttttgttttatctgacctacatgagtacaaattagcaatcatgctgttttcctctaaaatgtattgtggaaaattccaggtgttcagtttatttcacctgattttttttaatagataacatggcattgttgtgtgacttctgatacagtttattttgactaatgaattttgaattatctacctacaatttttagtttaccacttatctcttacagaagcaagtgatttcctacccctagatttttagtaacaccttaaaaatgtattgaaaacaaaaattaagttacatgtcataatctcagaagtagacatacagatatacctgtcaacattttttctcattataaaccaatttcagctcacatcagagttataatttcaaagccagacatgatactggtttaaaatgaatgttatgtttttaatgtttcttctctccccaaaaagcagcaatagtagtagatttaacaataccatagactcatgactatgaaatcgtggctatttgtgttaacatgttgttcctgttgttgatgtgatacaaagctcctgcaaaacagctggcacagtccagtgcactggcttccctcactggactcggtaagtgttttccatatttgtgagagggcctaaagggaaaaatcacacatacattgtctctctgcgtgttctattttg

SEQ ID NO: 40545 - DNA, 1068 bp, Homo sapiens
gttgtatgttgggctttatttacttcattccctctgccagggtctacccttaaattatagtgctaggtgtcattttgaaataactgattgcaattattaacttataaactgctatcataatttaaaattttgaaagaattatttcatgaattctagggtagatttgataatggacatctagtattcaccttgagatggtaatcctctcattaataaatattcagatacttgtatacttggtatacagatacaacagtttttatgttgtttgaagaaatataatggcagggagcatctgcttaccctacttttgcatggtagatcccatgtaaacaagacaaagagctgtattggcagctggcctagaaaagcctctgaaaatagcaaaattgcagaaaatatttaatgattcattaacttctatctttgcttataaatgaatatatctgcaagattatagaaacagcttaagttgtttagttcactttttgttcactgtaagtaggatgttgaaattgacaaaaatgtctagttaaagagaaattagtatctatttgatgtcttagtgttggtaggattagcttgtaaatggattcagaatgaaaaatttcatatacttcttgaaagtagcttatcagctggcttttagaagcctctttgcatttacatagccggaaaatcttaagacaagtaagcctaggttcttgggaccatagaagtatcggtggatattagagccatggaattcttggatgtgctgcacacatggatttctactgtcccagttcataacacacgtgtgtcccagagagtatattgtattaatttgaagaaaaaataaactgcaatactctttcagcatggggctgcttttggtccaccgcaaggtggatttcatcctccttattggcaaccaggacctccaggacctccagcacctccccagaatcgaagagaaaggccatcatcattcagggatcgtcagcgttcacctattgcacttcctgtgaagcaggagcctccacaaattggtagctatttaacttagtttagtggaccacaattggc

SEQ ID NO: 40546 - DNA, 2109 bp, Homo sapiens
acagtatgctttaatatttaagatctcattcaaaaaaaatttttctaatttccctcataccctctctgtctgaaatatttaagatctaaggaatagttgagctgcttattttacatagaggcactattcttttaactcctacattctgaatgctgaagtcagtgttaatttacgttaggccagattgattgggctgcattggcccaagcttggattgcccaaagagaagcttcaggacagcaaagcatggtagaacaaccaccaggaatgatgccaaatggacaagatatgtctacaatggaatctggtccaaacaatcatgggaatttccaaggggattcaaacttcaacagaatgtggcaaccaggtttgttgtttatgttttcacaattttaagacttttaaaaaacagaatgaagattattattaaattttttaatttgcttagttgtatgacttctggaaattaatgcttcttaaagaataggcagttttcaatttgatttgactttgacattttgtggttaaaattattctgtactcattctgctagctttgtggcactcagtttgattcttttcttggttcttcattcctaggctgacaggggctgggaacactctggaaacctcacttggcatctagggaagagagcattctttgtctctctattgcaacctctggccttttcagaagcagcactggcagagtaaaacatgtctagcctctaattaaagaaaaattgtgtcactgtgtgacaaattagtctgtcaaatatactctgcccctaccatccgcctacctttttcttccctttttttttttcagatagtgaagatctttcataagtttttgtgtgttttacttttttgtttgttttatttcacagtatgatgtagatttcttgatgctaattcagtcttccatggcttgtgttattcctttttaatagtcacttgaaactatggaggaatcagcctctcatttgggtatgctgatggtgaagtcataacctcctttccctattaatactttttgtttctccttataagaatggagacctcagtcgagaccagcctgggcaacatagcaaggccctgtctctacaaaaaaaaaaaaaaaaaaaaccttaaaacttagtcaggcatagaggcgcatgcctgtagtcccagctacttgggaggctgaggtgggaggattgcttgagcctaggggattgagactgcaatgagctgtgatcacgccactgcactccagcctgggtgacagaatgagtccctcatttaaaacaaacaaacaaaaaaaacgagaattcagattacttttaaaaacataaatattctagtctttgatactgtgaggtggttcatttctagctttcttgaaagtgaaatttccccacatttgaaaatgttttagttcctaagtttaagttcttaaatgactcccgcgggcatccctaccccttagttttactctactttgtgaccctgggcaagtgatttacctctgtgtgcctcgattttccctcccgaaattggcaaaaataatacctaatttctccctacctcacagggatgttgtgaggataaatgtgttcgtgtaagaaagaaattatataaaacctcaaggtattatttttgtggtgttgttactaaacaaatataaaaattcaacaaaaatagtgctttggattttgttacatttgttaaaaataactttgggcatttggttaggatatgaattagagtggagttagctcattttgaattatatatgacagtttagttcattgcttatttttaagataaacaaaaggaatttgaccaagaagtcataagttgttttttaaatctgtatgtttactgaaaaatctttcttgagatcttaaaattctgtgttgattttgttataaccgcctgttgaatgtttttatgcctaaatcttaaatagaatggggaatgcatcagcaacccccacacccccctccagatcagccatggatgccaccaacaccaggcccaatggacattgttcctccttctgaagacagcaacagtcaggacagtggggaatttgcccctgacaacaggcatatatttaaccaga

SEQ ID NO: 40547 - DNA, 1028 bp, Homo sapiens
gtttttagcatacaggaaaggatcaatctagaaggattcatttagtaaacatttattaaatgcctgctatgaactaagccttgggatacaaaaataaagaagaaaccatgccctggttatgtgagtcactggttcttgaacagggttgtgtatcagtgttggaataaagtacaaagatattagacttgtaagacttttaaaccttttattaggaatgttttcagactagcttacagaaaagttgggctagtgtgatgattcccccccataccatctcctaaattaatagttattaacataaagtaccttccctcccatcttttccatgctatttatatgttaagaaaccaggtcttggaggctgtcttactttctggatttaataccgtttatctcatttctttatcctttaaaattgctttatattggaagtaaaatccaaaagctcagttggactcagttaaacatttttgatgagaattcttagtgattctgggagcatagtagacacctaataatctgtaggggtgatattttggcaacctttgaatttctgatttctcatcaacttttcttgtaaggtttcctgaattaatattttattacttttggcaatatgatagttttctaattctgttctacattcttcatttttttagctgtaattatttataaggaaaaatttttcttcatctgctgaagctatttggttactatcttaaaggaatcttgattggggagaaatgaaatcacttttttcctacaatcttcaaaataattacatatccagaaatttatattgtacaaaaaatagagttttttttaaagtcttttttgagctaaattcattgtgttatgcttgccaccaaattctgagaccagcattaacataaaattttctacctcgtttggtaccctaaaaattctagttgcctctggcaagctattgacaagaattttagacctctgatgaaataaatgtatcatcatataataatttctgatgtgaggttttaagattaaataac

SEQ ID NO: 40548 - DNA, 1027 bp, Homo sapiens
gactacaggtatatgccaccatgcccagctaatttctgtattttcagtagagtggaggtttcgccatgttggccaggctggtctcgaattcctggcctcaagtgatgaacccaccttggcctgccaaagtgctgggtttacaggcatgagccgccatgcttgtcctccacttttaaaatagtcttttgagctacaagctgcaagtatttcagtatatactaaaatgcatgtcacataaagtagcaaaatttctgttttccgtatttcgaatgattacaagattaatttttaccagtgccatttccacctaatctgaattaaacaaataaattcttttttgactttgaggtcagtcaactcatgtaagactgaaatgtcaggggtgaagaggattgttgtattttctggcttctcagctttgtggttgatttgagaaatatttcatcctatgcatcaaatgatagatgtgtttctgtagctctttgattttgtagttgatgctcaaggactttaaaataccacattttaattctcatccatctctgtcacagtctctgagtgacttttgtaaatattaatgattgtcattttggccacacggggtggctcatgcctgtagtcccagcactttgggaggctgaggaggatggatcattgaggccagaagtttgaggatagcctgggcaacatggtgaaactccatccctactaaaaaatacaaacattatcctcgcgcggtggcatgcacctgtagtcccagctactcgggaggctgaggcatgagaattgcttgaacctgggaggtggaggttgccgtaagccgagatcacactgctgcattccagcctgggcgacagagtgagaatttctcaataataaataaatgattgtcatttaaacaagttgttttaggacctcaaagcgatgaagttctaatatagatacatttaagaaaaggataaaatagatgatggccatttctggttgtattagttttctagggatattgtagcaaattaccacaaac

SEQ ID NO: 40549 - DNA, 1034 bp, Homo sapiens
tgcgctaagcaactggccagaattggtttggtttggtttgaccctggggttcctccgtagtctgtaagtggagttgcgaactcaaccccttctccaaggcgggagtgtttctaggagggaacatacttccccttaaaggaagatcacgttgctaaagtaaaaaatttgaaggcgccctatgtgtagaacacttacgttcttggctttctggccactataaagatgggtcgggaatggcgccagctacgttaaaaagtaacgtgcaggaatggttcagttgcccggtgttgaccagagtagagatggttttgcccacaaaaaaaatggcgccgaaacatgtcaatccgcacaatcacgtgttcacaaacctggatgagagatggtatggcttcagatgacaaacggatgttattattctttacttccgggtgagacaaatcgggcgccatcttgtcttgttcccgaagaagtagaagcatcgaaagcgttggagaggtgttaccggaacggcggcgacaagggtgttcccgaactagagtgggtaagtgatggagaacaattatacgtgggcacttgccggaccattacaacgttcttggtttctgtggcgaaggtagcataacttaaaataggctgcgtacgctgcttggcgcgaccgctggaacctcattcctttaaagcgctgcggtccgccagacttggtaaatcagagcgctgctttcgctgaaaaggaaatgtccttgttaaagagagtgctcacggtcccatcttctcacagagtttcctctcggacgagaagggactaattgttgggttcctgaccggccgttaaacactgcgcgtgcgcagtgggaacccccttgtgggaagggggttcatgggggcggaggaggcgggggctcgcgacctggagcttataccctttgaggctctgactacgcaggcgcagttccttagtttgtgtttttcgtgtgttcttacccaatgatggatattatgtgttaagcttcgctaaaggtagtatccaatatttc

SEQ ID NO: 40550 - DNA, 1049 bp, Homo sapiens
aatgtaaggaaaatttatgtcaatggtaatgatatggagaaaaatcaagcaatatggactccctatgaagtcatgcagaaattaaggtacaggggatgaagatatcctagagataaaaggcatggtgatattagtactgatattcctgaaagagaaagctgagtgttgtaggaaggatggggttttaattctggggccctctcttctggcaatatagagacggagaagggaagtcttaacatctgtatgttcccagaaaaatgtatctccctaattcttgtatgtaattttgaaggttcatggacacttctgaagccatttcatacgtattttaaattgcacccaagaagaaatatctgagatgtttgcattcccatatgtattaggataggctgagttgtgctgcagtacaaccccaaatcccaactcttaagggaccggggccaaaagtcccatcaaggtaaagttttatcctccaagaccaggctctctggaagtgctatatcagatttggatgtttgctcctactgttctggagacccaggaaccaaaaggatatcttctgttttccacatacttaatgtacagtggtggaactgtatctgcaacaaacattctgaatggggaagaagaatgggagatacagttaggatccctaagtctaggtatggggtatattcatgattagggttcttttctatctcctaggaagaattcccttgtatattgttctccgtgactctagagtccaacctctgggaaagttttgttgttgttttttttttttttttttaatcttcatggctacatctgaacagctactgagggatatatatgccaactttgggagttgcacagcttttttgagaccatttcttagatgactagggactgtaatttctcttaatttggaatagccacaagttgttgtagccaaggtttgtgtgtgtttttaatacaattcttaaaattttagtaggcttctcatctgtagatagatttgaaggggtgggttgcccctccacacctgtgggtgtttctcgtaaggt

SEQ ID NO: 40551 - DNA, 1059 bp, Homo sapiens
ttttgatgggaaaaagtgcaagtttgcatacggttctaaaattagaaaagtacagttctaataacatctttaaggtactatattcaagaagcgaaaatttaaatgacataaatgtatttcagtcattaggaagtttacgtttagaagttatttccaatagttcaactacagaaccagtttaatcatggaaccagaatgattcagtagttaactactttcagtactagttttataaagatcaataaagtcttgttttgctgattagtgaagctgttaataagagtataaagatatttgtgacaaactttatagtattttttaatctcttacagtaatagaagcaccttgcatcttttaaaattatactagaggcacaagtactgatttgatcataagtttttgagttttttaccttttctgtttgccaaattatatgagttatctcattaaaaccacacaaaaacttaatatgaagaatgataaaaataattacataaaaatagtgaaattagctgagaaaatcttgccctcaagttggaagatgttatctctgagtaccttgaaaaagtgcattttcttttgcttactgataacaggcaaataatccagttaaataaagcactgtaaaactagtgtgtgcaatttctggcctaaatacagaaaaaatagtaacaggaggcagatacgtaaacagagtaaatagccataggcctatataaacatccttcttgaaccaaaaactaaggtaaaatgagctgcaacaaatggctaccaaaagatattatgtgaagtctattccataggctatttttcttcccttctttcccctccccacagctttttaaaaaaccatcatgctgattgaataattgtagagactggaaaatctcaaattgatatccttatataaaatcctgcctcagctcattagttcagaaagaaatccaaaagttcagttctctgagttgcttcaacacataagtatattagttttatgaaagattttttttttatttcataaaaccttaatacttctgccagaatcagaagtgcattgtg

SEQ ID NO: 40552 - DNA, 1001 bp, Homo sapiens
gagttcttaattacctatgttaattccttacacttgccttttacgactgttattttcatagccgtgatcctggcatccgtagtcctgatagcataatctccttttccattcttctgggtacttattggttagacatgaggttttataagttttaatgggagtggttgaggtgtggtacgaatagtggttgttttgttttacctcttaagaatagttcattatttcttggagactaaagtagttgatagtcgtaaatctgctacaaaattgtaaaggagaaagactttagaatgttgtatgtatagtaaaatgtattattaaatgtagtacagaatatcttattcagattacttttgaataaccagaagatagcctattatactgctagatggatggttgacatgttttttgcattaaaaagtatgatttttacagcatatggaaaagaaggtgtgaaaatgaacttcatagatcggatctttattggtgaattaactagcacggtcatgtgtgaagaatgtgcaaatgtaggtactttagaattcaattcagcatggaatggattacaatcacatcatttttattatattttctttcacatataatcattggcagtcatttttaaaatttgacagatgattacataatgattcttgaaagtctttttatacgctacactcctagaaagtaaatgtgataatttatatatttttaaaagtaaatgtatttttgtgttatttttcctcatgacacacctatgaggcagttttagcctatcttaatatactgaaattcattagctatctgtttgaagtgagagaaaaacttctgtgaagagagtaactgtgctacgttgcagtgccctaaaatgtaattccaggctgggtgcagtggctcatgcctataatcccagtactttgggaggccaaggccggcggatcacttgaggtcaggaattcaagactagcctggccaacatggtgaaaccccatctctactaa

SEQ ID NO: 40553 - DNA, 1027 bp, Homo sapiens
tgcttgctttttgtacactgataaaaatacattaaatccaagagagaacctaaatgtaaaaattctgactcttacttgggaaaatttgacattagagcaatctattcatggaatttgagacctggaagaaattacattttttaaaaaatttggtcattttattttcaaactagggaactgaaatccacagtgtaccttgctgtttgaaagtacttttattaggaggatgaggcctgagttaactattattagaccagaatctattaactttgttttacagcgaatacaagctagcattctaaaagcatttaacaacccaactactaaaactgctgatgatgaaactagaaaaaaagtcaaaggtatgttgactctttgttaaaacttttttctttaagaaaatattaaaattttattttagttggaaaaagaactgaacattatgtgaactaatccaccaaagtagtggctttaaaaggaggacgtagttgctgcagtgtctgaaaaatactttagtggaacatagaaaatgctagaatgtattcatgtgaatttataagaataaagctataccaagtatacagattgacaccgatacctttatgtgaggtcttctaagggaaacttgaaaggttgttgaaagtagcaaccacacttggaagttcatatgtatcatattgtatcatttgacatgtgtttggatcaatggatttatggatattttttagatgtaactagacaaaatgtttaagtgctccaaagactcctgcaaataaaccgtttattgaagagagtgctggtaagtcaagtgtaagtgcactttgcctactcctagtgtttgctattcatccataaaaatatgagccccaaatgatgattacctaatcaaagttggttatttatcattatcaatactatatagggtttatataccttgccctaaatgtatattctgcattgagatactaactaatgttagcatgaagtgatttttagaagacatttaaaaatattatttgtatttttt

SEQ ID NO: 40554 - DNA, 1079 bp, Homo sapiens
ttggccgggcgtgatggctcatgcctgtaattccagcactttgagaggctgaggtgggtggatcatttgaggtcaggagttcgagaccagcctgaccaacatggagaaaccccacctctactaaaaatacaaaaattagccgggcacgatggcaggtgtggccagcaactgtagtcccagccactcaggaggctgaggcaggagaattgcttgaacccaggaggcggaggttgcagtgagctgagattgtgccactgcactccagcctaggtgacagagtgaaactccatctcacaaaaataaaaatgagataataattaaaaataattaagtactgcactctgtcaaaagacctgtagttatgttagtggcacttagcttgttcttcgattttctcaagcataaagtagaacttatattaattataaattcctgaacagtgctgttttgtatatcacatgagatatgttgtaaatatcataaatagttgtaaatgtgtcttctactataatatattctaattattttgtattttgacagaattatttcttcatcttaggtctgaacactttctagatttaatacttgtctgcacttaaggcaaaatgttcattttagcatagagtttactgtaggttactttttaaagttactgaaatcaaccaaatatttcctatgtcagtgtctccatgaatagtacctgatctttctattaagttaatacagaggaaatttaattatcaagtccttaaaaaacatattcacagggagatcaacttatagtcctttatatgaaatagaaacactctcttgctttccttttggttaaggtaggaagataataaatcacagtggcttgggtttgaatactggtttatttgctagctgtatgaccttgcaaatgatttaaacaatactgctgagtcctcatgtgtaagttggagaaaacagtacatcccaacaaagttgttggaggattatgcctgaacatgtgaaaaactactagtattgtgcttaacatatagtagttgcttaataaatgatagccatattctcagtgcacacttaagatcacaccc

SEQ ID NO: 40555 - DNA, 1050 bp, Homo sapiens
tctgaccaacatggtgaaaccccatctctaataaaaatacaaaaattagctgggcgtagtggtgcatgcctgtaatcccagctactgggtggctgaggcaggagagtcacttgaaccctggaggcagaggctgcagtgagctgagattgcacagctgcactccagcctgggaaacagagcgagactctgtctcaaaaataaaaaataaataaagtgtaagttggaccatatcatggccctgcttaaaaaccctctcgtggcatttcattatacctaagataaactgccaaaactttcatttcaactgtaagtctctgtatgaattgtcctctgcttatttctctagacttacctggtggcttcccctttgtattccctcccatgtaatttaaagacaaaagtaactaaataccaactttgttatctgatgtgcaaaattattgagaatattttcataatattttcttaaattttatactttttcaggtgttatgaatgtgatgaaaaattatcaacgcattgtaataagaaggttttggctcagatagttgattttctccagaaacatgcttctaaaacacaaacaagtaagttaagcgatgactaaaggaatctgtgttaaaatacagtatttcatatagagttcataaattcataaagaatactttagattttactgtgacagcccagccaataatttgaataaagatattatgagtatcggctgggtgcagtggctcatgcctgtaatcccagcattttgggaggccaaggtgggtggatcatgaggtcaagggtttgagagcagcctggccaacatggtgaaaccccgtctctactaagaatacaaaaattagccgggtacggtagcacatgcctgtaatcccagctactcgggaggctgagacaggagaatcgcttgaacctgggaggggaggcggaggttgcagtgagccaagaacatgccactgcactccagtctaggcaacagagcaagaccccgtctcaagaaaaaaaaaaaaaaattatgagtatcatgcattcttaggt

SEQ ID NO: 40556 - DNA, 1059 bp, Homo sapiens
tgttcctcttaaaaaacaaacaaaaaaaaagccttctggaaagattcagcggatttgacttcccctcatgttgcattaaccagaattgcatctcatttctttacttacctagtgagggaaatcgctatgattggtctgtgtctcagtagttctcagtaggctggggtgaagttgtgtacgggattgggaaatgtgtgtttgcagaagggcaccactggcctgccaggatgctgggtgttccacagtgtgcacatttttaaatgatagggaaattaactttgcccatgattgttttaggtaaatactgtatattgagcatgttagcctgttggcaagaaattaaatttaatgagaatccatattacttttttgaaactttctcctctggcctgaaattaaaaacaaaacttttcagtataagtgtgagtataatttaagttttgattaatttgaaacaaacatttgtaagtcatacaaaataaaattctgttcatcttcagggatgtggtaaaaactcagaaagccaacattcattgaagcactttaagagttccagaacagagccccattgtattataattaatctgagcacatggattatatggtaagttaaattttgttagttcttgtgtccactaaccacagccccccaatttttttttttctttaagcttttaaggtaaaatatttaaagatgttctatcagcttatggttttttaacctgaacacaatctatgggatacttcaagaaaattaatattacctgtgaatataaaatttaaattggaaaaattttaactatctctctactttttgttgttgttgagacagagtctcactctgtcgccaaggctggagtgcagtggcgtgatctcagctccctgcaatctctgcctcgtgggttgaagcaattctcctgcctcagcctcctgagtagctgggaccacaggcgcatgccgccatgcctgcctaattttatgtattttagtagagacagggtttcaccatgttgcccaggctggtctttgaactcctgagctcaggcaatatgccctcct

SEQ ID NO: 40557 - DNA, 1029 bp, Homo sapiens
aaactggctatcgaaacatcatcccattttagtacatgtatagctttgtataaccaccaccaatcaagatacttgactgtgtcatcaccactctatgtgctgtccatttatagcaacaccctctgccttgcgtccattgctccctacaaccatgaatctcttctcattctataattatgttatttcatgaacattatataaatggaattatatagcatatatcttttgagttattttgtgtgttcaatctctgtgctttttagttaacagcatttaatacttttgaggtttgctcagtaatggtagcactttggtgtagcaaagaaaatgttgagattttgttttatcttattcagtaggtttaacttgccaacatgtaagtcatgctatcagcgtgaatcatgtaaagagagcaatagctgagaatctgtggtcagtttgctcagaatgtttaaaagaaagaagattctatgatgggcagctagtacttacttctgatatttggttgtgcctcaagtgtggcttccaggtaagaaaagtattatttatatgtgagtttgtctgaaatgttttccttaaatgcttattgtgagttggactgttggtcatgcataggagttaagataaatttattccaatttagatagaaattttccaggaatgaacttaaaaatgattgttaaggtaaagtaaaaggtatgctatgttcagaaagtaatcaggtgtggtttataaatacttgcagaggtaattcaacctatttgcagtagttcccatatctggaccagtctttaccttttgtatttacttaggaaatggatctacctttcagattaatttttttctctctcaaaacagattattctgctgcttttgcaaagtaatttaaaatcttaaagtttaaaagttattgatatctgtaataaaggaatttttttaatgaaattaaaagtatatacttttttaaaaaaataagagaaatctttattatttcacacaaaatgtccagaagtaaggccacttcaggat

SEQ ID NO: 40558 - DNA, 1034 bp, Homo sapiens
tacttactccgttgatgaaaactttagttttggtcattcacctggacatcatatatttaggggttgtgtcttggttcagcctggtatagcaaattattatagactgggtggtttaaacaacacagacttatttctcacaatactgggagctgggaagtacagggtcaagatgctggcaaatctagtatctggtgagggccttcttcctggtttatagatggccatcttctcgtatatcctcatgtggatacaaaggtagctttctagcctcttattataagaggccagtctcattcatgagggctccacctacatgacctaattacctctcaaaggcttcacctccaagtatcatcactttggggattagagttcaacatatcaatttggagtggggacacaaacatttagtccataatggtatagttggcaaaagccaatggaatataccatgtgtatactgatttaacaaagatttatttcatttcaagtgatgttcccctcttcttcctctgttgatttcccggaccagttgaaattgaagtcatttcagttttaatacacattaaataaaatataaaattttaattttgaagactaaaatgtatgaatttttttccctcaatcccttcagtaaataacagatgcgggtgaaagatccaactaaagctttacctgagaaagccaaaagaagtaaaaggcctactgtacctcatgatgaagactcttcagatgatattgctggtaaattgtgatatatggcatcccaaatagtgttgagaagaaataacaatgcagttgacccttcaacaacatgggtttgaacgctgaggatcaacttgtacacaaatttttttccaccaaacctagatggaaaatacactattcttgggatgcgtgaaaactgcatacttggcaggctgacttctaaatgcagattccacggggcccactgcgggacttgagtatgcacagatttgggtatatgtggggaggtcctagaaccaactaccccaccccacctccctgcctca

SEQ ID NO: 40559 - DNA, 1050 bp, Homo sapiens
ctagttgataaagttattacccatgggtgtacaagttaacaattctgataatgctatacatgtatatgggaattaaacaattacgtaaatcaatagcaaatgtttgagagccgggtttctcattgttggagcgggaatttacagataagcaaagggctggaaacagcatgaactcgtgtaccttaatacaatatagatggttagttacatatagaaatatttatagataagtgtatatacatgggttagtgtgtgtatttcttggctttctcagctgaaagggtctataagcaatgacatcccagtagcaatgagctcacctagtacccatatcttggtttctaatatcattctccaataaaaggtaccagggctccttggagaaatggttgattctaggactggggcaagaaatacacaagatggacctggaccatctcttaatgccagtaataaagaagtattcaaaacaaacaagaaaaacaaaaacgtctattgatgaggatatgtcaaaaggatataggagctaactaagagagctcccactgaccaaagctgaaagaatttgagcatcaaaattttaaaaatagcattggataataactcaaagtataaactaaatatccatgagtccatactgatataaataaatgagggagaagagacatgtcttccatgctgaagaattccaaataatatatgtaactattctgccctcaagtagagggagcataactccccactcctaaggtgctggctatacatgttaacttcctgctagtgtgtacatatggaaagggaggaaaaaggtaactttacagtggggaaacctgagaaatactgccttagccaggcgatcaaggtcagtagcaacagtgataaatcacattaatatcatgtatcattgatgtgatatgatgaagatggtactttatctcggtggtcttcctgtcaaaaacccattttctctagtctaatgagaaaaacatcagacaaattccagtagaggggcatttgacaaaatacttgactggtactcctaaaaactgt

SEQ ID NO: 40560 - DNA, 1056 bp, Homo sapiens
tacagaattaggccccactcttatgtcctcatttaatcttttttttttctttcttttttttttttttttttttgagacagagtctcgctctgtcgcccaggctggagtgctcacttcaacttccgcctcctgggttcaagtgattctcctgcctcagcctcctgagtacctgggactacaggcatgtgccaccatgcccagctcatttttgtattttttagtagagacggggtttcaccatgttggccagactagtctcaaactcctgatctcgtgatccgctagcctcggcctcccaacgtgctgggattataggtgtgagccaccatgtctggcctgtcctcatttaatcttatccctttaaagaccctctctccaaatacagtcacattctgaggtactaggagttagggcttcaacatacgaattttggagggggacatatattggtccacaatacttggtaaactttaggggctatcatcatcatcatcatcttcaatgacaacaacatcattatcactggaaaacactgtgccaatgcagtggcattggtaccaaggtaaaatacaaggaatttaaggacaaaaaaagaagacagaaacataaaaatattaatacagaaggaaataaatagtataagagagttacagagaatgctgtgaatgttttgggtgggaaaagattgtttcatgaatccagaaaggattaagtagaacttggtgaaggaagttgaactggggaaatgcaagagatagacagtctaagaacactgaatagtttagtcaaatagggaaagctcatgagttagattaactgaatggtgagtaaggaaatagtggggaaaactccttacctaatttcagctaatagagggccttcgatgctaaatgaaggaatctgcactttgttctattgacagtaatgaaagttagttatttgagatggagtctcgctcagccgcccaggctggagtgcagtggcacgatcttggctcactgcaacctctgcctcccaggttcaagcgattctcctgcctcatcctccctggtagct

SEQ ID NO: 40561 - DNA, 1045 bp, Homo sapiens
tagtgtgtacgcatttacattcctcatacattattttcttttgtattttcgtgcttcaaatgtggacttgaatagtcggtaggctcatttggtcatagcagtgtttctcaatgagggcactattgatatgttggagagggccagtctttgttttatggacagtcacacatatctcaaatgtttaacctttctgggcattaaatgccagtaacttcccctttcccccatcattatgacaacccacaatgatgaccccgtgagtgaaggatgaagcaatatgtagaatgcactgggattttcaccttgggataattacatggctttataaacacgtcgaaatggacaccatagctaaagctttgattgttgctaatgcttccctttgttcatttcaaagtaaactggttaaggagagctcattccgtccatcccaagcttgggtccagaccggtctttggaatcctccctatttcattaaaagtcagtgacattaggattgatctgaaggccccaatactactactcttgtctttagaatgagacatgtgctagacaatattgtttccattaataaaccttcctgtcagataccactcagaagctgagtaattttaatctgtttctattcttgctttctatttttctgattttactttgagtatctctagtttggtagactggtaatggaaacccagagcaaagggcaatcacttgccaaagaatagagttaagtgaaaatcctggcttaacctacaggatctggaagaaaatattagaaataaaacaagaagaaaagataaaaggaaagcaacgaatagtgtgatccaggctttctctgctgcattaagcagtttacagctttcatatattcctacttgtttctcttctctctttttatattgacttcagactgttttgagaataatttgatttatggaatatactttggatgcactactcctccatattttatctctttccttggctccaaacaggttgttattaaaattataaatattgtctaaaaaaattttttttgagacag

SEQ ID NO: 40562 - DNA, 1026 bp, Homo sapiens
gccatttgaccctatcttccatctcagttacccatgtttgtttatgggctcagccctagttccagggctcagttctcatgataactagtctctttctagattacattcttattcttcttctaatagtttatatacattttttgttctacatctttaatagtgttatgcttatgaaagatagattttctccacaataaagggaaagtatcttaaactattttctgtttgtttggcttggtttttgatattctggacataaaaggccttgtgagggtcatgttccttcataatgcttcttgactcttgttccctcctcactgtctttgtctggttccaggctctctggaagaggacatcacatttagagaacttcatctgcctctttattgttcttttggtctctgatcattcctgccaggataagattcctgaaatatgatattcattatgccttactttatctgcttaaatacctacagagccacctcattggttagagtatgacatccaatcttgacagtctggcccattgcctgcctcactctacccactccagtccacctgccaagcctgcccccatgtcagcactccactttagctagagtctgtttactctgcctgaggataacttgcttctcaaatcctatccacccatcaaagcacagctgcagctttgtctctcatccttacagattcctggatatatgtcataatttatgttcagcatgtcacaattccatagtgtagtgtggtttggatctggggaagagttagtgtcaaaaaagaaatcaggcagcgggtggagcaactgtgctaaatcaaatgggaagcctctgcttctggcttaatggaagtgatgctgcaatttgtgattccgctccccagcttaaaagaagagaggaggagaatggctgaatctactatcaaaacgtatctagggaaatttgttttaacaaaatctatagaataaaatattattaaaactaaagagtaaatttaaagagagcaatgcctcatttggcagta

SEQ ID NO: 40563 - DNA, 1047 bp, Homo sapiens
ctttcttctagaaatgttctatgaaatgcacatgcacacacatatgtccacataagatttatcttgaagtttgtgtatttgttattgtggttaatgcttatataaactagtccttagaatttcaaccatacgtctcatttgaaattgcacagtcgtaaattaagtttacttaacatttatgcacctagttaaagttattctttaattgtgtttagataatcatggtgctaaatcaatcattgatgagttcctactgcatgggttgttgataacctagagatcagaaatggaacatgctatcctgggtggtatagacagacaagtgagcaggcatttacagtgaattgtcataggctgagagtttcctctggggcacactggaaaagcatgttgtccagggcaaactcatcaccgtttctgttggaagaagcaacttagaagtcctccatcttggattctaaattctcaaaattttttttaaattagcttctcaaaaatcttatctggtccaaattgtttgtatactgttaaggaataattcacttttaattttcatgcatcattgctattatgtgtttttgacttaacagatgctagctgaatacctgcattaaaaagatacttctctggccatcaaaatagttgggagttaggggttggattaaaaagtgctagactataaggaagtggtaaaagaaatatccttaagtttcgcagtacagatgaagtcataaattatatactagaataactattgtctaggagatggtgtatacaaaggacattgctggtggtgtaagcaatatggactctggcctagctgaggaaagtgttgtgaaagacctagcgtcgagggtagaactcaggtatatgggcataagggagaggagaggggacttcaggaagcctaagattatgaggaaatgcaggaataaattgttaatgtgattgggtctggaggtggagtggaggagggttggtgtcatttaatgagagcaaagaagaagtggtatgtttggaaacatagattggtaccaactatatgct

SEQ ID NO: 40564 - DNA, 1074 bp, Homo sapiens
cactgtttgggtcactcctgaaaaatgagctcacaggtgtggttagactgctttctggctagatagtaggtagggaggagagacagtgggaggagttgggcaccttgggaggggtgtgtgtgtgtctgtgtgtgtgtgtgtgatgtgtatggtaagggagttcatgactggcagcaaggtaactggctacagattaaggagttcaactttaactctctcaaggacgttacccagggtgggccctgtttatctcattgcctcagggagagggagcagttgtgttgatttttgtcctgttggaatgatgttttgtcctgctgcagatgggatttttcaaaattttggggtttgagttctgataggattatgaatctcagtgaatttttaaattaaagaattctagattcaaaatagtctttgcagatgtattacattttgaaatatgttgtcaattattttggatgtttataattttttttgcttcttttttcttttataagaggtaattctcaggtattgttcctctgtctgggagagactgggaggtggttgttagctctaagctgaaagaggcgtggcacattgttttgttcattgcatgcttaggaaggctgaggagtaagacagactcacatctgaagggcggctgctttgtgtgagaggccagagaagctaagtgactcagccaatacaacatagctagtgagtggtccagcgagcataccaacccagggtctggactccagcatccacctgctttcctctttggcatgctttctttaagtggataatgctgttttagggtgaaccatatgaaattgtcacttctatacattaaaacagttcaatattggcaatttcatatgattccacctaatacttacatagtcatttatgacattttgccaatattttgcatggtctatggacagtttactctcttttttaatatggggtctccacaaagtgactcagtttcttcagagtttgggtatacttgggacctgctcaattgccagtcgatatcctgagcccatctcttcttcactaattttagcatcaacagtcatgatg

SEQ ID NO: 40565 - DNA, 1050 bp, Homo sapiens
ctttgaaaagagtaggatatattcgaaatcatcatgttgcttccctttctttttatacccctgaaatacctggaaggtaagaagaatcctactaccaaagttctctttttttttttttttgaggcggagtctcgctctgtcgcccaggctggagtgcagtggcgcgatctctgctcactgcaagctccgcctcccgggttcacgccattctcctgcctcagcctcccgagtagctgggactacaggcgcccgccactgcgcccggctaattttttgtatttttagtagagacggggtttcaccgtggtctccatctcctgacctcgtgatccgcccgcctcggcctcccaaagtgctgggattacaggcgtgagccaccgcacccagcctcctactaccaaagttctgaaagaattaaatatgattgtgattacaaaagtggttttacatttttcttctatttttatattttaggtatatctacacattatatttcatgagtgactgctaccttggcctggaccagcagtatgacatctatctcaacgttacacaagcgagtctttctgcacaggtcaacaccaaggtctctgattccctgactgacctggcattaaagtaacttgacctgaacaatccatttgaaaggagtggctaagaattctctctgttcagtcatctagacaaatcgaattacttgatgtttgccttgaaagaatcaacttctaacctcaaccatccaggaaattgacagtggctgcagtattgactccagtgacataaagttaaccacagtggccttttaacaaatgttgccttttataatgttatctttatgagtttcttgatatgtaagatgaaaaagcatttagaataatcttttaatttgtgtatatttgggatgatatttaggagctatcaatcaaattttacatctcacaatgtactgtttacatggatattggctgctttttttaaggaaaaccacattgagatgtgacaagtgttaggacttgtcacagatttctaactctgccgcataaactataa

SEQ ID NO: 40566 - DNA, 1029 bp, Homo sapiens
tctttaggctgttctttggagaaaataaatttttggcaagaaaaactatctccttaccattattgattttaaatttgaaagactacatgagattcactctttaaattcagctgctaatgttcttaatacagtgaattatatgagtatttgctctcatagtaagtatactgagtttttatctttgttttaatgctagctaccaattttatgtagctagccctgctgccctaacaaaactgattatttggccctttttaggaagtaatgtacagtaaatgctatgatcagatttgttccctgcaatccaactgtgatttattttctggtttctatgttgatgaatagtaatttagagatacaatgcttggtttctttgttttttgttaaagctaacatcagaatcccagtggagggggcaagtaccatgatataattcttgtaacatgtgcattttccctgttcaggcaatgctggacgtggctgcaaaccagggctggctggtgactgtcctgaatatcaccaacctgattcagatggtgatccagggtcggtggttaaaggactcttctcttcttacactaccaaacatagaaaaccatcatcttcaccttttcaagtaattgttttacttttcaatgtaattgttttgttttgatttcaaaaaaatattttttatatatgtagtcactgaaattttatgttatggagaatactgattattgacatggaaaatactcctgtttcccagagtgagacatggccaagtgacgtaacattcttgtttggaatttgatcatcagtcccaagctgaactacagtttaaacttctcctatctaaatcattttccatttgaagcattggaaacatttttatgttaatgtgtttattcttttataatatcaatcttcatttaagaagatatcattaaaatgctttgtgatctaaagcaaaataaatgatcaatgtctgttatcgttgaggagatttgagatatctgaaatccattgtcaaaagtaaattgtgcatct

SEQ ID NO: 40567 - DNA, 1031 bp, Homo sapiens
gaattaaatacataataattttgtctggagttcacatttttctgctgtgtgggaaacaaggtcagatgtaagccacctcagattctttttgaagcaagacagaatatgcagaaatcagcacacgtaatagaatacagtgtaatgagcacatatatgaaactggaaaaccaaaatcaagccttaacttcatcatttgtttaccatagtcactaaacttctttaagcttaagttcccctttctgtgaaggggggtaatattaatgcctgcctcatagttagtattgttaaatattagatgagagctgttactgaaagtgttgtataatctgtgcaataatatacaaatatttttatcacaccatattgcatactctctacactgtctgactttatataattcactgttcagagctttttacaataaattcatgggatttacttaatatgaaatgtagaagatacgttgtcaagcttaaaatgttagctttttaaagtataatctgcaactgtggaagataagaagaaaagtgtctataggtttggataaaactgttctttgcagaaatacttacaccactgtaaaaatgtggttgaatttaaatgctaagaccaagcctgttatgcgtaggaaattcttaaaattgattcgaaatagatgttgaggacatgtggtgtatccaagtcataagggatacctttggcttcaggaaccccacacctttaaaaatttccttacagagactgcccattttctaaactctagaggagaccagcggaagcccctcttttctatgagttcttgcccacatactctggaagcagataatttatcttcctctgaccccagaagggtcttttctctgtatagcttatttcctgcttagtatatgctacccctaacctcaaggatattacagtccacctggaaaaatagaaagtaagctctgtaaaaacaaatagctatatagtatgagtatgttggcattttattgttgaaaaattaaagcttacagaagatagaagccattaaa

SEQ ID NO: 40568 - DNA, 1032 bp, Homo sapiens
ttaaaaacaatgctaactatatatatttgataatatatagaaaaaagttatatcacacttagtttttaatagataatgatccaataatatctgaagaaataaagataaaaatataaggcattttttttatccgttgatatatctggacctagtgtggtaaacgccagattgtttttcaaatattattataaaatacagaatacccaattaatttaatacttcagaaattaaacaggattcctatcagggaaatttactgaaatgttttttctaaagcttcagtggccaaaagacagcagtggaatgtgagaaactaattttggtttgttttaacgcctcagaatgttacaaattaatcaagtgctacttaaagtctagaactcattaactttataagttttacttttcccatgacagagattaagttatagcataaagcttctttagtctcacatcgagcaggctgccatccccactgtacaagtgccctcttatctgtgatttagtgagttcagtgtaggcagcgatgtgtgcagtgacataaaagtactagtttactgttgcgtaatgtttatgtgcaaccaggtacaaatccattctggtcgtgtctttcctctattcccagtaatctgcttaggtaaagcagacactaatagttactgtacctggaagaaaaaatatatatgtatgtttaaaaatacacacacactcaaccaacattcatttgttcacatgctttcagtaaagaaaaagtcaaagtagattttaagtatttaatcatttgtttcttattttaacaaatctaaaaggtaaagttacagtcaatgttgttaagggtcacagtacatgtaagatttacatatcaaataaaactaccagagctttaactaaacccaagtgccagctaattgctgaaaggcatatctcatatttagctgtacagattttgccatattattcttaggagaacaagcaagtgagttatgtgacataagggtgtgagtaaaccattatgtaatagtgtatatcccc

SEQ ID NO: 40569 - DNA, 1018 bp, Homo sapiens
ctcaaatcagtgacctaaccctccaccttaaaaaagctggaaaaagaagagcaatcacaacggagcatgtaacaaaaataaatgttgagataaatgaaatagagaatataaaaagagtagaataagtcaacaaaacttagtctgcttctgctcgctcagtagatattcccatgtcgctgttcctctgtgaacatactcaacatgtctaaaatcttgtgttcatcatgcccagaagactgaggagtcctaccattgttctatgtgagctgcattcacagtctttaatacttccaagatgaatttttgggggtaatctttggctcctccctctctgctccccaatttcacatattaaaccagctgccttttattcagtcctttctttattattttttttctcaaatttctcccttaaaaaaaaatgttcactctttagctcctatttgggttctcatcaccctattcctaaacaattgtgctgacagtctcctgagtgatcttccaactttagtttctctgacatacttaatgtacccaacacagtcttgccaattaatctgttttaaaccaccgtttgcatcatttctcccctccacagtctacaattatatacataataaagaattatttcgttagcctggctgtcaaggtcctccacagtcttagttttctacctacaccttccattagactgttataaattacttcttcccctttctcctgattaacattcttactcccacctttaatcatgttgtgtacatatttcgcttcataaatttgcttatgattcccacctggacaatgtatctgacattcatccatccacatggtatggcatcctcttaacatttccttaatttagcctcagtgattattaccttttctaaatttgtagcaccagcgttcatttcatttatttggcaattgtgcctgtattatggtatttcttatatattggcctgttttgatatttcatttttagatttatttaactttttgtgtatgtatttcttaa

SEQ ID NO: 40570 - DNA, 1200 bp, Homo sapiens
caaggaggcctgcctgcctctgtaggccccacctctggggacagggcacagacaaacaaaaagatagcagtaacgtctgcagacttaaatgtccctggctgacagctttgaagagagcagtggttctcccagcacgcagctggagatctgagaacgggcagactgcctcctcaagtgggtccctgacccctgacccccgagcagcctaactgggaggcaccccccagtaggagcagactgacaactcacatggccgagtactcctctgagacaaaacttccagaagaaagatcagacagcagcattcgcggttcacgaaaaactgctgttctgcagacaccgctgctgatacccaggcaaacagggtctggagtggacctctagcaaactccaacagacctgcagctgagggtcctgtctgttagaaggaaaactaacaaacagaaaggacatccataccaaaaacctatctgtacatcaccatcatcaaagaccaaaagtagataaaaccacaaagatggggaaaaaacagaacagaaaatctggaaactctaaaaagcagagcacctctcctcctccaaaggaacacagttcctcaccagcaacggaacaaagctggagggagaatgactttgatgatttgagagaagaagtcttcagacgatcaaactattctgagctacaggaggaaattcaaaccaaaggcaaagaaactgaaaactttgaaaaaaatttagacgaatgtataactagaataaccaatacagagaagtgcttaaaggagctgatggagctgaaagccaaggctcgagaactacgtgaagaatgcagaagcctcaggagccgatgtgatcaactggaagaaagggtatcagcgatggaagatgaaattaatgaaatgaagcgagaagggaagtttagagaaaaaagaataaaaagaaacgaacaaagcctccaagaaatatgggactatgtgaaaagaccaaatctgcgtctgattggtgtacctgaaaatgacggggagaatggaaccaatttggaaaacactctgcaggatattatccaggagaacttccccaatctagcaaggcaggccaacattcagattcaggaaatacagagaacaccacaaagatactcctcgagaagagcaactccaagacacataagtgtcagattcaccaaagttgaaatgaagga

SEQ ID NO: 40571 - DNA, 1050 bp, Homo sapiens
caagtcatacacatatgcacacatgcacataattaggtggaaagcactgaggtgggagatacaaagtaatttaaaactagatacatgctgtaaaggaagtttgtgaaaatcatatgcctactacattctgtacccctgtttactccactaaaaaagccaaaaaaaaccttaaaatcccaggggaattaaacgtttgttttagtcttctctttgaaaaggtattgatcacaaaaggtctgttcccatcctgtcagcagcatgtttctttctggcattacactatataaaaccagttatgccggtatatttttgttaattaaagtcagttctccagttaataactaaataaatggaaccatctgaaaatatgtgtaaggaaagctgtataacggaatatttatatagatatggtttggtctaccccataaaaatttccacagcaagaatatcttcttctcccatggtgtttagtccaaggaactttcagcttgcgctagatattgtctcagtctgtattatctcaatgagggttcattctgaatgaagaaccataggactcacattgacaaggagatacgtaggtatcacactgttttcttaatttcttgcctaggaattattctttgttcactattgaacactatgtgtagctaccagcaaaatgctaaataatacagcaagattgtataattgtggtgtaatttccagaaatccttcttcttcttaagtttctttaaatgacttttttttttttttaccatgaaaagactaccaaatgactcaaagaactcagtatcctccctactcttgcctccaaaaatgcatattaatctcattgtggttttaaactaaggagaaagtgtagtcagacagaagctgtagggtgcaggatgataatagcataagaagatgaggaaagctgtggggataacattagtgtttcaaagatctgtttccattatcattgcttttgttattataatacttaagaaagtcatattatgtttttgtacaattcactcatataacattcattgttaatgcttcctt

SEQ ID NO: 40572 - DNA, 1050 bp, Homo sapiens
tgttttatgacaccagaacaacttggataccaaaacctgataaaaaatttacgagaagggaatataacaaacgtctctcattaatatagatgtagaaattctaaacaaacaatagttaatcaaatcaagcaatgtataaaaagataatatattactaccacatgcagcttattctataaatgcaaagatgattatttgaaaaatgaatggatataattcaccacatgaacaaaaatgagaaaaatcatataatcatttcatagatgtaaaaaaaattgatgaaattccatacctatttataataaaactgttagcaagcaggagtatgagggaatgttcttaatctgataaagaatatctacaaaaaatctatatcaaacatcataatttataagaagatattgaaagctttccctttgagataggaaatgatagagggattttgctgtcacttcttccagtaagcattgagctacaggcccaaaccactgcagtaaggtaacaaaaagaaatggaagtccaaatattcttttgagaagaaagggactagaaaagcacaacaggagggcttctgggacactttcaatgcttgatgttgatgttgattacacaactgtgttcacattgtaataattaattgtgttgtacctatataatttatgtaattttttctgtgtatacttcgataaaaagttaactaaatttttttttggttttgtaccttgatatgaccgttattattttatgtattacatagtatttcataatttatttattcatttctctattaatgtgcacctagagaatttccagttttctcctcttatgtataacgttgcagtgaaagattttctttcctattctcacatgtaaatgtttctctagcagatcataatgaaaaagtgaaattgctggttcatagtgattgttcagatagatattacaaatttgatctcaaaattgactggaccaatttgtagtctgcagctggtgacctgagagtaacatagcaacttttttaaaaattcaacttattataactattttctc

SEQ ID NO: 40573 - DNA, 1247 bp, Homo sapiens
tttccatattcctgcttaacagttcataaagtaaataatacaagaatactaggtggccaaacagaatgaactatttatacatgagctatttagacattgtattcagttcagtgaaagttgataaataacatttcttatgtgtatgtcattaaaatatcacctagtttgtacagtgcttttttaataccttagtaattattataaagctaaactttattgtcctattttatggattattataagtataaaacagcttgcttccacattaaaaaaaaacttagaaaatttttctgactagtgaaaataaaatgaacaagaaagcagttggaatgtttcattatgtggatattttcatacatttttactaaactgcagcagcagcaatagtttctcaagctgaggattttgtgatctacttattgatttatgcacagacaagctactaagtatattgcaagcatgcttatatatattagaggttgctaatagaaaaaaggaaataagatctgaagaaattgtcacttttttatacttctatctcaggcatataaaagttatgcatttactatttccaagttacttctcccctgttgcttactgctggaatgtggtggtgaaactttagagatgtatccttcttttcagtgctcatgtcttctcaaatcacttggtcttaacattattctcctcatggagtttcccggaaagaacttccttatgctgtgccttatgttatcctctgcttcaaggacagagaactatctgaaacaaagaaactggactttctttttttcttctttttttgtgagacagaatctagctctgttgcccaggctggaatgcactggcatgatctaaacttactgcaacctctgcatcccgggttcaggcgattctcctgtctcacctcctgagtagctggggttacaggcatgcaccaccatgcccagctaatttttgtatttttagtagagacgaggtttctccatgttggccaggctagtctcgatttcctgacctcaaaccttacatgatccacccaccttggcctcccaaagtgctgggattacaggtttgagccaccacacccagccacaactatttagttctttacaacaaattttgtaagaaaataagatttgctttttcttcccataaaatttgtgttactttaagtattttccatgttgaatggaaagtgatagaatattcagagagcgtttctacaacatgagtttcaaaaacca

SEQ ID NO: 40574 - DNA, 1058 bp, Homo sapiens
tgggtataccagatatttaagaaaataatttatgttcaaagtaatgttgataaaagatttttttatcctgtattatttaattgatatctgaataatcatcctgttgtgtctaaggtagtatcataacttaggaggcaaatgatgaaaaatagatatacaaaatattgatgactcagtttatgtgtggtatctctctaggcttaattttattttatatgttatcctaaaagtcttccaaatggacacttttctttgaagtcaagatacaatgtacaaacctaccaaacacactttgggatgtttgcttaaagtatatagacattgtgcattatcacagtgtacacttccactgtgtttctttttgttgttgttgttaattttaatatatgagacctaaagaattgtagttagctcagactttgtgtagaattccttctctgtttcatattttttttatcggcagaaaactttatccacaaggctaggtagaaactatagaatatactctcgtggtttctgctgttgtagatttttcactgctaaaataggatacctagaatatttattttattataaatttattattgtatttattaacaaatatttgttataattgtattatttttatatttttttcttcaacttttattttaagttctggggtatataaacaggatgtgcaggtttgttacataggtgtattagtctgttttcatactgctataaagaactacccaagactgggtaatttataaaggaaagaggtttaattgactcacagttcagcatggctggggaggtttcaggaaacttaccatcatggtggaaggggaaggggaagcaagacccctacctcacaaggtggcaggtagtggaagtgctgagcaaaaggggaagagcccggtataaaacgatcagatcttgtgagaactctctctatcatgacaacagcatcggggaaacggcccccatgattcaattacctccacctggtctctcccgtaacatgtggggattatggggattacagttaacgatgagatttgggttagggtcac

SEQ ID NO: 40575 - DNA, 1022 bp, Homo sapiens
tatcactgataacaaaaataaaagaaactttttgtggtctttctagacattttccgtcacttgacaggacttgattttctcaccagaccccaggaccagttaactctgtaatatcactgcttaggcaaacacaaatagctgagaaacacaacttagtacagaaaactcaatctaagatttagtgtccatgtatagctcttaatggagagtctcagtctttaagtttctccttccttggcaactcagaatagaacttggacccagcataattaaatcttttctctcctaggcaatatactctctaggtagggccatcaacctttcttttcctattatctgtctaatatgctgccagatccatgtagtacctgcaataatgccacatttcatgcctaaattgtttacatcattagttttcatgtatccatttgatatcctaatgaaattcatattctggggttaagtatctttccattttatttcccacaacttttcaacagcaattagaagccattctccagccaaacctgttttgatatttgtctcatcaagacgtcaaactcgtcttactgctttggaattgatcgccttcctggctactgaagaagatccaaagcagtggttaaacatggatgaaagagaggtaagcaacatattttatcttctactacttacacgtttcaggttgtattatattagaatgatcattacatatgtaattgtattatagggaaagaagaaattcataataccgccaccttaccacactattaatattctgttatagtttgttctactatagtcccacttaatatttattttgtatattcatatttataattttttcctttaacgttatcacctgtgtatattgtaacattcaatcattttcatattctttaagtattcactgcccttactgaagttaaaatcaattttgcaaaatttgggttttaaaaaatatataataatctttttttaattttaggaagcactaatatataaaaatttaaaacctgtta

SEQ ID NO: 40576 - DNA, 1045 bp, Homo sapiens
ctttggtagttctagctttagctttttttttgtttttttttttgtttttgttttttgaggaagctacaaactcttccttttgtggttgctgcaatgaccaacacaggcttgttaaatgattaacattgatttttccctattttctaggggaggaaagaggccctgttctagaggtcattgtatctcgaacaaattttatctcatcacacacagaaaagcctgttagaatagttggactatctactgcattagctaatgccagagaccttgctgattggctcaatattaagcaggtatgtagaagattgataaattatgcatttatttagtagtgttactttgatgattccttttaagagatattataaccttataaaattcaatataaaaattgaaaatggtttctctctcatatttactctagatgggcttgtttaacttccgaccatcagtacgcccagttccactggaagttcacattcaaggctttccaggtcaacattactgtcctcgtatggctagtatgaacaagcctgcatttcagggtaagcttcagattcttggaataaaatagtaaccattgtttatggtagctatcaaatatcttctaattggtgttggtttctttgaaaggatgatactggtccagcttctacgtatatctaaaactgtttgtctcaactgttaaggaatacaaatatatgttaaattacctagtgaagattggagcgatttcacaaatggtaatgactttgtagttgaataaaagtatgtaattaaaaaaagttatcagagttttcttaatattaatcaaagtgtttttatgatagtagcttggacagatgagaaatggaagctacaggtcaaaaacatctcataatcatttttatgagaaatcataaaacttagaaatttcagtactttagtacagtgcttctgtttttagtttttcctcttctaacaaattaggcaaacaggaaagatttaagaatagcactcctattttattgaaacatgttttatttgggctgcataaagaatattt

SEQ ID NO: 40577 - DNA, 1025 bp, Homo sapiens
gtgtgtgtgtgtgtgtgtgtgtgtgacttttgtgttaagatttacatagcagaccctggaagcctaggtaacatcttaactggtaaagaaaataaacattcttaaaatttagagtatatgtatagaacattaaaatcaggtttgactgtttttgtgacattttaaattattgctttggtattcaacactttgctagttcagtattctttcatacctttaaagttgactcaaacaatacttgaaagtaggtaggatataaatattaagtaaatgaatactttgaaatatttgtaatcaaatactacttattttgtacaaagtcctatattaggtacttcttaaagagcttatacaaatttcatttaacattccattcatattattgataagtctttttagagaatgaaaaacacacttactatttcattttctctattaagaagtgtatattccaaaaggggagaaaaagacatgaaaacacagtgcaataatgttggaaagacagttctgtagaaggattcagcagaaggagaaaataggtttctcccaggctatcaggaaagtcttggttcatgaatgtggtaaaatttgatccagtgagagtatctttattttatgagaaaattgggacttttaggtgaagtgagttagagtaacagcttgtctagtgcagaagatctgtgttggagagtattcactgccagaattgggacagtcattcaaagaatggataagttttagaagataacggttagagagaaaagcatgaaaggcctcattttctattagcaaaattacaagaacatttttgaaaactgagaaataaaatttgaatccaaaggaaatattatgatagctcaatttcagtcttactggctactgtaattgtgtggcttaaataactacgtgttgggttaacagtgtctaatgtacagaacaaagtctcttaatataaaatgatagtggcagtgaactgaggacctgctgtataccagagactctgctcagtgcttcacgtacattat

SEQ ID NO: 40578 - DNA, 1632 bp, Homo sapiens
gtcgtggaaagaagttctgcatgctttcactgggggaaaggaatataatgccttaattgtgctgatggattatcttagcagttgcccattccgtttgagttttactgactataaagccctgtgtggaaagttcacttgtgaaaactggaaagattaagtcagaggaaaccaaacttagacagttctgaaactacataccttacttcctttaccttttcacagctggtattcttttgtgctggatttccatgtgtagaacactttatccagtgagtatagtattggatctcaaatggcttctgtggagaatccaaatcgtctgttcacaaaatgtgaacaagataaagtatatctctgtagttattcagacagtagcaaaacctgggctccgtgtagtgctagctttggagaaccgagtagaaaaagcagtgatttttctgatgctttagaaagcagcaggcatcttatagtaaacaagtttagctccataatttatggtcttaaccatctctttgtccttcatttctccaaataaaacttcttttaaaaagcttcttacatttcttttgaggaaagatttgtacaacaaccattgtgtgtttgcctgtgtgcatgggtatatgttttaatacaaaaaagttgcatcatgttatatacacctttttgtctttttctttttcatttagtaatataacaaggaggtctttccaaatcaactcagaaagatgggtttcattctttttgcaactgtataatatgtcacaatgtggatattacagtaattcatatatggaatcctatattgatggatacttttgttgtttccagttaccttttattgttaacaatgctgcagtacacattttcgctcctactcttgcaatgatatacattagaaaaattcgtagcagtgaaatttatctgtcatgtactacatgcatttaaaattttgatgagtggccctaaactgcctactggagatattgttccaatttatacttcctccagcagttgttacagatggccctccatgtccatgggttccatgaattcagccaactgcggattaaaagaatttgggggggaaaaaaagttggttgtatctgttctgaacatgcacagatgacttttctgcagattaaaagaatttggggggggggaagatggttgtatctgttctgaacatgcacagatgaattttccttgtcattattccctaaacaatacagtataactacttatataacacttacattgtattaggtattataagtaatctagagatgatttaaagtatacaggcagacagtgtaaattatatgcaaatatcacaccattttatataagggacttaagcatccatggtttgtggtgtctacaggggaagagaaggtgtttgttgaatcaatcccccatggataccatgggaagactgtgctttacccccacataactttgccagcactgggtagtgttaacgtttttaagtttataacagattaacaggcaaaaaatggtacttcattattattttgattggcatttctttaattatgagtgaaactgagcattttttacattggctatttgtatttcctattctttaaattgttcataatcttggcccgttgt

SEQ ID NO: 40579 - DNA, 1938 bp, Homo sapiens
taatatgaaggaaaacattacttaaaatttaaacaattatcatcctattcaacaacacctattttttgtgtagaaggaatagttttaggaaaatatttacaggccttttgacatttttaataaaagagaacaagataaaatcatgttactatgtcaaccttagtctttaatgtattactgtcacttcttgtctaaaaacaatttcattagtaaaatagagccatttttaccttgtactattataggtaaaatattcacctaaaaatatccaaagtgactgttaccataatacaacagttaatgtcctgtaactgcattgcatgaatgttaggtgtctttagaattctagggagtcattttagacttgtacacaaagggagagtttatgatatacaattctgcatattttaagcttcataattgtttcaagtgctgcttttcagaaatatttgctgcttgtttttttcagttatgtttcaatataatttgattatgtagttcatttttaacatatcagtaggatagatgtagaccttcttttatagctttagaatgttttcagctttataatttaaaagataagcagatgattatcacagagagatataaagagaagacagttgtttcacatgcttgtcagccaccttaaaccttattttctttcagttgcatcatacaaattgttaaatcacctaaagctaattaaatccaaagtatatttcactacagtacgttaccatcataatcatgaaaggaatgggagaatgatgtgagtgttatgtctaatttggaataatggctttggccagaaatgaatccaaagtacactgaaaaagttattgggagttttgtcttttgtagagggtggggattgtttttaaattattcatgaggagtaaattatcctatgatcatctcatcctacttagccgttataggtcataagagttccagtattttaaaatgtttacattaatgaaacaaaaaatccaaatcattgtcattttagatgtacatgatgcttttcatcctcttctaaactcttactaatacatgttaagtggagagataataggctgggtcacatgcctactcctttgggttagccaccttacctttttggttagaagctttctcatcattaataaggaatatgagacccttttaaatttttttaaattgatacatagtagatttacatattttctgggcatatgtgggcataatacattcataattatatgaatacattgataattatatgcatgtattaacttacatgaaaatcttcggtcaaatctatttgactgaatatcaaattagtttaattgggatatccataaccttaaatacttagagaccctttcttaattcataaattttatattagatttccaattaatctgaaaaatgtttctgtagaagcattctgaatagcaacctctctcaatatacattacagaaatagtgtgttaccttatgttttagctctgtgtgccatttgacacttgatccgtagtgttctcgcaacatttagaatcatacaggaaaggtgtgctctatggtttatataatgaaatatatggaaaatagcctggagaatgggcttctcagaaaagcagagagaactttaaaaattattctaaaatatttgtaactaacaagaatatccttaaagatactgtattttaaaaacttggtgggtttagaaagttagtactcagaaactattatctgagttactctatttgtacttttaagttgcgttgcatattttttaatggattgttatatgttatatgtttatgaggtatttgatacctctgcattctagatagcctgaaagcttaaaaaatgcattgtaattggcaaaattttatttgtagttagaaagtttataattgtttcacatgattttttttatgttttaaaatcttc

SEQ ID NO: 40580 - DNA, 1050 bp, Homo sapiens
attaaaaggagaatttatgcaaactgataatagaaattttactgaatggactcttcacataagggaaaaatgcaaagtttcaaaaaaaaaaaaataagatgttaaacatcactagcaatcaaacaaatgcttattaaagtacgaagctgttttctcataataaactagtagttaaagataataaaagtaccccatgcagggaaacctacagtgtaacttcagctctcaaccttgcaaatagtgttgtaaaatcattttggcaagtgatttccttaaatgaaatcggggtaatatggtgagaaagagttgaaaagaaaatggatattggagtcttggtgtccaagaaattcatcttaagttgtaatatcagatcactcggggaatattttcctattatatacactgatattttgccctttctatcatgctcctacccttactgagaattatatgtcattaaaataaaaaaggatgccttttagcagcactttcctccttaatatataacatacaatgtttttattgattttaggttgtttaaagtagactttttataccctgctctatggttttattctaattaggattggaaatgatggttctggtatcaatcaatgtgttctcagaaatagagatatattatctacaagaagtaaaaggtgatattctgttacatcatttctagcatcaaccagttttgcagagtagcttagtttgttttgttacataagtatattttgtaattaagccagtgtagacactttgggctactaccttgcttatgattttattctttccctgatgtggcacctagtggtttccctgatgtgtctttaccagttaattgcccaaaatagtggtagtagtgatggtggtacaggactggggatagggacagcaataataatagcagacacttacataagcttagtatgtgctttgtgctataatcttttttatatgaaataattcccataatcacaagaaacctaaaaggtaagtaccgttttaatctccattttacagatgagaaaattgaagcagggagag

SEQ ID NO: 40581 - DNA, 1045 bp, Homo sapiens
gggaatatttttgcatattattaaatactagttcatattatgtgacatttgatagctgcagagtattcctatcttagatataccaagttaactgtgtacttctgatgacttacttattaagaataacgtttttcgttcactcacctacagcaaattgaacactgtttgacggggaagaggcaaaaagaatatctcaaaaactaagttgatatggaggagaacaaatagttcccttttagtattaaagttgattcttcatgaacttcaggaaaaggaaatttcctcacattcatatttatcagtcacattaccacagatgtcttctgttttagccatcggcataggcttaaatttctttaagcccagagattccttgggtctggtccccttaaagtgttctttgtcttttctgctgatggatgataggcatgtgtacaatgcactcctctagacttactcattgaatggtctatgggttatccacttcttggcgctccaggtagaactcttctttttctccagtcatgaaagcacaactgaatgcagactaatcttggatctgctatgtctaaaaaataagattaagattattttcaaatataatacttcagttctcattattatttaatttatatattgtaaagtatttcatatattttaaaggaatattgagcaggcgaatacattgtgtgaaagatgtggtgctttttgaggtgattcaactgtgtctgaggcaggcccagaactccaactccaaaactaacagtctgaaagaataatatctgtgctctctagtctttccaatttaccttaaaaacattttcactggatagtgctttgtttcatcaagttatagaagactaaaatattcaaaaacagtatcttgttttactgttattatttaatacaatgtatagaaaacaatttgaggataacggttggtacataattcgctttcaacaagtattagttcctttctgcttcctcattttttttttaatttctccccctaacttactatacttcatgaaacatagccccaaag

SEQ ID NO: 40582 - DNA, 1064 bp, Homo sapiens
tttttgttcattgtgcttttttgaaaatcccagtttatcccaagtgtatgaagttcttccacatttttcttctgaatgatttaaagttttattttttagatttaagtcttaagtctctctggatttttattgttactttggtaagagcagggttattattttatttctttacctaaagaaagccattttgtcatcatctctctagccttttctagtgaattataatattatctttgccatattctcaattctagtgttgtcttgtggctattactgagctgtgtttgttgttgttgttggtggtgtgtgtgtgtgtgtttgtgtgtgtatatctgtatctggccctccttgaggactacactgttttaattactatcattttagtataagtcttgattataaagcaaattcagcctcattattttattctcatgtattagaatagccatagctacttactgaacattttaattttgaaattggactctttcattacatcaaaagatctgtttgggtttttattagaagtatgtttctgcaatactttgaacaaagttaacacctttattatgtctctccatctgtgagcattgcatattttccagtttttaagtctcttttaaagctcttcaaaaatgtatttcgtcataggtcttgtacattttaaaagattaatttccagatatcttgtattatttgtcactatttttaaaaaaaaattttatatttcataatggctgttgttggagtataagaacacttggttttattcatattatatcccacaaccctgctaagtattcttactaatagttatagattatctgtaaattctctttgactttctgtgtaggcaatgatataatctgcaaattaaagcagtttgaccccaaaactttgagagaagcccagccttagaatcagatattttcatcattcaattcccttagtgtatatacatgtataacgttactattttaaatattttctcatctttttatacttttgaactgagagaagggagtttccataagcccagttgactttattgagtgaaggttaca

SEQ ID NO: 40583 - DNA, 1030 bp, Homo sapiens
aggcctttgggagataattggacttagattaggtcatgaagtagggaggactgggtgacagagtgagactccatctcaataaataataaataaataaatagaaatattgatagatttaattcaaaaagacaaagttctttgtgacctgaataattttaaagattacaaaggagtcccaaagccaaaacaatttgaaaactactatgataggtgaaagtgccttatatatgacatcagattctttttattgtctacatccagcctggttttcaaccttatctcccagatgcttctcaatataaactatagtcaggccatttttgctttttctaaaatagcattgctcaaataatattttcttaaatgaacattgctttttagtaagtttcctcatgtgttttctcctttttcttagtatcttcctttatctattgacatttgtccaaatcttgcccattctttaaaacccagttcaaattctgtatttacttcttccctgaatcccgtagcaccattcatttatattcataaaataatacctagtgcacaaagtctgtgcttttggacctgatgtagtgttaaaaacctgaatcactctcaagtaaaattttgattgctcttgtcctatatccaactatgttactgatgctaatgcaagaatgtttgtggaaagacaagggagataacatttaaattcaatttatgagttagtcactatgctaaatgcatatgtgcaacttccctgagtcttcacaagaaccctactgggtagtacctccattttacaggagcagaaagtaaaaccaaaaaaatctacttagacttatgcctagtctgtcctgcagactctggccaagcaatggatgtaagaagtatgcagacacaggtattttgcctgagaccatggctaggggactgcacggcttagcatcactgatgagagtgcagccctgccaatgagagtgcagccccaataagcgggggacatttgcatttatttagtacagatttaatgacaaaggcttgaagc

SEQ ID NO: 40584 - DNA, 1047 bp, Homo sapiens
atcagttttaggaatcaaaaaatttaccttaaaaataaaagtgtaaagtaatgaaattaataagttttacaagcctttaacttggacttttaatttagactttggtgtcagatacctgagtttcaatctttgctctgcaatttactagccatttatcctggttaagttctttaaactcaccatgccctacttcccccctctttaaaagaaggacgataaaaagacctaccgcataaattttctttggatgctaagtgaaataatgcacttaaagcatttaaaacaaaacctcatatgtagtacgtgctcagtaaaaatggttgctaaatagattagtgaacagtttacttgccaaattaaataaggaatatattatcttatgtatttacctttaatttaagagcattagaaatcacattgtagtttttgtgttcagttagtctactgacttgtcacaaattatgtagtttgggattggtgtatttagtgaagtagtatgtaagatcttctctggtttctttaaacgttacaatgtggaggtatgtggaaagaaagtcatagttggagctcatgaaatgggtttctggtagtctagattcatctgctgcaatgtgagctcttgaggacagaccacgtcctcaaagcctgacacttggtaggcagcgtttagtacatgatggaggagtaggaggatacattttagataacagcaagatgtgatttaggcttgcagttaataacagatctggtcctctggtgaagccattgaggtttagatgagaccacgggtctgatgtcacaaatattggaggtagaaagaacacttgctgttttcttctgtgtctaaacttttaattgggaagtcctttgaggaactagccatgttaagaccaaaaaagagaacgctgggaagaacactgagtaggggacatatggtgtagaataatttgaaggggcatgagaagagtaatttaacttactattttgtttctaaagggtagaattcaaggaataatgagaagaacttaatatgaaatatttatataa

SEQ ID NO: 40585 - DNA, 1072 bp, Homo sapiens
catttgttggctgcttgtatgtcttttattgagaagtgtctgttaatgtcctttgcccattttttaatgtggttatttgttttttgcttgttgatttaggttccttatagattctggatattaggtctttgtcagatacagttattttctcttgttctgtaggttgtctgtttactctgttgacaagtgggacctaattaaactgaagagcttctgcatagcaaattttctttaaaaagaaaaaatatatatacttactatgggccaggtagtagtgtaatttctctccaactttttattttgacaactttcaaacttaaagttacaagaataatacaatgatcactgtttacccttcacatagattcattagtcattaacattttgctcttcctagacccgttacccacacacctactttttaaatttttgctgaacaatgacaggaagttctagacatcatgattctttacctgtaaaatctttagcacatgtctaagcacaatacaattatcacactgagcaaattgaacactgatagtgtcatgtattacacatattttaaatcccggaaaaattaagagttggctagggaacaaaacttatttttataaaagcttgacttaaaacatagctgatgcgaaactcaggttttaagtggtaaataggaaaacaatttttttttacctttaccacactgttttttgccagccttacaaatagttttggattttaaaaaagtatatgagcgtaagaaatttggcaactgtcttcaaactattcaacatctatccttcttgtaagttacgtcctcattttcttacatttatgattatgacactaaaaggaaatgataaaaacagctataatttaaatctaaaatttctgacagattttctgtttcttacagattctcttgattactaatacatgttctcagagccttaaagttcctttgagattgtaagaaacttggaaaatataaatttagcaattttgtctgcaggtctgtttgttctttgagtgtattgaacacttctactctgccttcctccaagagcgctcccacctt

SEQ ID NO: 40586 - DNA, 1056 bp, Homo sapiens
tttgctcatttttatattgggttttctttttattactgagttataagagttcattgtatattttggatgcacaccccttatcagatagatacatgattttttttttcctattctgtgggttaccttttcactttcatggtggtatcctttaaagcacaaatagtttgtttattttgatgaaatctaaattatctgttttcttttgttgctcattctgttgatgtcatagttaggaatttttttttaccatatctacatctgtaaagatttattcctatgttttcttctgagagttttatcattttagctcttacatttaggtcatttattcatttgagttgattttttatatggtatgcagtaaaggtgcagcttaattttttgtacatcactggccagttgtcccatcatcatttattgaaaagtctcttcttttccctttaaatagtcttggcattcttttaaaaaattggttgaccatagatgcttgggtttatttctggactctctattctgttgatttgtctgtgtatcctcatgctggtactacactcttttaattactgttgctgtgtagtaagttagaagtatgaaagtgtgagtcttaaactttgttctcttcaagtttattttgactattctgagttttctgctattccatctgatttttagaatcagcctgttaatttctatgaagaagtcacctgggattttgataggaattggatttaatctgtagagcaaattggggtttattatgatcctagcagtagtcttctggttctagtcttctgattcatgaagatgactgttttttccatttatgtagatcttctaaaatttctttcagcaatatttgtagtttttagtgtagaactcttatacttcctttgtttgatttttttttcccagtaatgtattattgttaatattgagtgtaaacttgattggattgaaggatgcaaaatactgttcctgggtgtgtctgtgagggtgttgccaaaggaaattaaaatttgagtcagtggactgggagaggtagacccaccctcagtc

SEQ ID NO: 40587 - DNA, 1026 bp, Homo sapiens
atcatttgcggttgctgaaagacttgcagtctttttgttattcctttataagcgttctttctgaatattcatgtatttctataatcatttctataatcctagaacattccaggctataatcttttaaaataatgcctttctgtcattctttctagtcttcgtctttcaaaaatcctatcagagatatattggaacctctcactctatatcttccatctcttcaatactttaaaatttttttaaaatctatttacttctgtcttgcattcgaggtgaattctttgtactatttccacagaattatctgaggaatttttagtgattattttttatttcttgatttctgcatgtttctttttatatccaccagttcttctttaacttttttgttttgttttataaattccttttttaataaagcaactgctttatcttttcagctttataatacttatttcaaagtctttgtcatattgtttcatattattttcttatgtttcattgatgattttgttgactgccagttttagtgtaatatttcttatggttcagaattttaatttttagactgatcttaatttgaagcttcccccttcacattcctccttactccatgccctaaatttctatagtagctgtggccccaggaatcattttgatggtagttcaacttttttttcatgaacgcagaagctccatgcctaatccctggcttccattaagattagctctagttcccatttgcatggatcaatttttatctaggttacccagcaggagccaaactactggcctagctgtccagaagtggagctgagcctactgcaacttttagctgtgttcattgctttgcctattttgttgaatttctggttgagggagatattagtcttatttttaagttcaagtgtacctttttgtttgttttttttcctttttttttttaaccagaagagttgcattaaagtatgaattttgtgccatctttatcattttaattgataataccagttctctcagcaggca

SEQ ID NO: 40588 - DNA, 1048 bp, Homo sapiens
gcctggctttttaatgtctgactaccctaaagaaaatcttttggattaagtttttgaagtgagttctgatattaatagttcttgttaagatggaaaagatgttaataaaaacacacttgagaaatatgtaaagtgggatctgaaaggctagcatattggagatgtattgaagtatacatatctcagtattatttcaatattacatgctatttgcaaagctattaatgctgatgtagatactgatagagttattgtataatcagtttttagaaaaagagagttttgagttttattgatacaaccgtagtttgcttttgtgcagatgggctgcttctttatagcatttgtgatttgacatttgccgttagtattatctcttgactctatgcagatggcgttacttgacccatgcaagttcatttctgaacctccagatatgtgtctgatgtcaagcagtgtgagttatttggttagattgtcttctgagggaagactgtgtattttttggaacttatttgcattggaaatgattctatcatcctttgaaaatttggtggagaataattagcttgctttaatacagtgattctcgttttttgttctcaaaactcttttgcacttttaaaaattactcagaacctcataatttttctttatgttattgaactctattgatatttgtcatatttgaaattaaaattgaatttttactatattaatttaataaatgtctattaaatcatttgttttttagtctttcttattattctttcagagacagagtctcattctgtcacccaggctggagtgtagtggcatgatcatagtttactataacctgtaactcctgggctcaagcaatcctcttgcctcagactccctagtagctaggactacaaggatgcctcaccacacacaactaattttttaaagaatgttttgtagagacagggttctgtgatgttgtcctgactggtcatgaattcctggcctcaagtgatcctctcaccacggcctcctgaagtgcagggattgcaggcatgagcca

SEQ ID NO: 40589 - DNA, 1078 bp, Homo sapiens
agagtgtggggattatatggagccattacacctggtctattgctatgatttgactgttagatttactcaggagaatatttgtggtaattttttggaagatcgtaacttgaaccatgattcaattgagctaatactgtttcttttgtctttgaatagttggaactgataatgggagagaagcaattgaaagtggggctgcatttctcttcatgacatttcacttgaaggactctgttggtcacaaggaaacaaaggctatcaaacagatgtttggcccctttccttcatcatctgccactgcagcttgtaatgctactaatcgaattatttctcattttagtcaagatgatcttactgctcttgtgcagatgacagaaaaagaacatggcgatagggttttttttggtaaaaatttagcattttcatttgacatgcatgatttggaccactttgacgaactgccaataaatggtgaaactcagaaaactataagcctagattataagaagtttctgaatgaacatctccaggaggcttgcaccccagaactcaagcctgtggaaaaaacaaatggctcctttttgtggtgtgaagttgaaaagtacctaaattcaactttgaaggaaatgactgaagtgccaagagtagaagatctttgctgtactttatatgatatgcttgcttctattaaaagtggtgatgaacttcaggatgaggtatagttgaaatgatttatttttttatattaatgtgaactatcctaatgaaatagtgttttttaaacatgggtggttagcaaagaaagttctttaatgttctgtatagtagttgaatctatagccaaatggtttcacatagcaggcctgtatatacgttcctaatggatagttacaggaggtctgaaagtgtaatgagtgtagcagaggagtaagcagacaatagttgggtgtccacatgctctggttactgggacagtgctggtttgatgtcaacttaattttaatactggacaaattgaatgagtaatatatttcatgaaagattaagagggatggcctactgttgtagaaaggacagg

SEQ ID NO: 40590 - DNA, 1452 bp, Homo sapiens
caagagtagtggacaagtgggtagaaagaccttaccattccctaatcagctctctaactgtcaaactgaatatctcttcaagagctagaacagaatgtttgaagttgtcccagagtgcattgatctaatgattttactatagtatggatgcaaatcaagactcagccagaaatgaactagtttatttcactattcaacttgtcataaaaagacctgtttgttttgctttttctaatttataagccctgatttatatgagttttgacttttttatgcatcttacctttaataacttcatctttaagaaaactatgaatcaaaaggtaggttggacaggagtggcttacaaagtatggtttaaggcatttgtaaatccattgtagtttgtgagttatcaaggaagtaagattttgctgttaaaaaatgaggaatcaaaatctagggtggaaagccatttataaagcaatgactggaataggaagtataaaaagatagtagcagaatctggcaattttgtgtgtggacataatggtagatatttagaattctaaaggcctgttaaagggatatagcagtatttgtgacagttattttgaaaattgcagattgcaaaagagttcaaagagttttacttcccacaaagtggcagacagggtaatgtggaacaaccctctacagagaatacctagaaaaactgcaaaatacaaaatttgtttgactatatcagagaagttatcaaagcagtgaagatttttggggccaagatgtggaagcagaaattaacccagaaaatgtgatcctggcatttgggctactttttcctagaagtgaattgtccattccagaagaggaggctggatggaaaagaggaggatgagaagatgagcagagcttctgacagattcagaggactaagatgacaaaaatgactaaaatggacaaaagaagaaatagaaaatctgaatatttgactattaaaggaatttaatctgtaattaaaaaccttaagtacaaagaaatctatatgctatgatggctttaatggagaatgtcataatgtcatttaaaaaggtatgagagtactattgtagattaaaagaggttaaaggcatataataatcaaaatgtaatgtatgatccttgattgactcttgaatcagaaaaaaattacgtatttttggggccgttggagaaatctgaatatgggctggacatcattaggtaatattagatctcaggtgtgataatgttgtggctatgtaagaggatatcctaaatctcaggagaagcatactgcagtatatatagtggtatctcatgaagattaaaatgtactgtcaaatgtgtcagcaaaagaaatacacatgatgtgtgtgtgtgatcaagtgtttataatgagtggattaataaatatgagaagatagggtgatttgttgtaaagtaataaaggtt

SEQ ID NO: 40591 - DNA, 1072 bp, Homo sapiens
gtaaacaacatactatgtaaaggaaagctaaaatttcctggcatctaagtattcataattatgaaagacagtcctggccaggcgcggtggctcatgcatgtaaccccagcaccttgggaggtcgaggcaggcagatcgcttgagtccaggagttcgagaccagcctgggcaacatggcaaaaccctgtctctactaaaaatacaaataaaataaactagctaggtgtggtggtgtgcacttgtagtcccagctactctggaggctgatgtgggaaaattacctgagcctgggaggttgaggctgtggtgagccaagatcatgccactgcacttcagtctgggcaactcgagtgagaccctgtctcgaacagaaaaaaaaagacagtccgtatctatcagcgagcttcggatagagagtgacaggctggggataggcagaagtaaattagtaattataatactatctagcatgaaggatttgtaggaattcagtgtttgaaaaccactgtcttgattaaaataaggataaagtaaattaaaattttaatgtagctctaaggaagcttaaaagctatgtagctcagtcgcttattatagatgcccacctagtacacagtgaataacagcacttaaactagactttgactgcttcacttcccttcctacactaatattcttatcaattgattatatttgaaggaaaatgtaatttgaaattacaatattgtatacgaactcaggttactttcctaaggctaaaaatcaaactaaatgaaacaaatgactggtaaaacccctgtgtttgtacattgaaattcatcatattgcaaattctgataactaaaaagcataattaacactattatagttctagattttccaaatttagcaggtttgcaactataaaatgtccatacacctattctggtcttgcatgatctggccttcccctctgtctgacctcacttcattcttgccttcattactgtgtcaaacacgtctgtcttcaacttcctcaaacctaccaggctagtacctgatttgggtcttcacacatgctgctctctgtgtt

SEQ ID NO: 40592 - DNA, 1020 bp, Homo sapiens
acatggttgatgaacgagttttacaaatggacagaggagaaggctgtttcatatacacaaaaagccacattcaaatgtttgaaggtgccagttattttcttgaaaaagtcaaaaattttcatcaaaacataaagaccattcacaggaatagactagtatctgaagggtatagtatctgaagaacaattataatagtaagctgaggaatttatgcttaaaagttgtttttaagtaggtagatggagtgacaagagcaacaactataaaagcaccaacaggcatattttcagcaaaattagaggactaagaaaactcccaaatcaaatcatgtgattacttcaagatgcaataaatctggagagagaggcataattttagaagatctcagaaatccctaggaatagttcattaccttaaggaatggaactctcacacctagtacagacagtagtgataaaagcgaatatgattatatagtataaaatgctgcacttttttaatacagcctaaaggctgttgatgaaggctaagaatggacaagtcttgaatgtcaggtaagcaaactgagagacaatatggaaagatcagtgtgatccagaaatggaaactcagaaggtaaaagcaaaatgtctcttgtaaatattaattgaattgccataaagtccagactgtgtctcattccagccaacagcttgtgaagaaacttgaagctcagatctgttattaaaaacctttgaaccaagtttgggtaggaaaagtgcagaagacatggcaacaatcattagcaacagcagcaacacaagagggagttcatgagcagaaaagtctgggaagcaccctggcccactcatcccttccagagcaaatgcttacaaagagttgattagcaaaatgcagccattcagataaccacaaaataaaaatataccacattcatacaaaaatattacagatgacaagataaaaatagtacaattttgttacaggttattaaacttaccagaaagataatgccacaaa

SEQ ID NO: 40593 - DNA, 1033 bp, Homo sapiens
gtgtagtcttaacatttatgtgagagaatcaacagcataataaaatttattgtcagttatgtttaaaacaaattattaatctacaaatgcaaatatgagttcgagctgtataaacaactttagatgacaatatataggcaataaattacagagtgaaatttatttcttaaaaatgcaaatgaacccatctggaaaatatgataaaatgctagtaattcagcaagagaaaggaatctggaaagcagtaatgatggagagttttctagatgaataatcgttggtactggataaaaaattaaaaataagcatttgactttgggggttggtaaagtacatcttttgagttgcctataacagtacaaatctgttaaagcccacaggtacagatcattctcttatgattacagaggtatagtttcaattttggccacttgtactgagaaagtttcagccagtggaagggaatgttgatgaactcgaaggaggtaacaggaataattatgtctctggaaaaacccactttggaggaaatgttcagataataatacagtttaaattgcataagtcagatcaatgagaaattatggccctcatatgaagatagtctataaacaatagcagcagtggcaacagcaataataaaaaagtttaagtgtctttaagagtcatgaaaatagaagcaggagttacctaacagaaatatagtacttgacatcattaagaaatataataaagcagtttactggtaaaattgtgcacttgcctgggggcactgtagaattttttttactgaaatatataagtaaaagttgatttagaataacaatgtgaaactcttctccaaaaacgtcttaacatacttgtaactttttactttatcttgtgttaaagtatcttgatcatcagtaatttgtgctagtaatggatcaattcaatttttatactttttcttggaatgcctttctttacaattagctaatcatcctttaaataagctgactttattttagcaaaatccattaaggaaggttgt

SEQ ID NO: 40594 - DNA, 1049 bp, Homo sapiens
ccctgtgccttctgctttatctccctttgagaagtctacctgtgtctcttagtcttcaaagaaggtaatgatgccgtaatgccacatataattacaattaattattaaaaatattaggaaaattatcttttctttgcaaatatataaaattttaggcttatatttaataataaaaccagagagcttcaaattatagcaatttagagtgtcaaatttggcccaattgagctcagagggtataataaagatatcatgccaatttcagcaaattgcacagtttatatctattaacaccttcccagtgtgaaactacctccttgtgaggactattagctctctccataaatgattcagactgtggaagatgcaatattactggtatttgcagtttaaataatggtaataataatatctaaaatatagctatattgagcaacaacacaaaaaaccagaaacatgcagacctgtgaccatataccaccttatttctgcaaaacaaatttgggctgatgatagatccctctttctcctctcttccatttctaaagaacctaaacatacaaacaaaggaatcccaaagaacaaaatgttagcattgaactctaatatctcttataacatgcaacatccgttcccatgtagctaatgtaattttgatttttaatctacacatgactcactaaagtcatgattgaaatatttattatactagggatggattgtcctgccaatttgaaactaaagtttagtccatgggacaggtagcagaaatcaggcctcatgtcatatctcagtttctcctttgctttagatgttcctagtaagagcaatatttattttactatattgtttttgtataaaatatgataatttatgtaatttggagtaatatatgaataccatctaggatttatccaagataatgtactaagaagtattttaacaaaatatagtggctgtaataaaagaataaagtatggtccctcctatttccacattaattccaatcaggacagcagctatcaaaaagctaagtttactttagcatt

SEQ ID NO: 40595 - DNA, 1031 bp, Homo sapiens
tatataatgcgtaataaaacacatacatattccaagcagagaatagatgggtacctttccttatattttagctcaccatattcagctcacatatttttaaataatttatctccaacttctaaaaatatggcctttattccttgatcttaatcctgtttttcattcataggaaagtgctatttttatgggccagtgaagcttatataccattgagtgacatttagatactacagttatttctgtgtgaggagaattaatctcttcaagaaggaaactcagagtccttccctctgttgccaggcccatcgcagaatatctccagttatgttttctgttgagagagcacagccttcaatagtgttttaaaatttaaatgtgaaaaagttttaagagccaatgtaatattttgtttgttgaaccacttttgtatcatattttgtgacagttaattaacaaatatgtataaatgtttttatgtataaattaatttttattagaaattaatggtacttgtgtcaggattgtgaaagtattgagtgtgaaagtatgtgagcaagtgagtaaaaatttctgcagttggaaatgaatgaaaaatctgctggaatatgtttatgaaaagggaattatagcttttgcactgatttaaaattttaaggatcaagtaactgagtttgattctttttaaacattgatttgatttttacaatttagttttattttcagtcctgtctccagtaatcatttcattttctttctttctttttttaaggagagctctctgacttttttctttcttcaggcagtggaacacaggctggttaaaagtacaatttttcttcctttatctgccattctcctttcttccctcctgcccttcttgaagctttattccttggttcctctgcaacaatacatccattactgatggctaaacagaccaagtataaacaacactgagaacgttctcagtttggcttttttttttcctttggtctttttttagtctggcctttggcaaaggttcatgacag

SEQ ID NO: 40596 - DNA, 1029 bp, Homo sapiens
acttcaaaaacatagaaggtctagttatctaaccatcaaattgttaagtattaataaaaaagcaaaaaaattgtcttttagacagtgtttccatttaaaatagttggagctgctgtcctttaaaaagcacacgtattttctaatctgccaagtaaatctacttctttccactctgctttagtggtttttctgtattaaatgtgcacaaatagaagaaaccacagcacctccaaaatgctgctgcttaattctcctgtatgattctctgtattgaagatgtctacctaaacagatttcatgagctttgtgaaattttgacttcaaagagtgacacttgaatttttaatcaccttactcaggaacaatgttttcttggtatgccttccatttctcttttatgtagaaaaattatatgcatttttactaagtcatcaatttctacttgaaattctatcctcagtttcatgcatgcatgcatggctttataaaagtgggataagtttttttgtgcttcagggactgttcagtgaaagcaggctccagcagagctttgtccatatccgacaaatgcttgctgtcagattttcccttctcctctgtttgacatgatggaatcccttacaaacatgtcgatttggaccagcacgctgcatactaaattatgaaaacagtattcacattttagcatcaaaaaaagtggactcatcatgtggtattgttctgaagtgaaaccttggtgatgaaaggagaaaacaagcctatccaccaattatctcaatattttgaaggccatggcatagggtggatgtttgactcttgctgtgggatggcaggtttgctatgatttatgtagatctaactatatgattttggttttgatgacagatgttacaggaataatattcggctttgtgatgttttgtaatatccctcgggtaaaaatgaatctgtgtagaattgaataatatggtagttgtatttgttaattgaagttgctatgctttgtactttatttcagagcatcatgcc

SEQ ID NO: 40597 - DNA, 1135 bp, Homo sapiens
gtgttatatgattctggtattgtgtattgttcacaggtaagtgctttagaagttcctatttgtaggcatttatcctggcatatcagaaaaaaaacctttgtcattcaataatttctacctgttagcagaatgtacttttatagtttttttaaaaaaattttattatagtatctattaaatgcatactccaattaattttttagaatgatacaaaggcgggccaggcgcggtggctcatgcctgtaatcccagcacttcggaaggctgaggcaggtggatcacctgaggtcgggagttcaagaccagcctgaccaacatggagaaaccctgtctgtactaaaaatacaaaattagctgggtgtggtggtgcatgcctgtaatcccagctacttgggaggctgaggcaggagaaaagcttgaacccgggaggcggaggtcgcagtgattgtgccattgcattccagcctgggcaacaagagtgaaactccatttaaaaaaaaaaaaaaaaagaatgatgcaaaggctacttttactgaaagtttttattaacttgttaacatttgaaatgagatgttatgaaagtattgcttataatggtaaaaatagacaatggtgattgaagttagaagagtgaatttcttgggagagggcgtgcacgaacaggagggccaagtgaagcttctgggtgttggaaatgttctgtgtctagatccgggtcatgggtacatgatgtatgcatatctaaaatttcacttaatgtttgtgtactttactatatgcatgttatacctcaatcaaaaaaagtagagaaaaaagatgcaatgtttcaaatgatacggaatgaattagttggacttagataggcaaatatcaactttaccttctcttgtttcacaaaatattcctaactgatataataaaggctttatataattcaagtaccaataggtaacaaaaactgataagaaatgcattagtgcctcaaacttgaagttggtaaggggcaggaaatgaaatttcaaaaaagtggaaatccagtaatcaatgaacatatcaaaaagatgtccaaaatatttacctaaatagagaagctgaggcacaaaatataattttaaatagtttacttaaggcaaag

SEQ ID NO: 40598 - DNA, 1061 bp, Homo sapiens
gtgccttaaagtaggccttaattactcatctgttcttattttatacaaaccctgttctgggtccattttactttggattgaatattttctgagctgtgaaatatactcagaatccttagtcatttaagttctgccttgaatgtagattttatcataaagctatctttaattccttttcccttaagccatctccatgtatttttaaaagctcatcaatataaatgtttgtgtctgtcttatttgtttctcatgtttagaaggggaaaaaggagattgattacaaggatcataaaagtaatgatgcatttaatgaaagcatgtattttatagataaaataaactttaaaaaataacttgaagctagtacccaaattaatgtaatgaaatgaccttcagaaagtaatttctttatacttgggtcattttagcccttttcttgtttttatttatttacttttaatttgattttctgttttaattttgatgactttaccctagttataatactccagattctctataaaacttaaaaaatttctgataagccttgtaaatttctgagttttatcatagttatgatggttttaactgtataaaatctgaatgacctgttgcttcgaaaaaaatgcttattactatatctattgcatacccagtgtagttcaggcagtgttctaggcactaaagttcctgttttcaggtagattacattccagtaagggatataatctacctgaaaacaggaggagaaagccaataagaaaatagagctgattttagttaaaatccagattagaaaataggaaccagtgtattccagtgggggaaagccaataagtaaatagaaagttaaaatccacattgaaaaataggaaatagtctaggactcttgattggggagtttattatagggagattttagaacccccaacaagacatgggatacatagaaaactaagtaaatgaaacattacacagttttgtagttcagagaaaaaacaaagttgtacaagaaaggaaatacagttgactcttgaacaacatgggtttgaactgcacag

SEQ ID NO: 40599 - DNA, 1050 bp, Homo sapiens
ttgacttgattgtataaatgaatatagtttgcaatgtaaacactttaattatatctttctgttccccaatgttgcttgttagtttttctatcacatgtgacttagagacttacttcagctgtgtctgtaacataatatttttctagtcatgtttataacacaatttttccatttatttcatgttttggctcaaatgaaggagttggtcaagaaagaggtggtttacatgtgccatgttggtgtgctgcacccattaacttgtcatttaacattaggtatacatatgtaacaaacctgcacgttgtgcacaggtaccctaaaacttaaagcagaaaaaaaaaaaaagaaagaggtggtttgactggtttcacctttgcagttgcattttggattctcctgcacctctcttaaattgtctctcttcaatttgtttcatccttttgttttggctattataatgtttcttgaagtctggaacatttcggttctgttttcttgacaccaagtaggattggatcccccagggctgtgcatttcctggagaccgaacactttcagctggcactgctaagttgaatataattgccagtctccatcattaatttatagccaggtgtaaataaatattttctaggcagaagttacaagagtttccaataagaagggaactgtcttttttggggaaattgcatttcagtggaagcttatagcttaaaggcattcattagaggtaaagcaagaaagagatggctaagatgctttgagttagcaataacatttctgttatgtggtagagatggacaggtaaaagtgagggacaaggatgaaagggaagtgagagccaaattctttgaaaagatgtccagaccatgttagtaacaggtgtgactaatgctgtatatgaaaaaaaattttgcattgctatgatgttagtctgtcagcagaagatcaagaacatccaagatgacatctgggttttatttatttttttagttaaatgtgtatttgaggaacatttataatatgtgtagtgcccttcttatagcagtc

SEQ ID NO: 40600 - DNA, 1054 bp, Homo sapiens
agccattctgtttgaaaaatgaaggaactcgagagcaatgagtttacatgacaggggcgttacataataggcaggatatatagatggcagggcatttgtttaaacagggcatgtccatgtaacactgcctcaataaagaaacaaatgggctttcagaatgttataccaaattcagtcaagggacatcgagtgcccggtgttaagtacggcatcaaaccaggcactgcaagtgttaaagagatgcatgaaactggcttcaggggttcagtaaggaagacccacacacaggtctcaggtgctagttaatggtccaggaactaattacctagtacatctattaatgtttgtttacatatctgtttgtagatacaatcattacctagagcaattattttggtgtcattattggtaaactagacatacacttaaatcttcaaatttcattgccataaacatctataatactgggagcatatccatattatagcacatatctgtccccctaagtggactgtgatttccttgaggtagggtcatgctttattcatctgtagtgtctggaaactatatggtctgatatctgataggtattgaatacatatttgttgaatgatttgaagtattggaacaaaacatttaaaaatataaataattattgctaacaatatatgtctacatcagattctaatttaagaatctgtttattgcatttacttccttacacatatgtatttattgtcaacaatccataatcattgtccagaatccttaacaattgaatactatttttctctgtctctacagtttagtaggttttggcaagtatacagcagtgattattagatatgtatttcttttatttctctgttttgaattctatttctctaatttgaattcaaaatgattttcatctctgtttctaagaggcagccagagattacttctagagttaaaaggagagccctcatttgaacctgtttgagtatttcttatactcaactgctttggttcatggtttaaataaagttgcagagtatgcattatatttttcatg

SEQ ID NO: 40601 - DNA, 1021 bp, Homo sapiens
aaaaaaaattaattaataccaaatctgaacagatatttcctttagctactcttaaagaatggtttttaccagttttttggctaagatgatcaggaaatggatagcagacactcactgtaaaaattttattcattttttggtgttaattagtgctaacacataagtgagtataattcttataactgtctgggctcaatccttcttagcaaggctgtcagtagtctactgactctgtgaaagaattcctgcaggaaaggtgagaggcggacttgtcttggtccctacttgattattcaggtcaagactctaatgtctaaagtggcaacctaacctagggttggcaatgacccatataccatttatatttatgtgaatgtgctacacattataaacgcaaacattttggatccaaacagcttaaaatttctttgcaagtaaaaagatacaaggatctttttattctcttcattatactggagggatatcttttatcattcattattgcctcatgttttcccagttttcttattttcatctgtgcatctatatttatatcgcttctcattatgacttttacagatacagtcttgactctaaattattcttaaatattctatgtattttaaaatatgtgtcatgttactctttaagtaccttctttttcctgagtttcacggcaatcaaagacaaagaaaatgatgtctgacctgctgtatatatcaaaacacaatattcagttggatacaaattcgttactaccttcatttacttttgaaaacatgacagaggtttaagtataaggcattagtatgttgtgggagattgctgtgtcttccatagtctaccctgctcttccttggctcacggcagcctagctagagaagctgggagtggtcacttgactaagttctcaccgaaatgtgattgaaagatgtgtatgacttccatctcacttgcttgaaagaaagttgcttgtcttggatgctttccctttcccattcatgcaagctggaatctggat

SEQ ID NO: 40602 - DNA, 1041 bp, Homo sapiens
tgtcttaatttttgagaatttttttttcctggtagaatataatgtgtgttacatagcatagtggagatatatgttgtatctgtatctatataggtatttatttgttgtttttggcctacttcctgtaaacataaagtcttatatgagcaaaaacagaggtcaaatttatgatttatcaaaaatgaagaatagtaccgctaatcataaataaggaccaattattaaagaaacacaagtttaaatttttaggaaagtttgataacgaggaagagtttttttttttcccaaagcaatgatacagatttaattattggaagttaatattacaagcaaggattcttctttgcccagctttattgaggtataactgaccgataaaaatgatatatatttaagatatacaacgagatgtttgggtatgcatatacattgtaaaatgattaccacaatcaaactaattaacatatccatcatcatgcaaggattcttaaaaatcttcaaggctgtcagttttattataaatattataagtcaacataatgtctgtacaccgttcataatggatggttgaatcacatacagttatagctaatcaaaaaccattacaaatatatttactctctttaaacactttcatatttcattacaaatggccgattgaacacttccacatccattacagtattatatttccattcaatttactattaagagttcttgaacagctaccgtgtaatagtagctattgtgaattataaatatttcatcacctctctatggtaatccatttctcatttgcttgccaaaagttataaagtgcttattaaacattgataaataatattacagcacatgatatgaaatattgtcttgcaaattagcttattggtaaaccttgaagttggtgatactttaatctgtattattcagtcttcataattcattataaacaatgattattgctatgtcattggactgtggagaaatggatcattctcagagacagcatcaccaacttgagcaattttcttattatacaga

SEQ ID NO: 40603 - DNA, 1032 bp, Homo sapiens
ctgcttatacatatccatacccatttgggctattatattttagcttttcaattgattacttttgtagcttttaattatttacatatttctttgtctgtcttacctatttctgtgtcaaacattaggcaaaagcctctctccccactatactcagaggaaattagcacttctattcttctttccaattccccttcccctacaaccaactcccaactatcattagctatgttattacttttctattgtcaaggtatgtcagatttatattctgtctggtaattctatttatgtcttctctcttttataggttgattctgaaaatggaaaatcaataaagaatttttataatgttatgattatataaatattctctgcagtaccaaattgtatgattgaacctgtagagaagataaaatcttaatgtggcaaagcttgtgtcattcaaaaaaaaccattctaagtataaaacccaagtagattttaatttttaaaaatcgaatcaatttttgaaaatcatgccactgtttctttggtcaacaaatttttctacatttttttctcctgctatttctaattctttttcttttctttcttttttttttaacatgagaaagatatcatatcttaagggtatctagctgcttaatcacaatatttctttaatgtacgctaaccatattaggtacatatgagggtacaggggaaataagctttctcagttgttttatgtctgaaaatatctctgtcttccccccacatttggtaggattccttagtattggatttcagatttaaaattaattcctccaaatttgaggctgttgctggctatcttctagtgttgagtgcaatagaaaatggatctgatgccactgtggttctcattcctgtgtaagaaacctgttttttgttggcttgttttaccccaaggaaggccttttggaacttttgcttgtctttggaatttttaatttcacaaggatttgttcgtgtcttctgtgtggttctccctggggctctcagtatgacgac

SEQ ID NO: 40604 - DNA, 1051 bp, Homo sapiens
actcagtcttatcataggcttgtgtatgtgaggctctcttttcttaacctcctatcttatttgggtttgacacaagtgattccatcttgatattgacaactttcacacatctgagtgcatttccaacaaagaacgattttaaaccacattcttaacctgaaattttgggtggaatttggattagaaacccaaatgaaagtctgttttgttgttatgaattctttacattgaggtctcttattagactccccggcttgggcaggccctggactttgccttgtatccccgtatcctatgaccttataaaaaacaaaagccagggtcatcaaggatcagtgcatatcattagagtgaaaactgactttggtgttgagcatgcctctctaggtccacattttcatgtaattttaggcatctcagtgttccttacctcctgccagcttatcagcacatcttaaaaagtttttttcttttaattttatgcatcagttttgggtgtttttagtggaagggtcaatcggactaggttgtaatactgcctgaaatgaaaatattcattattgtatcgtcagaaaacgaatgaaatttcccgtaattcagaaagccatctcaaattcattattagcatcacatcattatcagagcacaggttggctaatcagtttgcctaggacggaaacttggctctaatatttactagctgtgcggtcacaggtaagttaatcaacctccaattgtcttggttttctcagcagaacaatagtacctactgcataggcttgtgataagcatttaataaattaatatatataaagcatccagatttatggaaaatattaagtgctcaatatatattagctaacataattattattattctttcaaggttacctttgagccaatctactctttcattgccctttgattgaactaagtgtatattattatttctcttaaaacaatcctctaactgttaataagaggaggtcattctcaaataacacctagcccatctcttagggagaattttcaaccctgcccccaaccagac

SEQ ID NO: 40605 - DNA, 1048 bp, Homo sapiens
gaataagagactattgctatatctgggaatgagttgtatagtgggatggacttctcccactttgtaacttttttttccctgtttctccaaatcatatgcctatgttattttctgtatgatacatttacatatatatgtgtgtgtgtatgtatatacacatacatatatataaacatccactatctttaatccagaaaagaagtatcattaataggttttttgaatctataaagtgccataaacagtattttatgtagtgataaacagtattttcataatcacaaaacttataattttgtttagtgtgtttaatttaaaacaagtttaattgaactctttgtaaacagttaaaaaaaaaaaaaaggaatgctctcttgcccacaaagttgtttccacgttgcctgataattagcactgtttttagctctctctaattctaccaattagagatttatgaacatttctctcccttaacttttttaaataacaaaaggggtacttaatatgggaacatctgcaaagcatagattagtgtacgaactggtaaaaagcaataaattataattctactacccaacaattgtgttatattttcttctatagcaattcattttttacacagttgagttcataaagaatatagcacgtagtatcttctttatttacttagcattttgttttaaacatttttcatgtcattaaaacttttttaattaaaaaaagtgcgttatctagagatggaggtctctctgtatatgttgcccaggctggactcgaactcctggactcaagcgatccccccacatcagccttcctagtggctgggactgcagctgcatgctattgtgcctggcttgtttgtaaacattttgtggaatggtggcataatgttttgttgtatggattcatcataatttacttgaccatgtctctaaaattaacatttagatttctaatattgttgcttttataaataacaggtagcctcttaaaaactgcttatagtctaggagggataatattgtctgggttatttgttgaaatgtcc

SEQ ID NO: 40606 - DNA, 1043 bp, Homo sapiens
gtgtagttaatataaagagattttacaaagattaaaaatactatttagaggtagcatctttctaatttactccattcccacaatttcttctgtatgtagatggatatgttgaatgcaaggtagtatagaaaaatggttagattttctcctttgggaaaaagattatattaataggaaaatgactcaattcttaaaacatggtagtttcatataaggaagaaaacagaaataaaacactcgaatataaagcaagggaatgtattataggaaactgattaatgaaactatctgggcagagtagattaagttatccaaatagtttgaggagatagttattaaccacgtagttaataaaatccattttcaagttaaccccaaaacaaaatgtaatagaaggaaatcccagcttggaaataatctgctgaacacagcctctactattcaggcagtcttttgggtatcgggaaacgcaagctttaaaggatagctcacaagttggaggcccaggagatgattcctactcacatgttttgtttgtcatactgtttctaaaattttgaatgagttaccaagattttacaaaacctgaagatttcatgcagaagtcaggagttttgggtccttttgagcagtgagacaatctgacaatattgggtgcatgggtgcatattcctgcaaagcattatggaattgagtaaatgctgctgctttgaataactaaatgccctctccagtttgccatttcctcctctctctctctcccccctccctcccccctcttttttctaccctctttttttttttttttttttttttaactctgttgcccaggctggagtgcagtggcatgatctcggctcactgcaacctccacctcctgggttcaagtgattctgctcctcagcctcccgagtagctgggattttaggcatgcaccatcacacccgaccaatttttgtatttttaataaagacggggtttcatcttgttggtcaggctggtcttgaacccctagggacctcaagtgatccacccgcctcagc

SEQ ID NO: 40607 - DNA, 1044 bp, Homo sapiens
ctctgactttactaagttgagctgattcacatttgggaagagcaacattgtaggcatggtcttgatttatacagtgataataataattattaagcatttagtatttgccaggtattttatatgtattaactttaaaaacgctcacaaaaaatctcttgaggtgagtactattgtccccattttacagatgagaaaactaggccaaagaagatatggaacttgttcatggtcatagagcatgtgttagtgataggctatgaactcatgttccctgaccccagataccatcactgttgccagtctgctgcttggtggcatgagtaatcagagggacttggctttagaactttttgtgtgactttgtgtctttcataggggagggctatgctgcactgagaaaggaaacttttaaaaaatttggtacaaacgtctaaactagatgtgcatctgagttaaaggattcaggttaaattctagagttttagtgaggagaaggtatcgagtagctccagtgtactgaactggaggtgtagtcatccattgtagacagaaggcatcaagagatgactgtggactgttcttccatactgtgctgcttgtgaatttatccatgatagaaccagaatataaaaacactgaatcgtgtgatgctaggtaagctgatgcctatgaatactttcatgattcagtttctaactattagtatgagttatataccttacacatagttccaacagatgaattcaattattttgttgtattaaaaaaattgattggggcttaaaatatttttcttaatatgtacattttattctggaattctcatttcatctgtttgtttttggtcagtttagtaaccagatgggataataaagatcctttctttttcttcttcttgaaaaaaaatcgtaacaattaatgtgatattcatgaagtgcttcaaatttcttgagagaatataatgttagtcatttttattcataattatgaataatgaaagcatacttaatattattgaaagcttatcttcagcctagaagggaa

SEQ ID NO: 40608 - DNA, 1067 bp, Homo sapiens
tgtgttagtcacatctctttaactctattaaacagtttttagcaagttcttggagtttttactgctcttacattacatgcagtgttggtacatagtaagtactcagtactttctgattaatcaaaaattgtagataactcacagtttgcttacctggcagatgaacaaaagggagagactctctttgctattcaagagatcttattcttcaatttttagggtggagaatgggaagggataacaaattacgttccaatttctgcatgtattctaaaggatagaagtaagaataaagttaggagtaagaggccgggcgcagtggctcatgcctgtaatcccagcactttgggaggctgagatgggtggatcacctgaggtcaggagttcgaaaccagcctggctaacatggtgaaacctctctctactaaaaatacaaaaattagccaggcgtggtggtgcgtgcctgcaatcccagctacttgagaggctgaggcaggagaatcacttgaattcaggaggcagaggttgcagtgagcagagatcgtgccactgcactccagcctggacaacagagtgagactttgtctcaaaatgacaacaacaactacaacaataaaccaaaataaataaataagattaggtgtaagagattattttcatgaaaaattaaatggaacacgcaacgtaatttttctgggtgtgaaaattcattgtaataaggcttggatttaaaagaattgagaataaatatattcaattacatgtctgatattaagttctgagacataaccaaatttatcaagtcttttgtgttgaaaatgtaggaatttaaaaaaatacatttctctaggtagtcaaactatttcagctaagttctgtctttttgtaaatagttattgaaatgttcaaacattatccagtaactccttattgtaaataaagatctaagaatgattatttgtagaaaaggcatttagcaagctagtaaatctgataattagatgactgatacactgctaacatattttactcttattttttgagctagccttttaaagatcgctgtg

SEQ ID NO: 40609 - DNA, 1046 bp, Homo sapiens
ctctgctttttactttctattcctttttcccttcctggacaatttagtcaaaaaacatctgtattaggtatccactttgttgacccagagagggaggtgtttgttgcctgactagggtgaggagggtgtctacatgtgtagtggtggcctagtgtggggttttggagtttggatgtgattaagaagtgtgtctgtgtagaagagggtcccagtgtgagtcatgtgggttagagtggcataaggaggatgtccatgttggcggtggttgcagctgatcagtgctgtctgatggagcctcagtgggatgcaggggccatgtcagtgattggagattggttacataccaagggagtggggttgcaggttgatcaaataagcaagtatgagagtctaacttctcgttgttggagaaaggagttacaaaatggaggaaattagaaggaaccttgtgttgaattggagttaccagtttgaatttagttttaaatttacatagatacatgtagcaaacctggcacccagctcttggtctctcagtgccattctcaatgaaccagggctccttggagaaatggctaattccagggctagatcagggaaagtataaaataagcctgcaacatcttattgtgtaagaaagtaaggaagtgttcaaagactgatggggttatgttaacatgactcggaagacagcttgaatggactcccactaccaaatttggaagaatttgagcatcaaaataaataatgatggcaacataaacaggaatctatgagtctgtactgaaaaaagttaatgaataaatggaaagtctgatgaagggtaggatgattacacagtctcagattatctcccagcagaataattgcaaagagaaaaagggtgccttacagtagagaagcttagcagtgatcaaagcagacatagcagtgtgccagctgataggatgctctgaggacatcatggcatcacttctgtggtattcttgccaaggatacacaccttaaatctaatcaggaggaatcatcagactaaatacagttga

SEQ ID NO: 40610 - DNA, 1612 bp, Homo sapiens
atttcaagtaaaaatctttgctagttactgagttgctgtgatgttagactggaaataccattttaattcttaccacattttgtctgaggtagcaattgatccctaatttccatttcattaacaaggtactctaatgctactttattgttcaaattaactaatgggttttccattaagaatgagtgggtttataggccatgtgtttttagtaggtgaaattgtttaacatcctgttattagttttctgatttattttagaagttcttcaagttagtcttaacacatagccattctttcagcattaagagatgtttatctagtgccttgggaaatttggagcatttgaaggagaagatcatttttatttttgaagcacagtgaacatggggaagacaatttaggcttcctgagtcttgctgtgttctttttttgtgaatagtaagctgtgactattaatggtttcatagacttacaatttggaaattttggtaaccaagaaagattgtgaaacttttaacttcaagatcttatcttgtgggttgtggcatttgacattaggttaagaatagtcagactaacaggatatcaatgtactatgaatgaacattaagttaataatacttttctgccaaattcattcctcatttcagcacttcttgaaattttaaaaaatcgttcagtaagctcgagattgtatattttgaaatatgacttaaaatgcttataaatcatgtatgattggcatatcattgttactatatgtagaatataattcttcagtaaggatcactcaataataatgaatgaagcagtattttcacagtaccaagaaacctgctaatattttcagtagtaattaactcattgttcggtaacaaatggtatgtatggtgtttcttatttaatgtattttattatttatgaatatagaaagtatcagatatagtatgcaatggtttatttttaattttaaaatttatttgaatcctttttgttggtggctgctaccatagttagaaattaaagttattttcatagtattcttttttgtgattgaagaatgaattttctgaatagatcttcaaagagaaaacttcctaggtaaactcacctcaaggttgggatttagttttaatgtatgtatgattgaagaaataaaaggtaagaaaagagagaaaagtaaagaaaggtccaatgtggtttattacttatcttattttttttctcattcttctaattatttgctgtgttcctttattaaaaactctggcttttcgacatctttgttgtcacttttacacatatccatttttttctttggtgttatttctgcaccactgaaaatttgtctttcattttttacacattgtcaatatttgaaaataggatcactgttggtttagactcagtgctcatctgcatgatcagcctgtgtcatttcttgcgttaggccttacctcctttcagtgtgttgattttctaggttttatcttttctcatttagaggccaattattcttttttctttttgtttcaagcagttttatatcaccacctgttctttccatttcagaagttcattttctgatataaagctaaatagttttgctgac

SEQ ID NO: 40611 - DNA, 1083 bp, Homo sapiens
actcttggtgtataggaatgctagtgatttttccacgttggttttgtattctgagactttgttgaggttgttaattggcttaagaagcttttgggctgagactgtggtattttccaaatatagtgttatgtcatctgcaaacagggatagtttgacttcttttcttgctatttgtttggccttttgtttttttctcttgcctgatggccctggccagaacctccaatactgtgttgaataggggtggtgagagatggcatccttgtcttatgttggttttcaaggtaatgcttacaggttttgcccattcattatgatactggctgtgagtttgtcatagatggttcatattattttgaggtatgttccttcaatacctagttttttaagagtttttttttttaaacataaatcgatgttgaattttatcaaaagccttttctgcatctgttgagataatcatgtggtttttgtctttagttctgcttatgtgctgaattacatttattgatttgtgtatgttgaaccaaccttgcatccttaggttgaagcctacttgattatggtgtatgagctttttgatgtgctgctggattctgcttgccagtgtttttgttagggatttttgcatcaatttcatcaaggatattggtctgacatttttttttattgtatctctgccaggttttggtgtcaggatgatgctggctttatagaatgagttagggaatagtcccttctcaattttttggaatagtttgaatgggaatggtagcagcttttctttgtatatctggtggaattcagctgtgaattcatctggtcctgggctttttttggttggcaggcttattttctgtaatttctataacagtagtgaacaccgttgctactttccatctcattcctattttgggaccttacagacaccacttctaggtcaatgatcagaggaaagccatgattagaaggcccacgtagtccttctcttataaaatagtgactgaaatacttgtttttcttatatttgaaagctatagttgactacttgttttcagtttagaggaattacatagattataa

SEQ ID NO: 40612 - DNA, 1047 bp, Homo sapiens
cgccttggctacccaaagtgctcggattacaggtgtgagccaccgcgacgggcctctctcagctattttaatggattttaaaatgttgtctctatatctaaatagcatgctaaatgctacttcctggttttttggttttaggtatcacctgttgactttctggaagatgaggctattgttctctttttcagcccctcctcccgccctgtggtgtataagcacattagccttgtatccctccaatacaattattgtaattttagttagatcatttttgtgtgttattatttttttgagtacacgaaaactattcatagttaagccaaatagttggttatagttgctttcctttcttgcataacattttattttccctgtagttaatgattgtctttttttagaaattaagataattgtagattcacatgcagtgctaagaaataatagagagagagagttgccctgcactttttgccgagtttcctccagtggtaacattttgcaaaactatactataatattacagtaaggacatggacattgatacaatctgtcttactgagatttcctcagttttattttattttatttttttgagacagagtctcgctctgttgcccaggctagagtgcagtagtgcaatctcagctcactgcaacctccgcctcctgggttcaagcaattctcctgcctcagtctcccgagtagctgggaccacaggtgtgcgtcaccatgcccagctaatttttgcatttttagtagagatggggtttcacgatgttggccaggctggtcttgagctcctgacctcaggtgatctacccgccttggccttccaaaatgctgggattacaggtgtgagccaccatgcctggccttcctcagttttaattgtatgtgtgtgtgtatgtttatgtattttaagttctattcatttttattacttgtgtaggttacctgtgtagttttattacctgtgtacatggtaggttttcaccaccatagtcaatattctgaacatttctaacaccacagagatatgtcatg

SEQ ID NO: 40613 - DNA, 1910 bp, Homo sapiens
gaaatatttcatgtaagtcatatgtccagtggcatcctcagttgaatacatgctccagcagcggtatcaatacagtggccattcttctgtcaccagacctcacaaaacaaaacaacaaggaaacacagagaatttgcttttatttagtctgcagattgcttttttaaaaaacataattttatacgtgtagaagcttgtgtgcattgagtctccttttttttataatttgacaaatcattgctatgataatgtccactaaatcattcctagttttctaaatcactatagtcataattcatatacatagatgtactttattctttgcatgcttgtttctttggcaggtcaccattattgcagatgataactgcagatttttatgctggtcaagagaaagattaacatactttctggaatcagaacctttcttgtatgaaatctttaggtatcttattggaaaagacatcacaaataagctctactcattgaatgatcccaccttaaatgataaagtaagtgttctctgagtttattttgttaaataaatatgtatatgaggtatatttcactttatgaaatatgttttcctgaatttttagtaactagccatatgttaaatgtactggggatacttgtaatcttgagaggagaaagtattttgtaatgattagatttgctgttacttagtaaggagtctacaattgtcagggactagcatttatggtgataaggcaccctcttcatcaagagcattttaaggaagatggtaaaggagtaagagggggtggaggatggagtaagttagggaggacagggcagctggaggtttgcagacagagaaaggctgacagaccccagcgatcaggaagttggcctttgaaccctgctgtcttccagtcttgcatatcttcaggtcaggcgagaaagtgaaaggagaggtgtagagctgcatagatcttcagcaatttgcaatttgatcttaattttcccgtatctttttagaaagaaattaaaatgattacaagagagaatttttaaaaacgtcgtttctgtgataagtactgttacccagtgacaattgagtatatgtgccctttcaaaatcatcttatctggactgtttatcaaattaagctggtgcttatttcagttaattatttagcttattataaataggctactaagtatatttgattttgtataatatatttatagtaatagctaataataaaaatcatagcttatgtttattggccacctaatatgtatcaggtattcttttttttaaatgcactaacgtatttctaggaaaagtacatgctgcttaaatggaatgtatgattcaactcccataattctcagaaagcttaaaactttgctttgtagaaagccaaaaagctggaacatcagctcagcctctgcacacagatctccatgttggaaatgaggaacagtatagccagctccagtgacagtgacgacggcttgcaccagtttcttcggggtacctccagcatgtcctctcttcgtaagttatcccaaaactgatactactccagagttctgatgggtatctctggacatagacaaatgacaactttgattagaaaaataactttgcaggtaactatttgaaaggcaacctaaaggtaacaataaaaacaatcaaattttgtttagcatttcccccatattgcatatgagctaaaagccaactttagaactattatttctgtttcagaaattgaaattgttcactggttttgccatatactttgcttaaatagtggctcactggctgggcatggtggcttacgcctgtaatcccagcactttgggaggctgaggcgggcagatcagcactttgggaggctgaggcgggcggatcacgaggtcaggagatcaagacca

SEQ ID NO: 40614 - DNA, 1030 bp, Homo sapiens
tatatggctatatattatttgcatatatgataatgtattatgtatgtatgatacagtgatttaatggtggtataaaaatagagccttctaaatatcctaagccttcaaatagatgtgagggtattcatattttttaagtattcaaataattagttttctagttatttttcctgtgtttggattcagtcaccagtgggaatttgatggaagactagactaaataactttgtaattaccatggtttatgaacattggtgattatcttaaagactaattccctcactcctcccttccctacaagtgtttatacgtatatatgtgcctatgagggaatagttttgcactatgctaagtattttatgtatttcatttcatttgatcataaggcaaatgaggtattattaccatcttttaacaggtaaggaactgaatacatttaatatgtgacagagttggatttgaatctgggtctgtctaattcataagcactagagaagtctatttaattcacagaaataattttggtataatacctatgaaggtaaaaagatacaattgccatttttacgattttacttttgtttacttgtttttacaggaattttcaaaatgaattatacagagtccagcccattgagagaatcaactgccataggttttacacctgagttagaaagtatcatacctgtgccttccaataagaccacttgtgaaaactggagagagatacatcatctggtttttcatgtagcaaatatttgttttgcagttgggttggttattccaactactcttcaccttcatatgatatttcttaggggaatgttaactctaggtaagatacctaactgatactttatgtaacttttctgtaactgacataagatgggctttacattgagagcttcagagtattctttgtcaggcccatagcaagccaaaaaatgtaagtctttgttaatgaattagcagtatatcaattagcttagagcataggccttcacatgccatatctctcccttacttactt

SEQ ID NO: 40615 - DNA, 1025 bp, Homo sapiens
gtttactttgcatttcattgagcatccttgtatcttcatttacatttcctattcctttataactcgtaatcttaacaatttaaagagaaaaaaacccagatgagcttggaacaactgtgtttatttgcacttaagtttgtcttcatcatttgtagctcagtgtgctaacttactttgcagtgaagatcaactctagtgcttaggaaagaaatccattgtgccactttggcatgtcagcatttatttacgcaaaacatgacctcaggcttacaggcctttaaggcagacagctggttgatgaatcatgttggacattcatatagtgctgctggcacatgtcagaaggacactcctgctcatcacctgcccctgtcagttcttccacttctaataaagcatatctgttttggtgaccaaataaaaacacaagtgaagaagggctgggtgtggagtaatttaatcagggcaagtcagcacgctgcattgagcagtacagtatcaaggataaaaagatggtttggtaacagctgaatgaaacgaagtagattagtaaagatggaagcacagttccccttataatcataatgggtcatgaccctggaatgcagaagccccaatatatcctacaaatcaagatttttaaggagacaggattcccagaagttcccttctgaattgccacgaacgttttacatggcctttctctattagcatcattttaacatttcgctgaggattataaatttttaaggaagttcaaaccaaagttcagagctccactagcaaatctttttaaactggctttcgtgggtgtgtttggtatcctgaagaattgattgatttaaaataccctagttttgaaacagcagggagactgacatttgcagcctggtattttgcagttctcactactcattgtatttgaacaataatttttctttgttgtaatacccagtagaataaaattttgtgctttgtttaaaagaggagaaattgaacatgttcaggatgctggcctgtcttca

SEQ ID NO: 40616 - DNA, 1036 bp, Homo sapiens
gggacctctagaacctgagagcaacccccaaccaatagccatcaaggaaacaggacctaagtcccacagccgcacaaaactaaattctgccaacatcccgagactgcaagtaggttttttccagagtttccccgtaagagtccaaccagccaacaccttgactttgaccttctttgaccttggaagacccagagcagagaacccagctgagccaacccagactgctggcttacagaactgtgagataagaagtctgtgatgtttcaagctgctaaaatttgtggtaatttgttactgtaacaatcaaaaggtattattatactttatatcaaatatatgggatttccttttctaaattaagtaaagaatatatgctcctgaaatggcaggtcaagagtaggggaagggggtgttgagtatggtggctcatacctgtgatcccagcactttgggaggccaaggtagatcacttgagcttaggagttcaagaccagtccttcatgggcaatgtggtgaaatactgtactgtctctacaaataattagctgggcatggtgatgcatgcttgtagtcccagctactcgcgaggctgaaatggaaggatggcttgagcctggggggacagtgagccaagatcacaccactgcattccaagaccctgtctcaaaaaaaaaaaggaatatattcaaatacaattaaacttcttttatgctcaatatagctacatatgtttgaaactgcaagttgcattattgaaatcttacacaacttccattgtatcctgcaaccactatgctgataacaatgagtaaacagacattaaaacttctttttggcccttcattccccatatgtaagagttttatttttaatcaccagtgtttggctctcagactggcacaagaagcctgttcctcctattagtaaactacaaattttgatgaaaataactttagtttctaaagttttgtttttttgagacagagtcttgctctgtcacccaggctggagtggaatggcgccatctcggctcact

SEQ ID NO: 40617 - DNA, 1027 bp, Homo sapiens
taaaactttatttactcttttgcttttgtcatcttatctctggttgacttctctcaggatcatattcagggattggcattcatgccaacgctggcaccagccaccttctaactcaaattcagaagaatattcacagatctgttttggaaattgtagcccaagacctctgccccttgtgcggtgagtctggatggccacttctgtactcataaaagcaggtgatttttctacctgcagggttacatctgtcccagtgtctctcaccctatttctgcctccctaataggtgatggtagacaattaataggattagcaggccatctagaaacacaactgtgatcattgtttagatttgctctgcctagagaaggcttggcagaaaagagttgggggtaatcttttcctgcttttcttaaacccccggggcaacattttagtttgccagcaaaactcaactgtttttggctttctgccatactgttttagaacaaaaggagaggagagacaataggagcttcgtgtgggctgtccacctgctacacagatttcttccctcccctcccctccacttgctttgcctggagttacactgatggtcgacgggtgatgggtgagtaaaaatagacccagtgctggggatattccattatctccctaaaggaaaaaccattactggcattactgtcattggtctgtgaaggagggaggaaaaaatttccatctccacaagtgtagtcttttgatttggattaagtgtaccttgacctggttttagggaggtagactggattattctctgttcaccctctgtgctgactcaatgtaagatatagacagaaatgttgtcatagttataaaaatggtagtaaaatattgtgaagtggaaggcattgtgagggtacctcatagaaacacatgcaagttccttgtcattgtctgtgttgggtacatgctcctccacacaacttttgatgctcttcttcatacagccgcgccccagtgccgccccgtagccccggaccaccat

SEQ ID NO: 40618 - DNA, 1024 bp, Homo sapiens
atccttcacccactttttgatggggttgatttttttattgtaaatttaagttctttgtagattctagatattagccctttgtcagatgggtagactgtaaaaattttctcccattctgtaggttgcctgttcactgtgatggtagtttgttttgctgtgcagaagctcttcagtttaattagattctatttgtcaattttggcttctgttggcattgcttttcgtgctttagtcatgaagtccttgcccatgcctgtgtcctgaatggtattgcctaggttttcttctagggtttttatggtttttggtctaacatttaagtctttaatccatcttgaattaatttttgtataaggtataaggaagggatccagtttcagctttctacatatggctagccagttttcccagcaccatttattaaatagggaatcctttccccatttcttgtttttgtcaggtttgtcaaagatcagatggatgtagatgtgtggtattatgtctgagggctctgttctgttccattggtctatatctctgtttgggtaccagtaccatgctgttttggttactgtagccttgaagtatagtttgaagtcaggtagcgtgatgcctccagctttgttcttttggcttaggattgtcttggcaatgcaggctcttttttggttccatatgaactttaaagtagttttttccaattctgtgaagaaagtcattggtagcttgatggggatggcattgaatctataaattaccttgggcagtatggccattttcacaatattgattcttcctatccatgagcatggaatgttcttccatttgtttgtatcctcttttatttcgttgagcagtggtttgtagttcttgaagagatccttcacatcccttgtaagttggattcctaggtattttattctctttgtagcaattgagaatgggagttcactcatgatttggctctctgtctgttattggtgtataggaatgcttgtgatttttgcacactgactttgtatcc

SEQ ID NO: 40619 - DNA, 1053 bp, Homo sapiens
ctcgagattcagacttctctgcctttccttcctccaccctttttcatcagggacctttcaagatgtctcaaggccagctgtcttcctggtagcttcctgggtacctcttgctccaggggaaggcatatccatgggttactctgttctggaggtacaggatgtgttcactgccctcctcactttcagccagggacctcgggaagcctcccacattcagtccctcctgcacatgtccaaaatgctgggctcaggaacaagagctcccttgtgcccctggggtgtaacatgaaacagctgccattgggctttgatgggcagaggtgccagttatttaatatagactgtgaggctttacttgaaggacagtttcatggcaggagagaaattgtcaggttctattggaccaaaaaaacccaaaaacccacaaagctctgttttaaagtgaattgtgagcatctggggagaaaaaaaatcctaaagaaatcaaacactttgtggcactgttcccagcagagggtgctctagaatgaagattgtgaaaatgcatcatccctttagaaaggattaaggaaaaaatgcccagcttctttgtgattatctccctaaatcctatattgagaacctaattctgttatacctaattcttgaaaagtttttttttcaaaagtaatcctgaatcttagtatctgttgtgtctccataagccatttttatatgttcacctgtgaaccctagtaattaaaaacatatgtattacacatatattaacatataaagtgtgttgcctgatgcttgacttatagtaggcatgcagtgaatgttaatttccttactcttcccatgtcccctgtggaagttcatgcacatgaagaccagcagggtctcaccttccagaacagacacagaaaagtccagtggtgttcctggtggggggtccctgcctcctctgccccttgctggttggctgtttttgacttggaccagtaattgctcagtagccctcttcccagttggcacagtccatatttattccccaagtacttagcccttgcc

SEQ ID NO: 40620 - DNA, 1031 bp, Homo sapiens
gattattttttcttcaactgttttgacttttattgttgttgggtttctttcttggaatagatggggaaaaaaagaatcaagtgatgattcatggaattgagccaatgttggaaacacctctgcagtggctgagtgaacatctgagctacccggataattttcttcatattagtatcatcccacagccaacagattgaaggatcaactatttgcctgaacagaatcatccttaaatgggatttatcagagcatgtcacccttttgcttcaatcaggtttggtggaggcaacctgaccagaaacacttcgctgctgcaagccagacaggaaaaagattccatgtcagataaggcaactgggctggtcttactttgcatcacctctgctttcctccactgccatcattaaacctcagctgtgacatgaaagacttaccggaccactgaaggtcttctgtaaaatataatgaagctgaaacctttggcctaagaagaaaatggaagtatgtgccactcgatttgtatttctgattaacaaataaacaggggtatttcctaaggtgaccatggttgaactttagctcatgaaagtggaaacattggtttaattttcaagagaattaagaaagtaaaagagaaattctgttatcaataacttgcaagtaattttttgtaaaagattgaattacagtaaacccatctttccttaacgaaaatttcctatgtttacagtctgtctattggtatgcaatcttgtaactttgataatgaacagtgagagatttttaaataaagcctctaaatatgttttgtcatttaataacatacagttttgtcacttttcaagtactttctgactcacatacagtagatcactttttactctgtgttaccattttgactggtcgtcattggcatggggtggatatagggcataggattacttgtctcagaagctgtcatagaatttcttgctgccaattaaaaaacctgtgttctttacacactacacgtataaatattgtaactgttc

SEQ ID NO: 40621 - DNA, 1025 bp, Homo sapiens
ctgagtgtctactgtttttattttgtttgttttgttattttagtgttcctatatataatcctgaccactcttgttgaattttttaaatggtgattatgaacatcagacacgtaaatgaaaagcattcaagtgctttgaactgacactctcagaatacacctttattctgctcttatacccaggttacaagacaagattaacgtgaccctacacaagaaaggcacacaaatttgtgaagctgttcttttaaaagagattctttgttctgttaaatttctaggctgctctacgtgtacatccttttctaggggatacacagtgtgacttcccttgtggttttttttttttttttttttttttagaggggagcagtgaggcagcgcagccacacaacctaatccacaaaccttccttttaggtgatttcaggtgctgtaggtgagtacatctgtgtgacagacttctccccatgcaaactgtcaaatgcttctcttgactgcagaacacacacttcattgaaatgacatagataatgcctattcttttcaggtatttttgatggtatctttcataccaggaggaagccacatctctaacacatctcagtatcttttctttagaaaaaaacttttatctttgcttcttctttttattacgtattaaaaaaaattgtcatttaaaaatctatgtagagtatccaaaacatcgagtcactgtttcagtaaaaaactgtttactgcctggttcagttcacctgtagtattgtcagatgtgtcaaacatgaagcattttgacacacctgcattcaacttaagttgaaagcgaaagactttaagattgggtgtgtatggataagaacttgctgtcatcacatgatgaaaagagaaagtacttcataaaagttatgtggcaccattgtcttctactccctacaagtgattcagtgatgaaagaattttgtctgatttcatcatatgaaagtcaaatgtactagtatttatgaatacgtgctttaggtcattgttc

SEQ ID NO: 40622 - DNA, 1052 bp, Homo sapiens
ttattcatgaggccatgtttatcatcttttaagacctggttctgaagagggatttaaaataagtacagtgattatagcttgtaactacagtataccctcttttgctagtgaattctttgacacagaatgctccttactcaaccccttaccaaagtctcttttgcatttctcagatggataaattgtcacctaaattatacaagaagcacattaatatttgatgtatactattttcttagaaccctgtttaataatcataagttaagcctgctatatattaaaatgtttatactattttaaaacttccattgtggaaaataagcatataatttgacttgatgaattggtggtattattattatctcaatctgaaatactgttgggatgtatcagcctactttggattcaatagaccattctctcttcagatattgtattccaaaattttgaatttttttgtggaaataggtacttacattgtaaataatagttaagttcctaggacaagccatataagtaatagtgaaatagaactataaactctgacctggatttataacattgttcttttgtaatgccagattctaattcagaaatctataaaaggaagagttcccttactatggcgtttctcttccccattcaggtcacagcagtgtgggtgggaatccagaggttccaagctagtgaggaagaaagtgaagatgaggagttcttggctaccctaactggtggcgagcgttctggaaaagctcgcaaacagtggacgcagtgagtccacaatgtgggtagcaatttgttagtaaggacatttttaatggtcccatatttgatacttttatttcatattactccttataatgaaattatgtattttagtaaacctttttaaactagcatattgtaatttcaaaacttttcagcttcattttcagtatcagaacatgaatattaaatgagttttggtgaacagttaagacaaagttatttaaattcctacaggtaacttaaaatcaccatgatgctatacaatttttaagaaaaaaacttgt

SEQ ID NO: 40623 - DNA, 1027 bp, Homo sapiens
aatttttggggtcaagttcgggaagtttagggccattattttttcagatactctgaccctttttctgcatcttcttctgggcctctcattatatgtatattggtatgcctgatggtgtctcttgggtctctgagcctcctttccttccttccttccttcttccctctctttctcgcaattgacctatctttagatttgctgattcattcttctggctgcccaaatcagctgttgagcccctcaagttaattcagtttttgtgcttttcaactccagaatttttgtttggtacttttttgtaactcctatttatctctataatttctatttctgtttgggaatgatacatgcaacaacatggataaatctcacacaacattgtgttgagtaaaaagagctgatataaagagaatatactctatgattctgtttttaagaagttctagaccagacagaactaatctgtagtgacaaaaagtggttcttctgaaggatcagaaatattgttctgatactttcctgtagttctttagataaacttttttttagttctttgcgcatatttaaaataactctcttaaagtctttgtccagtaagtccagcatctggtctttttcagggccagtttctgctgctttttccccccagtttgtggcttatacttgtttctttgcatgtctttgtaattttgttgttgttgagacctgaatattttatatagtataacagaataactctggaaaccagatgcttcccccctttcccaaggtctgtttttgttgttgctgttgcttgtttagtttctttcctgaactaattctttcaggtttttattttttatcacacaggcccctaaagttactgcttggtgagtttagtgatcatctgatgattagaagagattttcttgaatgcctagaactagagtatcttccaatctttgccaggggcctatgtgtgaatgttggggcattgccttcaatgatacggcaagcaatttataactggattttactttcttcttgt

SEQ ID NO: 40624 - DNA, 1064 bp, Homo sapiens
aatctgtgcttaaaagtatgatttgttcacttgaaccctgggaagtggaggtggagattgtggtgagccaagatcatgccactgtactccagcctgggctacagagcaagactccgtctctaaaaaataaaagtaaataaaagttttaaaaatatgatttgtatctcatatgtaaagacaagaaagtatagaatggatgcttagtgcttaaaaggacttcacttctgattcaagtaaatataacagttataagataaatactggtatgttaaagacagatcactcaggcatctttttgtaatgatagtaatctaaggtcagtctatgaagttaatttcatttcttcccagaatactttaaatattgattaaatacccaagaagaagtcttctttagtaaatgtagagaagctaaggctctgtactgtgcttatgtctttatgctcctcacaatgcctctcacaaaatagggactgcataaatatataaactatatgaacaaactaaggaaatcctaaccaactatataagcagtgattatttggggctcgtaatatgatgtactataatgttcatatcatacattttatggaattcgggactggattttcaattaggcaataattgttattttctactattgctctaaaattgtacaacaaagtattatgggatgtagagtgatttttaaaatctgtattatagcactttatatcttgtaaaatacctttatgctaccttgtttgactttcataacacttctgtggggtagacaaggcaagtattattttttaagttggaggtcaatgaccagacaaaggacagccagccggtaagcaatggaacaaggactaaagtacaaatctgcctcaaaatagtatatactgcatgtgcatattataaagaaatatcttttttgcaagaagatgaatatgtttattgaggttttagcagttgcatatgagatctttcatgggcatagtttggttcagttaatgaagatttcattggagcattgtgtgatttgaattttaaaggattaaagaaatacagcccaactttctt

SEQ ID NO: 40625 - DNA, 1047 bp, Homo sapiens
tttggtatcataaaatgagttagggcctcataaaatgagttagggaggagtccctctttttctattgtttggaatagtttcagaaggaatggtggtaccagttcctctttgtacctgtggtagaattcagctgtgaatccgtctggtcctggacttttttggttggtaggctattaattactgcctcaatttcagaacttgttattgttctagtcagggattcaacttcttctggtttagtcttggcagtgtgtatgtgtccaataatttatccatttcttctagaatgtctagtttatttacatagaggtgtttataatattctctgatggtggtttgtatttttgtgagatcagtgatgatatcccctttatcattttttattgtgtctatttgattcttctctcttttcttctttattagtctagctagtggtctattttgttaatcttttcaaaaaaccagctgctggattcattgattttttttttttgagggtttttcatgtctccatctccttcaattctgctctgatcttaattattcttgtcttgtgctagcttttgaatttgtttgctcttgcttctctaattcttttgattgtgatgttagggtgtcgattttagatctttcgagctttctgatgtgggcatttagtgctataaatttccctcttagcactgctttagctgtgtctcagagattctggtacgttgtctcttttttctcattgatttcaaagcacttctttatttctgccttaatttcgttatttaccaagtagttatttaggagcggttttcatgtagttgtacagttttgagttagtttcttcatcttgagttctaatttgattgcactgtggtctgtgagagtgtttattatgatttccattattttgcacttgcagaggagtgttttactttcaattatgtggtcgattttagaatacacatgctatgtggtgctgagaagaatgtgtattctgttgatttgggatggagagttctgttgatgtctattaggtccacttggtccagagctgag

SEQ ID NO: 40626 - DNA, 1071 bp, Homo sapiens
gtcagaatgagaagttctccagagtccaggaggcaaagggaatgctcacagcagcctttaggaggtgggtgctgtggtggttgggtagttgtggcagcgcctacgtagcctatagtcaggtaggcgagaggaatgtctgtggcatgctaggcatctgggtgctgggtgtccacccaggaggagcagagcttgtgaccctcatctgggcaggtgaccaggaaatggaggtagcagtgtgctccccatcccctttctgcccagctgtgacattgttggtgtgctgtccctgcgccagctggggatgcagggagtggcctacacatctctcttgtagaagcttttctgtattgtggggtggagtctgtttctacgcacggagcagactgactttccagagtgctaatggaggcagaaggagatgtggtttcctggtgctgttggacagagggactcaaatttggaaacaggcccatggttcatcagaagaagcttaacaaaagaatgaagactctattatttcctccctggctggctgagggaaggcacagaaagactcgatttgaagccaggttctgccactcagtgatgtgacactggaggagttacctgtcctgggtttctctatttgttgaaattggaactaaaatagctcagggtgaggcacaggcacacatgcagtggccagcccagtgcctggtgtgaagttggtgggctgcagatgttacaggggatgctcacctcactccccactgcgcaagccaggggcaggcgcgaggtttccaggccttgcaaatgggagattccccagcttcttaatgagtgaagctgatttgctggcccggagggaaggggcccaccatgctgtgttctgggctacttctgggctaacctagcatctgtcactagtctataaatggacacggaagtgttttccaaagcacaagcactcggtgtcttgaatgcccaggcagccgcaccagcaccccttcctcccacctcagctgcatgagccctctggggtttctgcccactgcaggtggctgagatgtgtgctcttccttcatcacttta

SEQ ID NO: 40627 - DNA, 1047 bp, Homo sapiens
tcctacatgtggtcatccagtcactgaaggcttccaataatagggaacccacagcttgtcaaaaataatcattctgttgttagacaactctagtcatttgaaggttcttttcttatttataagtggaatcttcttccgagaaactttaccttgttgctgtttgttctgtcccctgaagcacatagaacaggactgttccttcttccatttaattacttcagatatttgaagatggcttttatatcctcccttcctccaggttaaacattccctaggtgacatgtttccaaatccttcttcatcctaatactggacccaatctatcatgccagtgcccctcttgactcatggcccccaggactgaaaatagttttctaaacattagttgaccgtccgtgtgctgtgagaccattcctgcctgtgttttggacatgtacacctgctgatgctgccaaagtttgcatttgcatttttttgtacctacatcacagccttggctgataccaagactgtggttattaaagattctcaacatttttcatgagtcactgccaaattgcagcttatacttttacaattaatttttgaaacctaaatatacaactatataattatccctgttagattttactggctactatcagtcttttgttcaacatgtcaataccgttaaaattttgatactatccatgtgttacctatctctcttggctgtgtgacatctgaaaattaaaatttaatatgcatttcttcttcatcttcattcaagtaatgcatagaaacgtgataagaagaagaaaccaagcattaagttctggtagcatgacactagagactgctttcctgttctaagcgtttttttttttttttttttttttttgagacagagtctcattccatcaccaggctggagtgcagtggcgcgatctcggctcactgcaacctctgcttcccaggttgaagcaattctcctgcctcagcctcccgagtagctgggactacaggtgtgcaccaccacgcccaactaatttttgtatttttagtaga

SEQ ID NO: 40628 - DNA, 1074 bp, Homo sapiens
tgtagtcccagctactcgggaggctgaggtgggagaattacttaaggattacttaagcctgggagatcaaggctgcagtgagccatgattgcaccactgcactccaccctgagtgacagagcaagaccctgtctcaaaaaaaaaaaaaaaaaagctggttgtggtggcattttgggagcccaaggcaggtggatcacaaagtcaggagatcaagaccatcctggccaacatgatgaaaccctatctctactaaaaatacaaaaattagctgggcgtggtggtgtgcacctgttgtctcagctactcaggaggctgaggcaggagaatcacttgaacccaggaggcggaggttgcagtgaactgagatcacaacactgtactccaacctgggcaacagaatgagacttcatttcaaaaaaaaaaaaaaaagtttatttttgctaaatatacttgaattttaaatgtattttataatggactgagtttaatgtgtaggagctaagagagtttctccttcccctctgaaggttcaagcctgcatagataaactgacaatagacagattaacagggaaaatttagcacacaaatgtattaatgagcacatggacctgacagtcctgcagatatgagactcagggccagatggttgagacttaaatactctcttcatagaaaggaaggtagttggaggtctgtaggcaattttaaagcggtagtaaatgatttttaggggaatgaatgggctcaaagacaagacagtggtttgtaaatgattctctttggacgctgaatgggatggaaggacaaaccagttatgggaaagtgaggggcagaaattcacagtgaactaaggttgtcttaatatgcagataaagcgtcctaggtaatctctcagagctgccctcagaagaatagatgaaaagtctctctgggcatggtgattacttttagtcttttctcttttttggcagtgaatctttcctggttgtttttttagattctcagggagagggagtcttaagacaattgcatttctttctctttttttttttttttttttttgggatggagt

SEQ ID NO: 40629 - DNA, 1030 bp, Homo sapiens
tttttatatgatgtgagataagagtctacattgttcttttttcttttttagttttttattttattattattttttgagatggagtctcactctgttgcccaggctggagggcaatgttgcaatctcagctcactgcaaattccacctcctgggttcaagcaattcccctgcctcagcctcctgagtagctgggattacaggcgcacgccaccatgcctggctaatttttgtatttttagtagaggtggagtttcaccatgttggccaggctagtctcgaactcctgacctcgtgatctgccaaccttggcctcccaaagtgctaggattacaggcgtgagccactttgcccggcctgttctgtgttttaaaaataaatatatgaatattcagttgccccagcaccattggttgatatgaccctttttcccattgaattgtcttggcacttttttcaaaaattaattgaccataaatgtaaggatttatttctgtactgaaaaccctgttccattgatctctatgcctatcattataccaatactacactacttcaattactgtagctttatcgtaagttcaggtagtagtacaagtcctctaattttgttctttgttttcaaggtagtgttgcctattctaggcactttgcatttttacttaaatttataatcaccttatcaatttctttttttgagagagggagagtgttgtccaggctggagttgcagtgacatggtcacatctcactgcagcctcctgggaccacaggtgtgtgcctgtgatgcctggtatgttttttgtagagaatggggtcttgctatgttgcccaggctagtcttgaactcccaagctcaaacaatcctcccgccttgccctcccaaagtggtgggattacaagtgtgagctgccgtgactggcccacattatcaatttctgttaaaagtcttctgggattttgatagggattgtgctgaatttatatatcaattgtggagaactgacatcttaacaatactgagtcttccaac

SEQ ID NO: 40630 - DNA, 1030 bp, Homo sapiens
tcctgtcagctttaggtaaaagttatagatggtacttttgtagaaaaagtagataggcccagctggagaattcctggaggaatgtgtgagaatacaagcaacagtggagaacaagataagactacagtctgtctctagattcagaacaagtcctgaggtataaatttaacacgttgtttcctgtttataggtaatattaatcataatagtataaaatgagaagtaaaattattaagttaaacttattttcttaagttagctctatttatttaaacttttggaggccgatttttactctgcctcgtagactaagaagttattcagtattaacatactttaaaaaatggattattacaccgggtgcagtggctcacgcttgtaatctcagcactttgggagtccaaggcgggcggatcatgaggtcaagagatcgagaccaccatctgagccaacatggggaaaccccgtctctactaaaaatacaaaaattagctgggcatggtggcacacgcctgtagtcccagctacttgggaggctgaggcaggagcatcacttgaatccaggaggtggaggttgtggtgagccgagatcacaccactgcactccagcctggcaacagagcaaaactctgtcttaaaaaaaaaaaaaaaaaaagattattagacttgtcaggcaaaaataaaagtcaagtgtgtaggtttagttttggcactcttctataattacctgtatacattgagaaacatgaaaatttgagacctagactttgaaagtggtaatttgcattctgttttaaatttacttatttgattagaacctaatatcaacatttttaaactctctaatatagaaggattaggatttggcaagaattatgtgatactagggccgggcgcagtggctcacgcctgtaatcccagcactttgggaggccgaggcgggcagatcacaaggtcaggagatcgagaccatcctggctaatacggtgaaaccctgtctctactaaaaatccaaaacaattagccgagc

SEQ ID NO: 40631 - DNA, 1050 bp, Homo sapiens
cctgagtagctgggactacaggctgcgccaccgtgcccagctaattttttgtatttttagtagagatggggtttcaccatgttggctagactggtctcaaattcctcacctcaagtgatccagctgcctcggcctccccaagtgctgggattacaggcgtgagtcactgtacctggccaatatttttgtttattagatagattccatgatgtggatgtactaagctaaaattataaacattttttagtgtttaaattcactgccagattgcatttttgaggagttctaaccaatttgtaacactatcagcatgtatgagagtactagtatcactatatctttgccaatattggtcattatcattttagaaagatttttgctaatcaggtgaaaaaagttaccctgagctacatgtaatttatttgaacattatgtttctatttatttgtttatctttgtatgtcttgtttacatatgtcttgtggtcttgtttcttattaatccttaggagacattatatagtgaaattattgtcttatatgctgtaagtgcttctttaaaaaaatttttattttttataaaaattaaatagagacgggggtctcgctgtattgcccaggctggcctcaaacttctgggctcaagcaatccacccgcctccacctcccaaagtgctaggaatacaggtgtgagtcactgcacccgcccagataagtgctttttgaaatccaatttttaaatttacatgttgacatctttttttttttgtagttcttctattttctctacagttaagtttttctacctaataaaggtctgtggtaaatacccagttctgttttatttctttaatggtttagtctctgcctttagcaaattgctagcaagctaagaagtttcgggacttgtgagtctagatctagctctgtgacttactctaccaaagcaagtgccagattaatttgttctatttacatactttatcaaaattggaaacagtttttttaaaggactggagaagaaatctagcaattttagcacagtcctaag

SEQ ID NO: 40632 - DNA, 1008 bp, Homo sapiens
aaaggtttacttgtgttatagttgatcaacaaatgtttattgactcactactgtgtattaaagcacaataagggatatgttgaggtaaaaaaggttcctgcaagagaacttggggaaactagatgcaaataatgatgcagtttaatgatacaaggtccagtgtggtggcttatgcctgaataccagcactttgggaggctgaggtgggaggatcacttgagcccaggagtttgataccagcctgggcaacatagggagatcctatctctataaaaataaaaaattaaagaaattagccggatgtggtaatgctcgcctatggtcccagttacttgagatgctgtcatgggaggatcacttgggcccaggaggtcaaggctgcagtgagccgtgattgcaccactgcaatccagcctgggtgacagagtgagaccctgtcccaaaaaaaaaaaaaaaaaaaaaaagatgcaagataaaaataatcataattgttagtaattgctaaatgaagtgtttagctaagtgctacaggacttcagggtagaacactgtgggctggctaaaccaaaggctttatggaagaagaaaaattttaagaagctgctggaaatgggtagaattgtatagatggaaaataggaagaagttgtttctgctctgccttttacctggaatgccaagtgtggaaatcaggaagaggagtggtagtattatgttacttttgagtcaaaatcagcagttaatcatgtgggagaattttaacttaatgagcctaagaaagcttcttgatgatttcagcatattgtaagtcctcttaattcaggtctgtaaaacaaaaacaaaaaacttctttaaatgctggaagggcttcgggagagtgatataatccaggaaattcactatgaaagcaacaatattttattattaaacttggacatttcaagtatttaactgagggaaataacagacaaagaagccatgtgtctctgctggagaaactttattttcc

SEQ ID NO: 40633 - DNA, 1035 bp, Homo sapiens
gccctgtcctgacctttgccttagtcacggcattcatcttgtgtatcattcttcaaagcatagaacatcatggttgaagatagtgatcaactttttctaaaaacagagcacaaaagaatacacttaaattgtagcaagtgctgattaaaattaagtggggaagctttttgaagctataccacttgttagcaatggattactacaagatgctgttgcatccttttattttgaaatcttccatgggattgacttgcaccttaaagacagagtgaaggacaatataaaattccttatgagtctctgcagtgtactagtgagtaattggaatagttcagaaaattttgactgtatcttatatacactatgaaaatatattagttttaaacattatagatatagatagaatttcagaacaaattctaatcagctggtgcacaacctctgtaaaaaatgtgaaatttgtcaatccaaaatttgttcctctctcagaaacagctgtctctaaatagggcctcatattgttggtaaattcattataaatgctggaagcaactccagtttgatatggttgggatttgtagaaataatgtagacgtaggctatctacaaaccattttttttaaagtaacaatccaatctaaatactcatatgcattacaaatgagtgtcataaacttaaattctggaacctccaaaaatataagaaacctctggaaatataagaaagggctcatttaggatggaatgacaaacaatagggagagttctcattttggtttctgcccacctgctcccaccccttaaccaaaaaccaaaacaaaatatctggaattatttaggtaatatagctattcttaaaagaatggatttctaattataaaactctttgctggcacttaaatgtccttttagatagatagaattcatgattggtaaaaatatgtttgatttcataaaggctctctcaaatcatgagtgcagattttggaagtatcagggacaagactctattagtcaattttcatgctgctgata

SEQ ID NO: 40634 - DNA, 1068 bp, Homo sapiens
gatgtgcttttttgaaagctgactttggcggctgtggtggttgtgaattgcagaaaagaaaagctagaggcaggaaagcctggcagaagactgctatggtttattcatttcttctttcagcagctagttaagtgtgttctctaatggccaagtactatgcttgttagtcagggaaacaacaccagacactgacccacatccctcctctcccttcccctccccaggatttatattcaaataagggaaatagacatgtaaaacacaaagtgcaataaattgttacatatgttaggataaaagtgtttccaaataaaatgaagacataaacaatagagtggcaaaaggtctcaacgagatgatttaaacattgaaaattgagatgttcttgcggatagaggaatgatgatggtgagttataaacttaggcagtagtgatggagatgaagtggaaagactggattcaagctacatttgtgaagtgaggttggtaattgcagacttgataattgtgagagtgaaagaacagaagaagaataagctgagcaattgagtatgttgagatactagcagaagtatgttgggtgtagagtgtagggggaaattttgtagacctgttgaacgtgaagtatttgcagcaagtggaaatgtccaaactgaagttaggaatgggttaggtcctcctacaggaggtaaacactaaggctagagttggaagtactcaatacaggtgagatttaaagccataggggtttctcatctctcagggaggaagtatagaattatctcagcattgtttagttgcaagcatagaaattgcttttgttttttgttttttgtttttttgtttttgttttgagatggagtcttgctctgttgcccaggctggagtgcagtggtgtgatctcagctcagtgcgacctctgcctcctggattcgagtgattctcctgcctcagcctcccgagtagctgggattataggcatgtgccaccatgcctggctaatttttgtatttttagtagagatagggttttaccatgttggtcaggctggtcttgaactcctgatc

SEQ ID NO: 40635 - DNA, 1045 bp, Homo sapiens
ccagataccgtgtgcagagggaccactcgccgcccacaactgatccctgtcactgacgacctttgctggcccagagcggcggggtgggaggagctgaacctcccaacccgggttcacctccaaagcaccgcccctgcgggggcgttctcgggtacgccgtaaagtagagagtatacttaacaacccgcctctgtctttacggcaggccgcattccatgcctccaatatggcgtcctccacataggcagtggctgtggtttctaccccgggtggccgggggcagtgctgagctgggactgttgtttgcccagcctgggctgcagaaagcagcagttaaagttcgtttctggtcactgctccaggaagccaccttactctgagggtcaagaattgccgcttccttttagttactgtaagttcctcctctgcccctggtttgtttcccgcggcacttctggatacccccaggtcccagacccttccagactcaaaccatgaactttcggcagctgctgttgcacttgccacgttatcttggagcctcgggttccccgcgtcgcctgtggtggtccccgtccctcgacaccatctcctcggtgggctcttggcgtggtcggtcctccaagtccccggcccactggaatcaggtagtgtcagaggcggagaagatcgtggggtaccccacgtccttcatgagccttcgctgcctgctgagcgacgagctcagcaacatcgctatgcaggtgcggaagctggtgggcactcagcaccctctgcttaccacagccaggtgagctacccctctcccgctgacacactcgcactcattggaatacttttttttctggcgggcatacgcattctagctctctcagactggctcctgatttatctctttttagtccttcctttttactcactcctcctagacattccgtgttgtctcttctctagtccacttaacgttcttgctcagctgagtgcataagtggttttctttgaaacacttgtatgctttcctcgattttgcttcttaattgttgag

SEQ ID NO: 40636 - DNA, 1048 bp, Homo sapiens
tttttttttttctgatttgggtccatgatcaaaacatttgggcaccactgctttgtggtattgatagggtgacatttgacactcaccacctgagatcacagagtgatatactctggagttggtgggttggcattcactgtgtgcagccctactgtagctgccaagagcaaagtgagacttttatgagatagagctgagtaggtctggaggtgggattgataggcaaggggagggttctgcacaacggttgtctgtggagtgcaggtggtgcaggtatggagcagcagtgctggggacgacttgctgggactttgagcaaatcacagcctgttgctggtcctggcaatcagtgactgctgcaaatggaaggtgagtgtgggaaggactggccactctgttcagcacgaggttgtttagcgttaacctatcagcctgggtacacaaagggagctgtagccctcataccttacccgaaacacctgaggtttacactttaacatctggataatagcagcaatggacttcagtgtgaacagattccattaagagttaacttcaagctatttctctgtattttccagcctcgttccagtagagggcgatagggctgtaattttctttaacaaagaatggtgtgtttcgtttcagactaaaagccacgattaaagaaatgctttgtaatttatttgtatctgcaccttctgggatttcctccctctcttttgatcttttatgtttccccctaacctttttcttctttacatgtgtcctttgttatttatttattatttttttagaggcagggtcgtgctctatcgctcaggctggagtacagtggtgcaatcatagctcactgcagcctcaactcctgggatcaagtgattctcctatgtcagccccctccgaagtagctgggaccacgggcactaacctggctcattgtatttatttatttagagacaggggtcttgctatgttgcccaggctggcctcgaactcctaacttcaacccttggccacccaaagtattggcactataggcatgaac

SEQ ID NO: 40637 - DNA, 1043 bp, Homo sapiens
gtgatatttaggccctgtgtgaatgtcctattctccaacagtgttttacccaatcgttttaaacatatgttgatgattcttttctgaatcaatttttactctgctcattctattcagtgtagtttttatttctctgaagagtgaaacttaaccttcagtgtgtttgagttgtctttttaatgtgtctgtttgtgaccattgttcacttttgttgagtcttaaaaagttgttttgggatctttttttaatgttaagaaatcagccctttgtgatatgtgttgcaagtatttctccccagtttgttgtactattctggttgtttctaccagatagaaatataaatacctatttgtttatccattttcttacttattttttgtagtatgatttaaagaatttttttttaatagtttctaggtttgtgttatagttaggccaaactgagattaatttaagaaaaaaagattccttcatgattttttctagtttttttaaaactggcatattttaatatttaatcttgactgtaaaatctggattttggagattggagcagatcactagagcagatcaccagagaatacaaatgtcatttttaaaaaattgttcttttgtccaagtggaatagaaactttttaagagtttgttactatttgtatttgaagtttatgatttgatgataaataaaatatcttcttgacctttggcattgggcgtttattctagaaataagaaaatttggcaggaagtatctcctatctagtgaagtctgttgttttattccaacatttcatttacttatgcttttatacctgcttaatttcttcaagatgatagcatagaatttggttgctttaagtactgctttcttgaattgtggagagacaaattaacctcatcagttctgcataatttgatttcctctttgggaggtatttataatatgtaacatacatttcgcttttttttattattgtttataaggactttagtaacatttattaggactttctgtatcatctgcagaaaaaacctggctgtta

SEQ ID NO: 40638 - DNA, 1049 bp, Homo sapiens
tgcctctgccttccaaagtgctaagattacatgcatgagtcgctgtgactggccccaaaattatacttttctataaactacctgtttccttaaataaaatatgattgatgtttttgaaagcagaaccatcttagcctttgtgttattgggctttgcaaatagaaatacttttatttgacaaattatgaagaatgaataaaataactaacaatagacagactagccagatattaaactctttagtctgactcccacatctttataagtaggaatgtttataattttaaaaaattgtatatgaatagtgaaattgtcatcgagtcagtttagttaaattgacaataagttaacttcagggattcagattgatatgttctcattgagatatgcagaatctttgtgtttgcctttcccttttaggaagctgcagtaaaggaagatgaagaagaagtttcagataagggcagtgattctgaagaagaagaaaccaatagagattcccaaagtgagaaagatgatggtagtgacagagactctgatagagagcaagatgaaaaacaaaacaaagatgatgaagcagtaagccttataggtttaaataatttaaataattggaattatatctctgatgatagctttgggttttgttgttgttgttcatttgtttgcttgctcgcttgctttctttaaataatatctgtatattttataattttattactttgaagaacgtttttaaggaatggtagtcaaggttatacagaaaaatgatttctaacaaggattggaaatcctcgttttcttaaatattaaattgttaggtagagtaggacctgggtttgaggttaggtcagttggtctcataaggggattttcagtgttggggatatctctgggaatatgagtaaggaaaggtgtttgtgaaatgcatagtgcttacttggaaggctgtgtcacaagctccagttcatgtttactgtagagaaacagtactgtggaccctgatgtcaagaggttggttaagggaaaagctaacatttatagaatac

SEQ ID NO: 40639 - DNA, 1073 bp, Homo sapiens
tgtccctacaaaggacatgaactcatcattttttatggctgcatagtattccatggtgtatatgtgccacattttcttaatccagtctatcattgttggacatttgggttggttccaagtctttgctattgtgaataatgcggcaataaacatacgtgtgcatgtgtctttatagcagcatgatttatagtcctttgggtatatacccagtaatgggatggctgggtcaaatggtatttccagttctagatccctgaggaattgccacactgacttccacaatggttgaactagtttacagtcccaccaacagtgtaaaagtgttcctgtttctccacatcctctccagcagctgttgtttcctgacttttgaatgattgccattctaactacaccttatacaaaaattaactcaaggtggactaaagacttaagacttaaaaccataaaaaccctagaagaaaacctaggcaataccactcaggacataggcatgggcaaagacttcttgactaaaacactaaaagcaatggcaacaaaagccaaaatagacagatgggatctgattgaactaaagagcttctgcacagcaaaaaaaaaaaaaaaaacccaaaaaaacaaaaaactatcatcagagtgaacaggcaacccacagaatgggagaaagtttttataatctatccatctgacacagggctgatagccagaatctacaaagaacataaacagatttacaggaaaaaaacaaacaattccatcaaaaagtgggcaaagtatatgaacaggcacttttcaaaagaagacatttatgcagccaacaaacatatgaagaaaagctcatcatcactggtcattagagaaatgcaaatcaaaaccacaatgagataccatctcacgccagttagaacagcagtcattaaaaagtcaggaaacaacagatggtggagaggatgtggagaaatagaaacacttttacactgttggtgggactgtaaactagttcaacccttgtggaagtcagtgtggcgattcctcaaggatctagaactaggaatacttgacccagcaatccc

SEQ ID NO: 40640 - DNA, 1084 bp, Homo sapiens
ctcattttatgaggccagcatcatcctgataccaaaacctggcagagacacaacaaaaaaagaaaatttcaggcgaatatccctgatgaacattgatgcaaaaatcctcaataaaatactggcaaactgaatccagcagcacatcagaaagtttatccaccacgatcaagttggcttcatccctgggatgcaaggctggttcaacatatgcaaatcaataaatgtaatccatcacataaacagaaccaatgacaaaaaccacatgattatctcaatagatgcagaaaaggccttcaacaaaattcagcagcccttcatgctaaaaactctcaataaactaggcattgatggaacgtacctcaaaataagagctatttatgacaaacccacagccagtatcatactgaatgggcaaaaactggaagccttctctttgaaaaccagcacaagacaaggatgccctctctcaccactcctattcaacatagtattggaagttctggccagggcagtcaggcaagagaaagaaataaagagtgttcagttaggaaaagaagaagtcacattgtctttgtttgcagatgacatgattatatatttagaaaaccccatcgtctcagcccaaaatctcattaagctgataagcaacttcagctaagtcttaggatacaaaatcaatgtgcaaaaatcacaagcattcctatacaccaataacatacaaacagagagccaaatcatgagtgaattcccattcacaattgctgcaaagagaataaaacacccaggaatacaacttaaaagggatgtgaaggacctcttcaaggagaactacaaaccactgctcaaggaaatgagagaggacacaaacaaatggaaaacattacatgctcatggataggaagaatcagtattgtcaaaatggccacactccccaaagtaatttatagattcaatgctatcccaatcaagctaccattgactttcttcacagaattggaaaaaactactttaaatttcatatggaaccaaaaaagagcccgcatagccaagacaatcttaagcaaaaagaacaaagctggaggca

SEQ ID NO: 40641 - DNA, 1036 bp, Homo sapiens
gtattaaccttaaatgtaaatgggctaaatgccccaattaaaagacacagactgccaaattggataaagagtcaagacccatccgtatactgtattcaggagacccatctcacgtgaaaagacacacataggtttaaaataaagagatggaggaatatttaccaagcaaatggaaagcaaaaaaaagcagggtttataatcctagtctctgataaaacagactttaaaccaacaaagatcaaaagagacaatgaagggcattacataatggtaaagggatcaatgcaacaagaagagctaattatcctaaatatatatgcacccaatacaggagtacccagattcataaagcaagttcttagagatctacaaagaggcttagactcccacacaataatagtgggagactttaacaccccactgtcaatattagacagaaaattaacaaggatatccaggacttgaactcagctctggaccaagcggacctaatagacatctacagaactctccagcccaaatcgacagaatacacattcttctcagcaccacattgcacttattccaaaattgacagcataattggaagtaaaacactcctcagcaaatgtgaaagaacagaaattataacagactgtctctcagaccacagtgcaatcaaactagaactcaggattaggaaactcgctcagaactgcacaactacatggaaactgaacaacctgctcctgaatgactactgggtaaataacgaaatgaaggcagaaataaagatgttctttgaaaccaatgagaacaaagacataacgtaccagaatctccgggacacatttgaagcagtgtgtagagggaaatttatatcactaaatgcctacaagagaaagcaggaaagatctaaaatcgacaccctaacatcacaaaagaactagagaagcaagagcaaacaaattcaaaagctagcagaagacaagaaataactaagagcagaactgaaggagatagagacacaaaaaacacttaaaaaaaaatcaatgaa

SEQ ID NO: 40642 - DNA, 1297 bp, Homo sapiens
atgtcatcttctagtatagatgcttactgggacttaaatcctaaatttactggttctgtactgattctaaatggattgtatggttggtggatatagctttaggatatgtagattttcatggtgttttttttttatagatatggggtctcgctctgttgcccatgttagtctcaaactcttggggtcaagcaatcctcctgccttggcctcccagggtgctgagattataggcatgagccaccatgctccacctgtgatgattcagttcttagtctcaggtctcaggtccaataagcagtatcactgacaatagtgaataaactaatactagtctcaagggtttttttgttgttgttatttcgcacatcacactgacatattgtcaaggttttaatgcagaaaatagtatatattctcataacattaaaatactcaacgtttgcttgctaagaataaaagtgaaattttaaacaaatatttttactgtatgtatccttactgtgtttgtaaacttgagtagactgtacttttcaaaacttgttcaagacagatgtgagatactttagaaggtatctacctgcataggcacacattcatcagctagtaattgctaaacgtctccttctttgtcaattgtagccagttaaaaatacttaataaaaatgcagtttgaaagattgctttgtttgtctgaaagataaatataggttgacagattttgtatttctcttcttgccgccccccaggaagtatttgaaaaggagcagtccatctgtgctgcagaggaacagccagcagaagatggggtaaaaacttgggtttccgaacctatttttcctagtgaaagaaatattttatttacttttccaattgacttatattgctctgggagagtaattcagtttagctatttccacctaaaaattactacaaccttcaattgaatctgttgctataacttaagagtgtgacgtgttatgattcacagcagggtgaaactaacaagaacaggacaaaaggaggatggcaacagaagagtaaaggacccaagaaaactgctaaatcaaaaaaaaagaaacctttaaaaaaaaaacctacacctgtgctattaccacagtcaaagcaacagaaacaaaagcaggcaaatggagtcgttgggaatgtaagtttattattatcgttattatcattattaagctaaaatatacaaactaaaatgttcaagtcttacgtgtacagcttcaaaagttttacataatttatgcacccgtgataccctagaaagctcccttgtgct

SEQ ID NO: 40643 - DNA, 1053 bp, Homo sapiens
tctcccaacgtgctggggttgcaggcatgagcaactgcgcccagcctattttattttttgttgagacacggtctcactgtgttacctaggcttgagtgcagtggtgcagtctcggctcactgcaacgtccgcctcctaggctcaaatgattctcccacctcagcctcctgagtagctgggaccacaggtgtgcaccaccatgtccagccaattttttgtatttttagtagaaatggggtttctccatgttgcccaggctggtctcgaatgcctgtcctcaagtgatatgtacccctcagcctcccaaagtgctgggattacaggcatgagccaccatgcctggcctaatttttttttttttttttttaatagaggtgcgggtctctgtaggctgcccagctgatctcaaactcctgggttcaaaggatcttcctgccttggcctcacaaagtgctgggattacaggcatgagccaccatgcctggctttcagtttctattatttatattttctcctgagtcaactggtagagactgtagtattttgactcaatttattcaactagtggtagattttagcttctttctctgaggtttttgagcatctgcaagaaatacatgccacatttatatcccatgcctaaaattgctggtaggaaaaacatatatatatttttttcttagagagatggaggtctcactgtgttggccaggttggtcttgaactcctgacctcaagtgatcctaccatttcagcctcctaaagtgctgggattacaggtgtgagccaccaagcctggcctgaaaatcatgttttgtagtaggatatattgaatcaaagatgttgtttttattatagcaagtgataaggaagcatttgtcatggactctaggtgagagagctgcctcctgggagaagaggaactgaaaccaatgctgaaattgggtttagaatccaaatctagactacccatatcctttggacttcccagcctgaaaaatgagcaaaaatttggtcttgaactattgacatttctggagtaattggtagaaa

SEQ ID NO: 40644 - DNA, 1026 bp, Homo sapiens
aatgagaatattgcatagtaaaactttgaaggtgcgtctttattgaggtttatttttacttttattaggtaaaagtaaacgtttattattaaaggtttgttaatagtaaacctattaattgctaattaaaggtttttgttattaaaattgaaaataaactgaggacatcaattgacaaagttcttggttgagtcaagattcttattttttccctccaactttgttttttctaatttaaaaaaataagcctgtattaactttataatttaaaaattcttaatttaaattttcttggagaaaaaggtcatgaaatgccatatcgttattttgtactttgaaatgcacattaatcaacacttttctaaaagttgctggattttgttgtggttaacatgtgagtaattttctttttatgaaaagctttgtgagttagggaattatgtattttcttttttttttttattcagtataaaattaaaactatccaggatttggtgagtttaaaagaatcagatcgtcacactctactgcacttccttgaagatgaaaaatatgaagaggttatggctgtccttgggagttttccatatgtgaccatggatataaaatcacagggtaagtgggaggtttctctgttgagcattgcttcccttttgatagattggttctcatttatttgactcaggattctcaaaacactgtacttaataacataacttgttattagactttgcagaactgtagtttacctgtcagatttactatgttggaaaatgatttatacctaatagtttgagaacactgatagagtcctacttttattatcctcataatgggatgaagtctgaacactctgttctgtagttcaacttttagcaatttcttaactttccaaagaatgatgaagacttccaggcataataaaagaatgagatatttgaagtatattattagtatgaaagaaatagctgcctagttctaaaattaaatttttaaaacccaacttatttatgttaattaaatgtt

SEQ ID NO: 40645 - DNA, 1053 bp, Homo sapiens
tacttgggttcaaatcctggctgtgcaatttgctagctgtgtcctaggacaagttatgtaacccatgtgtactgcaggttttctacctacaaaaggagggtaataatggtaccttcctcttggagtttgagaataaggattaaacaagataatacatgaggaatccttttaatagtggctcccccattgtaagcctcaaaataaattcatggatgttgttttaatttacctgacgaaggccataattctttttctcttcaattttaggttttacttgtatatggattggcatttatggttatccttccagttgttgtggtaagttttagctttttaagttaatgttttttttggaaaggagattgacatgttttggagtctccctataacattttaaatgtatgttagaatataacccattgatccttgaatttaagagtcttgccactgaaggtgaggtgggaggatcgcttgagcctaggtgtttgaggttgcggtgagccatgaccccacctctgcactccagcctgggccacagagtgagaccccaactgaaaaaaaaattatataactatacttttaatggtcttctaaatgtgacattacttgagcatgatgtgtatatcctcccaattcaaaaattacccacaactgaccgggcatggtggctcactcctgtaatcccagcacattgggaggctgaggtgggcagatcaatttagggcaggagtttgagaccaacatggtgaaaccctgtctttactaaaaatacaaaattagtcagacatgctggtttgaacccaggaggcagaggttgcaatgagccgagattgtgccactacactccagcctgggtgacagagcgagactctgtctcaaagaaaaaaacaaaaatcacaaaagttacaactgagttaacacagatacatatatacatatgtatacatatgtgtgtatgtatatatgtatgacatatgtatatgtgtacatatgcatgacagatgtgtataaatgtatgacatgtgtatatatgcatgacacgtgcatatatgt

SEQ ID NO: 40646 - DNA, 1522 bp, Homo sapiens
ttccttattatcttgcaacctgtctagtaatgctttttattggctcctgtatttttctgtggcctttcatcaaatagtgtaagtggagttacaattaaataaggattaaagacatcaaggcacctgtttgcataaatgactaaattgataaatttaaaaatattttcaagtcatcgaaaactaatgaatgtcctttttgctattttataaaggtatttctgcattgcctatctcagattggagttttgttaaatagaaactacattgcctcttaagttttgagaagtagaagtacggttaaaattagatttgaccatatggaagatcttttaccagttggtctccaagaatgtcttccttattatgttattggtcatttttgagcgtgtgtgttggtggggtggtttctgccttatattccttaactacattgtatatttttgtaaggaattgggaattcattttaatgctttttaacatcttcactgggaactggaataaagttattcttgactctgtaccttgagccattgtcaaagtcaggggttacattttaggtatctaaaaattactctttaactttcacattccctgggttaggaagctgctgttcaggagaaattttcctggttcttctggcaattggcttaggagaaaattgtgatcttagcacagtgcaaattaccttacccacagcaatggagttttacatgtggtggtcatctgtttctttcagaatgtggtgctattgttttgtggggaagctaccattatgaattaaatttatgtttttaaaaaatgtgtatttatcattactaatgtataaacatgctcattgaagaaattttggaaaatatatgagagtataaggggaaaaaaatcgcctacaattctccctgccttcttagaaaatgtagttgcctttaaagtttgatctggttgaactgagaaccatctggttgaacatgagaactggttaagcttgagaaccatgggccaaccaggaattagtatcaagacgcaatagttagcattttctgttaatgcgcatttcttgctcctccctttccctttctcctgatttcagagaaacttttcttgattcatggaatcagtatcttctaagaaatgagttggttggctaatggagtttgtctatatgagtacttgtttttcagatgtggctttctaattttgcaactttgttcttttgatgctagtttaacggatgaagagtcccggaaaaattgggaagaatttggaaatccagatgggcctcaaggtgtggtaaatgatgattttaaaatattggcgatatggtatatattataaaaatgttaaccagattaaaggaataatattattttcttactaaacttatactcacatggagtttaacatagataaattgagctctcattaatttttgctttatttttctttctaaagactagtttgaaagatataatttaagttgatccatagagaagaataatcactatcatttccaattactagttga

SEQ ID NO: 40647 - DNA, 1030 bp, Homo sapiens
acaggtgtgcatcaccacacgagctaatttttgtattttttagtagagttggggtttcactatatgttggccaagctggtcttgaactcctgacctcaggtgatccgcccaccttggcttccaaagtgctgggattacaggctgtgcctggcctattttttgatatttaaatgtcagtattattttatgtaaatttgtcatctgttttcactttcaaattatcagtgcttagtttactatgtggcacatagtaggtgctcaataaaatacatatattggacaatataagtgtttttatttaatatatgggatgaaatttatgggaaaaatatataggatgaaaaatggattttgtctttctcaaaatactgagtagttcatattttaagttcaaaataggattgattatttctttacagaattgtgcttatttttgctaacagaaagcttgttttttttttttgtttttccccagggagccacagtagcagaaattaaaaaacaatatcgtttgctgtcacttaaatatcatccagataaaggaggtgatgaggttatgttcatgaggatagcaaaagcttatgctgcgtaagtatcaggatccattacaaatttttaagaatggtacagataagccaggtgcagtggttcatgcctgtaatcccagtactttgggaggctgaggcaggaggatcgcttgagcccaggagtttgagaccatccctggcaacataccaagaccccatctctacaaaaaataaaagaattaaccctgtgtggtggtgtgtgcctgtagtcctagctacttgggaggctgaggtgggagcgttgtttgagcctgggaggtcaaggctgcagtgagccgtgaccatgccactgcagcccaacttcgatgacagtaatactccatctctaaagaaaaaaaaaaaaaggatagttttctgttttaataaaatattaaaatagttgtcatacactttttccaagtgcttacttcatgttgagtctatcatttaggggctacacagca

SEQ ID NO: 40648 - DNA, 1034 bp, Homo sapiens
cccgtttttctctttgagaagctcacttgggcagctgctgcagtggagataagcaccaggtatcgtcaacactgcaaaagggcccttacaggccctgattgaagcagcagggcagccctctaattgagtgaagctcattccttgggaagtcagttgctggagcttccttcttcacagagctgtttctcttctgagggtgtacgttcaacctcgccaactctcctgtctcctttgcttttccagatattttcctaaatagaactaaaaaggatactacaatggtattaatgattactatctgggtgttggattggtggatttttttcttccactgtatgccaaattttctttctttttccttcttccttttttttttttgagacacggtctcactctgtttcccaaggctgtggatagtggcacagtcatggctcattgcagcctggatctcctgggctcaaggagctgattcctctgccttcttgaggaagcttctaagtagtaggactatgtagctggactatgggtgtgtgtgggtagctggactatgggtgtgtgtgccaccacacccggctaatttttaattttttttgtagtgatgaggtcttgctatgttgcccaggctcaaattttctttatgaatttgtattaacacccaaaatcttattaaaacaatctctggctagcattgcgatcttgagcaagacacactctgcacttatctccagaggccctttcagctcaatgaattgttactactttggggtatgtggtgtttaaagttctggtgggacatacatccttgtatgttaagttgcctttccttcttagctagcatttatttactttcctagtacttgagtttctcttccactttctctttgttttacctgtttttggttaaccttttacttaggctatggattatcactataagattaagactaaaagaaaaataggaggacagagctaacagggtggttagtaaattaataatgaagcttcccaggtcctcctctcccttcttccctccc

SEQ ID NO: 40649 - DNA, 1604 bp, Homo sapiens
ttttacatagctaagaagcacttacagaacagtaacgtaaagttctgggagttaaaagccagatatttttgtcaaacaactttaatgatacaagtttacaatcagtttatcatagttgtctattaatggcttccagagtatttaccattgtgctatgattggagccttatgtaatttggatatccttaacattttgaaataattgcacataattaccttaacactacccatctttggtattgccaacaatactgtgctgtgaccttttgtgtgtactgcccactttgtgctttcttgtaattgttaatgtttgtctttcctagtgcttttaaaatgagaagtgttcttaatgtttatgtggaatttcaatccaaccattatttgtaagtgcataattttgtttactgcttttttgatttacaatagaagagttatcactttaaacattttatatcattaggctttcattgatatatttgacaagagtattatctgacaagagaaaataactgattgcttgtaattattagaatttcgaataatcaaaagcatgcttttattctttccgtaggttatggaaagaattccttttgaattgagataaaatgtatcatttaaaaaaagtttttgttgactccttgatcttacttttggggcttgatcttcccttttcaaaacttacttaaccttactttttcaaaatgcctggttttgaaatgtggctctgcagcctactgtaattttaggcaagttatttaacttccgtgtgtttcagtatactcatctgtattggttactgatttaacttctgtgtatctcagtatactcatctttattggtcatactcatctgttacggtcagagaagatactttgtatgatatctgtctttcaaaataaaatatcttgtggcttaacatatagtctatcctgcaaaacgtcccatggcacttctgaacaatgtatgtgctgctgctgtagggtagtgagcgttgtatatgtctgttagatctagttggtttgtgttaagtcctctatttccttatcttctttttggttgttctatccatttttggggatggagggtgtattgaagtctgaaactattattgtagcactgtctgtttctctcttcagttctgttggtttttgcattgtacattttgatgatcattagatacgtaaatgtttataaatgttatatcttcttgctgtattgaacctcttactaatatgtaatgtcttttatctcttgtaatcttttttgttttaaagtctattttgtcttatagtcaccaccctgctatcttttggttactgtttccatggaatattttttccatcctttcaccttcaatctgtttgtgtctttggatataaagtgagtctcttgtagatggacgtagttggatcaggtgcttttaatccattctgccagtcttttgattggaacatttaaccatttacatttaaagtaattactgttaaggaaggagggccaggtgcagtgtttcattcctgtaatcccagcactttgggaagctgaggtgggaggaacacttgagtccaggagtttgaaccagcctgggcaacataatgagaccg

SEQ ID NO: 40650 - DNA, 1028 bp, Homo sapiens
tgggtgtcagtttgcccgttttacatccggctctctgcttcaggcttgccttagtccatatgcatattttgatgtatttgtttgctcttgctcaaaattgtgttatgaaaattaaggtgaatacttaaatgctattctaatcattatgaaaattgttgggcaccacttggacttttttcttggatttaccctaataacttgagttgtttctgtggaattacagttgtagtaaaaggatgttttcatcatagtgactttttttctgcagcccagttgcagtatcttgaatatgaaagagaaatcttgaattactgcctcattcaaagctctgaataaggaacttttttcagaagtttgctgcaaaataatttgccgacttgtactgacaggaggctactgaataatctttatctcacttaataaatagttatgttctgtcttggaatattaatttgtttggttattggtgcactttagaccccatagggtctgtttgagtgtaaacgctgtgttacttttctaaaatctgaaaaattctttttttttttttttgattttttttttttttttaattgatcattcttgggtgtttctcacagagggggatttggcagggtcataggacaatagtggagggagggtcagcagataaacaagtgaacagaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtagggtcaccgatcaacaggatcccaaggcagaagaatttttcctagtacagaacaaaatgaaaagtctcccgtgtctacctctttctacacagacatggcaaccatccgatttcccaatcctttccctgcctttcccctctttctattccacaaaacc

SEQ ID NO: 40651 - DNA, 1026 bp, Homo sapiens
cggcctcccaccccctattctaaatgacacttgtttccaaaatatgggggctggaggagcagatccagaacccaaggaaacgtgatcaaccagggcaattaatccagagggcaggacaggctgagcctcagctcttctctgaatatctgggacccctgcgcagccaggtgaaccgcccgcgaccgctgctccggcgggaagccttctctgggatcctgtacgccgacgcccggaatccggcgtggtgcgctgggaaactgagcggtggaggaaggcggagcggttaggggcgggaccctaggggaggggttgggggagggctttgacgttagggcggggctaagggcgagacctcgccgagttccaccgttgcgctcgccacgtctcccttagcgagctcgctggggacacgcagggggagggaaaactgagcggggcgggaactatctcctctcgcgagagctggcgacggcggcggcagcggcagaggtggcggcggcgtgtccgtgagagtggcgtgggggcggggaggagaggcggcggcggcagtgtccaagctacgccactcgggccggggcgttgggagcgggagtgcagagcgtggtcgtggcggcggcggtgagaagagcgaggcggaggagggggtgccatggccgggcagcagttccagtacgatgacagtgggaacaccttcttctacttcctcacctccttcgtggggctcatcgtgatcccggcgacatactacctctggccccgagatcagaatgccggtgagtcccgccggcctttgcccgcgaacccgcgcaggccccgccagcgcccccaggccctgcggcgcccgcttgcccggccccagcccgcggcgtccgggatgacagggacggtgcggcccggcctgtgtccagcgtccgccactggcggggcccgggtcagcagcgtttccctcggcgcttctccacctcccttcattgtcctcaggagtttcgctcgctccatcttctccattgttgtggacgctccttg

SEQ ID NO: 40652 - DNA, 1026 bp, Homo sapiens
aagatttatggtaactggtttcttacttgacttttataaatagtattttacatcttatttttgcctttatttcataagtaatttaaaaatcactggattgctttattatattcagggcaatatggattatttttataccaaggatttgcatcgtgaattacattaagttatttggcaatttataatttattactactttaaatcaaatgtagcattatcacactgtatttaaattgtcattttttaaaggaatattttcttcttaagatatatagaggattttggagaagagagacaggaggggtaaaaccagcttaaggttcagcgagcagaaagggacctgagaggatgctcactgtaagactgttggacagtggtgtgtattgaggggatgaatcggaacgatagtctcatgcagaaaatagtgagattaagatcatccttattgtttctaaattatttcaatcagatgaaagtgatacgattgaaatgaaatcacatagttcgtgctcagaaattctattttggtatgtttgtattagcctttagaaaaaacactccgtttcagaattgttcacagttttatttcttaggtttttagagttcaggatttcatttattaatttcttcttgcttttttggtggaaataggctttgttgtaaacattaagaatataaaatctcctctatatagaaacaagaattttgttaaaaagagaatttgaatcccttcctatactataaaatgctctatagggagacaaagtgtttcttttttcttttatgtttactgtttatgtggagtgaaatataaggctcttggatgtataacatactcaaaagctgttacactttctctgatctgctgtgatccactgaaaatgtgctggggtttgttctgctgtcactgtttatgctgctggaacttagcactgtcttgatttgaagcatatgattgagagccatttgaagcaatcttcattaatgcagataaaacaagtttacatgtgcagagttagaaaatga

SEQ ID NO: 40653 - DNA, 1048 bp, Homo sapiens
tttttttcatctgaaaatagaagcagttttctttctttctttccaatatgtatagctttccttttctttctcttgccttgttgcgctggtgataaattagtggcatgatgtcaagcaagaccaggtattttcgtcttattccagatcttagggggaaaaatcattcagtctttcacagttaagcataatgattgctatagaatctttgtacatgctctttatcaggttggggaagttttcactgaattcttttaagagaaattcagatttggatttctaacttagacttttagatgtataattttgttattctaccttatagcactttcattgtctaagtacatttatttcacgtacattacatatttaagattgtgatgttcaagaagatataaatgatgttgttttatttgtactgcttctaacaaagtcatgtgcaatttctaacaaagttatgtgtttttaaggttggtagaaaaaagttttaattaggttttaattcttataaggctggaactgttaggattcaaacatagaattaatagataaatactatagattacataaaaatagtaaataatcatgtttgataattaaatttaaattaaaatataattcttttgatttatctagccaaacgtctcaagtccagtaccagttttgcaaatattcaggaaaattcaaactgagacctacaaaatggagaattgacatatcacgtgaatgaatggtggaagacacaacttggtttcagaaagaagataaactgtgatttgacaagtcaagctcttaagaaatacaaggacttcagatccatttttaaataagaattttcgatttttctttccttttccacttctttctaacagatttggatatttttaatttccaggcatagcaatgttatctattttaatgtgtatttgtcacaataacagaacatgcaagaacaatcattattttattttataggcatttgattactattctagacttctggtatcttcttactaacataaatatctcaagtagaaaagtttttgaaaac

SEQ ID NO: 40654 - DNA, 1037 bp, Homo sapiens
agaagctagaatcgcctgaggacaaagatgatgggggctgaaaggtcagccatccttgagttggggcgggggcggggttgaggtcctttgggcaagttcaggggtcagacagtgaggtgtgggaaggtggtgatatgtgggatgggatggcctggcaggtgagagagctgaattccagttgcagctcagtgcctggcttggtgatcttggtccagtcacttctctgggccccaggatttgtgaggatgatggagcagattatctctaaccctttcctttccaggtgaatcgtgctccttaacagtcaggtgatgacagagttgcaggaaccaggatggatgccaggtgctggaaaagaggaggaaatctcaggaggctagagacagcccaggcctctgcagcacccggggctgcggaaagaactgggggctggagggagagacagaaggtgaagttccttccaggggaggaatgggtgggggtatccacagcctgtgactcatcagtgtcccaccaggaccaggtcaaaccccagcagaattctccaagacaacccgactttctctcattcctgccctgatctcaagtcctcttgcgggggggtcaggcctgccatcagaggagaaggctgctgtggccagtaaaactgagggccaggctggacgttttcaaagagtaagcggggagggcaaagagctgaaggggctctcaggactgtccaagtaacagaccaagcccctcacataggtttttttctctagtgaccccattctgccccatggatgtcacttgtttttttctttttcttttttttttttttttttttagcttttgggaaggaggagcaaggcgagggaggtgggaagagactttttttttttttttcacatgagccctcagaattacagttcacaaactattcagtaaactgaccggcctcaacctccccttcaacggcctaatctaaggggtggatctatgtgttttgttgcttgtcagaaacaatcgctgcgcggcccattacatttacagcacgt

SEQ ID NO: 40655 - DNA, 1028 bp, Homo sapiens
ccttttcttaaattcccattatatatgaaatttatatatatttaattatatatatattgttacattttttatcattttccttctttctttaactgacatccttgagctatccttttcttaagtttcatgctaaattctaccctgaattaatggtggtcatttatttaacacagtggttccagaattctttttttaaataataattgtgtagatacagatatttttccctgcccaccagatagccattctactggaacgtaatggttagcattcctttgtttctcagttatagaaggtccctgcagattttaactctcaactaaacagatgttaacatgggggtgagatctgagaatgctagcataaatttacggagacaaatccatagatatcttcatcattggtcatctgaggagagtaaatctaggaagggattataaagtttatttggacatttggtttttttgtttttattttgttttttgttaatctatatgaagtcgagttgctctttcccttttttaccctattgaattttgtttgaggataaacaactcgttgtagaaactatatcaagggtttaaagttttaatttttttgaatatgtgtaatttgtattattggtgaaaagaaaaatatgtatcagtttactatatatatttctccttgttctgattgtttgcttacacatttctctgtttgcgtttaaagtaaggatccagctaagtggttggtcatttaacagatatttgagcttctgttgtatgcccagtttttcttaaaataaccacaagaagcctaagacaggggtcttgatttgaagacattagtatgatagattgatggttttccaccaaaggcagttttatcccccaggagacgtttgacactgtctagagacattttttattgtctcagctgggggtgctatgttgtctagtgggcagaggctagggatgctgctaaagaaaagaatgccagcctggccaacacagtgaaacaccatctccacaaaaaatagaaaaatt

SEQ ID NO: 40656 - DNA, 1059 bp, Homo sapiens
ttggcatcaaaataaattaaagcaaggtctcactctggtgtctctcatttcagccctgcctcagaatgacatcagaggcaaggagtcatggaaggacgtggtgtgctcagaatgatgaaaagttattttgtgactagaaagtaggtaaaaaggtgtgggtatggtaggagtcctgaactagatgaaggctagtctgtactcatttctcaagtttaataagggttttctttttttttctgtttctagcctaagataaaagtggctgcatatgagcacaaaatatgcagatcatagcattccaacaaaaatgtaaagaaggccgggcatggtggctcatgcctataatctcggtactttggtaggccgagtcaggaggatctcttgagcccagcagttcaagaccagcctggggaacatagtgaggccccatctcttccaaaatttttaaatatgaataaaactagaaatacaaaatctgtgttaagaaagctctcaaactttaccaaaagaccagacctaaataaagaggggccaggtgcagtggcttacgcctgtaatcccagcacttcaggaggccaacgtgggtggatcacttaagccaaggagttcgagaccagcgtgggcaacatgcgaaaccccatcgctacaaaaaatacaaaaattagccaggcatggtgacatgcacctgtagtcccagcactcaggaggctgaggcaagaggatcactttgagtccaggaggcagaggttgcagtgagctgtagtcttgcccctgcactccagcatgggcaccagagccaggccctgtctcaaaaaaaaaaaaaaaaaaaaaaaaaaaaaaagtgtaatactgtattccttgtaatactgtattcctcgtttggaatgtttactgttgaagatttttttattttataaacattttagctcgtcctttgtgttctaggagttacaggtagagctatgaacaaattaaggtcccctcttttatggtgcttatatcctattaggtaaattgcgggggagggggttgttgaagagaaggcaggaaaaatatagt

SEQ ID NO: 40657 - DNA, 1321 bp, Homo sapiens
aaaacatccgatcaattgtttttttctaactaaatttcttttttagagttgttaactttaacttgagtagctcctgtgggtcagttgatttattgagtacttgcaatgctaagtttaataacacatgttactgcattcagtaagttcacagcagcctgaaacagggctagatttctctgataagttttccccagaactgtccaataaatgaacatttatgaactgtctgttatattccagacattgctagatgcttgtttaaaagatgaataagatatgcctagcctttggaagcttccaaactggtggtaaggagagtggggagaggtaaattcataaaatatgcataatctgtagtgggaacccaggtctgccctgaggggccaggagtgtgtgtgggcagaaagtgagccagtagtctagctagggggagcacctgtctcttttgtgcttcactgccagcatctgacatcaatgacatgccagaatcacacagtaataatactggagtgattccttgttactctctgacacaaacatttttctcgatttttatttataattttatatataatgtataatttggttttaaaattgttattttaatttttattttttaataaatagtgacagggtcttgctgtgttgcccaggctggttttgaactcctgagctcaagcaatcctcctgcctctgcctcccaaagtgctgggattacaggcatgagccaccacacccggctataatttgttttaagcatcgatgttcaggcggtatggtaggcactttcactctgtgttttctctgatatagtttattctactgcattttcttacaaactgtaattactcttatttccagttaaaacaaatgataggctgggcgtggtggctcatgcctataattttagccctttgggaggcagaggtgggaagatcacttgagcccaggtgttcaagaccagcctgggaaacatagggagacttaaacgttgtttttttttgtttgttttttgttttttaattatctgggcatggtggcatggactagtagtcccagctacttaggaggctgaggtagaaggatcacttgagcccaagtggttgaggctacattaagccgtggtcgtgccactgcactccagcctaggtaacagagtgagacccggtcacactcaaaaaatacatcctagatattgaccacttcatcattcttacttagcaataatcgtttcctgtttcctcctgtcttactccattttcacactgctataaatttactacccgagactgggtaatttgtaaaggaaagaagtttaatt

SEQ ID NO: 40658 - DNA, 1049 bp, Homo sapiens
ctctgtcgccaggctggagtgcagtggcgcgatcttggctcactgcaacctctgccttccgagttcaagcgattctcctgcctcagccgcccaagtagctgggactacaggcacgcgccaccacgcccagctaatttttgtatttttagtggagacggggtttcaccatgttgaccaggatggtctcagtcccttgacctcatgatctgcctaccttggcctcccaaagtgctgagattacaggcgtgagccaccatgcccagcctggatttcttttagtatgtaatgtgttaacttaaaactaaggacaccatatagtaaggaaattaggccttatttgagcagcatatgattttttagagtaattatagtcttgcattaaggcagagtggctatgacatgaatagtttaatattttgtaatttttttcttcttgagataagagtctcgttctgtagcccaggctggaacacagtggcatgattgtggctcactgcattctcaaactcgaggactcaagtattccccccgcctcagcctcccaagtagctggactacagggtactactatacctggctaattttttattttttgtcagatgagacttgctatgttgcccatgatggtcttgaactcctggcctcaagtggccctccccctctcagtctcccaaagtgttggaattacaggcatgagccacctcacccagccctgcaattttatttattattttctaaatgttgctgctctcccgaacccctactgactaccttttgctgttgaatttgctatgtggaaaaccattttatgttccagaatttgggcttttaaactatcttacagttactgtctcattctggtcttgagaaaaatttacagttttacaggatctgattgaaattactctaattcacagggcaattttatatggatggtggcacttagaatgcaagtttcccaatctccatttatcttttggtttgaggatagtgtttaagactattaggatcacttgattagtatctctgggcttttgaaaataattaca

SEQ ID NO: 40659 - DNA, 1070 bp, Homo sapiens
agaaaaaaagaaatataacatgcatatagaaaactgaaaaacatttatgttaacagtacagtttaatgaattattataaagagaacaaccaagtgtaactatcacctagatcaggaaatagaacattactattcccctataaatccctggagtgcccttccccatcaaaaccatcctctcgacttggtgcggtggctcacacctgtaatcccagcactttgagaggccaggttaggaggatcacttgagcccaagaattcaaggttgcagtgagccatgatggtgccactgcactccagcctgggcaacagagcaagactccctgtttccaattaaacaaacccctcttctctctccctaaaagtaatcattttcctaacttttgtggtaatcatctctttgcttttctttatagcttgctgtgtttgcatccctaaacactgtaatctcatttttttcctgtttttgatcttcatatgaattgtatcacactgcatgtgttcttttgtgtcttgctgctgcttctcaatattatgttcctgagattcatctatgttgctgtgtgttgctgtattcattcattttcatggctgtatgacatttcattatatgaatagttatctatctataatctataatactttattgatctattctaatgttgatggctaattgggctgtttccagtttagagcaattgcaaacattgttgttctaaacattcctgggcacatgtgcatgagtttaatatacgcttttacttatttatttatttttaattttgtagagatggagactcgatatgttgcccaggctggtctcgaactcctggctccaagtgatcctcctgcctcagcctctcaaagtgctgagattacaaatgtgagccaccacgcctgacccgagtttagtatatacttaatagaagaatttctgggtaatagccctatgcatcttctacatcactcaatgccagattgttttccacagtggctgtagggtttatactctccacagcactgtgtgagtatctacttggccacattctcactagcacttggaattgttgg

SEQ ID NO: 40660 - DNA, 1031 bp, Homo sapiens
aaaaaaacttaatttaaggcaaacttacaaacaaaatgagtttctctaaaattatttaactgcagagaaaacatgccctgtagtgctgtctcttgtgaatttagtttttatttttcataaatttacattctaaccgtgaggtgttgttttagatgtaataataattacactttttctagtttaagacacctaggtggaagtactgctttttcattttctgacgatgcacagggattgatatttgggttggttgagttttagatgtacaaacacactggtcttattttgtatcactgatgatccacagggttggctgctatgtgctgaactttctgttctagactttctgccaagtactttatgcaaaactctggttttagtgaaacaggttttattgtttttaatcagagttgtattataagctgttgttagctatgtaatgctaacagaagagttggtatgtatatacagccatgaaaacaaaccatcaaaacaagcctgtctctgttcgactggttgtttttccctcccattcctttagcctcagttcattttgtttactgccaaaggcctgagatggtgtaattttcttttctaggaacttggcattagaattcctcgaccactaggacagggaccaagcagattcatcccagaaaaggaggtacgttgtttgtgaaagtacatagtgaactgtatgcttttaaggaagagctttcatgacccacatgttggcatctgaagaactgttggtcaacaacatgttttagtcagagttggttgcagttaatcattctttggcagtgaatctgtgggaataaaaagctgttgtacttgtgttgatttctagtatttcatgatgtgtttttaacacccatatttaatcaagtaaagccaagatttgtttttgaccagtgatacaacatctgcttatatttagatgttgtttaggtgtgcccataacctgagttacttagtcttgactgtctccacaggctgatatcagtgctagattggatctttaattctat

SEQ ID NO: 40661 - DNA, 1040 bp, Homo sapiens
tattgtgatggtggaaacttgttgtctctttcaaagatggttattaggttgttgaggggaaaagattgttctcatgttaatcttccagccacaccttcacagagagcctgtgaggttagtgctgtgattagtatctacatctgcttttcaacaaggccatttgttggtggcagttctgtctcctagaatctggattggccaaaatttgttcaaagtctgtagttaagtttcttacagctacagatgaaggaataattgaattaacctaaataggaagctatgaaatgtatttagtttggcttatgatcaccccattgaacacccgcagtgccttttttgatcagcatctactagaaaagagttgtaaccaatttaacatgtgaccaagaagtgtttcaaaagtgagttttccagaaaatggaaactttttataaaccaagactactactgtataataacagtggtatctgtaagaatctccaaggtatcaagaagtcttaaagaggctcaaaagaataataatgaaagataccaactctagaaccagatgtcattgattcagcccccgtctccaccactcactagtactgactgagctagaatacttgggttcaaatctcagggctttccttggacacagggtggggaacatcacacaccggggcctgtcgtggggtagggggtggggggagggatagcattaggagatatacctaatgtaaatgacaagttaatgggtgcagcaaaccaacatggcacatgcatacatatgtaacaaacctgcacattgtgcacatgtaccctagaacttaaagtataattttaaaaattaaaaaaatctcagggctttcatcagttatgctaaatggagataataatagtacctgcttcatagattaaggtaaggattaatctaagactcttgactttttcatgaatattgtagaacaccaaatactctttctaaactttagtatcatagactcatgttctttgtttacaggtagtataatttaaaacagtgctcagctcatactttg

SEQ ID NO: 40662 - DNA, 1082 bp, Homo sapiens
cacttaacaattgtttgactttactaaggtgtgtaagcaacacacattcagtagaaaaatgctgtggaaagtagtacgatactcacaatgctgggcagtggcagcaagtgacagttctcagccacataatcacaaagacagacaaccaatactctaccatgttgccagatgattttgcccaactgtaggctaatgtcagcattctgagcacatttatggtagtctaggctagactataatgtagaagatttggtgtattaaatgcattttttacttatgatattttcaacttattgagtcataaccccattgtaagttgagaagcatctgtagaaatatttttaggtattttgtccaacatgagtaagaagcactaatatcgaggtcagtttttaacctaatctgggagagggcggtgctgtcagggctttttaaggcttataggaccattacccttatagaaaatggcttcctgctactgtgctatccaagttcttatttctgctttatagaatttttctgattcttcctttgtgattaagtgcttcactattccttttttctctgctatcagtttaatggtagtccctatgccctaataagttactatggacttagaaactagataaagaagcttgttataattttgtaccaagtaaaagtaaattgtctctaagagaggcaggtgaagggttttccactgaatacagtacatatgctatggtatgtaaattttgtgacatctattttacatcttttttttaatttgttctagattcatgagattgttttttaaaaagtcaattgagatataatgaaatgttgctatatcaatagtcaacatctattttggcaaaaattactgattttcaaatgtgtgggaaaacattttaagggtgtgtgtgtgtgatcattgaatttcattctacagaaaaaaaaatcactcattctttgagtaggcagtaacatatttagccactaagaacaatctacaatattctcttatgctttaaatatatgaaagtgactttaataatgattatttgacaatgtaagtcttcatttatgtttttatatttttc

SEQ ID NO: 40663 - DNA, 1086 bp, Homo sapiens
gctgaaatgttacgcagtatgggactgtactttattaactctacaactttgaataagttacataatctctccttgattcagtttcctcatctgcaaaatgagcattatgcttatggttcctgcctcacaatgttgctgtgagaataaaataaatgatgtttgcaaagcatagcacagtgcctagcataaaagaaatgctcagttaatgttaggtatgcctgctattactaggcagaaaccagatcccagaggggcttataggctatttaagggttgtggactttatcatagaaataatggaagccactgggggattttgagcaaggtagtatagtgattgatagtgtgtcagaaggatcactctagagaatggatttccatggtcaaaagtggatgtgtgacatcaattaggaggttgtcctactagcctatgacaaaagtgatagtggactaggatgtgaggtagggcaggagggagtggaaaaaattaaaatgggtctgatagatatcaaggagttagaaaccacaggatatagtatttagttggatttagaagatgaggaaaataacaaaattaagcatggctctaaagtttttggcttgaggtacttggtgaattgtgcaattgttttctgagacaaaagagtggcagggggtcaatttaggggaaaaatgactgctgttttagacatgttgagtttaagttgcctatgagacatccaagtagaaatagctcctaaatgaatttctgcccccgataccgctgttctagttctgtcactgctatgtcttcttctccagattaaactcaccctccacttttatatctatcctccacatagctgtagagccatttatctaaaatgaaaatctatgtaactttactggcaaaagccctttagaatagaattgaatttaaacttcttaatgtcatatagtacccagcattatctggctttcacttacctctccagcttcactgcctaccattttagcatcagcctcacatgagaaagcaaatattaattcaaatgtagcactccataatgctttctgttattcattagtaaagcagcaaaagctgtg

SEQ ID NO: 40664 - DNA, 1060 bp, Homo sapiens
aagtgatttcattttttcttaagcatgtctaaaataattgatttagaaaaaaatcttcatttctcaggagttgcaaaatcctaggggaatcacgttaatggcaaggaaagagagctcgccctttgagtgcacctatgcttccaacatgggaggcaggaatgctgccatggctgctgctgcagaagacccctgggtcactttgagactccagttgggcaacagcggaggaaggaggagtgggaatatggctgacttttactgcttagcattaacagtatggtgatagctgactgtgccctcaaacccctcctctccctgcacagggaaacagaagagggctgaggcccgggagtaacgtctacctctacttcctgggaaagaagtttgcttcccactcctgctcccaccccaatcctgggaattagggtctcccccacctgcctcgtgcctcattctggttctccttcacaataggcaggtgttggaggatgtggatggcagttcactaggacgcattatcccaggaagggattagaaagatgcttggctaagctgcaggcagaggtgaaagggagagaaggaaaaaatcccctggcacatggagaagacagtgtaaggtaccgaactgcatagggtcaggtgccaaagtagggcccttgtgtgctcttgatgccctttatgttggggctggggcagcagcaataaccagtagctggggcaggggacaccagctcccaatgtcaggtccaggcagcaacccagaagcaggaaggagggccctgtgagctttactgccaagtccagctctgctcttagtaaacccaaagtaatttcatctgtgactctgtgctcctgaaaggctgtttgctcagctcattcacgctggaaggtagccaaaaggaaacacagataaagggctaaacacatgtatgcaagtatagtaaccaacacttgcacaattactaagtgccactatactaaggtgtcaagacaggaattatttcatttaatctcagagcaagcctttgaggtgagtattcccattttacggagaggctaa

SEQ ID NO: 40665 - DNA, 1032 bp, Homo sapiens
aacaaactctgcatttagataactattaaaggttgttaagatgaagatttactgtttctttgttactcgttggtacagctgtttgttttacttgcacatttgtacatatacttaatgttttcaagtgccttaattgtttaaaatctctggcttcaaagtttcttggggaaaggtcggtttacctcacattttttgtttccattagtaatattctaggtacctcacaaaatgtattatggtgccatggctgttagtttttagtgagtgctgtaggattaattcgaaaataggcagaattccattcctcccaaggtggcaaaaattagctatactgatgtaattgtcatttacctgggtatgaattccctgacacacattcatgtcaacatatgtagcaaattttgtgaaaacataacaatttgaagcttctgtaattttgagcactgctctaacaacaagcataatataaaattagttagattttgcaagtctacaaatgagctcttgcaacagaactcacagcctttttacttttttcccctaactttagcaatgtagtatcttgagccattaatttttgggtttttttaaaatccagaaggtatatagaaaccttttcagatttttcatctgatttgttcttgcagatgttcttctatcaaataccttattttaccttacagatatttgttgcacaggcagatactgctgtatttagacatttctatttcagttcattaaaaactgcaaaaccaatctgtatcatgtaccaaactgacttaaaataaatctacatgtttattgaattaatagtgtgttactgcgttttgcttataaaatttaatgcttagtggatttatcttagtccgcttggggtgggctttctactcattttattgcacctctagaccagccgatagtaactaaggcacatgttcatatcaatagaaagcagagccttggaagtaataggtggagggaggacttggtacacttgtgggagtgatttgcaagttgatcttccacaaatca

SEQ ID NO: 40666 - DNA, 1791 bp, Homo sapiens
aaccaaatattttaccttatactagtaaattcaaaagtcatgtgaattctcagcactattgacgtttacactcacaattaactaaaagtacatagtctgaagaaattgttgcatattttagaagtgtttgatacattcccagggcacaatttatgtactaggagaatttttcccattgtttttatatttgtactagtacagtagcattgaccactttgtatccttgggtggaatgaaaaatgggatatggttgtcttcctcaattagggataaattctagctgtaaagacttgaggaaatactttatagaatttaacacatggcaaaatagaggctcaggtgcatctttaaattacaatagaggaccatgaaacttaggattgttgtttcttttgtcttatctaacaggtacaacaaataacactgtgactccaacctcacaacctgtgcgaaagtctacctttgatgcagccagtttcattggaggaattgtcctggtcttgggtgtgcaggctgtaattttctttctttataaattctgcaaatctaaagaacgaaattaccacactctgtaaacagacccattgaattaataaggactggtgattcatttgtgtaactcactgaagccaaaatactatcttttaagatgtcccacatggaagacgctattccaggatctttaaatttccatggatgcatataggatgtttgggagcatcatccgtgaagaaaaaatcaattaaatcattgtgttcaacaggaatatttaaaatattctgcatgaatcctgtggctgtcttattttaaatagctgctgctgtgggattatattttttttccttaacatgccaaatataactttctgaaagtgatggaaaatgttgtcttgtgcagacaacatcatggctcttggcagtttaaatttagtaattttaatttagtgaacagaattgagaagaacgtgccaaatgagaatcaattaggtggatttttggctgtcatttcaaaagtggaataaatttattaatttagtagtactaaatggtatccttagattaaaattttgtgcttgataacagctgttttttctacattagaaataagatgccacacaaggaactacattccagatttaaagaaatgaaaggataccattagtgtgtataacagattattgttcatacttgtaaagcatcttatgtcattgagaatataaagaacagtgccttagaagacagtgaaaggtaagctctagcttaatgtctatgatttgttctttgacattaaggaaggtaaggattggtcagaggatgtaacttgatgtgagcagtagtaaacctgttttagatatcatactgttaatattttattgaaaatttatttcagagcggagaaacttaagctaaagtctgttatacagaattgaaagccttcgtatcttgaacctcccaacatttttcttatggctgttgaaaagtatagagctaaattgatttaattacactttcctttgtactttaaaaaaaagtatgctagcactattgtaccttgaaaggatttccaccagactgtcttgagtagtgacttctttggtgaggcaagaaggatatacattattttagaatcatttactatttaaatgagacaatcatattattttagaatcatttattttaaatgagacaatcattttaagttttaagataacagaagtgaccaatgtaatttcacaacacctaaggattttttggttgatcaggttactgtagatttttactgattgtcctg

SEQ ID NO: 40667 - DNA, 1031 bp, Homo sapiens
ggactcaggggctgtgtggccagcctgccttgagacctgagcggggctgccttaggtacgagacctgtatgatgtgctagccaaggagcctgtgcagaggaacaacgacaagacagatacagggatgccagccaccggtgagcaggccttcctcccaaggggtgaccaaaatatgtactacccagcgaggcccaggtggtccctgcaaagcagctgcagcctcaggacaggagcagcgtgccggagcactcattgttggctggtgggttggttgggggcctgctggaggaacggaggggcagcaccgcacaggcagcagttggctgccagtctgaatgtaagcgcgttagtgtttgaaccaccgttacagccatagtggtgctggcaacctcccctgcccccagtttagtctgctgccctctatgtggccagttgcgatttcactttattcactcctctactttattccaaagagattttttttaaaagagaattgggatggagagctgctgatagtcagctttaggctggtgccctagtagaggtgggtccctgactcctcctcccctacagaacccccacatgcagcagctgggctccctatatgcctgggatgggcagagggggccttgggcacagcacagccttctttcccagggtcggcaggcacccaggaggagctgctacgctggtgccaggagcagacagctgggtacccgggagtccacgtctccgatttgtcttcctcctgggctgatgggctagctctgtgtgccctggtgtaccggctgcagcctggcctgctgtgagtccctggcagacccacctctctctcatgatctcagtgtaggagttagcatatccagttgaatcctagagacagtgtgcttccctgcatctgccgacagtcttgtgagactctaatgcattcagatagtggagagctttgtgaatggcacaggcccccaaagccaggagtagtgtcactgggttgggcactgggtagcagagactacacacctaccttcaag

SEQ ID NO: 40668 - DNA, 1061 bp, Homo sapiens
agcatagacactgagaatgtttccactttctcccctagaaccaacacttaaacttaagcagcaccacctccagaaaaatcagtttcagagatgacgaggaggcagcattgattagggcaggtcagtttttttatgtaagatcggaaaattggatcttttataccttttgtcaaagaatgtatgttaaaaataagcctattcagttttctaagaaaaacttgccattacaggttatttaataattctgttgtctactggaattatctaaatagcaaattgatttatggtgctttggactttttttttttttttttttggagtcactgtctctgtcgcccaggctgttgtgcagtggtgctatcttggctcactgtaacctctgcctgctgggttcaagcaattctcctgcttcatcctcccgagtagctggaactacaggtgcgcaccaccacgcctggctaatttttgtgttttttttttgtagagacagggttttggcatgttagccaggctggtctcgctcaaactcctggctcaagtgatccaccctcccagcctcccaaagcgctgggattacaggcgtgagccactgtgcctggcctggatgttgttttttaaatacaagtttttcttcttaaattcagtaaacatctcataggatatggattttaacacatgtactgagcacttactgggaaccagacattgttttaggctttgaggatacagcagtgaatgagatggacaggcccctgccttaaggggccaacattcaatagggaagacagagtacagacaagtatataacacatttggtgttgtgagtgcgttgaagaataaaatgcaaggtaagggggcgggatgccggaaagagagttgctcttttatgcatggactggtttgggaaggtctcacagatgaggtggcatcttggatggagatgagaatgcagtgggggagtgagccagccggccattgaagatgtccaggagagagcattctaggcagggggagccctgggcacagggccctcaggcaggaataaatgtttttgacaagct

SEQ ID NO: 40669 - DNA, 1026 bp, Homo sapiens
gttcctacatctctgatgtccaatatggtggccagtaaccacatgtggtttttgagcacttgaactgtggctagcgtgactgagaaactgaattttaaattttattttaattcatttaaatttgaataaccacatgtggctagtggctaccgtattggacactgcagtcctagtgagaaatcccttcctcctttgagccctttcaggtgcttaaaacccactctgctttggatcagattgttgttaccacttgtatatccctcaacttaattgtaatcttaagtatagggactggggcttaagtcttctcctgtgatccagcagtatctggtgctgtggttctcagcctgcaaattggaatcacttagggagcttctaaaactaccagtgcctagacctccaccccagagcttctgatttagttgtctggagccttggtgcttttaaaagctccctaaagactttagctacagataggttgaagagcttgaattcaggtacttcgaacaaagtggatacttgagaaatatttgttgaactgtaataggttatattttagctttttttttttttttttttttttttttgagatggattctcgctctgtcacccaggctagagtgcagtggcgcgatctcggctcaccgcaacctccgcctcccgagttcaagtgattctcctgcctcagcctcctgagtagctgggattacaggcacacgccaccacgcccagctaattttttgtatttttagtagagacggggtttcaccatgttggtcaggctggtctcaaactcctgacctcgtgatctgcctgcctcagcctcccaaagtgctgggattacaggcgtgcgccactgcgcccagctggctatttttatcaaaaattttatgtgcatagtttagagttaaatcattatacaagacttaagaaaaagcatgtaggatcgttcttcccttatgtcctcagtacagacagtccccgactcacaatggttcaattcatctttacaatagtgtgaaagca

SEQ ID NO: 40670 - DNA, 1033 bp, Homo sapiens
accaaaccattcgcacttctccctgttctctgccttgaccggctacggagcacccaagggaagcagaggcagagggacatgggaccttactctacagcagctgtgtcttctgcttctgctctgagcagttttgttgagtgaagctgttacactggctatatgaaaggtacttgcccagtacctaacagaaaaacagtagcaacctctagggagatgggccttttgtgtcaaacctgccactctgtgttttgcagtggaagctcatgacctgttatccaactgcacatctaaccacagcctgttcttttatctctgcacccttctgtgtcattaacatgatttgctctgcttctctgtctacatggtttccctctaacatctgtacctatctgttcttgttcatttctgtgtacttcgcaccatgtacttggcactgtcgttatgtctttctgtgcctcctacatctctctgggtcatgtcctatttcctctgcttcccccagtctcggtctcctatctatctatctatctatctatctatctatctatctatctatctattcacaagtgataaaatataaagtaaacataaaatagtatagagtaagggaatccagaaatagtatgtttaaatgcagaaaaagtaaatattttaagtttaaatcacaggaggatagaagaatgagtaatgtataaaaatgttataccatttttgtcaaaaggaagtgccactttaattttatttgatcaaactcttgagagtttgatttccatgattctctctggtgatactagactggacatagaccacatgtaaaggcttctcaggggcccttgtcctcaccactctcccaacaggcacagtccccagcctcagagccttctcacccctctgcctggccacatactctggaattctttggaatatgaaatcctggggaaggttttcaccttctccccacagttatcccaactaaggaatcacctcagtatattcccaaaataaagctgtgtggccgattcatccaaaactt

SEQ ID NO: 40671 - DNA, 1035 bp, Homo sapiens
gtggtactggtaccaaaacagagatatagaccaatggaacagaacagaggcctcagaaataatgccgcagatctacaactatctgatctttgacaaatctgacaaaaacaagcaatggggaaaggattccctatttaataaatggtgctgggaaaactggctagccatatgtagaaagctgaaactggatcccttccttacacctcatacaaaaattaattcaagatggattaaagacttaaatgttagacctacaaccataaaaaccctagaagaaaacctaggcaataccattcaggacagaggcatgggcaaggacttcatgtctaaaataccaaaagcaatggcaacaaaagtcaaaattgacaaatgaaatctaattaaactaaagagcttttgcccagcaaaagaaactaccatcagagtgaacaggcaacctacagaatgggagaaaatttttgcaacctactcatctgacaatgggccaatatccagaatctacaaagaactcaaacaaatttacaagaaaaaaaaaaccccatcaaaaagtgggcaaaggatatgaacagacacttctcaaaagaagacatttctgcagccaacagacacatgaaaaaatgctcatcatcactggccgtccaagaaatgcaaatcaaaaccacaatgagatatcatctcacaccagttagaatggcaatcattaaaaagtcaggaaacaacaggtgctggagaggatgtggcgaaataggaacacttttacattgttggtgggactgtaaactagttcaaccattgtggaagactgtggcgattcctcagggatctagaactagaaatatcatttgacccagccatcccattactgggtatatagccaaaggaatataaatcatgctgttataaggacacatgcacacatatgcttattgtggcactactcacaatagcaaagacttggaaccaacccagatgtccaacgatgatagactggattaagaaaatgtggcacatatacatcatgcaatactatgcagc

SEQ ID NO: 40672 - DNA, 1035 bp, Homo sapiens
cccctatatcattttttattgcatctatttgattcttctgtcttttattctttattagtctggctagtggtccatatattttgttgatcttttcaaaaaaccagctcctggattcattgattttttttttttttttttgagacggagtcttgctctgtcacccaggctggagtgcagtggcccgatctcggctcactgcaagctccgcctcccgggttcacgccattctcctgcctcagcctcccaagtggctgggactacaggcacccgccaccacgcctggctaattttttgtatttttttagtagagatggggtttcaccctgttagccaggatggtcttgatctcctgaccttgtgatccgcccacctaggcctcccaaagtgctgggattacaggcatgagccaccatgcccagccaattcattgattttttgaagggtttgtcgtgtctctatctctttcagttctgctctcatcttagttatttcttgtcttctgtagatttttaatttgtttactgttgcttctctagttcttttaattgtgatgttagggtgtcaattttagatctttcctgctttctcttgtgggcatttagtgctataaatttccctctacacactgctttaaatgtgtcccagagattctcatacgttgtgtcttcattctcattggtttcaaagaacatctttatctctgccttaatttcattatttacccagtagtcattcaggagcaggttagtttccatctagttgtgtggctttgagtgagtttcttaatcctgagttctaatttgattgcactgtggtctgagagactgttatgatttctgttcttttgcatttactgaggagtgttttacttccaattatgtggtcaattttagaataagtgcagtgaggtgctgagaagaatgtatattctgttgatttggggtggacagttctgtagatgtctattaggtctgcttggtccagagctgagttcaagtcctgaatatcattattaattttctgtctcattgatct

SEQ ID NO: 40673 - DNA, 1039 bp, Homo sapiens
tcttttcatttattcagcagcatttgttgatgcctgcagagttttgagactgctgggtattggggccacaacagtgaatagacagagccctactttctgagtatacagataaattaacaaagaacaatgaatgttgtcaagtagctcataggaaagagaacagtcctagtctaggaagtcaggaaaggcctctaaaaggaaatgacactgaaggtttgagatcaacctagacagataaatgttgaagtgagtgtggagtctcccaggcaaaggaaacagatgcgtgtgaatgtaagcaaatgcttggtgcagagcatacaagcaatgcaatagctggaaatacattagaaagataagcaggagcaaatcatgagaggatcttaggaaacatagtaaggagtttgtattttattccatgggcaataaaactgaagaagtgagttaccagtgcagcattttggaaagatagctgatggctacaaagtggttaatggattagagagaagtcagcttggaggtcaagagaccactcaggctgttagaatgggtggacagatgatagttataatggtggcagaggagagaaataatgagatagatttaagagatatttaggatgtggaatatatgaggtttggtaattggagaggaaggagtcaaggatgacttccagggctgacttactgttgggtggaacattagaggaggaacaggtttgggagaatggatgataaagtttgggacattaggcagggagaggatcactgccatggatggagggaggaattaattttatatttgtggaaggaaactatgcaggaaggagaaaaagatggtataagtagttaaattgaaggtctgatgccaaaaaattgagatttattttttctttgaagtagatgacaacactgcttagggtgattggggaataagaggagtgtaaacaatgttaagaaaagtagagatggcttaacaatagtcattgtgaaaaatgggagaactttccaaggaaataggaaattatcacaatattgaagcc

SEQ ID NO: 40674 - DNA, 1030 bp, Homo sapiens
agagggaatagaccttactgagcagttcaagcttaccggcctctttgtttacactttgagctactcaagcctcagcaatggtggacacccctcccccgtcaagctgcagcgtcacaggttgatctcagactgccgcactagcagtgatcaaggctctgtgggcgtgggacccgccgagccaggcatgggagggtatctcctggtctgctggttgctaagactgtgggaaaagcatatagtatttgatcaggagtgtactgtttctccaggtagagtctgtcacagcttcccttggctaggaaagggaaatcccctgaccccttgtacttcctgggtgaggcaatgcctcgccctgcttcagcttgccctctgtgggctgcacccactgtccaaccagtcctaatgagatgaaccaggtacctcagttggaaatgcagaaatcacccgtcttctgcatcagtttcgctgggagctgcagaccggagctgttcctattcagccgtcttggaagtgaccccctcttctatgtcttctttctcattgtctggtactggtttggaggcactcttctccatcaagtcatcttctgttaattcctctggtgtgctgtctaattgggttttgaatttctccaagatccataccttgccacgcttcatccccacccttttttctgtatccactgtctatttcattatttccttgactggcactgttaaaaaccctgtgaggtcatgcaaaacatctggacacagttttctcaaattttatgaatttgttttcttgagcttgatggttttcttggctttttcaataataactatgacatctttgatggtataatccctccaaactttcatgatgttctctgttgggattctcttccatagtgttgacagtcttccacagaataccatgtgtaatgagtcttaaatgtccttatgatctagagcctgaattagagctgtcatgtttgcgggcaagtggaccactttgacaccttcagtgtgaaactaatggggttctgagt

SEQ ID NO: 40675 - DNA, 1145 bp, Homo sapiens
ttggtcactgatcatgacgtacagctcttcttaacagtgatttgtagactagagcagcagtctccttgtttttggcacaagggactagtttcgtggaagacagtctttccacgggcagggggtgggggtgtgtggagtgggggatggtttcgcgatgaaactgtaccacctcagatcatcaggcattaattagattctcataaggagcatgcaacctagacccctcacgtgtgcagttcacaataggcctcgtgctcctatgagaatctaatgccgccactgatctgacaggtggtggaactcaggcagtaatgcttgctcacctaccgcccacctcctgctgtacagcctggttccttacaggccactgaccgttactggtctgcagctggggggttggggagtcctggactagagtactagaaatgaagtttgtatttgtgcaattactcacagttaatatgctgtagtaagtgaaatttgaatcatggtgttgggcagtgttgttactaactcgagtcactcaaatttgtgcatatgcgaagcatgcaaagtgagagcagcctataattcaaagatggttgaactttttgatcagttaaataaagatttggtagattccaatgagatttcaggtgcagggctacttggagtatttgatctgagcttttgaacacctgatacattttgtgtgataatgtaaatttgatttactcttacagcttccttaatccttttatgcacttccttagagaggacatctcacactaactctctagaacaaaatccctattatagtaaataaaaacagtgtttttaggagaataatggtgataattgtgaattcaccatgcagcagctgacattgaaagcaagtttttaaaaaacgttttgtataatgttgatattctagtaattggaagttaaatcaattttgattattttagttgggtaatttcatttttattgtcttcatacaagcaaatacagttggcccttgaacaacccagagattaggggcaccaaccctctgcattgctgaaaatctgtgtgtaacttctgactttccaaaaacttaactacttatagactactgttgaccagaagccttaccgagaacataaagtgttgtttaacatattttg

SEQ ID NO: 40676 - DNA, 1087 bp, Homo sapiens
acatctcatacaattagattaattccaagggtgcagggttgtttaccaacaaaaaaaccccacagtcaatataattcaccacactaacagagtaagagtaacatgatgataaatgtaggaaaaacatttgatagcatgatttttttaaaatcttgggcaggtagtaataggaactttgttagtcctagccagagcaatccaacgaaaaagaaagggcatccagatcagtaaagaggaagtcatactgtcgctgttcaccaatgaaatgatcatatacctagaaaaccctgaagactcatccaaaaagctagaactgataaatgaattcagtaaagtttcaggatacaaaattaatatacacaaataagtagcactgctatacaccaatagtgaccaagctgagaatcaaatccagaactcaaacccttttataatagctgcaacaaataaaataaaatacttagaaatatacctaaccaaggaggtggaagacctctacaaggaaaactacaaaacactgctgaaagaaattatagaaaacacaaacaaaatggaaacacatcacatgctcatgggtgggtagaatcagtattgtgaaaatgaccatactgccaaaagcaatctacaaaatgcaatttccatcaaaataccactgtcattcttcacagaactagaaaaaaaactcccaaaattcatatggaaccaaaaaagggcctgcatagctaaagcaagactaagcaaaaagaacaaatctggagacatcacattacctgacttcaaactatactataagggcatactaaccaaaacaacatggtactggtataaaaataggcacataggccgggtgcggtggctcacacctgtaatccctgcactttgggaggccgaggcaggcagatcacctgaggtcaggagtttgagaccagcctgaacaacatagtgaaaccctgtctctactaaaaataaaaaaaattagccaggcgtggtggtgggcacctgtaatcctagctactcaggaggctgaggcaggagaatcacttgaacccaggaggcagaggttgcagtgagctgagatcgtgccacc

SEQ ID NO: 40677 - DNA, 1059 bp, Homo sapiens
tgggaattgctttagtttttttttttttttttttttacatcattgggaaaccaaattacttttggaaccacatgtgttatataatagtcgggaaattcaaaaattggttattttatgttatagcaccgtataatttagccctttttaataaaaaagttcccccttattaagcaagttaggcactgatggattaaaagatgttaaattatatgtaattggttcattctatgcaatgtttaaattcttaaacagtgtatcatttgcagtattaaaaatactgagatgaatttgattttatatttgcttgatgattaaattataccttttagcatttagggtttcttttgttttttgatttttttaaaattcttttctagcctgacaaaggatcccatgaaaaagatggtgttgggattgctctaaaatgggaatcaggcagttttctcaggatttaggagataaagttattaggctttattttactttctgccactgagattttgatagttgagttagataaatgacattagaaatcaccaaggaataaggtagagaaataagaaaatggatctggtgttgaaactgaagtaaaaagaaaggatgaggaaaggttttctctctaaaaagcttttgcattgtacctaaaggcactattttaatcacaatgaaagccatttttcttttgcgatttggataatatttcaaaactagtctgtatgctgtacattcctttcatcaaaatgtgtgtgattttatacccttgaactctgagctagcccataaagatgaagaaatgagtaagatatgatccatccatgctttttcttgggagagtgaaacaagcaagcctatgattccataatacatttgtaagatattatttttctcaaatgtatttcttttccatgcacatacaaaaaagcagctccttagaatcatgattaagtagttgctttagaaagtgtatgtgtgaggcgggtggatcacgaggtcgggagttcgagaccagcctgacacggtgaaaccctgtctctactaaaaatacaaaaattagctgag

SEQ ID NO: 40678 - DNA, 1024 bp, Homo sapiens
acaggtgctggagaggatgtggagaaataggaacacttttacactgttggtgggactgtaaactagttcaaccattgtggaagtcggtgtggtgattcctcagggatctagaactagaaataccatttgacccagtcatcccattactgggtatatacccaaaggactataaatcatgctgctataaagacacatgcacacgtatgtttatcgcggcactattcacaatagcaaagacttggaaccaacccaaatgtccaacaatgaaaattatatttctatgacatataattttttagttaacattaatgtcattttaaaaatactgaaacacctttaaatgatcgtaaattatttcattgaccatgaatgtaaagaattaatcacttgtcattgattaggtaataaaatacttttaattcttatgttctttgtataacccataaagcaattattaactgttaatgtaattatttctgtgacatcttaaaataagcagctattttattttcctctgaattgttaactacaaggagtcctttaaacgttttaaataaactttacaggccattttttgagttctgaaatcagaatttagatagtgtacttttctgatttctcaattcataaaatcattatgacatctgatcttgggttatttttaatactttatatattgcttatactcatacatatatatgcctcattttgaatcaagagaaggcattctttaacagagagtatattatcaatattagcagtagtcatcaaaataaacaatttagaattctgtcaaacattttgctatggttagatttcagtagtttcattttccttgccttcttaaaagagggctttcaatataagatattgtgagatcttataaacagtattgtagctcattttatttttaatgttaaaatctatatcaggatttaaaagtatacccatgaaaaggttttttttaaaattaaaaacagattattaagattttagctaagttattcttaaaaattattttaaa

SEQ ID NO: 40679 - DNA, 1046 bp, Homo sapiens
agtagactagatgaaactttagaatgaaatgtggttagttttgcttggatcctcaaattgctagtgtgtgataccaagtgttaccaagaatgtcaaacagctggaactctcgtaagttgctgatgggggtataaattagttcaagcactttgaaaactatttgacaatagttactaaagctgtatgtatgtatgtgtatatataccctatgacccagtggtttactctctctagtcattccacatttactccataatacacattaaaatctttttaagatcaaatgtttgtcctcttttactcttttattttgagacagagtttcactcttgatgcccatgctggaatgcaatggcgtgatctcagttcactgcaaccttcgcctcctgggttcaagtgattctcctgcctcagcctcccaagtagctgggattacaggctcgtgccaccaagcctggctaattttttgtatttttagtagaaacggggttttaccatgttagccaggctggtctcgaactcctgatgtaaggtgatctgcccgcctcagcctcccaaagtgctgtgattacaggcgtgagccactgtgcccagcccttttactccttttaaggaacttatttgttccttgttgaccaccaaagttcaaaatcttcaatttgattgcttttttaaaaaatcttttattcctgcttctgttttcctttcaagcaagtgtccttatttttcctctcttattctcaacttgctgttttacttgtgatggacatcagtgctgtccagtacaactttctgcagtgaaggtagtgttctgtaactaccctgtccagtatggctattgagcacttgaaatgtggctagtgtgactgaggaactgatttttaaattatttacttcgttttaatttagcaacttgtggctagctggttaatttattggacagaacaggtctaaattactgtcttcctttaacctctttagctggttttgatttcattctctctacatgcataataatttaccttagtctactttagaccttagct

SEQ ID NO: 40680 - DNA, 1480 bp, Homo sapiens
tgtcaaagatcagtgactatttgcacgggtctgtttctgggctctttattcagtttcattgaactatttttctatttctccaaaactacactgtcttgattaccgtaactttatagtaagtcttgaggttgcatagtgtcagtccttcaataatgtgttggctctgctgggtcttttgactctctataataaactttagaatcagtttgttgatagtcacaaaataacttgctggaattttgattaggattgtgttgaatctacagatcaagttgggaagatctggtatcttgacaatattgagttttcttatctgttatggactgaatatatgtccccatcccccacccccaaattcatatgatgacatcctaacaatgtgatagtattaggagataggactttggggagatgattagatcatgagagtggagtcctcataaatgagtgccttttttaaaaagtccccatagcactctctcgagctttctgccatatgagaacacaacaagaagtctacagcctggaacaggactctcactagaacctgaccatgctagcaccttagtttcatagaattccagcctccagaactgtgagaaataaatttctgtcatttataagatgcctattctgtggtacttcattatagcagccccaaataagaaactatccacaaacatagagtatctctgtatttatttagttttttgatttctttcgtcagagttttgtagtttttctcatatagattttgtacaaattttatgagatttatgcttatttcattttgtggggctgcaacatatgttattatgtttttaatttcagatatgacgtattcgttgttaagatgttgggaagcagttgacttttatatattaatcttgtatccatgctgtaattgcttactagttccaagagttttttggttgattctttcagattttctgtgtagacaattatgtcatctttgaacaaagacagttttatttctccttcccaatcagcatacttttattttcttctcttgtattaactaagactttcggtgtgatattgtaagagggaacatcctttccttgtcttgactttagcaggaaaggttgtagtttcttgccattaagtatgatgttagctgtaggttttttgtaaatcttcttttcaagttgaggaagttaccttttattcctagtttgcggagagttttagtaatgaatgggcattggtttttgtcaaatgcttttccagtatcttttgataagatcatgcaggcttttcttctttagcctgttgatacgataaattatgttaattgatttttgtatgtagaaccagccttgcatatctaggatgaatctcacttggtcctggtatgtaattatttttacacattgttggaatcgatttgttaatattttgttgaggatttttgcatttttgttaatgagagatattggcctttagttttttggatttt

SEQ ID NO: 40681 - DNA, 1076 bp, Homo sapiens
tctgctttaagaaatactttaaaatttttttcacacaaaaaaataaacatttttgagttttgtgtgttatatgccaggctttatgctaatcattgtatcttatttgatcctcataaacagccagccaaagaaggcaggactagccacagagggacggagaagttaagattctttgcacagtttgtaaatggcagagccaagattcaaacccatctgatctgtggtcagactctgtactcctaactgctattttgtctacctttaactgctattttatctactctgcttttaaattttacagattaaatacaactagcaatatttttgcttgaggacacagtaaataaaaaattctcatccattgctagagtataaaataccaatattagtttattattttaatgaatgtaacactaaaactgaaagacctttcatttcatgttgactttctggtgtccctggtcattttttgagccttgctctctataaaatgagtaagctaactgttctcattgtcttcaggatagtcttggtaaagactgtactttggtgtgaaaatgtaatttggggaataccactgatatttttaaaacatttaaaatcttttcagggtaaaagagttcagaaatattttggtcaaaatgaggactcagattaggagaattattgtagggcattttttttttcaattggtaaactctcttcttagtcttttttctccctggtttcctgatccaagacactgtttctttttcataagcattcatctgcttttccatttcctttattccctaaataatatagaataaatggcttatcgtattttggcttggtgtatcactgattttttcatgaatgattctgttttcccatctatatccttgacatctttaaaatataactttgccctactgcatttttaccccttgtccttttacaaaaactgtacctatctatttgacttttgtgctttgcttcctttattcctggaattcatgcatcttgccaggaacataaagggagctagaagggtgcacgagaactaaggcttctagaacattgtactcaaactttat

SEQ ID NO: 40682 - DNA, 1065 bp, Homo sapiens
tctaatgttcttaaatttaaatttgcatggtaggtaacattcatttttctgattgttcatagcattatatcataattagaaatgcagtctcaatttgaactctcaggaacagtttatcctttatgctctaagtttctgttaggaaacatttttgtttatattgaatatttgaatgaagtatttgatataaaatttcggaagttttgaataagaaaagttttgtatttgtttttcggtagcagaatatgtcattactaatcgttgccttccattgaatggaaggatttaatatttaagatgaggattttaaccatcatatcagtcattccctaatttatctgattttattttttattcacttttttctttgcaatatcatgtatttaattacttgttttagaatccagtttttttttttctaacttgaatctacaagtatgagtaggcttcagttttgcgtgatctacctgaaggatgaaatttttttttttttgcaaatataagaaaccactgttggttacttgatttttatgttaaaaactgtttacatctcattatttaaaaataaatgattcactataaaaagtaagtgttgtatttttataattttccttttccatctttccttgtttaagcttgttgcatttacccttttgataaaagagaatcacataagcattgcagaggcagttttaaggtatagtaattgttttatggcacttggaagtggcgtacatataatataagttgatggtgtaggattagttgcttggttaggaaatgaccttgcaatttacaaaatggacacctttgtgccttggtttccttatatgtaaatggagataatatttagtaggtagtgtgcataaattcaggaaaggtgtgtttttgtagtccttttaaagaaaatttaaatcttttagctgatgaatgattaaaaaatttctgtgaaaaatacaatgaaaaaatgtcaggattttccatggcatattagaatggctgattaacattgatttttgctttggagaggtatgcctctgaactgaaaaatgtttctcatctatc

SEQ ID NO: 40683 - DNA, 1054 bp, Homo sapiens
ttgtacctagttgttatgctgtgttgtttttaattgttgtattgttattttttattgtttattttgttgaatattctggattcgtgctggttgaatcccaggatatggtgctcatggatacaaagggccaactgtacatgtaaacattacttactaaggaaacagacttaaataatgcctgagtgggtaaatggccttgttcaagatgggcacaaaatctgtaataggtggtttaaaaatacgctacatgaaatatagatgcacagtgacgaagtatataatctagcaatgatcaaaaaaaggttcagttaggtttctcttctcataaaaatgatagagcatttgacaactattaccatttgcttgtgtcagaggccctgatggaacagcaaattcttccttgccctacacttggagttaattatgtgaattgacagtggtttcaatgacaaggtcccccaaacatcagaactcccactttaagactctcatgtaaagctataattacatcagtatattgtcagtatatctgtagcacaaattatcttgtacgtaaaagacaatggattaaacaatattaaatagatttatcttcttaatttttgcctgagaaaatcttttatagtgaattgctaaagtgttctctcattatggagaatcagaccaaaacttcctatcccctgaaagagtttacagtaaatcactattactatttttttttttagagagaagggtcttgctctgttgcccaggctggagtacagtcacatgatcatagtcaatctcctggctcaaccaaactgcccatctcagcctgaccaagtagctagggctacaaatgtgcaccaccatgccagctgatttttaaaattttattttgtagagatgaggtctctctatgttgcccaggctagtctcaaactcttgggttcaagtgattcttctgccttggccaaatcattattaaatgatttactgaacgtgattctgtttggaaggagaattagaaaagaaaactctggccgggcatagtggcttaggcctgtaatcccag

SEQ ID NO: 40684 - DNA, 1043 bp, Homo sapiens
ggaagactggactcaattcagactcctacatgacaagtggagaggtatagccaaagagcagggtggggatcagtggatggaaagttaccaagaggaaacatccaggataaaaggtctctggctaaactgactgcatagtattaggctgaagggaggcctgggtaataagcttttaaaggtgggggatttttgccaagccaacttagcaagattcttgctctaacaggattctccaaggacagaggaaagcccaaggtcaggcctagtcaagcagaagactcacagagctccctccaacacgaccctgtaaaacttccctccagcctctttgcagacaacacctcctctactgtgctgccccaggcaacaacatgttttcataccttctgtaataaacctgcctttctttacccaaaaccatcttggttaaaaccttgactgcctgagagcagcctgactgcagtttttgtcaaaggaaagagtctttgtcacccaattgtagtcaattatagacagattactgtatttctttttttccccaaattcaaacattctttgaaatgcttttctatgtccatattgttctgttgacttaaaaataaacctttcatagctgagtcctgatgtctgtggaaaaaaataataaaccttccaacatatctattaaatgaatagatacagctatttagttggagagactggcatgaggggcagtcaggtgtcccattacaccgaacttgcaactcatacaccatctaggggccaagggaaaaactttcctttcactctctgaaagttcgctgaaaaatcaactcacaaaaggcaggttaattggagaaaatgtcatgggtgtgactagctagggccagtgtctcaggcagtcaaggtttttactaagagttctgggtaaagaaaggcagatttattacagaatgtatgaaaacatgttgttgcaacagacagcatagcagagggaggggctgtctgcaaagagcaggggctggaaggaagttttacagggtcttgcgggagggagctatgtg

SEQ ID NO: 40685 - DNA, 1044 bp, Homo sapiens
tgtcttggctttgcctatagagtaaattccaatttctttaatgcggtattttattcccaagatagttttccagttgcatttctacaccaaacattcactgctcttgtcacatcaaaatatatataaactctcaacatgccatgtctgtgtttttatgtgactgtgtccttacctgtagggttccatgagcctgaaaacttttttgttgttgttgttgtttatgcttatcaaaatcttagttatccttagctataaccccaaaatcttagtatcccttttttatttattgagccacttcatccagccaattgttttaatttttagctcccacaaataagtgagaacatacgaagtttgtctttctatgcctggtttatttaatttaatgtgatgatctccagttctatcctaataatgtttttgtgttaaaagctattttatctgatgttaccatagttgactcagctttcctttggcagtttgccttttactttcagcttttatggttcttacctttaggtggacctcttttaaatagcatggattttgtttttaatccactatggaaatacctgtgtcttttagctggaaaatgtattgttttactcgtcaggcctaagttggtaagtgtttcctccagaaggggtttgctttggcttctactggtagcatctaggtttcctttagtgcccttgaaggtcttagtgattgtggggtagcaggctcagcttccttaccttgctggtggcccaaggctcagtgtccttgctgaagtgcattattggcagctgctctcaggcctaccttgcctttccttaactctccagccataaggataccttatttggagtgagggtaaagtttgttatctcttgtgcaatctgggatgcttcaaggaatatttcctttctttttcctttttctctcttttccctctcctctgctgtctctctccctcttccccctttccttctcccttctcctctactctcctttccccttcctgactcctcccctcccctcccctcctatcaaagacagggt

SEQ ID NO: 40686 - DNA, 1084 bp, Homo sapiens
tgtcttccacaaagtttttgtagatagtattttcattatttcaattctgaatattttaaacttttatggtttctccttttactctgagtaatttagaaatatttaaaaattttcaaatatgtagagttttaattgtattgtggttagagaacatagtctgtttgataaaaaatttcttgaaatttcttgagacctgctagtatatgatcagtatttgtaaatgttccatgtgtgcttgagaaaaatgtgtactctctaattactggatagaaagttgtgtatatgctctctagatcatcctagttaattgtatcctttggatagtctatattttactaatcttttgtctgtttgacatatgaataattgaggaaagtatgttatcattggcctttttactccctgaagttatatttattttgcttcatatatatatttttcaagtacataacaggtttaggattattgcctcttcctggtgaattgaactttgtatcattatatagtgatcatctctacccctaatttgttttgaaattttttaatttttacagacacatagtagattcctgtcctttatcttcccccctgcctcccctccccctggcccccttcacctcctctgtagttctaaaacaccagaggaaggagggacttgggtttcgctggttctgcttaaaaacatcatggctttctgttccatggtcgggggcaagaagtgtgccgaggttccagcctgcgagggactgggtgtatagtagatgtgtatatttatgggttacatgagatattttgataaaggcatgcaatgtgtaataatcacaagagggtaaatggggtatccatcacctcaagcatttatcctttgtgttacaaacaatccaattatactcttttagttatttttaaaagtacaattaaattagtattgactgtagtcaccctgttgtgctatcaaatactacttcttatttattctttctattttttgtgcccattacagccccacttcctcctctctcctgcccctactacccttccccgcctctggtaaccatatttctactctctatctccataaagt

SEQ ID NO: 40687 - DNA, 1029 bp, Homo sapiens
tactttaccaactaagtttatgtaatattccaaattatttgttgttacttcagtggtgtttacagcatcttcaccaggagtagattccatcttaggaaatcactttctttgcccatccataagaagcaactccttatccaaacctgtttgatcatgagatggcagaaattcagttaatcctcaagctctacttctaattgttgttctcttgttattgctaccacatctcatttacttcctccactgataccttgaactcctcaaaattatccatgagggttggaatcaactttttccacattcctgttaatgttgatgccttgacctccttgaaggaatcatgaatgtttttaatggcatctagaatggtgaatcctctctacaaggttttcaatttactttgcccagatccatccgagaaatcacaatctatggcagctatagcttcatgaaatgtatttgttaaagaataagacttggaagtcaaaatgacttcttgattcacgggctgcagaatggatgttgtgttagcaaacaggaaagcagcattaatctccttgtacatctcaatcagagcttttgggtgaccaggtgcattgttaatgagcagtaatcttttgaaaggaatcttttttctaggtagtcagtccgaatagtgggcttaaaatgttcggtaagccatgctgtcaacagatgcactgtcatctaggctttgttgttacatttatggagcacaggtagagtagatttagcataattcttttttttttttttttttttttgagatggagtctcattcttgttgcccaggctggagtgcaatggcacgatcttggctcaccacaacttccgcctcccaggttcaagtgattctcctgcctcagcctcctgagtagctgggattacaggcatgcgccaccacacccggctagttttgtatttttcgtagaggcaggatttctccatgttggtcaggctggtctcgaactcccgacctcaggtgattcacctgcctcggcctctcaaagt

SEQ ID NO: 40688 - DNA, 1082 bp, Homo sapiens
tcttttgctgtgcaggtacttgttagtttaatcaggtcccatttgtttatttttgctttttttacatttgcttttgggcttttagtcatgaattctttgcctattccaatgtccagaagggtttttttaaggttatcttctataatttttatggtttcatgccttagagttaagtctttgatccatcttcagttgatttctgtataaggtaagagatgaggatccagtttcatcttctacctgtggcttgtgaattatcccagcactttttgttgaatagggtgtcctttccccactttatatttttgtttgctttgtcgaagatcagttgactgtaagtatttggctttatttctgggttctctattctgttctgttggtctgtgtgcctatttttatgccagtaccatgctgttctggtaactatagccttgtagtatagtttgaaattgggtaatgtgatgcctccagctttgttctttttgcctagtcttgctttggctatgtgggctcttttttcattccatattaattttaggattgctttttttttttagttctgtgaagaatgatgacggtattttcatgggaattgcattgaatttatggatcgcttttggcaatatggtcatctacacaatattgattctacccacccataagcaggggatgtgtttccatttgttcatgtcatctatgacttctttcagcagtgttttgtagttttccttgtggagagctttcacctccttggttaggtatatttctcccttggttagctatattcctaagtatttttattttatttttttgcagctgttataaaaggggttgagttcttgctttcattctcagcttggtcactgttggtgcatagcagtgctactaatttgtgtacattgatcttgtaatttgaaactttattgaatttatttttttatttttatttatatttatttaatttatttattttgagacagagtttcgctcttgttgcccgggctggagtgcaatggctcaatctcagctcactgtaacctccgcctcccgggttcaagcaattctgcctcagcctcctgagt

SEQ ID NO: 40689 - DNA, 1029 bp, Homo sapiens
tcatttgtgaaaatcaggagtgattagtgtaagtttgttttatttagaacttttggtggtggacacaagagaaaatccgtatgtaattttattgcatttactttgttggtattttgtaggtcaggaacctagcattgtttagactaaaaaatatccaattttagagatggggttaactttttcccctaatatatttattattgttaatactgctgtttaacactcattccaaaacttagtggcatgaaacactttttattatgcacatcgattctgcaagttgtgccctctgaaagggcacagtggggatagatttttctcagccatgtggtgactgggatctcagttgggaagactggaaagttgagattgacacacttgactcctgggggccaaaatagtttgatggctttttcaccaacatgtctggtacctaggctagcattgttgaccagactgccttcatgtggccttgcttgtgtataacctggcggcctcgaatgttaaagtgaacaaggacaaatctgcgtttttttttttgttttttgttttttttgacaaagccttgaaagctgagcattgtcatttccacagccttctattggttacaagtgcacactcagacagaggaggggaattagacttcacctcttgctgagggagttgacaaggttttggaagagcctgtggtacaaagatactgttgtgaccatctttagaaaagacattctgtcacaatagttaaatagttgccactgttgtttgttttgaatatgtattttataataacattagagatagaagatcaggaatccttttttttttgagatagggtctcactctgtcacccaggctgtagtacattggcacgatcatggctcactgccaccacaacctccccagactcaggtgatcctccctcctcagcctccttagtagctgggactacaggcatgtgccaccatgcctagctaatttttgtaaggactgggtctccttatgttgcctaggctaggaattctttatctt

SEQ ID NO: 40690 - DNA, 1040 bp, Homo sapiens
tatagagcaatttagtattcatcatagctcaaccaagaatcttttgtatgtaataatttgacttttataatgtgttttcatatatctcatgagaaatggtcttatataacctaattctgtcttatgtctctgtctttcctacttattgaaaagttcatattattgaaacccagtattctattgttgacctataataaaactataaatattattctctgacagaatgttatgaagatgtgccactgaataatagttgttctttccagcttgattatcttagaggaaaaatggcatgtgatttaatttatacgagagtaccttgtagactttatgggattatgaaaatgcaaagtattattattaatccttccatatattccatgttactcttcagaacttagaagtaaatattttttgctctgtagcaaaatgactgcaatcagtggacttttttccagcacctttgtaaagtctggagtctaaaaagcccagctctctgtaggccaggttcatttttggaagtgtgtagtgatctatctttcccactcaattgtggttttgtttgctattaacaaaaatatagtttttttgttaacagataaaattataagtccaaaccactagttcaaaatatttttctaaattaattaagatttaagatccctccccaccctattcacttaggtatctataactggggccattttctaaatggaaccttttcaggcattacttgtatatcaattattacttaataatccccccattttctttaggcttgagttgaaagaacacttatatttgattcagatggctttctaggactatgaatagagatagtgtttcagagtttcaacacacatcagtgtcctttcctttctgattttctgggacaaggacctggtaacatctgtttattcttactcaaaatgcttgcattaatttacctttgctaattatctcctaaagtattccctaatactttccttcccatctacagaaaaagtatgtgaaatgcttttgctgcatgattataacat

SEQ ID NO: 40691 - DNA, 1048 bp, Homo sapiens
ctcagccacccaagtagctgggactgcaggtatgcaccaccatgctcagctaattttttttttttaattttttgtaaagatgaggtctcactatgttgtccaggctgatctcaaactcctaagctcaagtgatcctcctgcctcatcctctcaaagtgctaggattacatgtatgaaccgctgcaccccaccacagtcatcatttcttcacataatctttctttcctttcctttctctcttctcttattgcagctctcattatacatatgtttataggcttcatggtgtcccatggatctctctccaaggctctgttcatttttcatcattctttttgttggtcagactggatactcttaattgtctgtctttaagttttctgattctttcttctgctgttgagcccctctggtgaaattttcattttagttattatttgtttagttttcctggtggtggaaggacagagtatataagggaattgagagtcagagaggctaagagggactgatagattggggagaatggaggcaacaccataaagagtagatagggcttgttctctgtcatcttccttctacataccattatattacctaatgcctagtattttgtagttcatataggcacacatagctgagaggattttaaggcggaaataattaggaatgaacatttcactcattactttaaaacttgggactatgattgcagaataactgttgaggatatagtgggatgctgggaaaataagttaaagagcttgtaatcatggaataaacttggaagaagtacaagtttacagaaaggaaaaacgtttaagaatgaaatgtgttattacctcgtctcactaaaaaagaatgtcatgtcacgttttaatttcatttgaaccttattgaccaaaggctaattataacctcatacctttgtacagtgctttacactttacattatgccacaacaggaagtaattctgggtgattaaaataccaggatcatgtgaacgtcagcatttttagcctgggattacagggaagttctaatatg

SEQ ID NO: 40692 - DNA, 1033 bp, Homo sapiens
agtattaattcacttaattttcacaacaatctgtgaaataaaattttaatatccccattttacagatcagaaaacagaggcaaaactaattatagctcagaaggcttactattatattaccttattttagttcttcagtaaagattgctaattagggctttaccataatatcacatctattagagatgtttgtctctaaattgttagaaatttatttaaataattgttacttaataattgttaaataattatattgtccgtatccattagggatttctctctctaatttaataactattacatatattgcccacagttccatgtttctgcttcacctgcatggaaacactccttcatcgcttttagtcataagaagtgtggtgcaaagaacacatggggtgggaaatctctagacctggatgtctgtctgccttagtagctaagtagtgatcagttccagtttcatctgttaaataagggaactattaggtctcttctaatcataccttctttaattctagaatgggagcctctccctggactgtgtgtactttgaggggcagaccttgtctttttatctctagttcctaccatagtgtctgacatagcaagtgtgctataaatgtttcttgaataaataaatgaatgaacagaatgaaaaaattctaccagtggtccacaattctaagtttgtgttacttttatttttaaatttttttttagagacaaggtcttgctctgccacccaggctggagtgcagtggcttaatcatatctcactgtaaccttgaacccctggcctcaagcaatcctgccttggcctcccaaagtgctgggattgcaggcgtgagccaccatgcttggacctatgtttgctttaggatgcaaattgtttgaaaaaattctaatttggtgattttccattgattataaagtggtatttgtggctgggcatggtggctcacacttataatcccagcactttgggaggctgttgggggggtggatcacctgaggtcaggagttcgagacc

SEQ ID NO: 40693 - DNA, 1049 bp, Homo sapiens
tccggccttctctaaaaattttatagttttccattttatattaagtcagcagtccattttgagttaatttttgtgcagggtgtaaggtctgtgtctagattcttttttttagcatatgcacgtccagttgtccagtgctagaactagcactgtatgttgaaacaacttctttctccattgctgttccttgttcctttgtcaacgaacatgtgagtatatttgtgtgagtctatttctgagctctctattctgttccattgatctatttgtcttttctgtcaccaatatcacactgtcttgattactgtggctttataataagtcttgaagttgggtagtatcagtcttccaactttgttcttctccttcaatattgcattggttattctgggtcttttgtctttccccatgagctttagaatcagtttgtcaatgtccacaaaacagttggctgggattttgtttgggattatgttgtatctatagattaagttagaaagaattgagctcttgacaatattgagtcttcttagacttatatgtggaatatctctccacttatttagatcttttttgatttgttttatcacagttttgtagtttaagttttccttatatatattttatacttttgttagatttatacctaatatttcttttttgggttgctaatgtgaatggtattgtatttgtaatttccaactgcaattttttattgctggtatataataaaacaattgactttttatattaatcttgtaccctgcaatcttgctataattgtttattagttccaggagttcttttttgttgattctttgggattttcttcgtagacaattacgtcgtctgtgaacaaagttttatttttgcctttccaatctgtatacctcttatttccttttcttgtcttatattagctaagacttgcagtctatgttgattaagagtggtgagagcaggctgggcgtggcggctcatgccagtaatcccagcactttgggagtccgaggcgggcggttcacctgaggttgggagtttgagaccag

SEQ ID NO: 40694 - DNA, 1535 bp, Homo sapiens
cttgcactttgtaatatgcatttgagaatcctctatgtcttgtcatggcttgatagctcatttctttttagtgctgaataatgttctatttctggacatatcaagtttatccattcacctactgaaggatatcttggttgcttccagcttttggcaattatgagtaaagctgctataaacatttgtatgcaggtttttctttagacatgttttcatcttctttgggtaaataccaaggagtgcagttgctggatcacatggcatgaacatgtttagttttgtaagaaactgccaaactgtcttccaaagtggctgtactactttgcattcccaccagcaatgaacgagcattcctattgctccacatccttgtcagcatttgatgttgtcagtgttttggattttagccatgctagtgggtgtacagtggtgtgttttaatttgcaacctctaatgacatgagagttgagcatcttttcatgtgtcctatttcccatctgcatttcttctttggtgaggtgtctgttcagatcttttgcttattttttaattgagttgtttgttttctttttctttttattttcttttcagagctcctctcaagaaaggagggctgtctgttttcttattgttgagttttaagagttctttgtttatttttgataccacttctttatcagatatttgttttgcaattattttctcccagtcaatggcttgtatttttgccttcttgaaaatatctttcacaaagcaaaagttttagttttactcaagtctaacttcccaaatttaaaaaatatttttaattgatatataatgattttacatatttatggggttacatgtgatactccagtacatgtatacaatgtgtaatgatcaaatcaggataattagcatattcatcacctcaaacatttatcatttatttgtgttgggaacattcaaaattctctcttcatggctgggtgctgtggctcacaccagtaatcccagcactttgggaggctgaggagcgtggatcacctgaggtcaggagttcgagaccagcctggccaacatggtgaagccctatctctactaaaaatacaaaaaattagccaggcatggtgacgtatgcctgtagtcccagttacttgggaggctgaagtgagagaattgcttgaacctgggaggcggaggtttttggccaggctggtctcgaactcctgacctcaggtcatctgcccacctcagcctcccaaagtgctgggtttacaggcttgagccactgcacctggccaattattattaactatagtcactcttctgtgctatggaacaccagaacttattcctcctatctgtgattttgtacctgttaaccagcctctccttttctccccatcccctggcccttcccaacctctggtaaccactgttctacttggtacttccatgaggttaacttttttttttttcctatttatttatttatttatttttgaggcagagtctcactctgtcgcccaggctggagtgcagtggcacaa

SEQ ID NO: 40695 - DNA, 1030 bp, Homo sapiens
agtagagatggggtttcaccatgttggccaggatggtctcgatctcttgaccttgtgatctgcctgcctcggcctcccaaagtgctgggattacaggtgtgagccaccgcacccagcctattttgtatttcttttgaaatagggtcttgctctgtcgcccaggctggagtgtagtggtgtgatcaggactcactacagccccaacctcctggactcaggtgatcctcccacctcagcctcccaagtagctgggactacaggtgtgcactgccatgtccagctagtttttgtatttttagtagagatggggttcgccctgttgtccatgctggtcttgaactcctgagcacaagcaatccaccggccttggcttcccaaagtgatgggattacaggcatgacccactgtgcccagcctttaatttgttttatattctttatataattgtccctttatctgtggttttgctttctgctgttttagttactgacttgtggtctgaaaatattaaatggaaaattccagaaataaagatttcgtgtttcaaattgtacccattttgagtagtgtgatgaaatcttgtgctgtccagcgctgtcctcctctgtccctttggggacatgaatcatccctttgtccagtatatctatgctgtagacactacctgtcacttagtagccattttagttattagattaaaaaacagtgtgtatagggtgtctggtactatcccagatttcaggcagctactgggggtcttggaacgtattccccatggataaggggggactactgcatatgtattggctctcacataatttaaaaagttgaattgttactttcagtgtatataaattcatactttattgctgcattagtttttccaatagtataaattggttcttttcgtaagaatataattagttaaggctcaacttttggtcttttcatacaataagctgcattatatataattaattgtgaatgttacctatatattgttgatatgctcattgtcaaatctaaaatc

SEQ ID NO: 40696 - DNA, 1023 bp, Homo sapiens
gccagaaatcacataggttacattaaagataaatgattctggtatatataatgtagtatataaccaaaacattgttcaggtctttagaagaaacattagaagaaataaaatatcattagaaaagtttaatactacagttagcaaaatgttatttcccttgaagtatgactttaggcaatattaattatatcacaaatttataagaggctggaaatgcaagatttacatctgagtttttcacctttaattaaaaatattctctgggtcgggtgcggtggctcacgcctgtaatcccagcactttgggaggccgaggcgggtggatcacgaggtcaggagatcgagaccatcctggtgaacatggtgaaaccccgtctctattaaaaatacaaaaggaattagccgggcatggtggcgggtacttgtagtcccagctgctcgggaggctgaggcaggacaatggcgtgaacccgggaggtggagcttgcagtgagccgagatcccgccactgcactccagccagggcgacagagcgagactctgtctcaaaaaaaaaaaaaagttatttgttcacctttttgttttgcaggaagagaggcttttgacccaactctcctttttatttaatatttatacttttgaatattttttgtagagaccgggtcttgctgtgttgccagagctagtcttgaactcctgggctcaagtgatcttcctgtctcagcctcccaaaatgctgggattacaagtgtgagccatcatgctggacctccaactctcttttactttaaaaaaaaaaaaaaatccggtttaaaagttgttctttttttgttttttcgttttacagacagggtcttgctgtgttgttcaggttggtcttgaactcctggcttcccaaagtgctggcattacaggctcatgccaccacacccagccaaatgttactcttgaagagaaacaagttcagaatatttctgaactttttaatacaagcaagaattcataaaataaattttcttcatta

SEQ ID NO: 40697 - DNA, 1048 bp, Homo sapiens
gcactttgagaagctgaggtaagcggatcacatgaggccaaaagttcaagaccagcctggccatcatggccaaactccgtctctaataaaaatacaaaaattagtcgggcatggtggcgtacgcccgtagccccagctacttgggaggctgaggcaggattgcttgaacctggcaggcagaagttgcagtgagccaagatcgcatcactgcactccagcctgggcaacagagcaagattctgtctcaaaaaaaaaaaaaaaaaaaaaaaaaagcgagaatatactccagaaatagatggagaaaagaatccttcccacagtgttagaataacttgacggggggagaaaaatgaacctcaagccctaccctacatcactacaaaaacttacttgagattgataatagacctaaaaacataaaagcttaaacattttatgagaaaacaataccaccataacaatctggaggtaggcagatttatttagaaaaagtccatttaaaaattgataaattaagactccagtggaaacttctgctcaaaacactataaaaaaaatcaagagtcaagacacacaatggggaaaatatttgcaaaataactgacaaggaattttattcaaaatacatagagttcctataacttggtaataaaaacgaacctaatttaaaaatacacactcaaagacatattaatggccaataaacacgagaacgtgttcattagtcagagaaatgcagactgaaaccacaagataccactacatgcccagaagtcacaatatttgtgtgcaaatgttcatagcagctttactcacacttgccaaaaactagaaaccaataaaatgttcactaacaggaaaacagattaacaaattatagtatattcatacaatcgagtcctactcagcaataaggactgttgaacctcaacaatgtttacgctgaaagaattacaaagctccagggaaggaaataaaaatgaaccctagtctatgatgaaaacatttgagcttggtggtggtgggagattgcttaattgcctgggta

SEQ ID NO: 40698 - DNA, 1028 bp, Homo sapiens
ccggagtaccacttatccagcttgtaaggcgcccagtggaagtcctgcaggacccaactctgagactgaatgctacttactatattaccaagcaaatccttccacccttggcaagaatcttctcacttattggtattgatgtcttcagctggtatcatgaattaccaagggtaagcttaccaaatagtacatgtgctctaactatggagagatttcactccaaattttcagtagaactaaaggttttatgtgctattgatatgggagtgctgggaagggaagagtgtggtcccgtaaaatgatacggaaagcgggaggggaagtgctgggtagagaaaggtgggtccctggctagggctccacccccacagatctaggtgaggataggcactcctgctttcatgcccaaatgttaccattttccaagaccaccttggcctgccatgccccaatcctgggcctataaaaacccgagaccctagtgggcagacacacgagcggctggacattgtgaggaacacttcggtggaagacccaagcagctggtcgtcaagaggagcacgccagcagaacagcacaccgagaggcactggcatgctggcaggccattgaccggcaggacaaggtggagtttggccagggcagtcagagaagagacggggccacctagaagcccaactccaggggaaaaccatctccctgctgattccaccatcagatgagagctacttccactcaataaaacgttgcactcattctcctagcccacgggtgatcggattcttctggtacaccaaggcaagaacccggaatacagaaagccctccatccttgagacaagctagagggtctaattgagctggttaacacaagccgcctatagacagcaaactaaaagaataccctgtaacacacacccactggggcttcagctgtaaacattcacccctagacactgccatggggccagagctccacaacctgcccgtctgtgtgctcccctagaggtttgagcagcggggcactga

SEQ ID NO: 40699 - DNA, 2067 bp, Homo sapiens
gaggacaaaatcattagagaagaggagttcaaggaatcaaggagtatctttattttcttcccacataattgttacacttactgcatataaaataacagtagtccttttcctttaaaattcaagtagatatagtgccattcacctctggaatttagtactgcagaggagaaatctaaggtccagctaattaatatatttgattattgctcctgtctccatattaggctttcctttaggaacctaattatatattaacattctgttctctgttccccatatcttccctcttctcattttcatgttttcatcctctttatctgcatgctgagacatttccatattcctaacttgacttttagtagaactatttagtagaactgttctgctatttactgctttcaatatgagctttcattctgttagtgattttataatccttcctcatttaatcttgtggccttttcctcattctattgctctctacctttttacaacctatgaggggcatctgtgtatatgtatacctacacaagtacatacacacactgtgaagtgtgctgcattgtagtgccattgttctgaagattgacagaaattgtagataaagtaagaccaatttgggtcactgcactgagataagattaacattcaatccctattttgtacctcctggatcacaggagtggaaaagaaagtaatttaaaattataatgtaatatacaaatgtgaagtgctgtttgaactatttctgaatccgaaactgacctaagaatggggactactggttccttaatttccattttgcattgaaatacctgccattgtctagattgcttttgtcttgtagatatttcagagaaatcatctagctggaagtacatatttattaatttgggcccttttacagtatcctttacccattaacactgctttcacttacgtatttggaacatggggagacatttctgacattttagtattttgcttttggaatgaaattgagtggctctataatgtctgtgtagtggggtctagtaactaatgtaattattgggaggagaatgcctgcctttaactagataactcacctcaaatctgtggaatcccattaatcagcatgtcatcaagaaccaaaaagtaagtatggaaagaacaaaaaattaatttgcttgacaatgcttctgtcaatatgtatattatcatggagtataaaaatggtaagaactagaatctcttaaaataagtattatatgaccaagttgaatctcatcaggtctgctttctctaattaaataattttccaatttgttatgaacatttctgtccagtaggctctacatagttttgaattatgattcagttgtactgcacatcagttttacaagtagctttaatatctactatgaaaagtttaaagtgatattggtatcttttagaaccaaatttgctacataaatgtaagcattattataatggtgtcttgcctttttttttaggtggctctaactaactacacctttgaaaatgtgagctttcatgttcttcatcagcgttttcccctctttacctttcgagtcttgtcagactggtttgataacaagacagatctatacaggtactgttctataactctgaagaaggtaatataaaatcatcattgagatgtaatttatatgtaataaaatgcacacatttaaagtgtattgttcaggccagttgcggtggcttacgcctgtaatcctagcacattgggaggccgaggcgggcacatcacctgacatcaggagttcgagaccagcctggccaacatggtgaaaccccatctctactaaaaatacaaaaattggccaggtgtggtgatgcatgcctgtaatcccagctactcaggaggctaaggcaggagaatcacttgaacccaggaggcagaggttgcagtgagccgagatcgtgccactgcactccagcctgggcgacagagtgagactctatctcaaaaaatatataaataaataaagtgtattattgttcaatgactttgaaaaatgcatttatcttgtactcattact

SEQ ID NO: 40700 - DNA, 1336 bp, Homo sapiens
gataatagtgaagataaaagtaaaggtaggaagaaagcgaatcccttcctatgacccttgaaagcagagttactcttgggaagattttatactcacttcccaccaccatcactattttcatcagacaagggataggaaaagcagtgttctgttctcaagattgaggggccagtgaaagacaaatatttgtttagcctctaactaacttcccagttgtacttgaggttggtttttctgtggtgctgaaataatggagaactgtataaagttccattgtattattcattaactaggtttctaccttgggagccagccaccatttcagtacctttttttggtttgttttttcttttttaaagttttctgagttctaaacaagccaatattttcaaaaagctttgggatgcattctctgtataaatttatctgttcataaatgtaggattatctattacatactcttgtgcacagagctccttaaaaaatctcttttgaccatttggtagtcggtcctcagtccgatagtagaatcttgtccaagtttatgaaaaaaaatttttaacaaaaatattttaatttaaaaataaaatcattaagtggataatttgcattttctcaacagtgtagctcttggtagccatggactctcttattaaatgcttcactttgtagaaacttaaggattctgcccattgctaggtttagggttttagatgcctaaagcaagatagaagacattctttggatcctgatatacagataaaagctgtccatgagcatgttgttatactcacccttttttgttttgcttatatagttgaacttcatcctataaaaactaaatcagtattctacatgaaaaattaagatgatattctacagacttgtcatcagattgaatcccagatgggttaacataaaccattctgagaattagaaaaccaaaacatgtgttttctacaaaacaaaattaaatgacagagcatcaaaaatagtatgctactacccacgactctgaaggaaaaaaagtatttttactatttatagcactggtgactagatagattcccatctatttgagtcttgtcattgtcagtcctaccttttatcttctcacagaggttgtcatcaacatgtcagatgctttcagtatccacacttcttttatttctgcaagcaactcagagaaagaaatatgtaagagtttcagtcaatactattttgtgtaccagcacatgtccagtaatgtccctgggcttgtatgcttgccttttccttgttgggtatattcccaatgataggattacctgccaacattgagaattttgttagtcat

SEQ ID NO: 40701 - DNA, 1049 bp, Homo sapiens
tccacctcgctgctggtctcccacagatccaagagctgaagaaatcatggctgctgcagaaaaagaggcaatgctttttaagggtcctaatgtatataagaagactgttaattctcgtataggaaaaactagtcgcgcaagagcacagattaagaaatcaaaagcaaagcttgctaatccctctatagttactaagaaaaggaacaaacgaaatcagacaaataaactagtagatgatggaaaaaagaaaccaagagcaaaacaaaaaacaaatgagaaaggtacatcgagaaagcatacaacacttaaggatgaaaaaataaaatctcagtctggtgctgaggttaagtttgtactgaaacaccagaatgtgtctgaatttgcaagtagttctggaggctctcaactactttttaaacagaaagatatgccactaatgggctctgctgtagatcatcccctttctgcttccctacccactggaattaatgcacaacagaagttatctggctgcttttcttctttcttagaaagcaagaagtctgtagatttgcagacattccccagttcacgagatgatttgcatccatcagttgtttgtaattctataggacctggagtctcaaaaattaatgttcaaaggcctcataatcaaagtgctatgtttactctaaaggaatcaacgttaattcaaaaaaatatatttgacctttccaatcatttatctcaggtagcacagaatacacagatatcttctggtatgtcctcaaagatagaagataatgcaaataatatacaaagaaactatttgtcatcaatcggaaagttaagtgaatatcgcaattccctagaatcaaagctggaccaagcatatacccctaattttttgcattgcaaagacagtcagcagcagattgtgtgcatagcggaacagtcaaagcacagtgaaacttgttctccgggaaatacagcttcagaggaaagccaaatgcctaataattgctttgtaacttccttgagaagtccaatcaaacaaatagcatgggagc

SEQ ID NO: 40702 - DNA, 1037 bp, Homo sapiens
acaaggaagatttaattgaagacctttcacagacaaacaaaaatacagaaaaaggtctagataactcagtcacttcttttacaaacgaaagcacttattctatgaaataccctggatctttaagcagtactgttcattcagaaaattctcataaagagaatagtaagaaagagatcctcccagtatcttcctgtgaaagtagtatttttgattatgaagaagatattccatctgttacaagacaagtaccaagtagaaaatatacaaacattagaaaaatcgaaaaggattccccttttatacatatgcaccgtcaccctaacgagaatacattgggcaaaaattctttcaacttttctgacttaaatcattcaaaaaataaagtatcctctgaaggaaatgaaaaaggaaacagcacagctctgagtagtttattcccttcatcatttactgaaaattgtgaattactgtcatgctcaggggagaatagaactatggtgcattctcttaatagcactgctgatgaaagtggactaaataaacttaaaattaggtatgaagaatttcaagaacataaaacagaaaagccaagcctcagccagcaagcagcacactatatgttttttcccagtgttgttctttctaactgtcttactagaccacagaaactatctcctgtcacatataaattacaacctggcaataaaccatcccggttaaaattgaataaaaggaaacttgcaggtcatcaggagacttctaccaaaagtagtgagactggatccacaaaagataattttatacaaaataatccttgtaatagtaatcctgagaaggataatgcattggctagtgatttaactaaaaccactcgtggagcttttgaaaataaaacacccacagatggttttatagactgtcactttggagatggaacgttagaaactgagcagtcctttggactatatggaaataaatacacacttagagccaaacgcaaggtaaattatgagactgaagacagtgagtcaagtttt

SEQ ID NO: 40703 - DNA, 2390 bp, Homo sapiens
aaaaattctaaacttcatgtggaactacaaaagagcctaaatagccaaagcaatcctgagcaaaaagaacagttggagacatcatattacctgaggtcaaaacgatactacaaagctttagtaaccaaatcagcatgatgttggtataaaaatggacacacaggctgagcaaaataatactacaaagctttagtaaccaaatcagcatggtgttggtataaaaacagacacataggctgagcatggtggcttactcttctaatctcaacagtttgggaggctgaggtgggaggatcacttgagccaagaaatttgagtccagcctgtgcaagatagtcaaagcccatctctacaaattagccagtcacgatggtgcatgcctgttgccccagcagcttgggaggctgagatgggaggatcatttgagcctggaagctcaaggctgcagtgagccataatcatacactgcactccagcctggatgacagtgagaccctgtctcaaaaaaaaaaaaaaaaattgtaggacagatactctgggacattggtctgggaaaaaattttatggctaagacttcaaaagcacaggcaaccaaagcatatagacaaaagggactgtgtaaaagcttctgcacagcaaaggaaacaatcaacagagtaaagagacagcctacagaatgagagaaaatatttgcaaactattcatgaaatgagactaatctccagaatatgtaaggaactcaacaggaaaaaaaatagtttcgtatctgaatagacacctctcaaaaaagaagacatacaaatggccggcaggtatattttttaaatgttcaacatcactaatcatcagggagatgcaaatcaaaaccacagtaagcaatcatcttaccccagttagaatggctgttacggaaaagacaccaacaaatgctggtgaggatgcaaggaaaaggaaactcttatacactgttggtgggaatgtaaattagtacagccattatgcaaaacagtatggaggtttctcaaaaaccaaaaactagaactaccatatgatacagcaatcccactgctgggtatttatccaaaggaaaggaaatcaattcaatatatcaaagatagataacctacacccccatgtttattgcagcactgtttataatagccaagatgcggaatcaaccttaagtgcacatcagtggatgaatggataaagaaaatgtggtatatatacacaatggaattatattctaccatattttttatgaaaatgaaattctgtcatttgcagccacatggatagaattgagatcattatgttaaatgaaataagccaggcctagaaagacaaatatcacatgttcttactgatgtgggaactaaaaaaagttcgtctttagccaggagtcgtgatgcacccctgtagtctcagctacatgggaggctgaggcaggaggattgcttgagtccaggagattgattccagtctgggcaacatagcaagatgtcatgtcaaaaaaataaataaaaagaagaaaggtagttactagaggctgggaagggtgtatgggaagggttccaggaagatacgaagacaggctggttaatggatatagacatacaattagacgaaataagttctagtgtttgatagcatacaggagtgactgtagttaacaacaatacattatatatttcaaaataactagaagagaagatttgaaatgttctcgacacaaatggtgaataatgtttgggctgatggcatcctaagtaccttgattttgtcattacagattgtatgcatgtatgaaaataccacatgtggctctatgagtatgtacaaatattatgtatcaataaaaagggatctgtaatttatgagtaataaaattttttaaagaacatttaccagccgggcatggtggctcacacctgtaatcccagcactttgggaggccgaggcaggcggatcacaaggtcagatcgagaccatcctggctaacacggtgaaacccagtctctactaaaaatacaaaaaaaatttgctgcgcttggaggctactcgggagactgtggcaggagaatggcgtgaacctgggaggtggagcttgcagtgagccgagattgcgccactgtactccagcctgggcaacaaagcgagactccatctcaaaaaaaaaaaaatttaccttctaaaaagtaattatatgaaaattgaaagtagaatttattccttttacctttctattcctaggtaatacattgcatgcaactggatcctgcaagaatcatttatcaggaaattctcttgctgatactttatttcggtgggaacaagatgaaataccaaggttagttaatgttgtaaaggaaatgaaaattttacatata

SEQ ID NO: 40704 - DNA, 1030 bp, Homo sapiens
caacaaaaaaagaaaactacaggtcagcatcactgatgaacatagacacaaaaatcctcaacaaaatactaacaaatcgaatccaacaaaacataaaaaaaaaaaaatacaccatgatcaagtgaaatttatcctagggccaggcacagtggctcatgcctgtaatcccagaactttggaaggctgaagtgggtagatcacttgagcccaggagtttgagaccatcctgggcaacatggtgaaaccctgtctctacaaaaaataaaaaaattagctgggtatggtggcatgcacctgtagtcccacctacttgggagacttaggtaggaggatggcttgagcccaggaggcggaggttacagtaagccaagatcatgccactgtactcaagcctgggtgacagagtgagaccctgtctcaaaaaaaaacttatttcaggggtgcaaggattgttcattatatacaaatcaataaatgtgatacatcacatcaacagaatgaaggacaaaaaccatatgatcatctcagctaacacagaaaagttatttgataaaattcaatgtcccttcatggtaaaaactcttgataagttaatcatagaaggatcatacctcaaataatgaacatcatgtctgaaaaacccacatttaacatcttactgaatggggaaaagctgaaaacctgccctctaagaactagaagaagacaggatgcccatttttaccactcctgttcaacatagtactgaaaattctagccatagcaatcaggtaataaaagacaccaaattgggaaaaaggaggtcaaattgtccctttttcacaggtgacatgatatatatggcaaaacctgaagactccaacaaaaaactcttagaactgataaatttagtaaagttgcagatttttttttaaaacccacaaaaaactaatagcatttctgtgcaccaataacaactagctgaaaaagaaaacaagaacacaatcccatttattaaggctaccaaaaagaatagtaataaatttaacca

SEQ ID NO: 40705 - DNA, 1763 bp, Homo sapiens
tttttttgtgtttttagtggagaggggtttcaccatgttggccaggatggtcttgatctcctgacctcgtgatctacctgcctcagcccccaaagtgctgggattacaggcgtgagccaccatgcccagccaaggacttaatgtttagtataattctgggttccgtgaaagatgaaattcagagcacccacatactccttgttgaagaggcatctgccttttgttatgtacttacacacaatgggaagtagccagctccacagagttttgccatggtgtcaagttttggtggcgctttttaaaataacttttgcagcttctgaattagggaacatcaatcaaattggaaaattcaaactctgaaatttttgaaacctgtgtacatgggcttgttcagccacagacgatcttatttctcttggacttgttgtctaacttcagtttgccatgatagtaagagggaaccttcagaggaggggaaggggagttgttgtttaaagagtatgaagtttcaactagacatgatgaataagttctggacatcagttgtactgcatggtgactgtagttgataatgtattatatacttgaaaatcgctaagagattagattttaaatgctcttaccacaaaataataagtatgtgaagtgatggatatgttagctcgacttaatcatttcatggtgtatacatatcaaagtttcatgttgtataccatatatatgtacaatttttatgtatcagtttacgttaatagagttgaaggggtagggatattttctttccttaaatctatatgttacctagaaatacctaataccctgactcctttaagaatccaaaatggccgggcgcggtggctcacgcctgtaatcccagcactttggaaggccgaggcaggtggatcatgaggtcaggagatcgagaccatcctgattaacacggtgaaaccccgtctctactaaaaaatacaaaaaattagccgggcatggtggcaggcacctgtagtcccagctactccggaggctgaggcaggagaacggcgtgagcccgggaggtggagcttgcagcaagccgagatcgcaacactgcactccagcctgggtgacagagcgagactccatctcaaaaaaaaaaaagagaatccaaaatcatttagtagaaggtttcaaaataccataactttcactaattttataaaaacattcttgaaagcatcctgtatgtggaacttctagaagtatagtggaaaagcgcctggactgaagtcacaagttcttaattagaccactaactagatgttgaaaaaagctgggtttctagtaccagctacctacctctggacttcttttaggagagaagccactaattttaatgctaaatccactgatttgggggcattttctcacaatttaacctaatcctaactaacgggagttgtagtagactggtttatctctaaagactttacagctctgtatctccacacatttgtgtgaggtagagctagcggagggaaataaatagaagtggtctgtatcttgtcaagataaagcaaattacagaactacaaattttatggtaataaaagacatactatttccaaaaagcagttgactctcgtgttcatttttacacatttctctttccttatttaacttttgagttttttattttatcctgtttctttcattttctcttatatcattcttattctatattagagctgttagtgctatgccaagaattccttgtgttgtgg

SEQ ID NO: 40706 - DNA, 1077 bp, Homo sapiens
gtgtcttccccataggttgaatagattaaatcagaatcattcttgttgatatttgcatatgtggagtcataatgcggtgcataagaactgtagggcccataattcaaatataacactggagtgactttgttcttttgtcctctttgaacccctgcaaagtattcacaccagactgaagtcttccagttgtcattcccagtctcacagggcagtagcctggctctcctacaatgagatccacaggatggagaagtcccaacattgttgttccgtctggttttcttctttccaatttgcactgactgttcacaagccgcctggtcagctttcctccagattccttcacgatgcggtcaagctgctcctgcgctctctctaaattattgcttttaaacttatcttcaagcatgtctttgtctttctttttattttctttgctgggactcttgaaggcgtgtgctttggcatctccagagtcctctctcttctcggccagcagcctctgtcctccccactctgcgaggtgtctgttctgtcttcctgcttttgagttttctgcaagtcagccatgaagtctatgctctgcttcaggctctgaattctttcatgtctaagaattttcatccccgagtgcaaccgcttctttgcagctttataataaatggtctctggtttattgtaaatcatggcattagtacacattagtttgaaaatatcctttagtttttctatggactggtagtcattgttcttgatcttttctttcatttaaaatccattgggtgtttaatgatcatggagtagccaggagcagtaaaatcagtcacaggaaatgaaagaaagcacttggatcttttctctgcaattgtctcgccagttgattcaaagcttcttgaaggggtggggtatctgttctacttcttcttgtttggctaaagtgcttgtgagaggcttctcaccgggcaagtctaatcccacaggggcgtgacactggaggtctttttctgcctcattctccaccccgtctcaatctcgcttctttttatcctccttaactcttatctgttttctcccctt

SEQ ID NO: 40707 - DNA, 1027 bp, Homo sapiens
tgtctcagatatgatttgtttcggagaatgttccatatgctgatgaaaagaatgtgttttctgcagccatgggtaaaatgttccataaatgttgattaggcctgtttgtgtactgtgtagcttaactccagtgttctttcttgattttctgtctggatgttctgtccattactgaaaatggggtgttgaagtcccctactattactgtattgcagtctgtctctccttttaaatgtattatttgctttatgcactcagatgctctggtgttgcatgcatagatatttataattgttatatcctcttgctgaattgacccttttatcaatacatagtgaccctctttgtttctttttacagtcttgatagtctgttttatctgatacaaatatagctactcctgcttttgtttccagttgcatggaatatcttttttcagcctttcactttcagtctgtgtgtggctttataggcgaagtaagtttcttataggcagcatatagtttaactcttgcttctttatctgtttagacagaattcattctgccttgtgattagagaattgagtccatttgcattcagtgttactgttgccaagtaaacttactactgtcatttcattgcttgttttctgttgttttagaactccttccttttttctttttcttactgtcttcctttgtgattaagagattttctctggtagtatgttttaattcattgctttttagttatagtgaatctgttataggtttttgcattgtggtaaccatgagactacaaaaacatcttaattacaaaacaaagaatagaaattttttttaaaaaccctctttttttttcctcaggtcccgctttattacctaatacaagtccaacctctggaacattcaaattcactgttgcaaagtttaattaaaaacacaatttacaaatatttaacatattctaaaaagcgtttctaagttaagaatgaaaaagtatgtacataatatataatcaaatacaggtggcctcaacttccacc

SEQ ID NO: 40708 - DNA, 1119 bp, Homo sapiens
aataaaatccacatataagcaggtatctacaatgcccaccatctatttaaaaattactagatatggccgggcgcggtggatcacaatgtcaggagtttgagaccagcctggccaatatggtgaaacctcgtctctactaaaaatacaaaaattagctgggcgaggtggcggcgcctgtagtcccagctactcggaaggctgaggcatgagaatggcttgaacccaggaagcggaggttgcagtgagccactgcactccagcctgggcaacagagaaagactctgtctgagaaaaaaaaaaattactagatatataaagaagtaggcaaatgtaatctataaaaaggagaaagtcttgtgaataaaaacagacccagaatgcaatatgtgatcaaattcaaataaaaggactttaagataggtatttaagtgtatttagtaattttaatgaaaacacaatagaacaaaacttataatacaacatagccgcctgagcgacaaagtgaaatcctgtcccagaaacaaaaaacaccaccaccgatcctaaacaggacacacacacacacatacacacagagagagagacaccatggcacatcataattgaattgttgcaaattaataaaaatctttaaagcagccaagaaaaatctctcaaaccatatacagggaaatcatcataagaacaactacttaaagagatgtagttaataagacaactgataaggcagaattgaatctaaaattttttcaggccaaaagagagcaggttaggggaaaaaaatgagcaatgaataagcaggaaaaatagaaaacaaaatggcaaaacataacctcaaaccttattacttaaataattggattagttttacgtggacttattattctaacttaaaatgcaaagcactaccatatgcagctcataagaatcatacttaatatatagacagtttgaaagtaaaacagtggagaaatgtactttgcaaggaaaagtcactaggaacactggcgtatctaaagatcaggcaaagtagacttcatggtaagacatattatcagaattaaagagggatatttcaaaatgataaaaagttcaagttttcaaaaagacaaaaagttc

SEQ ID NO: 40709 - DNA, 1153 bp, Homo sapiens
gtttttttctttaattatccaaatgtacagcttttctcattactttcttcctctccataatatgtaatagtttgctcttgtagtaccattttaagcccatacttttctaccttttttgttttgttttgtttttttggtaattgtatatagcacttaccctccactgcaggaacttaagttatacatatataagcctgcttaaagatgtaacataggatactaatgttttttggttttttttttttttttttttttttttttgagacagggtcttgctctgtcacccgggctggagtgcaatggcacaagcatggctcactgcagcctcgaattcctgggctcaagcagtcctcccatctcagcctcctgaatagctggaacaacaggtgcgcatcaccgtgcctggctaattttttaatttttagtagaggtagggtctcacaatgttgcccaggctgggctctaactcctggcctcaagcatttctcctgcctcagcctcccaaagagctgggattacaggcatgagccaccacacccgcacccagccttgttcatgtattttcaggctttttctgtgcttcattttggacggtttctatggctttgtcttcaagtttattaatctttaattccggcatttctgatatattcttagttctactcatatttttcctcttcatttatttttcatccgtcatgagatgaaaattttgatttatgtttgtttattgtccacatctctatttaatatattcaggcattcttctacttcttgaacatatagtttacagttgcaataactattttaatatctttgcttactaattccatcatctgtatcatttcctggcttgtttctattgctacatttttttcctcataatgggtcacattgttctgtttattacatgcctagtttttttcactggattccaggcatggtggattttaccttgtgttctggatatcattgtatttttagaaatattcttgagctttattctgggacacttaagttatttggagatagtgtaatcctttcaagtctttttatgcttagttgggtgggaacagaacaaacttaactagggctaatgttgcccatctactgagtcaataatcttatgattattctactcgatgtcttgtga

SEQ ID NO: 40710 - DNA, 1034 bp, Homo sapiens
taatagcctcccagtttgtctctaactttacctgttttcaaattcagcccttatatattttagattatagccctggcctataatctaaaataaaactctagacaacataaagttttttcatgatcgagcacctgcctaccttttcagcatcatcttctgcttctccctcaagcactttgcttttcagtctgaactgcttgctcttgctcaaatgtatgtacctcatgactttgcatatgctgttagcttaatgaaagcaggtaccttggctgtcctaggtgttcagtgtctggtgtggtgtcatcccttatgaaatgactgaatgccattcctctggatggaatggccttttctactggtgaattcttcacacttcaagactgtcctgagacatcatctacactgtgaagcctctcccaactacccttagtcatatcagtcctttgtgccaccattgtactttgtatccctgttaaagcagttatcacattaacttgcaagattgtttgtttttaacatgtctgacttgcctcttagagtgtgcgtttcatgagggcagattcagtatgctgccagtctttgtgtccttagtgcttattgcctacacatgcattaaaaattagaaaaaacagccgggcgcggtggctcatgcctgtaatcccaacactttgggaggctgaggtgggtggatcacctgaggttgggagtttgagaccagtctgaccaacatggagaaatcccatctctactaaaaatacaaaattagccaggtgtggtggtacatgcctgtaatcccagctactcgggaggctgaggcaggagaatcgcttgaacctgggagatggaggttgtggtgagccgagatcgtgccgttgcactccagcctgggcaacaagagcgaaactccatctcaaaaaaagttagaaaaaactcaggaaggaaggacaaatacatgattccacttatatgagatacctacaatagtcaaatttatagagaacaaacaatagaatagtgtttactgagggtgggat

SEQ ID NO: 40711 - DNA, 2420 bp, Homo sapiens
tgaaacagtctcgctctgttgcccaggctggagtgcaatggtgtgatcttggctcactgccaccttcacctcctgggttcaggctattctcccacctcagcctcctgagtagctgggattacaggcatgcaccaccccacccagctaattttttgtatttttagtagagacagggtttcaccattttggccaggctggtttcaaactcctgacctcaaatgattcacccgcctcagccctcccaaagtgctgagattacaggcatgagccactacgcccgaccagtcatccaagtttttaaaagtggcctacctgtctgcttcattatgtaaacagaattctataaaagtagaaaacttttaacaattttttgagaatgaccaacagcccacaccaggctaaatattatcttacatgctacatttttaaacatcttacaaggatttcttcaaatgagaaaaactaatacagaggttgttttgatctgtactcccaccagcaataggagactttttccatgtcttcatcaagattatgttctcaaatgttttgatcattgccaatctaatagacataaaatggatctcagtgtagttttaatttgcattccttttattatgagtgagattgagtgttttttcatatgcttgagaggcccttatggtatttccttctcagcgtactgtttatcttttacccattttcctgttgagactcttggtcttttccttactgattccaaagagccttcatatattagtaaagttcatctccatctgtaaattgagttccaaatgttttcctccgttagttcttatggtagattactttttatttaagtagtatctttttttcatttcataaataatctttatatctgaattaggcttttaaatcacatttagatgaagttaggtttaagtattaggcatgggaatggaaggaaaagatcctggcattatcaaatcttttgtagagaactttttaaaactctggatagttaaaatgaaaaacttcaaaaggatcctgtctttgatttattttttcctcttctaggtttggttttattatgacatcagtcgttttgaccgggcagtccaaggagtaggatcataacctctggagggctgtttttagatgatgagattgtatagtatagatggaaaatactctgtgtaacttagaagaaattgttaataatgttgctttgagtctcgttaatttcattgtgtgtgtgtttgtgtgtgtgatgtgtataaaacatgcatagatcatggtagtgcttctagcaatgctctactcttacgtacagtcttccctctgtatccatcccttagtatctgtgagggattcgttgcaggaatccctgaggatataaaaatccacagatgctcaaatcacttatataaaatggtgtagtatttgcataaaataacctaagcatattctcctatatagtacttcaaattatcacttacacctaatacattgtaaatgctatgtaatagttgtgatactgtattatttaaggtagtaataacaaggaaaaaagtttgtacgcattcagtacagatgcaactctttccctgaatatttttgatctgtggttggttgaatccacagatgtggaacccacagatatggagggccagctatataattttcaatctgttcagccaaccttaacctaatcaaccacatgggtatgttaggatggctagattaggctagccattagcagtggaccacacagaagaaaaacacacagaatgtagactcttttgagaatgcagtaatgctacctactgcccaaataatatcctagattttttctgagattgtgggaagccaggaagaaggtggcagagacatctgtgacctcctatgccacatctgacatgaagtactttgaccttttcccttgacttttgtataaaaaggtattagaaaactgcgaggctggacattttatatgttttgagtaatttaatataattttaaacattttaaagttgtcgaaccctttcttcttatataattttacccagcagcatcaaaaacaaataggaatccttaagtgattagtggggcatggcagaaagccagttttttaccatgctttacatagtttttagtttttcaaagttattgatgtattctttagcgtctgctttattactaacatctttatacatgtttcactgaaaattgaaaggaagtttttcatttaataccaaattattgacttactgttattttcttggttaatcctttttaaacaatttaaaatttcttttttctaattttattttattttttgagacagagtctcactgtgtcgcccaggctagagtgctgtggtgcgatctcggctcactgcaacctccatctcctgggttcaagtgattctcgtgcttcag

SEQ ID NO: 40712 - DNA, 1029 bp, Homo sapiens
ggtaagaaggaaaaaataagagaccataatagttgttacaaacaaatgattactgcaatactgtttttaactttagttattgttagagatcttctaattcaaagttttcagttgatgttacatggctcacagaagggtagtcctagtagaatgggggctgaaggaaggcgttggggttcctgtgaacaaatagcatggtgagtgacaaccaacagttaaaagcagcatactgctccttttgatattttaagtgcattaaatgaggtgtgccttactacttggaatctacttcagcagccagccacagtgtacagctgccttttgtgggaaagggatcatggaattgttactggagtttgtattcacggtgccgaaggaacatgccacctaccacaaggtgcaacccacttacaatgagaggacaaggaagcagggagggtgtctctggtggcccagctccaggcctgactatctgtattcacctgtattggatgctgctcaccacgtgcgtttgatatgctctgcaaggtgactgcctaatagtgcatgtatgtttgtcagaaataaagcatgattttaattttgaaatattcttgatgtgaaaatgtttggttttgaaattcatattaaaattttcagcattacatgtgtcaaaaaatatctaccataacactttacattttttcttctgtaattagaaaatatgataattttttttcaccaggcactgtgtagatgcctccaaatgccctcctgttgtccagtgtgctaaatttttttttgctgacaagttttgtttgcaatgttaaaagggttgagaagcatcattctagtcaaatgtactcattttgtatgaagaaaactgaaatctacatagcaggctcagggatttgtccagtgtcctacagttggttggtgtgaggctggatttgaaaattggggatcttggatcttgactcttcagctctcatcacctcacactgaccccctctccccccgaaacatgagggaatattggaggaaggcatt

SEQ ID NO: 40713 - DNA, 1042 bp, Homo sapiens
atgatcatattgaacttaattatataaattccatttagaaattgcaaaatgattcataaattaaagcaagccagtaatttctggttgtattattcttacttgtatgtaaagtggttttaattttaaaatgttttgaaaagtaacatggttttggcacatgacagcactaaaacagagtaaagactagaattaacttaaatatatatgagagcttaatataggttgagcatcccttatctaaaactccataatctgaaatccttcaaaatctgaaatgttttgaacaccaacatgatgccacaagtagaaaattccacacctgacctcatgatgggtcgcagtcaaaacttcgtttcaggctggatgcagtggctcatgtctgtaatcccaacactttgggaggctaaggtgggaggattgcttcagcccaggagttcaagaccagcctgggcaacatggaaagacgctatctctacaaaaaaatacaaaagttagccaggcagggtggtacacgtttgtggttccagctacttgggaggctgaggcaggaggatcgcttgagcccaggaggtgaaggctgcagtgagccatgattgtatgactgcattccagcctgggtgacagagcaagtccctgtctcaaaaacaatcaaaacaactttgtttcatgtgtaacattatttaaaattatataaaattacattcaggtttggtcccatcctcaggatatctcatgtatgtgcaaatattctaaaatctgaaacacttctggtcccaagcatttcagataaggggtattcaacttgtatatgaaaatggatcccaccttcatttatgagtagggaaaagaagaattgtttaataaacagtgttgggatagccagttagtcatctggaaaaataatgttggcttccagaggagttaaagatttaaatatgaaacaaagaaacaaaaaaggtagggtaattattttttacgtaatccaggattggtgaagtcctttaatagcatactgggttgctggattttaggacataaaaat

SEQ ID NO: 40714 - DNA, 1050 bp, Homo sapiens
taattttgaaaattagcgtgtatcaacaactcaggttcaaaagtttctctaatagaatctgctttgttcatagtctgttttttactaagctatttaaaaatattttaagatcatataacacctatttgattacaattattggagagattttcaggaacgctatggagatgtaatgactcatcacaaacaaattggtcactttttttaaagtaggtatttgaagccctgagtagcaagttgttttagctttaagtgccttaagaacagctttactctccagaagctcacaatgtagtagagatgatgggcatgtaaacgtaagtcaaatgcagtatgactggactatagaaatgtgtataagacaaagcaaggattcattgggagacatgttctatatccaggcaaaaaggggagtcagggaagacttcgtgaaggaaatatggattagtcatgttaaaggaatttttaaggaacttaaaatttcagatagaggaacagctacaaggtaattgacagatgaagacaactgctctttgcagggcagtttggcaatgtatattagaatccttgaagtgttcttttttgacccagtaattctagttttagggattttaatctatgagcataaatcttttggcaaatctggttgtcttttgaatccgtctacttcttttcataatccatcaccaccctaaactactagcatttttggtcaggtttactacagtagcctcctaatcttggtttatcccaatctactttgtccccttctgatctgtttcctacactgtaatcagagggatcttttaaaaatgcaaacctgattacatcaccctactgtttgatatgcttcagtagctttccattgcattcaggatatggacagaactctgtgtcttatatggtggcatctgcctgtcttacaaggtcttgcatagtctggcccttacctttctgtctagtcatgacttgagccatgttcttgacttactctttttgttccagccttgttggccttatctcagtcccttgttcttgccatgctccttc

SEQ ID NO: 40715 - DNA, 1030 bp, Homo sapiens
acatatcaaaatctgccaatgatgtttgactttaaaggaaacttacttaagagattcacaatggggcttcaaaaataggataatggatttgaaagtattttaaaaagtaacttgaaagacagtattgtgttcatattatacttattattaaaaaggaagatttgaattcaggtagaacactgctatcctctcctctgattctgcttttccaagaaatgaggtttcactgtcatctccaacacagcccactctgtgagctagccaagaaggaaaagtcaagagggttggttgagcaaacactgagactgaaagagagccaccatattgattagtgtgtctcacatctctttttctttaaaggataaaagttctcttgaaacccctccccatgttgacttaaataattttcattatatagttccttaaatatgtacaaatatgtagtaattaggtataaatgttttatgcttgtagctaactaaaaactatacaaacacaaaagaaaccgttctagagatctgttgaacaactatgtgaatatacttaacactactgaactatatacttaaattatcttaataatttaccatcttaatggtaaattttattatatatctttttaccacaatttaaaaaatcacaagaacaaatcaaatttacagattaagtgaaaacaaatcatcagttaaattcaaataaaaaaacattaattcagtgtgaaagtggtaacatttgctgaaactaaataactaatattgggtttaattacaatttatacatataatgataaaagtataacatgatgcttttatagattttatttcaattgttgacttatatatttgacttatatttatcaagcatgatacagtcatttgactcataatcattatcattattataatttttccctcctacaaggttattcattggaaaccatcagttcattgttttaattggcccacttaatttaaaaatgacgttctccaaaatataatattgacaaattattttattttaattaattaat

SEQ ID NO: 40716 - DNA, 1031 bp, Homo sapiens
tcaatggtatgtgtttgggttgagggtactgggaataattgttgagaattattggagcatggcgatatacaaaatagaccaaattttcattggttttgttattatttttaaatctccttcagacaatgcccgtattacctgagcccagcacaggccgctctcaccacctgtccccttggtacaccattgactagaaaatcatttgttgacattttgctttcatcctaagatttgaagtcctcaaggcagtccctgcgtccttttcatttgggcatcctcagtactcagtatgatgcctgccatgcagcaggtgctgcttctaagcacaatacctagagaagtcccgtcctatagtccctaggagttagactcaaaagcaaaggccttatggtggcctacagggcactatccgatacagccccttctacttccagacctctgcacctactcactctgctctactcacagtggccttgttgcttgtgaacagacccaacacactccctccacagggccttcgcactgactctcctatctgcctggacccagacaaccacagagcttgcttcttccactcttttaggtctttgctcattttctcagtgagacctctcctaagcaccccgtttaaaactgcaaatctttcacccttgccccagcactccctgtcccctttcttgtttaattcttctccacagcatacatcactgttgaacacactatccatttacttattatctgcctctccccaccagaacatccactccatgagggcagtctgacactgcacccccaggatccctggctaacagtttctgcctctgcctgatcactgaggtctgatgggctccttctactgcaggccagacctggggctggagtgaaagagtaatgaattgatttaagcctacggccctggcatacttcttctgaagtcacaggggaattcacatcactctgtgtgacctctgtcctaccccttttatgtgagggtggtgaaaagcaagttgaaatgcaaagggtaggtagtc

SEQ ID NO: 40717 - DNA, 1030 bp, Homo sapiens
attgtataggttatgtactacacaaccttagggatgctgttttcatagactgggattttacactgtgcaacctgcaaggctagttttaaagacacctgccaaaaatccccagttaactccaccacatttagagctgcattttagggccaatagctttgtaccctcaggaggtgggaagccaagataaggggaaacagaagtaatgagatgtgtccaagaggaagcagggattagctcttttcagtagaaacctcagttaatcattaataccttattgctgctttgatttaaccttttgtcttccttgaaaaggaaaatgagttatctataaagaagcttcttttgttgaaagcagctgctgttttaagacagagaagaagcaggagaagttggacaaagacattatgttttattcctccaaatacattataaatacattgtttggtgtaaatatattgcttgccttagaaagaaaattaatacaaaacaaatttaagtaagttccgactagtagtaactcagaccacatatctacaaatgacttcctttcaaagattccttacattaatgcagcctttgttttaacattttttgaaggtttatatattataatccttattgtagattataaaatgagaaaataataaagctgactaatgcaactggctgatattgccgttggttttttttaatctgaaattatgaaatcccttggaaaatctaacatgacagtatccaaattttaaatagtcactttcagcaacacacacaccttcaccaatgttgagtgattcaaagaaggggaaaaacaactcctttggttgtcattttatttacaggatttgtctgcacagcagagaaaaatgttccatttacttcagagatggtcagagatttccaagccatttggctcaagagatggtttaaataggaatgaatgtagtatacctttaattctctgaagtaagagaactccagctgaggtttggtccagagcaaagtctgctctcaacattgaagaaaatctatc

SEQ ID NO: 40718 - DNA, 1050 bp, Homo sapiens
gaacagtcatattgacattctttaatccaaaaccactgtttgaaattagtaaggatattttcagcattcccaaaaacatgttattagcacgttgagctgaaaacgtttttcttcctcagtgagtacagaaaccaaagcagtctgcgtgtatgtctatgtatagactgtatcgtacctgggctcatggagtagtctaaatttaaaacgtcctctcttctacctccaatgaaaatgtttccgtgtgtggcgtctgatcttccaccgtgtgtgtggtcgtctgctggtgtagcgctgtttaaggagcgctgtgtgctgctagtgttccacgatgtgtgtggtcgtctgctggtgtagtagcactgtttgaggagcactgtgcgccgctagtgtgggtttacacttatgagtgttgtcattacatgtgttctgctcttctctccctctcctgcccctgccctgctccatcagagagagctgcaggtctctgctgccgcctagtagttccctgtcacaaagggatgccaaggcttaccgatctgtctgtcaaaaccaaagatgtctgggaaatccctcgagaatccctgcagttgatcaagagactgggaaatgggcagtttggggaagtatggatgggtatgctgagactcaattactctcttattagcttccccgtttggaagatcccaaacaccaaagatggaaggtgaaaataaagactgcgtgaccgggaagaaagtttgaattactaatagtggggaataataatttcagttttggttttaacattctggaattcctaaaaaaaaaaaaaaaaaaaaaaaaagatagtaagtgggcaaaattggcaaatggctcaagttgtactattacatgactctcaattcataaaccagcaaatggtccaaggaatgttccagctgccataaaatatcttgctcttcatttccaaaagcaaatatttgttgagtgtcatcctaacgggcaagtcaccttccatctttcctagtgcatgcataattatggattataaggactgtgttttctttatta

SEQ ID NO: 40719 - DNA, 1075 bp, Homo sapiens
gatgatgaacacagatcacaatccaggtgcttggtaaataaatgcctttacttatccaagtcctcacacacctaggggaggaaaacaaaatacaagtaagtactcatgggcgtttttctcagaattcttatagggaggaagttattgaaaatactattcctttattcatatcatatctatctaatctgactttttttaatgcttgattatcttcatatacattaagactgtgttttgttatttcccagcagttacaataatgcttagatatcaagagattcaagagttttgtttttttgtttattttttgttatgagacagagtctcgctctgttgcccaggctggagtgcagtggcgcaatcctggctcactgcaacctccaccttccagattcaagcaattctcctgcctcagcctcctgagtagctgggattacaggtgcatgccaccacacccagctaattttttgtatttttagtggagatggggtttcaccatgatagccagcattgtctccatctcctgacttcatgatccacccaccttggcctcccaaagtgctaggattacaggcatgagccaccatgcctggcgtttgttttttttgttttgttttgttttgagacacggctttgctctgtcacccaggctggaatactatggcacaatctcagctcactgcagcctgggcctcccaggttcaagtgattctcctgcctcagcctcccgagtacctgggattacaggtgcccaccaccacaccaagctaatttttgtatttttagtagagctggggtttcaccatgttggccaggctgatctcaaactcctgacctcaggtgatctgcccacctcggcctcccaaagtgctgggattacaggtatgagccaccatgcccagactagagtcttttagataagtgtggaaagggtctcctgcagtaaccatttcaaatcaaggtcttagatttctggttttttgcatacaggtggcagttttaacacaaaccagttctggtcatgtctagaggggaggaaaacaacccacaactcaaatctgattttttttaaaga

SEQ ID NO: 40720 - DNA, 1029 bp, Homo sapiens
agttctgcttagtgctgggacaaagtgcttctgccagagctgccgattgatgactcttgctggtggatgagcaagagtttacatcctctgactgttctaagcctgtatatgtgagtagagctgtcattgctgaaaaaataagctgccttctagcccaaagaatgtgttaatattatattttttatgcaaaactgaagtgtaactgccacttctgcatcatgataaagacattcgtatttgacttgacagagcaaacccctccacagctggaggagaacagtggtgatcccctgtgacctcacattcatctgcacctctaaccctagccactccttcaggatcctcttgtgacaccggtctgttgttggattctacttgttacatgcccttttcagtgggcattcctgtctttcttctgatgacctgcattgcagatgtctatctgtggtgttacctgtcctcatcatgtttaggcagccacttacacaactgtgcaagcctatttctcactcctaccagccccaaaagatatgaagtgttttgtgtgccagggctctcagataatgtcacttatatagttccaaagtagatcacctctgcagccatttatggtttcagatctttattctcacatgtaacaaaagctacggctttgccacagttggggatgatttgtgaggtatgaattatgaatagacaggtagctagaatggatagagtcattggtccacttaggaagtcatagcttacttagatacctccctgtccagccacttgcatgcagtctctttctacccttgccttcttgatctggcacccccccatgcttctcttttctccccagcttcagtatgtgtctatcaagacccagtttcactcctgcttaatactggataagtatcagttgtataatgtgcaaatgcttttgcttataggtctcagatttagccagatctgggttaaaatgcagttaaacctagcactgaggccttaggcaaataactttacctcccttcattgatgatgatg

SEQ ID NO: 40721 - DNA, 1005 bp, Homo sapiens
ccttcatagcatccatctccttcctgatgtgggatgccattttggagggccacttcctgctgactttattgtaagctgtgtagaagagaaggtatcagccatatttttccttttaggcagagtttgatttgcagaggcctggacttcctgcttatgtgtctttccagtgaataagtgtgattcaccacagttcaaagtaaccccatctacaacgcctcatttttttaagtgaaatttttccatgggaatagaatagagaggaatcctgtaggtcttccatgaaattatactccctgcctctcagagttttacaatataattaggttacttgtttgtcttaaatttttttattatcctgtgcttatctggttgaggtgcctgttgaagagcaggagatgaaggtcaagaaatataagcacagtgctcaattttttaaaataactttgtcttactgttgctcgtggatagaaataaaatttttcatattaaactaatacttagccgtttgctgaaacctcttatcaattctaataatttatctgtattctcttagtttttctgtgtaacagacataccatctataaataattacaagtttttgttctttttcaatcttttatcttttatatatttattttttcttttcctaccactctggctaggacctgcaggaaatagcacaggggataggaagtagggatagcggggataggaagtagggatagcacagatccttagcttgttactgattttaaagggaaggctgttagcatttcaccattgagtatggtgcttactgctgggttttggtaaatactttctattagattatgaaagtccccttctgatcctagtttgctaaaagtttctattttaaaaaattataaatgtgttaattattactgagtgccttttctgtatctattgataagatcattggggttttctcttttaatcggatagtacaggaattattgtcatccattttttaaagttaaatcatcc

SEQ ID NO: 40722 - DNA, 1025 bp, Homo sapiens
gcttgcctgccatggcagcatccactccacccttcagtgcttgaagccaagtggttgtcgccccggaaggctctgcccttctggttttagactgctgtggaggagggagccacttggagatacaaagcccacctctctagaatcttccagggtccccacaaattataaaactatggtcacaccaggaaaccaaggcattttcaataacaacctttcctactgatttccagcttcatcttccagaattccagtgcactgccattcataccattcattaactgttctcctttcactagaccacgagcaggtatacagccacaaagaggaacccatctcatgagttaactactccatcagcttccttcaccctgaaatcttttggcagtacaggctagaaggaagaacaggctttgcaatcagacctgggaatgaatctcatcggcatcattactggctgcaagattttgggaaagtggcttaacttcttagtccagctcacaggattaatgtcaggtttggactcagataaagaatgtgaaggctccctgcctagtctctggcttgtaacaagtgccaccaagtgctagtgtcctttttctgtattatgtatgttgagttgtagatatctgctgtcaggccctgtccctgccactggctggtgatgtgaacacatcttgtgtctttgcatctctgcaccacagtttcatcatctcacaatgaactgcctgctctccaagatgtggagttttttaaattatacaatttggttgcaccttaggggatccctctgattatggaggcacagtaaggtcctgagcataggtggtcagcagtccagaaagggagaaggccgagggcagactggagaatgggactggtgagattcagataggaagagcaggggagaaatggtcaaagtgagactggaatcaaaaggttggcatttctaaaaactataattgcacttaagaagttttgccaaaggcgatttagttaccccacagtgaggaacatgggtgcctatg

SEQ ID NO: 40723 - DNA, 1049 bp, Homo sapiens
aaggctcctgttattcccccaagaaaggcctaaacaccttaacctggcatctgaggccttttatgatctgtctgtccaacccacctctttaacacatctaactctttcacttcaaatgtgatcctgtagcaaaaccaaaccatctctgtgcccttggagggctttgaacactcattttctaacctcttgggatgccttcctgctgtcgcttagagtctaagtctaatctgctgcaaggatcttttttttttttttttaatttctagtcagtctctgcttatccagcaaggctcatcttaagtgtcacttcttcctagtccatcaggctagaaaattcacctctgtgtccagtactgtgtctttttcatcataggtgcttaaaaataactgaagtgttatgaataagtcttagaacatattcatagataacacacgccagagaaataggtaaaggttccttccaggtgggcatttatgtcaggggaaaggcctgggtggcttcaacaacagaatcatattttctcatagtctggagactgaaagtccaagttcatggtgcaggcagggccagggtctggtgagcctccctcctcgtcttgcagatggccactgtctctggtgtccccacatggcctttttctctctgcaagttcccctgctgtctcttccccttcctataagaagaccagccctattggatcagggccctacctctttgaacttatttttcatcaacctcctttaaggcccccttctccaaatacagttacattgggggttagggcttcaacacatgcatttgaggggacacaattcagtccatcacacataggtataaaaattcttctgatcctctgagagtgtgtgtgctcatgtgtgcacacaccctgtgtgcaggtctcctctgttacaagcattcgttcctggcctcattcaggaaacccacaggatagcaaatggccttgctcccttgcggtggcccagcttggcctgcctactctagctgcctccgcatgatcccagcccacaaagacgctgcttcggcccca

SEQ ID NO: 40724 - DNA, 1050 bp, Homo sapiens
gaaaagaaaggttaggaaaactgtccagggtctcacagctagctggcaagaagggaggatattactggaaagaaagaaaagaggaattggtttgggggaatatgttgtgagttcaactgcagatatttttccattgttctcttgtcttcaaatatttcaaagggctaaacattcagatatttataagcatagtttctggtatatttcattgtccagttttaaaattttttattagtgaatactgagataatttgtaaattggtttcatcttcctgggaaaaacagaggaaactggtaggtggaatttagtacatcgatgggtgcccgaagcagaggaagaggttgcagtttacagagagaaacataatatgtgttcaattatttctgtttaatgatgtggtttttcttttgttgtggtattgtttttcaggaccagtcctgcctctgttgtagaagacatgtggtgtatataaagtttgtgatcgttggcggacattttggtaagtgttgctgcatttacttctaatgcctcttgctgtaaaagggtgctcacgaagggaagctgttgccttgttctgtccatcttttacttctgcactaaactcaggcagaatggagttctataattaaatgtgacattgaattgatgttttctgacagtgtgatactttttcttgttattgctgatagtattaagcaatatggggttttctaaaacgtaataagtgtatatttagaaaagtttccggatgccggttaaagaatacccttggcagtttatgtgctaagccagccatataatataagagtaataaacttgcagacccaaagaataaaataaattctccaaagcagagagatccgtgtgacccatatattaaaagaaagagaagcaggcagcttaggaaatggaaaattaaaggaagctacaagtccagcttgcctgggagccagcccacagaccagcataacagtggtcttgggagaccaagaacgttcaattcagcaaccacccagaccttgctagcagggaaagaggacagtctttgg

SEQ ID NO: 40725 - DNA, 1029 bp, Homo sapiens
ttttgaggggaggaggtcatttctgggagagaagaagcttttcctgttctcttctcatgtggtttgctccattcctaacactatggatatttttttggtgtttccttggaaagcaaaatatcccatattaacataccatggctgctttgggaagctgtgcatttccgcagattattccttcaggaaactctacatttgcgctgttggctgcaagaatgaaattatccttggcaagttgtttcattttaatctcaggagcaatggtgttaaatgttagccagtcaaagccataagcaaagactgttattcaagtttctgtgttaaccctttatctctgtggtctttccccacctaccccacacccccatgccccaggagtcactggttcaaaacactatgaagtggattacttccttccatgatactaacagtatttatacttgactcttcacagattggagaatatgaaacagaatgtgaaactaaacagctgaggatatatgatgaatgaaactggctgggatctgatcagttttataatttgcagtcctcaattcagagtagtttaggaataagaaaacctcttggacatttattaatgttaccggttgacttaaaaaaaaaagattgtggggtaaaaccttacttccacagtcaagccataaaagtggcatgatttgggagagaaaaaaaggttataatgaagcccaaatatttgaagtgattgaattaatactttcagaggagtgcccctgaagggcagagtgatttggaatatccagaatattaatactaccagttagccaaaagcagtgctcaagggatgaagcaggagcttggccttggaactccaaatggcctttgagggttagtgggaagcagatgttttgaggcagttggaggatcttgtgaacagtcttcaaagcaggtggaggctttttaataaagaaaagtgggtaaacagctaggctgctggatttccatttttctcccttagaagaactagattctggtcatcttctggtccca

SEQ ID NO: 40726 - DNA, 1030 bp, Homo sapiens
tccccttatatcctcagttactaatattataggttgtcataaacttctccctctgccctatctcccagagaatttatagacagttcccttggaacaagcatgctttcttaactccatgcatctagtatattgataactttttattctgtgttctttcagcagagctaccacttttgtcccttctgttatttgtccacaccaccacagtgcaagccttaaaacatctgtcctttaaactctcccagtcatcttgcccctggactctctcccagcactgtgctaccacactttctaactcagtcttcccttgtatgtggtctgccacacgcaggcacacactttaccttgctctcacctccttggccaccttcagtggttctctatcactggacacagcaaattttaaattgccaatttattcactgtgggagctggctctcctactcccatttctgccagaaactatttttccaggttccttgcatatctgtctcaaaccactgttatcccatcttcctgtactgctgacactctgcccctgtaagatcattagtctgtcaacaagccatcgttgggcatctcacattttctgtgtattaagtcactgggctctgcaggaagatgggtccccacgacttggcagccttatttctgtggaggcttgcacttctcttcacctagcaacttttccataccatctgtctggctccattgagtcagtagttcaataaagatactttagaaacactttttaaaaaaattatgggggtggaggaccaggagaatactacaaaggaaatgagtccctgacatccccatgtgagcagcctcatcttctgaggccagctggtctggaggccagaggctcctgctttattcaacaaggagcatggagacagtgatctgttcttctccacatcctagcaccaagccaggcacagggtaggcccttaagcatctgatgaaggaatcatgcatgtatccgtggcatgtctattgcagtatttcatagacttaatggagctggaag

SEQ ID NO: 40727 - DNA, 1888 bp, Homo sapiens
tgtgtagcaggtcattctttcattaatgtaacatttttttggttcctactgggtgttagacatcatgctggactctcttgagacaaaagtgaatgtgactgacaagtactcaggtaatgatggtacaatctgagagctgtgcagaaggggcttggaagctctgactgagggctgagctatccagaaaaactccatgatggagtgggtgtgaggagctgtgaatgcattctttctctgaatgtttgctgagccttctctgcctgtacgtctctctgcctccccaggtgccttgagttcccccactgaaaggctggacgtcgcagctctcgctagccacccaggcgtccttttcggcccccactactctgcccaaccacattgccttgggtgtaacttttcagctgttctgagttatgttcctcaattccctggccacttgggggctgccccttcatcatctgagaatgacttggggttatttctcatcttgatttgagtgcaagagaggcttttctttctgaactagagccattctgaatgcagctcgtttgtctctaagttagggaagtatactatctgaaacattgttccagaacaattgtgagtaactcctgacctttgaccccatgcaggcacctagcttctgcaggatggcctgtgatctactgctagtcacgggcttttcagctcatacaaaccagggcaacttggggaaataacacagctctagttaggacaaggcagaaggagcctttttagaatccgcatgcactcaggttttggctgtggaagccagggattggcaaagactgtcgcctatgggaggtcagtatactgtgacccttctggactaggccaggtccacagcaggcaagagcctatgggtgccaggagccccctcagggcagtattgtgccttggagcccaaagaaatgcctggcatttgccccagactgcaggacttgccctcccctgtccaactcaggcagtgaatcctgcagccacaggagggggaagtccattcatctgggttcccagtcctggccccatgccgggcaaacagcagggctcagttagtggggtgtggggggcactgaatggaatgtgttcaattttgcttcacttctgctgttaacttcctgttagaccttagaaaaatcatttctcctccccaagtttcatttttcttatcagtaaagtggtccctttcacaggaccaagtaaaattactcgcttttaaattgaaaaacacaaaccaaatacattttgtttttgtttttgttttctgacttgggtcttgaattaaaatggaaaaagggctgttggccaccagtctaaagaatgccaggtaagaccagttatggattgggactgaaggagcaatgagtgtctaacaaaagagtgaacacgggtgactgacccgtggtgtggatgtctgtaagtgcacagggaatccagattaagagaagctaaacgggtagaaatgctgcttggatggagtgagtctgaggcacctctgaaaggctctgcctgcaccctctcctcagtcaagtagttgatgacctgaaaaacaatcattgccttaggggagtttgctgttttaaaagctctattctagaagttccactttcagaacctttttctgttgctggtagaacactgttgaacacggatctatcaacttttctttttgtctgtgtttacctatccagaagaatctaatataggatgtgcatctgttgtataagtaaatgatacctgttggccaactccagtggagaaaaattgccaaagttacagtgtttgttcttcatgtggatttttaagtttcctcttttagttgaacgtttttgtaaagacagaagtggaaaattagctttattttgac

SEQ ID NO: 40728 - DNA, 1146 bp, Homo sapiens
tgcttttcttttgattttataagtttagatcttttcatcctaagcatgtttcaaaaatcttactttttgtcatgtttcaaattttatgtttcaaatgttgccaattcctactcaataatcccatgtgatacaatcatctgatgcttcctgtgttgactttgatgtggttcttttactccaaaagcacctttcttggcttcatttttcatctggtcattctgtagactcccaaagttgctaggagagtccttagaaatcacactccttctggatgttgcagctcacgcctgtaatcccagcactttgggaggctgaggtgggtggatcactttagcccaagagtttgttatcagcctgggcaacatagtgagacctcgtctccacgaaaaatcttttaaaaactatccaggcatggtagcatgcatctgtggtcccagctactcaagaggctgaggtgggaggatcacttgagcctgggaggtagagactgcagtgagctgaggtcataccactgtactctagcctgggctccagagtgagaccctatctcaaaaagaaaaacagaaatcacagtcccactccctcttaattggaagaggaaattaattagcctgagaggtgaaactccttgccccaaggccttgcagcttcttaacggaagggcaggaggctcagccagccagctcttcaggcccacatgggtctcctctgtcactcagctgccctctttgtctgtgagtcttgcatattccacggaggttaagtgagcttccaaatctccatgagcagggttctagtgttctgggtagtccctgttctccacaggcttccaaattgttggagcaattccattcataccagccatcataattgttaatgcacttttttttgccatgaatacttcattatattcatctgttctgcagacattagcctagtatgttactttgtgcaaggcactggggagatgaggtcctggaaatgaatacttctgctgtccttgcttttcagaagttcacggtctactagaagagataaaaataattaataattgttaacatttgttgagcatttactatatgccaagcactgtttaagctccgatcttaacaataataatatgaagtggtttcacttataatctcc

SEQ ID NO: 40729 - DNA, 1057 bp, Homo sapiens
atactcttagcatgtatactgatgatgagcttgaaaagttcacagtggcattcacagttgactgagggaaaaagtcctgccaaactctgtaaggagacagtatgtaaataagaaagggaaaactaaattggctgagtgcagtggctcacacctgtaattccaacactttgaaaggatgagatgggaggatcacttgagcccaggagttcaagaccagccggggcaacatagtgtgagaccctgtctgcacttgtagtcccagctactctggagactgaagtgggaggatcacttgaacccaggagtttgaggctgcattgagctataattttgatcctgcactccagcttgggcaacaaaggaagacagaccctgtctctaaaacagattgaaaataattttttaaaagtttttaaagaaaactaaagattcttttttataactaaagttttgacaagataattctatacttcaggaatgtcacaagtgatattggtaagttttcatctaagccaacagcaaatgaccactttgccaactaatagataggactccgtttctgcatgggatgctgatgaccttaacaagctaagcaacatacacagtgtatgcaacatggtgattattaaatgtccattggcatcagcctagcattggagtctgtgtattgttagatataaactttgtcagtcacctttattttcttttgtcttttatccttcagttaaaagacttaggttaaaagtctctacttttaggagaactactatggagtttcatcttttataggagagcttcacattgtcctttgataatttcctcctgttaacaaaatttatgatataatatactttacaaagtaatagtcttaatgttctaggcttttaattagttttagtagtttggatactatgaaataaataaggtataccgaactaagtaataataatacaagtttcaaaaatcagtactacatagagttcataatgctacagtcaacattttgtagctacctgaaatcacccatatactgcagaagccttttcccccagaaaaa

SEQ ID NO: 40730 - DNA, 1021 bp, Homo sapiens
ggcattatataggtataacttaaatatgaaaaggagtgagatatagacggccctcccaaactcactgtcagaaccaaagatggaattcaggacttcatttcctgaatgttgccttcatttccttatccaaaattagattagttaatatataatcacagaaataagctgaaaattatttttacaaatataaattctgaccaggtgtggtggctcatgcctgtaattccagcactttgggaggccaaggcagaagcttgcttgaacctaggagttcaagaccagcctgggcaacataggtagaccctatctctacacaaattaaaaagttagccaggcgtggtggctcatgcctgcggtcccagatacttgggaggctgaggcaggaggatcatttgaccctaggaggtcaaggctgcattgagctgattatgctgctgcactccagcctgggtgacagagcaagaccctgtctcaaaaaaaataaagtttcaaattcttcacaattatattctgaatcatttatgctaatttttaaaaacactttaatcctcaggaacaggatctggacttggcacatttcttttaaaggtgcttgaagacgaattcccagaagtatacagatttgtgacttccatttatccttctggtgaggatgatgtcataacctcaccttataatagcatcttggcaatgaaggaacttaatgagcatgcagactgtgtattgcccattgacaatcaagtaagaaatgacattggaacttatgaataaatgttatatatattcagtcctgtattatgtatgtgtgtttatatgaaacgttctcttcacttttcagccttcttagagaaaaaatcagtttaaattgtttttctttctctttcctagtagaatatcatctacatccactcttcttaatagcttctctcccaatgtttttccctcaaaagtctttatttgacatcattagcaaaatcgacctcatggtgaattctggaaagttgggtacaactgtgaagcc

SEQ ID NO: 40731 - DNA, 1050 bp, Homo sapiens
catcctcacgtcatctaccttttatgtactatattaccaagacatccttgccacttttatgtcaaatatgtacaagaagaattttctgttgagatgagcaaatgactaatacatttgtaatgtaaaccaccaactagtttacagttacaaggtaattttttaatttcagcttttcttaaaccgaggcgcacctgttttcccacgtgcctatatcattattttccttccacaggcaaagttacaggaaaaataaacattcatataagccatcactataggttcaattcagtcatcttacaatgtaaaggaatagatgttcctctttgccactgatccagtcatatatacagtatatcaatagctatatatctctatctacctgtatcttagcgccctctggcgtttgtcaaaaagaagaggttttcttataggcatgacatttttcagctgtctctcatcacttcaactgaagtttccatatcaaaaaataataagtttaatgacataggaataacaatagagctttactctgaagtatcaagccaaagtaaaaactaggggtgttgtgctttgcaaatataacttaaactggatcaaagatcaactcattaaaaattctaaaattttaaatgcttgtgtccgtattttttaaaagcagggaggagtaatattaagatttattatagtttctgcatatttaattttaaaatgaccacaaatactgtttttctggaaagcactggaacaagccaagaagaagactggaattgcaggaaggagtataatgactcagaagacagtgtccattcagagagcccacagtttatgaagggactgatgaccacattgccgctgcacagtgggctctgtgactacaggagccttgctctgtagggaggggattacccttctccaataaaaagcctctgggcatgtgtttgttataataccatttctgcattctcttccttgaccatctgagagggccacttgcttgggttattcctggagagtgtaaaaacgttcccggtaaaatcatggcataatcct

SEQ ID NO: 40732 - DNA, 1029 bp, Homo sapiens
aaaacaaccaataaggctgagaaaggggaaaacccacatctggatttaaatacaaggtaagaaatatttttctctttagaatatcccactcactttgggaaagtgatttcatgtgatgtattattcaagactctcatcagcaaatattttctgaatgtatactatgttctaggtattgggccagctgctggggattaaactttgaacaaaacagatagaatctatgtcctcatgggagtggctaatgggagagtcggaacaaaaaaatagccaaggataatccagcaaatgatttggtgaatgctatcaaagagagaaatacacatgctctgggaacaccaagtaggtacctaatacctaacctgtacctggggggctggaaagggcttcttggaagaggcagagactaaaatgaagaataagcataagttaagacaaagctggggtggggtcagaaagagtgtgataggccaacgcagcaacatgagccaagactcaaaaataagagacagtgtggcacatttgatgtaggaaagacatttagctgggatagaaagaaggctagtgttggggctgaatgaggttgcataaaagtttgtaagccaagttaaggaattgatcaaatttatattttagaatgatcactctgacctcagcattacatgacctgaaggggttaagcccatacatctgtagagagacccgttagaataggactgcagtaatatggtgagagacactggtgcctaactaggctggtgatcatagagataaagggatatatgggagaggtagagccgacagccattgataactggtggtcggccaggtcaaggggacagtgtctgctttaggtaattggcttgatgataatctcattttcaaagatcaggaacacaggcctgagagtacatttggagaggaagatgattcgggtttgcatcatgtagggttcgaggtgtctatgggacactatatgcagaagtccagtaggcaattggttctgtgggcctagcactcagaggagag

SEQ ID NO: 40733 - DNA, 2265 bp, Homo sapiens
ttatttaacacatcatattatagcacctcacaggattttgtctccctactagactgagctgctcatggctagggaacacagtatcttaaatatttgtattctcagcacttgatgcatttcctaatgcaagtaatggtgatgagcacacgttttagttaacctgttaattttgatcctgtagtatgtgaaaaactgatttagagataatgatccaatttttcctatgtctatcaaattgaagttatgtgaataagccagcttttttttttttttttaaactagagagttagtaatctataacatctgacacatttagttctgttcttttacttgtggattcactcctcaataggctacatacagaaatttataattttaacttcccaatgtattacaatgatggcttcagtctatatttgtaactgattgacatccaaaaattcaagccatgactgaattaaggacgacttaactttagctgtaggattttcctaactttttttcttttctttcattttcactatgttttcttgtctgtctgtttttggtgttctcatttttaaaagctttatcttttctgtgcttaaaaaataaactctctatttggtgatgaggctctttcgatagggccttgcagttgttaaaattcttcagcctactgaaaaatgaaatactaccacagaaagctttttttaaatctataggtcaaaacctagagttagggccaccttttctccctctgcaccccaatccagtgactattcatagcttgtactgccatcgtttaggaaacacccaacacaaagcttatttagaccgaattcattaataataagattgcataactttttatattttaaaaataaagtatattttgaaataatatatatacattttatatttcaaaataggttttaatcttttcccaatctttatttttagacgttaaggaagaagataaatccaaggacaacagtggtgaaaaaacagataccaaagggtaaatgatgttccttatcaagtactttttacatactataaaaatactaaacatgtttattggtgtgtgtttgtgtacacacttcagaaatactagactgaaccttagaacatcattatgaggtgctctgaattttagtttgtattggtacataagacaacatatgccatcttacctattggtttatcagtataactatatcagtcagtttgtattcttgtacgtagtttatctgagacccttttttgctgttatcttttatatatgcacttaatggttttcatggtgttcttatttctgtgtacatgatttttttagtgttgtgagataggtaaatttaagaaacaattttaagtaaaaacagttgaggattttagtgtcagaaagcatgtaaatgtttgggcacacataattttgtgccagcctttacaggataacttggaatagtttattaaatcactagaaaaattaaggcattaattactccagaaacacttaagacattatcaattaatgtgtttcttagcatgagcctacaggacctgatcaatataataggtcagtgcatttaaaccaagattgtgccatttttaatatttcacattgcctcttttaacagaaccaaatcagaacagctcagcaacccctgaatttgacagtctcaccaatttcagaaaatcattaaaaagaaaatattgaaaggaaaatgttttctttttgaagacttctggcttcattttatactactttggcatggactgtatttattttcaaatggctttttcgtttttgtttttcttggcaagttttattgtgagtttttctaattatgaagcaaaatttcttttctccaccatgctttatgtgatagtatttaaaattgatgtgagttattatgtcaaaaaaactgatctattaaagaagtaattggcctttctgagctgatttttccatcttttgtaattatctttattaaaaaattgtacttggattatcttttgtctgtttattactacaatatgaagtcttgtttcagtggctaatgacatcatttctgtagacttacaatacactctaggtgaaagataatgattacagcttgaaagataactatttgctgtttctttgggaagagtatttatagtaattattacttatctttgcaatagaaattctaccaccttgccctctatagcttagccagttagtatcagtgaagattaacatcccattacaatttatgaaataatacagactctgcaatt

SEQ ID NO: 40734 - DNA, 1047 bp, Homo sapiens
ctttaaaaatatccaaatggtttttatctgttaaaagaaacttttctagtagcaataataaaaattgagtgctagaattatgtaaatcacatgttgcaactattgaagaatgcttaatgaaaattcccacagtatacagttacatgaagagaacagataaactttgtaaaattaactctgaaatggaaggaaatatagaaaaacgatttttgaataatgtcatttttaggtggttagttttttcattgtccctttttaattttttcccaaatactcttcagtatgcacaaatgtcttttgtaattgaaggattttcttttcttctttaaagattgagttatgtgcctaactggtaatattccgagaagggaacttactggaaacttataaatgtttattgaattatgacatttatccacataaaatatttacttttatgttaggtttactattaatattaaatttctacacgtagaagttgaagtttttgaaaattaatagatgtttttaactcttaagttaggaaaactactcagtaccactacctaaagttaactcagggttaaactatgttgtttagctttccataattattttacacatgtccatagggaaagaaaagtcaataaaaattaatttagatgatacataatgttttattgtaacatgatgaatttcaccatgtaaccctacatgaacatctttctgtgttaataaaataggtgtatattcatattataatcttaatatagttgtgtacttgacttttccatcagggacacctgctaaaatagctagttatatcttaattttttaatatgtattattgtataacgtgtttggaaaggagttttagacttgacattttttacatttttatttgtttttaaaatatttagaaaacccattttggttgagtaacatttgcacttattatctttttaaaatttatttttcgaactgttgcagtatgcagattttgttgttacccaaatcttcttgtcttaggtcatgctaaatgtgtagaagttgtaaaaacttttaact

SEQ ID NO: 40735 - DNA, 1774 bp, Homo sapiens
tcaaaaaaaaaaaagaattagaagtgtatataaatgtcaaaactcccattaaatacccttttttaaaagtagtttggcaattttcattttagttagtttcaactagtaaaaaatgacaatgaccttggaagtttatattctagtattttggatgttttaaactgaagacaaaaatttgaagccagtgttaaaggaaatttttttacctattgagttagtctaactgcctaacttccatatctgaatgaggctttgttctctactgatggatataaaattatctctgagttgttgaaggagttatttttccttatctgtggctgcagtttgagagagagatctatagaggtacttaggaatttggatgttcgcaatgttagttattttttgccatcagttatgacacatcttagcagattctactttgtattatactgagctagtgttttttgcttgtagttattccatgcatgctatccatagaggctgacttttcagtcaacttaaaattgatactgactcctcaaataaacagtgattgagcagtatcagtgtaacatcttgcctgctcatcaggagcaaaggaaaatcatttgcaatcatttgccttgttttttaattgactgttgatgttggttccagtgtcttcaactctttgagcaagttcttgcccactcagctaatagttttaaacaactttaatttgtctggacacatttttttgggtggtgtaatcaaacatgatttaattaattgacttggtgcacagctttccttgcttatctaacacgtgagccgctcagaaactttattttgatcacagcctcatttctgtttttttaattttgtgaagaaattttgctgtactatggtatgctgtttatagtgttatgagaatattcttatgagtgcttagtctggaaatatcaatttacattgtattgttttatttagcacagttatggcaccattatataataaatacaatgctttgccatctaataatatctcacttcactatacttcaaaaggatgacatgagaagtccattttccccttattttgacatgagtatacactggtaacaaaatgtcatgacatggtgattcatgtgactcctaaactgcgtttgagttacaactgtgtcactaatctgtggtgctccaagcaccagtttgaagtcatgagagtaccacatgtagcctctgtcacagctaatcgattctgcagttcaaatgaagccataggtaataaacaattgagcatggctgtctttcagtaaaactttttttatggacactgaaatttgaattttgtataattatcacacgtcagaaaatactcttgttttggttttgtttttaaaccatttaaaaaataataaaaacttcttagttcaaagctgaaaaaagaggcaattggccaaatttgggccatgggccatagttagccaatccctattttatactattgaagatttactacagaggtgttttaattaacaatcttgagtatggtataatcttcagtttttaatatattagaaatatgtgctatgtttttgaagcatgtagaatagaacagatttcacaaagagtaaatatatattttttaacctacattgggccacaagtgggtatttaaaggcctgaggctcaaacctcagatatttgaataacctcttaggctgaatgtaaaaggtgattaaacattctggaatgcaagagctcaaaaatgggtttcctgaatttgtggtgcttcttcccatcttaga

SEQ ID NO: 40736 - DNA, 1068 bp, Homo sapiens
aaaacaaaaacaagattacactttgattagccttagcttggcatgtacatatctcttgtcttgtctttgtgtacttcagttaacctggactataatacacatctctttttctttgttaagatattagtgaagcttttgattctacgtaatgttctcttgtacaggttaaaagtattttatttttagagattagtaacaaattggcttgaaggtagaatgcaaaagtcaacctaaaattattggaacagtatcttttaaagcttgataccaaagttcattctcattagtgtttgtattgactgacttcagtgatgattatactaaattagtgtaggtgctagacatctcatatttacaacctcatacacatttctgccatatcttgtttgatttgttataatgctacaatgtaactagaacatgtagtatttaattttttttttttcaatgaagattccaacttagatgcaaaagaggcatgagtagcccttgggcaaacaacataacaggattgatttaaaacccacataataatgagttctattaagcttatgatcctggccaggtgtggtggctcacgcctgtaatcccagcactttgggaggcggaggtgagtggattacctgaggtcaggagttcgaaaccagcctggccaacatggcaaaaccctgtctctattaaaaaagtacagaaaattagctgggtgtggtggtgcgcgcctgtaatcccactactctgtaggctgagacaggagaattgcttgcttgagccccagaggtggaggttgcagtgagccaagctcacgccattgcactccagcctgggcgacagagtgagactctgtctccaaaaaaaaaaaaagattatgatctctctgtgcagtaagaaactaaaattcatttcttatagtgcttgtgacttaagggtatacaaagatattaatatacaaaacaaggacccttattcttgaagaggttacaattcaagggcatagggaaagactaagaaagggttacatacatctgccatatcctttcattctctcagtgctaaggaactaaatgtgtg

SEQ ID NO: 40737 - DNA, 1030 bp, Homo sapiens
attgtcaccatgtaaggtagagctttatggtagattctttcttaataggtagtttattttctgcaatcatagcctcttaattataattgcagaggaatgttgcaaagggccatggccctgctttgctaaactctatattgtttcttagccttgttggcacctgcattaaaaaggtggctttccctttaaaagactttgtatatgaattgttttcagaagagagctgtgctgaaaatgaagttaactaaaattagaggtgtgataccaacaaaatcaagtatttatgttattagaagcatggattttgtaaaagctgattgtttatcccgtactgttatcaaatatgtaggagagaggacaaaaaagtttttggggttgtttccattaaacaaacaaaaggtgtatttagggaggactttgaaagatttagtggataaattgcattttttattctagcttttattgtaatatataaacccgtgttgaaatgatagacttcaaaccattaaaatagcttgactgtcctgaccctgtggggaattagttccaagacttccacagatagcaaaattcatgggtgtttaagttccttcaataaactggtatagtatttgcatataacctatgtatatctccccttacactttaagtcatctctagattactcataatacctaatacaatgcaaatgcagtgtaaatagttgttacactgtatgatttaggggaagattacaaggaaaaaaagtctctacgtgtttccagcagacaccaccatctattttttaaaaatattttcagtctgcagttgattgaatccacagatacagagggttgactttatatatttgagaggcttcttgttatttactattataggaaacactggagctttacctaaaagtattaattttattgaaatttagttgatgaaaatctgtgattttgttattttctcttttttaaatcttatgcataagtttaaagacattgtgatataagatgccgtttaaaaagacaggctaggaatt

SEQ ID NO: 40738 - DNA, 1061 bp, Homo sapiens
tcaagtcctaagaaggaaataaaagactgcaggtataaagtaagagagggggccgggtgcagtggctcacgcctataatcccagcactttgggaagccgaggcgggcagatcacaaggtcaggagtttgagaccagcctggccaacatggcgaaaccctctctctactaaaaatacaaaaaaaagttagctgggcatggtgacgggtgcctgtaatcccagctacttgggaggctgaggcaggagaatcgcttgaacccgggaggcagagaggttgcagtgagccgagatcatgccattgcactccagcctgggtgggtggcaagagcaagactctgtctcaaaaaaaaaaacaaaaaaagtaaaagagaggggacctttgatagtgtaatcagaaaagggaagacctgaaggaagagaatgggccagccttaaaaagagtttactacataagatattacaaatagcaaagccagatagttattaatagaacttggtgcacttaatgggaaggaagacaaggaaaatgtggagtcccatgttaggcagtaaaaagtgggactgcacaaaactgtgtagtaagaaatttgactttacccagaggtggaaagccattgaaagtttctcaaatagaatgcattctctcaaaataattggtaaggagttgtggaatataggctggaagcaagaattgaacacatattggtccatataaaatgtaatggttgcattttagatagaaatagacatatttaagagagatttgggcctcaaaccaatagaactttttgatggattagaaatggagttggagctgaggaatggtgttagagaatgaaggatgactcctaagtttctggattgagcagttaggtggtatgtggtactactcactaagattgggaatacaaataaagagctctgttttgaacatcttatatttgagatccttattgaattcaagtgaaaagactgagaagagagttaacctctgtgagtttataatccagagaggagagtctagacatagaaatttgggatttctcagcttatatcaggtga

SEQ ID NO: 40739 - DNA, 1025 bp, Homo sapiens
aaaatctttgaatgtccataaaagaacagatatagaagtttttcctctaagtggctgattaaatgggggggggggcaatgaatttatatgaatttaagagaaaatgaataaaataaaagcaatttttatttctgatagtatggtagaataggtaccctatatcatttatatcaccctcactgttgaaataactaaaatatatgatgaaatatttaaaatatatgtctaaatctataaatataaaactatatctatgaggctgctggaaagtaaggagtgaacagatccctaacataaaataaaatcagaacacccaattggtaagcaagttatcaagtggctattgctgtgagaatttttgctaaaccctagaattctttggcttccattctgatggttttgtgggaccagctgtgagatacagcctaggtcttggtcagtgcagggaatctaacaggaggcattcataaaaacagtattctagagagctatactgccaatgtaagaatgaatttgcaatgaactctgatatttcacaagcaaattgattttggcatagtgtgagagaatggaattctctgaggattcataatcccaaattggtctttgcttgagtttgggttctgattcatcctgcatgtgtggtccataaaacctcaagcatgatcccagacgaccatgtccttaggtgactagtagaaaaaaatgtataacttcttcgaaagaactcaacttcagcccaggattcaagataccacaaataaagtttcttataaaatgaacagtcaagagtgaagtatcacaaaacagtaaaagaagtaaggcactgtgagtaaaatgacagaccacaaaatcctcatataatagaatttttgacatggaatataaaacagttatgtttaaagaaattttctcactttgggaggcggaggcaggcaaatcacgaggtcaggagattgaggccatcctggccaacatggtgaaaccctgtctctactaaaatacaaaaaattagccaggggtgg

SEQ ID NO: 40740 - DNA, 1067 bp, Homo sapiens
aggggagtcttttgtccaaccaaagtcagttaaaggagagagagtgagagagagagcctgagttatagagcaggataatctgagtttggacttctcgctgagaatgcttggcatgaaacagtagggatgagccttcttcaccatgactgtctttaggggaatccactaggctgctttaatgctgctctttatgcttctctatttataatgaagtgctgtgagaccctgtagcagagatagtattgttttttgtttcaatatcaactggtactttttctctacaatgaaaaatgttttgtccataatatatatcacctcgtctctggttttattgttgaaaaccacctgacttgcgctccttttcttttcaacattttttattaagaaaatatttggaaggaagcaataatactaaattgcagaattacaaaagggcagcttatacagctaaattttaagatactctgagggacaaagaaataaagccactgatgctgggtaagaaaaatgtgtgacaatggaagtatgcaatgtgatttacttggctggctaccatgtaggaggaataaattctataatcttgccaaaacctaagggaaatgtgaattgaatagcaataaataaccttattggaaacagttgaatgtgatatactgtatcctctagccttaatacatgaaaatttctcattgattgcagcatcagactcaagtagactgaagatggggcaatttttaatgtactccacaatgtcccttctgttccctgccacaaccttctcaaacttgatgagttagaaggtcaggttaatctatgtatgcaactccaggctttttggcctctttcaggattaaataaaacttatagaaaatgtttttctctgttcctttcattttgttgttcagaagccattctatgtttataaatactgtatgtttagtaacattttaatttctcttattcgactaatgttttaaaggtatgaccactttagaacattttcttattcaaccctcacagtattgctgtgagctaaaagagagtattatttttcttgcatgtttaca

SEQ ID NO: 40741 - DNA, 1026 bp, Homo sapiens
atgcctttaccttccaccgtgattgtgaggcctccccagccatgtggaactgtgagtccattaaattgagtccattaaacctctttttctttgtaattttcccactctcgggtacgtctttatcagcagtgtgaaaaaggactaatacaactgccaattctgcctcctaagcagaacttgacaccatctatttctctctctggaaggtctgctaccctactcaagagactcaactctctttcttgacttgcaatagccttttcattggactttatagcctcagcctagcacccctacgggtatgaatcccaatccacaactcaagtgtccagaacagattatattaatactattttccatagccccagctatttactattttgaagccatgttgaacctgccaggatggccagaaatttaaacacattcatttgggaggttcagggtcttccacagtgccaaatctcaggtggggcagggacaatagaaaatctgatccttgatgaacactggctgccaggaggctccaccactgcagtgcgcttcatcctgttttccaggacacagagctcagagagcctctgcaccataattcagaaccctctctcctttctcttatttttctcttctctctcttttctcctctccttttaggcctctctcttttctgcctggaggactgcccttcctgccttgcattttctcacacctccacattctcttcctgttacccattgcacacaatctctaaattgctctaaggcaattttggatcaaaagagccagagagaacatttctgtttttcaccttgccatattccttacctgaggcaatgagcagagggcctgttgtctgcttaaatagagaataggggagaaaaacgaaacacagggagaaaaaaatagatgaatatctgaaatactatctcaccatgcattcaatatacagaagccaagcagactggctgcaagacctaaaacactaattgaatctcgttattcccttgtgtgaacattttcggtggc

SEQ ID NO: 40742 - DNA, 1044 bp, Homo sapiens
tatgtggtcttttgtgactggcttttttcactcagcataatgtttcaaggttcacccttgttatagcatgcatcagtactttattcctttttactgtacagtaatattctattgtatgaatataccatcttttattcattcatcagtttgtaagtatttgtgtttctactttctagctatcatgagtaatgctgctgtgagcattcatgtacacgtttgtgtgtgtggacataagtttttatttttcttggatatgtatctaggaatggaattgctgggtcatatggcaaccctatgttttgtgtgttgaggaattcacaaattgttttccaaagtggttgtgccgttttataatcccaccagcaatgtatgagggttcaaatttctctacattcttaccagcacttattattgtctgtcttttttgttttagcttttctgatggtggtgaagtgatatctcattgtagtttgagattgcatttccctaattactaatgatgttgagcatcatctcatgtgcttgttgaccatttgaatatcttctttggagaaaatgtctattcaaatctttagcccatttttgaattggatttttttgtatatttaaagtattctttatatgttatatatacaaaactcttttcagatagatggcttgtaaatattttctcctattctctgggttgtcttttcattttcttgatgatgtcctttgaaatactatagcacaatagttttaattttgatgaaatccggtttttttcttttctcatccatacttttggtgtcatatctaaaaaaaaaaagactgcctaaaatactaggcatattaagccattttacattttaacccttagtcttttagacttgcataatttttcctttgctgtattatcaggctgtcttcaccagcacttaaggaccatttctctggtgttagaacatgagagagggaacagttttcaggaagtcctttttttatagaaatcatttagctcctagcagccactagcagtgaacataggaaagagcagataagaac

SEQ ID NO: 40743 - DNA, 1060 bp, Homo sapiens
ggggtgggaggggaggcccctgaggtgctctccagggaagaggggctggggtttaaatagcatgcttggaggaagattttccttcaatttttcctaagtccttgaattcaccagtagatttttgtaaacaaaatgtaagtcgatgttttctctcaattatcctaggagtgacctttatatgtgtggaagattaatggtatatgctccttatgtcactgtttttgagtaaaatccatttcctttctctgtttcagcctatgacaaaattgatgtttacaggcctgctttttgcttataattgacaacatgtgcaaaaataccaaatttgtgtcctgtgcagtatgaagaattcagtgaatattcattaatgtattagcttgttttgctctctgttcatatatggctctattcttagaaatataatttgaatgtgatctttcaatagtctgaatattttacaaattatagctatgtcttgtgaaaataacctcaaaaagaaaaatacgactctgttgtcttacttgatatttcttgccctagtaatgtacttgacatttatgttcctaagcagtgtaagtaccagtagaatttctctgtcaaactcaatgatcatttagtacttttgtcttctcccatgtgcttgaaggaaaaataaagtgtcactaccgtatttcttgttttcatcaaaaaataaaaataatttaaaaaattctgtgttgtctaggttaatttaaggttgggaaatcattaaagttatcaaatgataccagtaactatcatcctgaaagtttaaaaaaaaaaaaaaggcaacagccaccaaaccttccaagatttttcacctgaaaaatggtaaatgggagcccaactgcaactgcatactcatgagcattattttttctacataaccagtgcagtttttggtggtaattgaagcaccatatagtatcacttaaaatactgttttcagtggaaaacttgtctatgcagcatccttgttcattacatttattattaactgtgccttccgagatctaataagcttaagatagacttttggaag

SEQ ID NO: 40744 - DNA, 1328 bp, Homo sapiens
tttttttttttttttttttttgagacggaggacggagtcttgctctgtcgcccaggttggagtgcagtggcgcgatctcggctcactgcaacctccacctcccgggttcaagcgattctcctgcctcagcctcccgagtagctgggactacaggcgcgcgccgccacgcccggctaatttttatatttttagtagagacggggtttcaccatgctggccaggctggtctcgaaccccgatctcgtgatccgccctccttagcctcccaatcctctcttaaaaaagtgatagctcagaaacatttgtaaaagcaaggtttttatttcattttggctctgtcattttcagaggcaaagaagttggcctgtaaaatagagtgctagagctcttacgcccctccccttcttcccaacttcctacttcctagcccttttatcaactcctagaatagttaaagagagacacatctagatgggatgaaaggtgccctaagcaggagaaactgaacaaaaggctagaggcatgggccaggtaaaaattgggcctagagtgaagactgtgctgtcgttaagagctttcgaggaaggagtacttactccccaatgatgatgaatggaaaaatacttttcagggagaattgaaggggttaaagtgttaaatatgttgcctagacaagggttctttaaagaaagacagcgcaactttgaatgctttcttacttgttttgtgacctaatttatgtggaagattgttatttcattaggatttagtaaaatttttttttctgattctaaacttattgtgaaaattgagctgtacagatattcttttgatttcaattgggaacatttggaagaacaacagtcttacttgcctgtacaatatagagacatatgaatagtcataacagttttcaacttgttcttgtttctgttaaactatattcctagaaacatagtttgaacaacttggtctttgttaggcttgtcaaattgccttcatggaaaaataatctacaaaagtatggtttaattgattgtcttacatgataattttccctggtaacaacttagtaagtgatatatcttttttcctaaattgcttaaatactgtgaaattgctctgacaaattggaagtgtaccattggcatatttgtcttcctttttatgcatgatggtaaaataaaagcatgttgttctgctagatttcttatttttcaccttacccataaatgtaatgcttgaatgaagttgttcatattaattaaaaattatggaatcattaaagtcctttaatccattaaagttcttaatggattaaaatcatt

SEQ ID NO: 40745 - DNA, 1071 bp, Homo sapiens
ctctgaaattacaaaaattactgatatttgttacatgaatgaatgaaattagatgtttattcttttccttagacttaatagaccaaaaggagtgtaacatttagtattataagctccttcatggtagagactcttcttcatttctatagccattcctcatatttcctggcagagggcacgtttattaaattagaattcaattttcagattgtggctgtgtcccagtctagataccatggtggataatttaatgtgtccatcaaataagagcaaggactttgaagttgaacaaaactaggctgaaatctagactctgtcactaactgtgtgaccttaggcaggcaagtcatttaacattgttgagttccactttctcatcagtaggattttgatatgcaaacttttctcatacagtttctggaaggagcaaaccaaacgttgtatataaaatacctgccaaggaatgagaactcagtaagtaggtgtttattgtcataacttagaatggttctaggggctgtcaatgagagatacaccctttggaatcagtcttgtgtggactggaacatgcctgggcatttttcaggcaggatctgaagcaattaaggtgagtgataccctacctctcagaaccctgctaaaagtagttgaggtcatgccagtttttgcaatagtttggaaatcaagccttctgtgctcttcaggaggagataaggattgtcgtggcagtattctataatagtaattctaacccctgggtgcatattagcatcacttgggagaacccaaaacacaccaatgcctagttgtactcttagaaattctgatttaattccttctaggatgaagtccagataccccatatgcttttaaaggtacgagatagttccaatgtgcagccagagttagaaccaatgctacgtagtggtgcttcccaaactttgctgcacattagaaccatctggagagctttaagaacttccggccacgtgcggtggctcacggctgtgatcccagcactttgggaggccgagatgggcagatcacgaggtcaggagatcgagaccatcc

SEQ ID NO: 40746 - DNA, 1050 bp, Homo sapiens
cccactttttcatggggttgtttgtttttttcttgtaaatttgtttgagttcattgtagattctggatattagccctttgtcagatgagtaggttgtgaaaattttctcctattttgtaggttgcctgttcactctgatggtagtttctcttgctgtgcagaagctctgtagtttaattagatcccatttgtcaattttggcttttgttgccaatgcttttggtgttttagacatgaagtccttgcccatgcctatgtgctgaatggtaatgcctaggttttcttctagggtttttatggttttatgtctaacatgtaagtctttaatccatcatgaattaatttttgtataaggtgtaaggaagggatcgagtttcagctttctacatatggccagccagttttcccagcaccatttattaaataggaaatcctttccccattgcttgtttttctcaggtttgtcaaagatcagatagttgtagatatgcggcattatttctgagggctctgatctgttccattgatctatatctctgttttggtatcagtaccatgctgttttggttactgtaaccttgtagtatagtttgaagtcaggtagcgtgatgcctccagatttgttcttttggcttaggattgacttggcgatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatagaatgttcttccatttgtttgtatcctcttttatttcattgagcggtggtttgtagttctccttgaagaggtccttcacgtcccttgtaagttggattcctaagtattttattctctttgaagcaattgtgaatgggagttcactcatgatttggctctctgtttgtctgttattggtgtataagaatgcttgtgatttttgtacgttgattttgtatcctgagactttgctgaagttgc

SEQ ID NO: 40747 - DNA, 1035 bp, Homo sapiens
ctgtctctacaaaaacataagaaaattagccaggtgtggtggcacatgcctgtagtcctagctactcaggaggctgaggtgggagggtcacttgagccttggagttgggggctatagtgagccatgattctgccactgcactccagcctgggcggcggagtgaggctgtgtcaaaaacacgtacaactcatcccagcatcccaccgctggcattttcttcacttatttacctcatttatagagtatctcttcctattagaatataagttccaagaacacaggcacgtttgtctgttttgtttgctgttatataccttcgtgcttggagtagtacccggcacatagatacttggtaaattatgaatgatggtttggattgacaggaataaacagaagtaaatgttaggaatttcattgtttaggaatataaactataagagattaagctccctccactgatattctagcatttatgggtttacttttgtttaccttttggaatcatgagagttttgttctagaacagtttttgttctttcatttgagataatttgaataagaaggatcaaaggattgggaaaggaaaagtaaaatatttggcagaataaaaatgttttttttggtaatgaagcctttagaaaactaaagttaaatgaaaaaactgaagtagaactaaactcttacgtcttaggagaacttagatacatatgtgtcagagtctgactgtatttatattctaaacacacatatgatcacacaacatacatacagagactatttgtataactgtaaatagatgtgacgtatgtataacttaaaaatcttttgataggtcacagtcgaactgttattggaattgaagagaaaaaaaaccgaacattatgcttactaatacttgatcctggatgtccttctcgagaaatgcagaaattattaaagcaagacatagaggctagcagtctcaagcaacttcggaaatctatgggaaatttaaaacataagcaataccagatattggcagtagagggtgctctt

SEQ ID NO: 40748 - DNA, 1028 bp, Homo sapiens
atgatgatggctaacctctgaggcttagtttagattctggtggtaaaaaatgtatactgggatatgaggtgtagtgtggtctaatgttgaggaaggttggttatcacttaaaactagaaggggtggagggattggcttgcagtagtgtgatgatcaaagcgataagcaaaggcctccttggcattggctctggctctaaggcattttatggtagagaactggctgaaagacttctcttacatccgccagcattacttatggaagctgtataccattatttcttactgctgcttttggaaatattttctgagtacttaatacttcattttctcttgagctttgccattgaattttttattccaatgattacatcttaatattttcattttcttcatctttctattttttcttagtaactttctgtcctggtttcaaagattcagttccctcctttatttcagtgagcattttgaacatacttattttacagtttattatggattactgtagctccatttcttcacaggtaactttttcagtttgtagatttcttagctgtttttcttggcattgcagcccccagtgagtttagcaattcaaattttagtgttcatctgttatgggagttttatatgatcccttccctgtgaagcagtttcatggttccttcacactggctgttcacagtctctgctttcagaccaggccttacatatacagattgctctatgctttcactctgtgtatatgcacaattctgggtccctcttctatgtcccttatctgctaggtcttggtcttatagaggaacaatttctgtttttggcaagctagacctgtctgcctgcagtgctatgtgatggatgcagctctttaatctcctgctcctgtgtagacagtattaccccaattcccagctttatgctggatgtttaagttcagcaccttaccactctgttgggtgctgagaatttagtcctaaaaacccatatccagactgggccctacttaccactttggttttcctt

SEQ ID NO: 40749 - DNA, 1078 bp, Homo sapiens
agagttgacctgaacagtgctgtcaaccaagttgatcaaattgacatttatagactactccatccagcaacagcagaatacacattcttctcaaccccccatggaatatccaccaagatggcccataaaatacaccttaataaagaagaatatatagtttatgttttcagattacaatgtaatttaactagtaattaacagaaagataggtgaaaattttcaaaatgtttagagataacacaacacacttctaataaccataggtggaagaagtctgagaaactaaaagtattttaaactaaatgaaaatataaatacaacttattgagatttgcgggagcagcacaaaagtggaatttttcttgtctctttctcacaagatccaggtgggattcctgagactacagcaccctggactttttcactctcatgtcagtccacactcagcctccagcaattcatcaaagttaccatttaagtgttcctaccaattttggctctatcaacttgtgctccaggtaagctgactgtggctgtgattttctttatttacccttctttccagattttggggtagcaatttgttctgtgatctcaattttttcaggactccagggaaagtaactgaatttttatttgttcagctttttttcttgttataagcatgggaatgatgactcataggttccttttatgtcagaactgactgatatttgtttttttaataagtaatttactcacatagttcaaaattcaaaagcatgcagtaacagatggttctcttctatttcattcttagttgccatttttcccacctgaagtctactagtgttatttctttctgcttatcttttcaggaatgctctaagcacatatacaagtatctgaggtttttttccccacacaattgatagcatattctatgccctattttgtatttttcttttaaaaattagtacattacagaggcaattccatgtcagttccatgacaaacatccttttaaaagttgtgtaatatttcatcatatttccctattgaaggatatttaggttgtgtccaatgttgaccattccaa

SEQ ID NO: 40750 - DNA, 1043 bp, Homo sapiens
tgggactgggtcagttctctctctgtatataacttgccacattattttagttggtccacatgtgtatttatcaacccagttgatatgaaagcttgtcaagggcataaattatgatctatgatttttaaaaatattatctacaattttttttctcattgtgctggcatagttctgggcccttagatgcttagcaaaattatgttgagttgaataggaaacaaaggcatgtcttgatctttaatctactggctagctgggaaaaccaaaaacacaagggacacatcctgtgcacaattgtaaaacaatgtatcaattgtacaaaaatgaaaacttcagactgaattggtaagtggtcctgatgagttgctctgctatgctaaagctgaagacttacagttaactctgatctttaggcttaccatagtctcagaagttgataccttagcacctaaaataactttactagataatgattgggatgatttgggctagtattcgttggattgaagacagaacacaactcacttactgacatcttctctaatactgttaatgttagtgatccaccacagcacacattgtctctaccacatggtgaaccacctcatagttttgtgttttcataagctttgaagataaaggtgaaacagtaaaaaggtttcttaaagtaagcaaagtaaaatggaagtagcattctgtgttattagaagatacagcttatagtggatttctcttgctaccgaaatatctgacttatactattgattttctgtcagtttagatggatgtcttgtatcttggataatattattctaatgtttgtgtatttatttcaaaggtagtctctctgttgtcattcttgaataacaattattagtcaaaagaaagaaaattaagcatccttaatttcttctattgttttctttataaggcacagttggtggatctgaaatctgaactgacagaaacccaagcagagaaagttgttttggagaaagaagtacatgatcagcttttacagctgcactctattcagctgcagc

SEQ ID NO: 40751 - DNA, 1022 bp, Homo sapiens
ccatagaccttgggacctgctgctttagtaataatcaaaactcttcccagaagaatagccatacacttccactctgctaattctcttagtttctttcatacagctcattacaatttgtagttttatatatatatataaatttatttatttatttattactgtttggggggttggtttttttaagaaatgggggttttgctgtgttgcccagactggcctcaaactctgggctcaagtgatcctcctgccttagcttctctagtagttatgtatgcctggtttactggctttttaatgaccatggtgaagttacctaacctctatgtacttcagttgtcatatctggataaaaagtgcgtctctcagagtatattatgaggattacatttgcttgtctagactgtagaatgttattttttgggggagaactaatggcagatgaacttagtggtcattatggttggatggaaaaaaaatagagtgaacagatacagctttctcacagaactttcatagaccagataactgcttcaagagctgacctgaagtaaggaggagtattatttcctatcttgagggatggcagagattttcaatttgacctttgaatatattttctgtttggtcatagtcttgtgttttagagtaagactcattagatttctgtgattttgaccacctcaggcacatagaagaaagaaaaaatagagggagattttttataataaagtgaatgagttaaatgatattttgaaggtgtacaagaaaaggaatggatcaaaatggctttcattagttacattttcttcttgacttttgtcacaagagaaaaggtcttatgaagaatggttctgcctctgttgtctgtcaggtagcttaggatcttttatgtaagaatctctgttcctagcactttgggaggctgaggcgggcggatcacgaggtcaggagatcgagaccatcctggctaacacagtgaaaccccgtctctactaaaaatacaaaaaattagctgggagtgg

SEQ ID NO: 40752 - DNA, 1027 bp, Homo sapiens
tagttcactctgactatggtatggagaaaattgcagagaatgacatgaatgaatgcagaaaattgtttagaaggtttctgtttatgtgagattatgatagtgtggagtaagataatagaggtaggagaaggtattcagaacaagagaaactggagaggtaaaaataaaaaaaacctagagatggattggaacagagggatgagggagttcaggataaatccaagtgacaatcttgtgcagctggttgcctgaatagatagatgaatgtgttatattattagcaataacaatattgccaactttattgatcagttaccatgggccaacctctcttctgagtcttttacatagactgattcatccaattctcacaacagtcctggaaacaggtttattagtatagttactccaactttacagggattaagtaagaggcctgaggctacggagctagagaaatcagtctctgcacaaacacattatgtctgatgggggatggaggaggtggagagagaagcagacagaaagagtgagtgtggctgaatagatagcaagaagtgagattgtagggtacaagggaggttttgttttcattttgtttttaaataaaaacaaataaaacataagtctgtgagaagcatctacttgagagaaaagccaaatatagaaaaagagtggggtagttaatattagtaagattttgtaataacagctacttagaagagggagagaatgggagcagacagtaggaggttgtggaagtttctgtctgatggcttttttttttctgtaaaataggagcccacgtcagttgctaaaagtaggtgagagtaagagcatgaggctagtagaagaggtttgagatagtaatggaagagtgggagagccaattggccagagaaacaggactgccaggcattgttgaggaatggcttggggttagttatcataaattatggtgcaaccggtctgtactgttgtgtgattttctctagcaatgcatatctgtttaggtacaggcacagta

SEQ ID NO: 40753 - DNA, 1049 bp, Homo sapiens
atggatcaggcagcccccagaatcacagcagatttagagactccagcacagcaacatggtggaagatttatagacaaaaatgggaaatgacatacagaaatcagaagtgaggtacagaatggctggattggttacaggttggcatttgccttatttgaacacagtttgaatactcagcactgtatgaattgttgaagtatggctactgggactggctaagactcagctattgttacaggcacatactcctaagttaggttttcaatattgtctacctattaaactaggttgcagttcgtccacatggcctcatatatagaagtacagagtcccttctcaggccatatttagttcgctttaacaggagaaacttagtttacagttcagctttgaaacaaacacaataacagttttttcccaaaacaaaccttacaattgtttgaaatgcttgttccccggtgctgtaaagaaatagcacttgaacataaatttaatttactcagcaaggccatttttatactttctgtagaaaggatacactcgctagcagttttgccaagacagcacaaggaacaaaggagacagggttatttataacctgacgtgtccaccctaccactctgtccagtttccactggctagaacgggaccttacattctgtatttgtcctgattggctagcaacttagaactttttaaaagaagtaaaggtagatgagaacaaaggaaggaggaagtaacttgtggaatactgagaaaggtaaaaacaccttcaaataaggaagaggaataggctgtgacctaatgcttgcttggaccagtataagcatgctagggcaaatatttaggctaaattgtgggagctaagaacataaagtgtattgatttctttatcatggctagcagatatttaagaatgttagcacaggtctttgaatacattttgcgtctaaccgagaagttactatttattcctaattaaatggggaggaaagtctttgaagaggaacctctatttactttttacaattccccctttttattttata

SEQ ID NO: 40754 - DNA, 1120 bp, Homo sapiens
tttctatcattaatatattaactagtatttgttatttcctctgtattctttcttcatacagatctagatgtttagaaagaatatcacaaaagagctggttatggtggcttgcacctgtaattctcagcactttggatggctgaggcaggcagatcacttgagtccaggaatttgagaccagcctggccaacatggtgaaaccatgtctctactaaaaatacaaaaaattagccgagtatagtggtatgctcctgtaattccagttacttgggaggctggcttgaactcaggaggcagaagttgcagtgagccaagattgtgcctctgcactccaggctgggtgatgaagtaagactctgtctcaaaaaaaaaaaaaagtatattttcctaaacatataggaattccaactacatgcatatcttattatatttttctctgctaaaatgtaatctctatgacagcagggagtttttgtttgttttgttcagatgtcactcccagtgacgacatcagtgcctcacacacagacaatgcttaatagcagttgttgaatgaatgaacacattttacgtaattaccaagcactgcaaggtaattggatcttctcagtaggaactcctgctactaagcagcatttattagtgtatgaaaattaaaatatattaagttatactttatttgcaccataaaaggatcctcactgcctatgtctgactgtgaaccctactttgaaaatcacagatctgaactctacagcctactattgtattttattatttttttcttttattctgacttagaggcattcaggtactactgtattttaaatacttgctgctcaaaatatggcccaggaatcatcagtatctgtaccaccaggagcttgttaggttgattccataacttggctactgtgaatagtggacaagattctgcatttctaagtgtccatcaatggatgaatggatagagaaaatatggtatacatgcataatggaagattatttagccataaaagatgagattctgtcatttgcagcaacatggatagacctggaggacattttgttaagtgaaataagccaggcaaagaaaaacaaataccctatgttctcattc

SEQ ID NO: 40755 - DNA, 1049 bp, Homo sapiens
agcccagccttccctgtgtagtgagctggaaactcctttagattgtattcattggtgtgtatgtatatgtacatatatgtataaatagttaaatacataaacataaaacttaacatcgcattgttgtgatgacaagaagtagtaaggtgctaggtggttacattaaaaagcacagcacagtgtataatcagtcactatgactggtggttttgtaagctgggttcagtttttgaaccacccagaatacctcatgtgtaaatacagtgttcatgacttaattgaaatacagttattgtttaaaaaaaaaaaaaaagaatgtgaagccactggttggcttatgccttctgatctatcattcttgcctctttttttgtaaaggggttttcttcttgttgttctgttttttaatagggtttacagctagaattttgaatgccaaagttctatttattaaattaagaaaaaagttttcaatgttaatggctagtatttttccactggactattgtttgttgatgttggaatttgtatttacagagaaataaattttttataaaaagatttatgtcctctaagagcctaatgttagtataagaatgtatttgtactttcagactctctattctgaattctcaatgacaagaatgtgctgtcttgacttttaggtgaaagctttgtataaatgcacaggagaatctttgactaaaacatggagaattctgccttctatcttataatttctttccaattacaaaaaagctttttctcagggccttctcataaagggtactgagattttctgatggcaggtactgtaacataggaaatcatgcctgtgtccatttcagttaatagcacagtgtctcctttctgactttctagaatccctgtttaaaccaggagtcttctttctagttttccaacagacagaatctgacttcagtattctacgttgctgaaagttttggttggcaagttaaatcttttattttccaccctctaatcaaaggttaagaacgtactaagacatatgcaaataaagcctacag

SEQ ID NO: 40756 - DNA, 1072 bp, Homo sapiens
agataaagggcatagcacatgcctgttttcttatatactagaataaaggctctcctaggaaagatttttcttaaatatttaaaagtgaaaatgtgagacaaggccttcaaggagactacccaggaagatacacagtttaaaatgttggctatacagctctcaatagattattttatagttatagttgaataatcagttataatacactgtaaagaaatcagattttccttctgtttggtgtctgagtccttcctgctcttcttacttctgagaatctgggcactaagaaatcagtaagtacattgtagtgctcctgcatcccagagtccttaacctaaggagggtcttagtcactggtaagaacttggctttctaattatattcacttggtttttaacattagtagcttgacgataatcagggtatagtaaatttccaccaaaaatgtgatgcgaagaattctgccttggtcctttatggtaaaacagataataacgtctaaaatagatcagccacaagtgcagcaaatatttttacactctctttgaatagaatcccaaccaccctcccccatgattttagaaataaaggcttcctaaaataatagaacaaattggcaaacaatcactaattggaccagtaggttcttacttaaatatctctcctagatttttagtgtatgttttgggattttatgggtttatttatttttttttttttaagcagacgttacagtttgttttaatctactatagatacgtttttgttttttggcttagttggggataaaataatttatttgtaagttagctttctaaaacttagagaaagtaatttaattcacgtatcttaaaaataaaattccaaagttaaaaaatttctgacttagtaggaagttaacaaaactactgctgatgcatttcagtttccaaaatctgtaccctccccccataaaaaagggagttaagatgtgctagtttaagtagttagctgaattatagattgatcctcttaaaatctggagtttgtaaaggggcctacataaacagtagatagacttggagggattttg

SEQ ID NO: 40757 - DNA, 1038 bp, Homo sapiens
ggggtaatcgcccccatgattcaattacctcccactgagtccctcaacatatagggattattggaactacaattcaagttgagatttgggtggggacacaaccaaaccgtgtcattccaccccagcacctcccaaatttcatgttctcacattttaaaacacaatcatgccttcccaacagtcccctaaagccttaactcattccagcattaacccgaaagtccaagtcagaagcctcatgtgaaacaaggcatgttgtttttttaaggttttttttttttctctttttcagtattggaagtttctgtcatcatatcccaagttcaggaattgtttcctcagccaggtctactctgctaatgagtccctcaaggacattctttatttctgttagtgttctcaatctttagcatttcttttttattcttttctagaatttttatctctacacttacgttatctgtatgttcttgtatactgtctacattttctatcataatcttactaatcctagttgtcaaaaatccctggtctgataattctgacattcttgccatatctgactctgtgtctgatgctttgtggtctcttcaaactgcgttttttgcctttttgcgtgtcttgtaatttttgttgaaagtagacatgatgtccaaggtttaataagtgtggtaaatagagctttagtaatgcagtggtaaagtgtgcagggaaggggaagtattctatagtcctgtgtttaggtctcagtcttttggtgaatttgttcctctggattgtgaacttcagttttctaagattttttctttccccacccttaggcgggacaggatggcaggagggcgatggagttggtatttccacagggaaggccaaaggagcttgatttgtgtattaaccctcctctatgtggaaggctggagttggctggagttgggttattccctttaccccaactacgttaagctctgataaaaccccagcagtttaggctctggtaaaatagtttctcctgacggcaggcatttttaagaacag

SEQ ID NO: 40758 - DNA, 1029 bp, Homo sapiens
tgtctagtttcttttttttttctttgcatgtggatgtccaattgttcagcaccatttgttgaaagggctgttttttcccctgtattgcatttgctcctttgttaaagatcagttgactatatttatgtgtcctatttctggactctctattttgttgtattgattaattttatattttatcactaataccacattgttttgattactgtagccttattataagtcttgaagttgggtagtgtcagtactccaactttgttcttttcctttagtattgtgatggatattctgggtcttttgcctcttcatataaacttagaatcagttcattgaatctactaagtaataagctaggattttggttgggattgtgttgaatctatagatcaaattggaaagaaccaacatgttcacaatattgagtcttcctatccatgaacatggaatatctattcatttatttagttcttcttagaacatttttagaagagttttatagttgtcttcatatagatcttgaacatatgttgttagatttatacctatcttattttttgattgcttatatagatggtagtgaattttttaatttttatattccacttgttcattgttgacatactgaaaaatgattgacttttgtgtgttaaccttgtatcctgtaaccttgctataattagttccaggaaggtgttttttgtttgttttcactgttccgaagtttaattaaaagcacaatttacaaatatttgatatcttgtgaaagcgtttttaagttaagaatggaaaagtatgtacataatacataatcaaataccaggtggcctcaactcccactaggtccactccgtgtctttttaggttcttcaagatcttctgttaaatctacaaagttgttttccatgacaggggaaggaatggaaatccccattgctttttgaactccatacatgcttacgatatcacctggagttacttgttgtacaagttctttaagattattggtcacctgttcagcaagatgcattt

SEQ ID NO: 40759 - DNA, 1057 bp, Homo sapiens
ttttgaaatgttactttgatggcatactttgtttcttcaaattaactcacatagttacaaggtttataactaccttttacattgcatgttcatgtcaaagttttgtcattaataagttataaattatatgcttaaattaacatgttctagattacttatattggttacagtgatgtagaaacatgatagattactttgaaattctaagtagaacagcatagcaacagtaattttatgatttatcaatatgtgaattttgatacatgtttttctatcaaaacaagtacctcggttttctgggatattgtcaagatgtatattttactagtaatatataactgccatgcaatggtatgcttctcaaagccagttatgactttactgaataaaaattcttgttttctaactacttgggaaaaaatgtgttactaaagggatataggggagaagttatttgaatataaaatcctttcctcttttctatattaggaagcaggattgtcttctgccttaatagaaggcttctttgttctcctagagttctgacagcgcctaagaaccagcttgtaggttgttatcaacttcattcttcatccatgcattcttggtgtagggtatatatgtcatctggccttttctcttatctcatggctagttgcagatgtggagttgcaccaaagtgatgatgagataggaacttacagccacgacagtgcattctgtcatctatagtgcatctttgggacttaaggattctcttctagcagatgaggcctttatttcccttcaatacttcttctaaggtagaaagtgaaataaagtataagtatttcctgtattatattttttgttgatgtctaacatacagtaaagtacataggaatattaatctttaataatagctccattccaatacacacccacatacatctccccttataatcaccactcaggtcaggatacaaaatttctaatgcccagtaggtttagcttgtgactcttctcagtctttatggtgacaccttatatcctacccatctctactgttctgacttac

SEQ ID NO: 40760 - DNA, 2038 bp, Homo sapiens
tgaggaaacgtttcatttactaaattgaggattgtaacataaagaatagggtagaattcaaacagaagtcataaaattgattgtggcatctccattcctggcatttattttattttttcctttctttctaaatccgagagaggaaatggagtaccactggaggataataacttgacaaaactataggcattaataggcagaaatccatttaatcaaatttgtgtgaaaataagatagttaagaatattcgtgtgtcaaaataactttttaaagtatcaaattattctctaacgtcagattttttgtgtttgtgaacattgttttaaaatttctaaacttctttatgatacaatattgaatttaatatcagtaactcaatttattaatagcatggaatttttttagaaatgtttgttaaaagttgactggactttagaggggaaacatcctcaagggcactttaaaagtagcttgtattatatattctgaaactccatttcattattcactgtatgaaattatgataatattggaataggcatgctgataatgtgcatgttgtagtcaaatgactattcatattagttcagatgtaaatagctcagttctgcactgtttctcagcagagcaataaataacaaaattaagtcattgtttttgcatggagaaattaaccactactaccaaatatggtaacataattggaagattttttaattggcagaaattcacatttgaaaagcaaaataaaagtgaaagataaatttaaatgacaaaccagtaaccaggatcaaagatgaatatgacctttttcatttcaaagttgtctcatttttcctgtcactaaatggataagcatttataaatttaagcactttgtcatgtcattttattgcctaagattgaactgatattcataaaattaactcattttaaaagttcagattatagaaattataggaattaagaattatagaaagtaagaattaccaaagtcagcgaaatctgtttcttaccttggcagctgtgatcatcacagtatagagtattgtgttgtatgaagtcttacgggtgtttagctggggagttttctgactctgtcacccagtttatgggaacagttgcagtaggtggaggagaaaaagtgttctagggaggtcttatgatgtcacataggaattctgaagtttcgattggttagccacagtctcagtcttatcacaaccaaactttagaacttcttactttaggtatggaaaagtcattaacactttgtgcttcatcttttgtttttaatttaaaacagtatatggtagataaatgaaaaaaataagtaaacttgaggtggtggaaagcttttgttaaagattcatgcatcttcaggcttagagataattgaatattaatggtgaagatgttgaagagctaaaatagttactgcaggaattttaattatgagaaaaataaacacaggtataagcaaaacaactttcattgaattcttgctgctgttgctttaatacgtgtcttcataatgttagcttttagtgaaagtgaaatatttttacacaataaaattttatacctgttttcttattttgttcttgttcttgtgtgtatgggagaaggagtatgagaaaatcaggctaattgctttttgttttaaaaaattatttttatcttacagttaaagaactaataaatgtatttaattcatttgtgttttcttcaattagcagtttaacaatatatttgtgaatagtaatacttatatttaaactgatacatacaacacccccaaaatagcaatatgctactttaagtatttaagattttttaaaaacaattgcattaaattattacacaatcttaccaaatttttaataaactgatgcagtattaagggcaactttatggcaaaaaagaaataattacagattccaaatcagttacatctcagttaatgaggctttataggtttgatgtgttgaaatttaagttttgtaatgtttttgaaaggatgtgcctcatttaatct

SEQ ID NO: 40761 - DNA, 1035 bp, Homo sapiens
tcccgagtagctgggactacaggtgcccgccaccatgcctaatttttttgtgtttttagtagagacggggtttcaccatgttagccaggatggtctcgatctcccgacctcgtgatccacccgcctcggcctcccaaagtgctgggattgcaggcgtgagccactgcacctggccgagtagtcaccttttatgaagatgtgtagcagaatacagttaagaaaggaataataattagacttggtaattcctatttgaacatatggttttgtgaggtttttgggcttaagtggtcttaaaaggtcagaaattttaaaaattattttgagacaaaacatgggaaaggagggagttggccaggagtttatcatgaagcatatacaggagtcatcccctacgttgacactggtaagttgtacttcagtcacatgaaacatgtcacctttccataaatactccattcccttttgtgattttgttctttgcacatgttgttctatctctgcctggaatgtgttctccaccttttgattgtctgccatgcaagcttcagttgattcttaaggttcagtttaaatatcacttcctagtgaaacctttcattagttattaaggtggaattggttgtcacctctactggtttttaatagggctttagtgttatctatatgaggatatctgtcagattatagcacaatttcaatttacatgtttgtatccccagctagactgatagtttctgaagtaaagaaactgtgtgtttatttagtatcctagtacttagtgcataattggtatgcttcaataaatcactaaagttaaataagggatttttatgactaaaactattagaaaattgttaattaaaaataatgctgtgggcagggcatggtggctcacatctataattccaacactttggaaggcctaggcgggacgaatgtttgagcccaggagttcgagaccagcttgggcaacataatgagaccccatctcatttttaattaattaattgtttttatgaatggatgaatgaa

SEQ ID NO: 40762 - DNA, 1057 bp, Homo sapiens
taatgaataaaattagtaatgtgtttcacttttttcatctgtcaagttttctatgtaatattagcataaaatttctggacattttgaagtgtgctgttacttagcagaagagcagatcttttctgaaaatttattatagtcctactttgccagaagtctcaaaaataatcaaaagataaataatcgctatgtagtagcaatttgttatcttatatacgtctgccctcttgtgtgtctggacttgggcgtcttgattttgttttatttggggaaagtcaccaaaaaaacccctataaaattaaaactataattagagcgttttatcgttagtatcaattgtaagtgtattatagagcagccccactgagttttcaagaacattcattttaatatagtgattctgatttgcattaaacaaatatatattcttaaccaattaaaatataaaaggcaacattaagcattttaaaattgtttttagtgccctgtaaattaagataagaacttattctatagtagaacatatttgagcatttagtatattaaattttaaaaataaattgttttcttatatcttattctttacactttatgatgaagaataattatttaaagagtttattctactttataatttgagttatagtattctgtaatcctcacagaataagattttaatttctatcaaagaatgaagaacaaaaaaattagttatttctgtttactgagaaaaatattgtaacaaacagtgtaatcaaaggaatatgactaatcagttcaaattttccacttgtttttaagactagggatactttctgtattggtaatttactaaaaccagtgaggtgagtgtatcacctgttgtttataagctttctacttgtttttaggaatttccagcttgtagatgaggcgtcacttaagaaatctctgcccttctgttcttcagatatccctgaaccaaacactttccactccccatctctagtatctctcatgggttcagaaaatttaatagtgtctccttcactattgagttagcaacacttgtgtaaga

SEQ ID NO: 40763 - DNA, 1059 bp, Homo sapiens
gcctcagtttcttcatctgtacaatgagaaggtggaactacagtcatttgtaaagttttggtgatacatgatgttatttaggtttataaatcagatgtacttttttttaaaaaaaattatgtgtcaaggcattcattaatcagcttatagaaagtgctttatgatgatatcatatataaagaaaaatagtatacagcccccagttggtctagggaatagcatgtaaatgtgtaaatttcttaatctgggaatgtttctattccaagacaattttctgtagcttgttttaacaaggaaactaattttctgatataagtcctgtcatctgttttttatcatcagaattttctgaaacaaattaattctataaaaaattgcaaattttccctagagtaaaaatgtaaaattggtattcattactactactaataaaaacaaatagaataaatgaacataggctatgaaaggataaggaaatcacttgtccaggaacctcacaaatatgagtatgatctcaaaacatagaaccctaacatactacattcataggagaacccttaacatgtcgcatgtacctttattcttattttagatacagttcttataattttgattatgtatttaaacaacacaatcaaaacagaagaatcattatgattgaattagaaatttgtgatttatccattcaagtgatgaaaaataggaaacctaatttttcaaatactgtcaagttttagttttcaaatgtttgtcattataggaaaacagagatccaggcagttgtttctccagctggtgtctttacacagaattggagctgtccagtggggctgagtatgctattccaaactagagtaggtgtgatagagataattgggcaaatttcaaggagtaaatactgattcatgctttttattctgcttggacaaatctctggtttaaacaaggtgtttttcttagcctcaaagcaatgcagaggagggtagggaggttggggacacactgttgagataaatttgtttttaaatcttctttctagtgcatagtagagagagaagg

SEQ ID NO: 40764 - DNA, 1011 bp, Homo sapiens
ttgacctctttgaaccatacatcaaattgtcctttaaattggcagtaatctggctagagatcagaatgcctgtttttttgttttttgatttttaaaaacagcttttcagccaggcgtggtggctcacacctgtaatcccaacactatgggaagccaaggcaggcagattgcttgagcctaagagttcaagaccagccttggtatcatggtgaaacaatgtctctacaataaatacaaatattagctgggtgttgtggcacatgcctgtagtcccagctacttggggggctgagatgggagtatttctagagcttgggaggttggggctacagtgagccaagatcacaccattgcacaccagcctgggtgacagagtgagactttgtctcaaaaaaactcaaacaaaaaaccagtgttagaaacaagtgctcggtgccgcaaagaagaactagcactcaggcaaaaagttttctcagcaaggcaatttacttctacagaagggtgctgcctgcatcagtcacgctcgcgagagcacaccgaacaaaagagaggatttttatttatttattttttttgagatggagtcttgcccggtcaccaggctggagtgcagtggcgcggtctcggctcatggcaacgtccgcctcctgggttcaagtcattctcctgcctcagcctcctgagtagctgggattacaggcgcccaccaccacgcccagctaatttttgtatttttagtagagacaagtttcaccatgttggctgggatggtctcaatctcctgacctcgtgatccgcccgcctcagcctcccaaagtgctgggattacaggcgtgagccaccgctcccggccaaagggtttttattcctaacacagttcctgtttctgtgtcctttccccattggctagggttggaccaaacaatctaaattaacccaattggctaagacttaaacctttctaaatatggtgaacacgcagtttgctaagagaggaggggagggagagac

SEQ ID NO: 40765 - DNA, 1119 bp, Homo sapiens
ccaagagcacctcagaatgatagaacagattttaagctcgcttgtataatcaccacttcagtgaatgttgtacctcggattcccggccagtgcaccaaaatgatacgactctgatgactggaggggaataccagggtccttttctcacgccagtttaaatacgacgacatggatatacgtggagtggttttaaggagcggagagagtttaataaatcggcaagaaagaaggaaggggctcccccatacagagacagagggagggggctccaagctgagagagggaaccctgagtgcagcagaaaacagccatttatattaggaggctggaggagctggtgtctgatttgcatagagtccaggggattgggttgaccaggtatgtcattcatgtagcccacaaaaatctggtcctcccaccctagccttttaatatgcaaatgcagggcaccatgatgttctacacacgtggggatatgtgggggtggccatgatgctaggcacttgtagtgacaagaagaaggtgggaattgccatattgagtggacccagtttctaatggctggcatttgcatatcaaagcttgctggcccgcccttcaggccatttttctgctatgcaagaaatgtatctggagctgccttaaaagaaaagaaacttgccaaggaccccttgtcttctctatctgcctaaaataatttcttaataactcctataacatagggagattattgactccatatctctccaaacagtgcaggtagattaaggaccagattatcatttattatctgtcctatcataaagtaatagttttatttctaagaaactttgtgttttcaaaacttacatcccatgatagtttgatttgtaaaaatttttgtaggagagaagtaacacttacagctctctacaggtcaactgcctgatgagacttaatcttaagttgaaactagtgtgagatgtccagaaaatagtagagttgaatgaaattttaaaaggcaggcaagaaaaaaattctaattttttttggtaaatgtaaaaagtcactgtttttttttttttctgaccagcttcccgcccgtccccaccccttgaccaaattggaaaatattttatt

SEQ ID NO: 40766 - DNA, 1105 bp, Homo sapiens
gatctcagtccatttgcccttctgtttggagaaaagatctaactgttggataatattaaaatcaaggctccccgcagcgggccaggtttatctgtccccaagatagtaagaaggctatgctcttgtgcaatagaatatgagtcacttttttttcaaagtctcagggttgaaggagtcccagtgctttaaaatacattccagaggagtgcatgctgaagacgatctgttggccatctagaaagagaagtgagaataaaagtgtccttttagtctccttccttttggtgtatgactcagggtggagaagaaaacagtagggggcattcctctaactagtctccctccctggttcctgggtcccggcacccagttaaatgtgccgcctgtggctgtaggtgtgaccctccaagccatggcaccagagaaactagacttttgaggcctagtcacacttacccaagtagtcccagtcctctgcttgttatttccctttgacctcctagacttgtgtgacctgtgtacctccctaaaaaaaaatggatctcagggaaaactgtgtaattggggaaggcccctttaatggaggggttatgctagattgaactctatatcctgctattatggcccatgctaaagcatttacccttagaaaaatggtttcagttaacttccagacttaaaatccccttactaattaagtactgtctctgttggagacagaataggtgacttaaagaaatgtaggaaccaaatggctgttttcctgctgatgggacaatattgagactaaaatttggctatggaagacatttaatttctaactgttgaaagcagaattttcccattcctggaagaggcttagagcctgatttctagcagtgcaaaaggaagctgcagtgttagcattaaaaaaagtgcctcatgtagaggatttctgtttcctctaggtggcactgttggcttagaaatactgtgtgctcctcagacaagcggtagagagacctggaaatgccgtgtgctctccagaccaaggggctgagagagagaggctcactgtcccggaggaaccctctgttcaggagattgcaatggcattcttgagtta

SEQ ID NO: 40767 - DNA, 1025 bp, Homo sapiens
ttccttcaatttccagaatcactcagggttcctgtgctgtaatggcagtctgagtcgctggagccgggggtttaagcctcgggacccgtcagtcctgctggaccatctatgagactggttctgaacccagcgacctctgcctctgggggcagatccatctccagtggtctccgccacaggctggacagggtcaaggtggcttcgtcttgctgcctgggcattccctcttaaaatgccctgacttgccacattgataacagctagcagatgcacctcagggatcctggactttacaagcgtgcaatgctgctactagagcctctgttcttcacttatatttcctttccttttcttgggcctcctcctgatctgtattgtaaatgactgaagtggctattctcaggaggttctctagggtgctatctggtcctatagcttgtttctgtagtttctttccaatatcgggagctgactgtgtaataaacttgtccttcaggattagctgtccctcgactgaatcatgataaagaggtgtgttttattagtgcctctcttagcctttccataaaggctgtgggattctcatctggtctatcatagatagtttagagtaatcgagaggtttggccctggtcttccataggccctctaacatagaccttaagaagtgcttccttttccattcatttcctgcgttattggggttccaatcagggttgtccgctggaactgcttcccttcctagtgggaatggagtttccacttcttccttaccttccttgtctcctctttttctccttggtctgctacaggaggcatgttgcttatatccatatttttctgctgcctgtggaactgctggcttttcagccccagtgagggtctgacttagcagcaacataacatccctctatgtgagatcaaacacctgagttaaattttggaaaatttctatatacttatcggagtcatcagaaaattgggccaagtctctgtttatttgcttaaggtcctgtaatgagaag

SEQ ID NO: 40768 - DNA, 1543 bp, Homo sapiens
ttgcacacttggatcggagaagtatgctcttggccacctggaagataaggaaacatccccaccccccactgggagatgagacttccatgaaggatgggctgatgacgaaatgggctgattggctttgggttgccttgcagtgaaatgcagagtagaagcactgtactgtcttctgtagtatttccctccttttggggatccaggaaccagcataaaatggcacccttaattttggggatctgtctttgccttcagctgcttatttggccccagaaacgcatgctttcctggcgcttttcctccaagggctccaccctgaagccagtaatccacttaagaaactggcaatgaaaaatcttacacgtgcggaatcttctatgtattaatatgtgttgtatgtttatgtataaaagagctctaattgattggcttagaaaaataagcacttaatattttttcagaaaaatggaaactttaatgcctttttgttcacgtgactttagtaatcttttggaaataaagacagttttaaaaattataggtaaaataaaatgtcttgaaaatgtagacatttggtctaaattaaggtcagatattagatttgctaaatgctttaaggtcaaactggttgactttggaaactgttcaatttgcctaccgtaaagccattagattctagataaggcctggggacatgtggagttagccatgccccctagctatgctggagagtcagttcttatctgcagttctgcctggtgtgtcctagtaacacaattaaaattgcttactaaccagggttttcaccaaacgtaaaagttaacatcgtaacatgtaattgagactattgaagaaacagttctatatgcaaggtgtgtaaggaaaataaaatgtacttttggtaaaagattataagaaggcacgggaatgtggatttttttgcctaaagagttaaataattattttaagttagaataaagctaaaagtttgaacagttgtggatggtgtgaaaaaaattgagagagattctgtgtgtgaacatattgactaaagttaaaggggtgttactcagtttttccgtaaattaaacattggaataaaagcacaacaggtttttcttagagcactaatctgctctttcacaaaaaaatgtaaagggttataagaatcttaccttatggtcaaaccgattaagattggatagacatatttgtaaaattttattaagaattgggtttaacattaatagaacattaatataaaggtgaaatttggcttatttggtgtaaaagtcatacaggaagcattatcaaatgtaaaatggtgttttgtttgcattgtactatatttgcataaatgtgttattggaatatgttccaaagttatgggaaactcctataattctaatacgacttaatgtatgttatttataattgttatgtaaaattctgtgtaccacaaaatcaaccaaatttccttatctactgtggctttaataggggctggcctaaaactttttactatccacagacaattgttgtc

SEQ ID NO: 40769 - DNA, 1039 bp, Homo sapiens
cagctaaaggatacagatttaaatcagtgatggaaaaagaagcaaaggacagggtccaggagacaccagacccaaatttatagtcgttctatcactgcgaagtcatgtgcacagtttgtttcttctagcagtgatgtatgagaacatgtggaatattgaaaactgggtaagctcagctgagccctggtgtccagggttttttggtaggtcggtatgtaggtgtggttgactgccctcatggatgacctccgtctgcagccctcaagctgataccatttggtccaaggcccccaccattaatcacattattagcatagactatatggagtggcctaaaacccccaggtaaagaaagactttcttactaggctggacattccaagggcttagaggttacttcctaggagctgggcaagggccaaatctttctcggaacgtgcacggtgtgggaaacccagacttttgctgagttaattaatccttattgcacagtgtgagacatagactgaggtttttttttttcccatttactttttgggtagagttattatgtgtactgttttgtttttcaaattgttttagctcttctagtttcttttcctttctgtataagcttagaatattgaagtctgggtatttggttaaaaaaaggaagaaagagaaaaataagcttagaataatcaagctactgtaagtaaaactcttaaaaattgtgtttgcacaaaaaagaatacaaaaaaagtcttcctaggaatttgataggaattttgttgtttagctatcagattggggagaaataacatcttttcttggtgagttttccagtctatgaacatggtatgttcttcatttatttagattttttattttgctcatcagcgttgtatagtttttaatattttctatgcatatgttgttagatttacacttaatattttatgtttttggagtgattgtaaattatattgtattttcaagttttaagacatagaacacagaaataagtttagaaatacatttataatatagaaatacattt

SEQ ID NO: 40770 - DNA, 1123 bp, Homo sapiens
accggcagaatggaaatcatccttgccctctgccgtgcacccattgaccactagatggggcatgaggactgttggatttattgtggtccctttgccaacgcgtcctatctgttctggggtggcaaggcctgggtcgggggcaccactgatgcttgcatgtcaaggcccaatttacgtgggcctggccataaaactgcccttcaaggaggaatctctgaattagtgacaggaggcttagtaagctcaaaggggatggttgatgtcctctaggccagggctgagagaacaactgctgcactctagccttttgtccccactttccatcaaaggagtaagcccccatcttaaggtggtaccagtatcccgtgtctcaattgactatattttctttcttccaatatccatgattgaatggttgaaaaagcaattcaactgctctaagggccgtacccatacaccacagattatacttgagaggcaccaaaaaaaggaaattcatctggggaacaatgaagaaaatgtcctagggcctctaccatccacatgaaaattacagatctgtcttcaaattgtcctgatgtgggagaccatacacgatggtggggaactggcctttcaaagtggccatcagatggcaacacctgcctaaattccagagggcaccatcaacaaggaacttctgaacaccaccttaaaaacttaagtctcctaaatagggattcttggtcctgtctagtgggaataatcttgcttaccaggtgaggaaagaaatctaaccggcagttatttgaacccaggacgcaggagtcagaagatgtggctgtctcacgcttagtaacccatgctgtgggagcctctggtggggccatggtctcaacctggatatctgggagaccatgacatttgctgagcactcccgggtgtacttcgggaccactacagaaagtgaaagacttaaaactggttccgggcaaaccagtgctcccaactccaaagggtcagggattgtcagagagccctttcccaggctgacactcgtgtttttagtccagtggtcttgctaatcgcctttaactggctgacaggtgcccagtgtttagcctccgaattctaaggaaggatg

SEQ ID NO: 40771 - DNA, 1132 bp, Homo sapiens
gaactcctggcctcaagtgatccacccaccttggcctctcaaactgctgggattacaggcatgagccactgtgcccagaagttttcttctttactgttgagtttgagagttctttatatattttagatactactctgtttgatacattgtttgcaaatattttcttgcactctgtatcttgtctttttatccttttgtaacacccaaggttctgtgcctagccacgccaaagaattggtgtggaggctgactgcggcgagtgacagagacttggactgagagagagagtgagctgtaggttttattgagcagagtgaaagtacaaagcttctacagtgtggaaggggtcccaaatgggttgccactgctagcttgggtgattgccttttaaactctttaaggcgggagatacgtgaggcgggaagaatgttacaggagcaagaaacaaaggcagtaaattattttgtgacatgccttagattttgagaaaatctgaaattgcgacttatgcttactcgttttgtggccttggagctgtacagcaagaaaaagaggatcttatagaacttaacgaactatgttcataaggaattgggaggatagataaggtccgctgatcacagaaaaatgggcagttaatcttttctttaactctggttttggcaggggaggagtggggcatacaggaaaacttacagctaaaattctcgctgtttatagctttcttgggaagaaaacatataagcaaatcctggtgttaggaatattttaagcatatatcctcagtattatttatccagaactgaagtaagtcctgatgcaggaaatgagtgagttttacagctttccaagcccctactcaacccaggaagctcagctggcatcacctctcagtcccccctctaaacaggacaccccaactgctgttgggaactgggcgatgactgctctagctacttcctgctggttaggggcgacgatggggccctgctgttgtattgtcctccagaggggaactttctaggccagttaagagaccagtgggctgatcctggggtcctcggtagaagcttgagttaaattcatttgaggttccatttgtaaggccatttgtagcttgatggcctttatc

SEQ ID NO: 40772 - DNA, 1048 bp, Homo sapiens
acctcagcatctactcccgtctgtctcaggccaagactggggtaagaggagtggggcacttgcctcaggcacagaatttaaggggacacaaaacattcagtaatccagataaatattttggcacaatattttaaaaaatcaaaacaaaaattcatgacagattatcggatttttaaataatagacaagatcagtgttcctgatttctccttttgcctttgggcgctgatgtggcctagcatggcatgtcttctcaggctgcatgagggcggggcttttgcctgctttgctcactgatgtacccccaatgattagtggtgtgtctgggcatagtaagtgtccgataaatatttgttgaatgagacatttaaaatatttgagggaagaattaccattcagctacatttctcatttctcatctctttctttctcccagcttttcccactaatgttgactgaacacaagaggctgttttcacattagagtcagacttgagggggagccatgtgtgacttagggaaaatatctggccaaaataggatgcagttcactataaagggcaattgtgaggtgtgaatgtttaaaaatattttttctttttttattttagagacagggtcttgtcctgtctcccaggctggagtgcagtgtcacaatcatagcttactacagttttgaagtcctgggctcaagtgatcctcccacctcagcctcccaaataggtaggacttgggagactgaagcaagagatgcacgctaccatgtctggctcgtttaaaaaatgtttattgtagagacaggctctcagtatgttgtccaggctagtcttgaactgctagcctcaagcaatcctctcaccttggccttccaaagtgctaggatgacaggcataagccaccatacctggcctaatgataccttcttaattgatttcattgtcagatttaatggatatatgtagtgtgcttcattgtattaactcttgtcagcttatataattatgaagtaagagttttttaaaatgctcaaaaatcaccctgcccccaag

SEQ ID NO: 40773 - DNA, 1029 bp, Homo sapiens
ttatttgtctttgctacaggttacagaatcagagtgtgcaccaatcccaaccacgggtattggaggtagagactactccaggatccttgagaaatggtccaggggaagaatcaaacttcagaacttcatcacagcaggaaatcaactatagcacacatatcttctctcctggaggcagccccgagggaagcccagttctagatcccccaccgcatctggagcctaatagatcaacaagtaggaaacattcagctcagcacaaaaataacagagatgacagtttagattggtttgatttcatggcaactcatcagagtgaacctaaaaacactgttgttgtgtctcctcatcccaaaacatctggagaaaatatggcttcgaagatctctaacagcacatctcagggtaaggagaagagtgagccaggccaaaggagcaaagtggacattgggttgcttccatcaccaggagagacaggtgttccatggagggcagacaatgtggaaagtaacaagaaaaaaaggctagcactagattctgaagcagcagtctctgctgataaaccagactcagtactgactcatcatgtccccaggaacctgcagaagctgtgcaaagagagggcccagaagttgtgcagaaatagcaccagggtgcctgcacagtgcacagtcccttcccatcctcagtccactcctgtacatagcccagacagaatgctggactcacccaaaagaaagagaccgaaatcccttgcgcaagtggaagagcctgcaattgaaaatgttaagcctccaggttcccctgtggccaaactggcaaaatttactttcaagcagaagtcaaaactgatccactcctttgaagatcacagccatgtgtcacctggtgcaactaaaatagcagttcatagtcctaaaatttcccagcgtagaacaagaagagacgcagccttgccggtgaagcgtccaggaaagttaacatctaccccaggaaaccagatctccagtcagccacagggtgagacaa

SEQ ID NO: 40774 - DNA, 1060 bp, Homo sapiens
aaactgcacaactacatggaaactgaacagcctgctcccaaatgactactgggtaaataatgaaattaaggcagaaataaataagttctttgaaaccaatgaaaacaaagacaaaacataccagaatctctgggacacagctaaagcagtgttcagagggaaatttatagcactaaacgccctcaggagaaagagggaaagaactaaaattgacaccctaacatcacaattaaaagaactagagaagcaagaacaaacaaattcaaaagctagcagaagacaagaaataactaagatcagagcagaactgaaggagatagagacacgaaaaacccttcaaaaaatcagtgaatccaggagctggttttttgaaaagattaacaaaatagatagaccgctagccatactaatgaagcagaaaagagagaagaatcaaatagacacaataaaaaaatgataaaggggataccacaactgatcccacagaaatacaaactaccattagagaatactgtaaacaactctatgcagataagttagaaaatctagaagaaatggataaatttctggacacataaaccctcccaagactaaaccaggaagaagttgaatccctgaatataccaataacaagttctgaaagtgaggcagtaattaatagcctaccaaccaaaaaaagtccaggaccagacagattcacagccaaattctaccagaggtacaaagaggagctggtatcattccttctgaaactatttcaaacaatagaaaaagagggactccccactaagtcattttatgaggccagcatcatcctgattccaaaacctggcagagagacaataaaaaaagaaaatttcgggccagtatccctgatgaacattgatgtgaaaatcctcaataaaatactggcaaactgaatacagcagcacatcaaaaagcttatccaccatgttcaagtcagcttcatctctgggatgcaaggctggttcaacatacacaaatcaacaaacgtaatccatcacataaacagaaccagtgacaaaaaccacatgattat

SEQ ID NO: 40775 - DNA, 1023 bp, Homo sapiens
aggcagtgtgaggattataacaataaatcacaatctctcaaggaagaccacatttagtaggacaaaaataggctgggcaaggtggctcacacttgtaatcccagccctttgggaggccaaggcgggaggattcttggggccaggagttcaagaccagcctgggcaacatagcaagattccatctccacaaaaaattttctgaaaatcagctgggcatggtgatgtacacctgtaatgctagctacttgataggcagagacagaaggatcacttgagcccaggagtttgaggttgtagtgagctgtaattgctccactgcactacagcctggggaacagagtgagaccatgtcttttaaaaaaaataagtaaggcaaataagttgatgccgaaaatcccaggcagaatcggcagtctggaagtaaaagcgcattgattttggagcccagcagatctaggtttgaatctcagctctgctcctctcagtgtaaccttggggaagttaatattcctgaacttctagtttccttatttctaagtttgtgataatagcacctacccttcaggttgctgtgattagggatgatctttgtaaacctaatgcagtgcttgcttgatattaaaaatgtagttatttttattaatattgttgaaggtagagttcatatgggatagaaaaatgagttaccttacagtctatgaattcattcatttagtatttagtgagccactactacgcactgtatacttaggattagattgtatgtatgtatttgtgtttgttttctaaagccccatttagtttttttaaaaaatgtttgtatcacaggtctgtacccaccaggtttacatatggtcttccccactttcaaatgcccagagaccaccctgtctgtcctggcactgtcttcatcctccctctttgctacagggatctgcctgacttatctctcataatctcctcttcctctgcccactcccgtattttccttgctcctatttctgctgacttcacctcagacag

SEQ ID NO: 40776 - DNA, 1063 bp, Homo sapiens
gctgtattcaggagacccatctcacgtgcaaatacacacataggctcaaaataaaggaatggagaaatatttaccaagcaaatggaaagcaaaaaaaagcaggggttacaatcctagtctctgactttaaaccaactaagataaaaaaaggcaaagaagggtactacataatggtaaagggatcaatgcaacaagaagacctaactatcctgaatatatatgcaaccaatacaggagcacccagattcataaagcaagttcttagagacctacagaaacacttagactcccacacaataatagtgggagacttgaacaccccactgtcaatattagacagatcaacgagacagaaaattaacaaggatattcaggacttgaactcagctctggaccaagcggacctaatagacatctacagaactctccagcccaaatgaacagaatatacattcttctcagcaccacatagcacttattctaaaattgactacataattaattggaagtaaaacactcctcagcaaatgcaaaagagtgaaaatcataacaaacagtctctcagaccacagtgcaatcaaattagaactcaggattaagaaactcattcaaaactgcacaactacatggaaactgctcctgaatgactactgggtaaataacgaaattaaggcagaaataaataagttctttgaaaccaatgagaacaaagtcacaacgtaccagaatctctgggacacagctaaagcagtgttcagagggaaatttatagcactaaatgcccacatcagaaagtgggaaagatctaaattcagcaccccaacatcacaattgaaagaactagagaagcaattatgtcacaattaaaagaactagagaagcaagagcaaacaaattcaaaagctagcagaagacaagaaataactaagatcagagcaaaactgaaggaggtagagacacgaaaaacccttcaaaaaatcagtgaatcgaggagctcatttttgaaaagatgaataaaatagactgctagccagactaatgaagaagaaaagagagaagaatc

SEQ ID NO: 40777 - DNA, 1032 bp, Homo sapiens
gtgcttcaccattggtctttttgggagggccagggcatcatcatcatctcttggttgaatgaagcccatcctctagcagatgccttaggaggggctcctgattattgtcttgaatttttccatgtttcaaatcatttttcatagcattgacacttgaaaaatgaaagatagcttggctggatataaagaccttggcttatactttctttcctaaagtcttgctttctatgttgctattgacaaatctgatgccattctgatatcacttgctctaaaggtgatttagtttttttgcctgaagtcccagagggttttttcctttatctttaaagtataatatttttactagactatgtctcagttgattattcctggtcagtttttctagatatcagtgagcttttgacatgtattcttttatccctggaaatttttattgaatgattgtttgacactctagttcagttctttgttttgtttttatttttcagaagctgtaattatttatttgttagaatttttcctaggctctgcagcaaccatttttttttcttaaacttcttagctcatctgtattttgttttattctcttggctatttttattcctctccttagcaccctttattatattttcagtcctgtcggtcctttcttagacaccttagattcaaatgttaatttcttttttttttttttttttgaagattcatggggcacatgagcatgtttgttacatgggtatattacataatggtagggcccatcgcccaaatagtgaacacagtccccaggaggtagtttttcaacccttgtccatgtcctttgctccccagttttggagtcctcagtgtttgttgtttccatctttatgaacatgtctacccgttgtttagctcccacttaaaagtgagaacatgcagtgttcgattctctgtttctgccttaattagatgttcatttctgagagtatttcctcttcctccctttacatccatttctttcttcagttttatcatctctggatatacatc

SEQ ID NO: 40778 - DNA, 1023 bp, Homo sapiens
gaagtactatttatttccctcttcttgcctctcataagacagagacaaagagacaactttgttttccttctgtcttttgcattcaaggaattaacaaaagtgggaagaaatacttagctgtcttagtttttaattacctttgccacagatttcaggaaatggctgaaagtcctttctgtattgctaagagacagatttagaagggatttttagaacctttagtcctttaggcagttacctactcattgcataaatacctttttatactatcctgacaagtggacattctactttgacttactttgatgaaaagttcactattttgtaaggcagctcattcctcttcaaacacctcgagtttccaacagttccttgtaaacttctacatgttagtctcagttaatttcttttgaagctgctacaaatttatctaattcctcttccataggagagttttcagaggatataaaaatttcgattccctgtatttttttttttaattaggctaaacagacccaatgttacaaaccattctttaaatggtattatttgcatgtccttcattatttcattgccctttttattctttctttttcttttctttggtgttttttttttgttgttgtttgtttgtttgttttgtgcactctcactctgtcgcccaggctggagtgcagtgcatgagctcggctccacctcccaggttcaagtgattctccttgccttgcctcccaagtggctgggattacagggacccaccaccacgcctggttaatttttgtattattaatagagacagggtttcaccatgttggccaggctggtctcaaactcctgacctcaagtgatccacctacctcagcctcccaaagtgctgggattacaggcattagccactgcaccccgcctagtctttctattagttttttttttttttaatttgatgtcccaacatggacattaaaacactagatcaagaattggcatcctttttctgtaaaaggccacatactagtatttttt

SEQ ID NO: 40779 - DNA, 1045 bp, Homo sapiens
gatttgcttttggcttaaagaacctcctttagtaattcttttaaggcatgtctgctagctactgatgctcccagtttttgtttatctgggaatgtctttatttttccataatttttgaaagatagttttgctggatatcagactccgggttcgatttttttttttctttcagcactttgaatatgtaatcccactgcctctggcctccactgtttctgattagaagtcagctcttaattttattgtggctcccttttaaatgaagagttgttctcttattgatttaaaattttctctttatcttcagttttcagcatttctgctatgatttatgggtgtggattttttaaaacatatatcctacttggattttgttgagcttcttgaatgtatagtctatttttttcatcaaatttggagagttttcagtcatttttttctaactttttttctactccttttagttcccctccttctggtactcccaatatatatatattattctgattaaaggtgtacaacatttctttgacactctgctcattttttatcttgccctttacctctgttctttggattgcataatttcaactgatctctcttaaagtttgctgactttttcttctgcaatttcaggtttactcttgagctatctagtgaattttttgtttcagttattgtacatttcaaatccagaattcttacttggtttttaaaaatcctttttatctcttattgatattctctatttgttgagacattgtcatcatccctttttttttttttttttttgcatctttgagcacatgtaaaatggctactttgaaggctttgcccactacatttgaaatctggatcctctcacaggcagcttctgttgtctgctttttctccctgtgtgtgggccacattttcctgtttctttgcacatcttatacttctttgttaaaaaccggatattttaatttaatgtattataccagttctttatattaattctcctccaggcctcgttttttatccttttttttattgttgtttgctt

SEQ ID NO: 40780 - DNA, 1044 bp, Homo sapiens
tctacaggatgtttttaaacaaattcttcacattgtgttttgactatgtacttacggaatttcagggaaatagttctgtgtatttttaatagcttaatttgtactaaagggatggtaggtggtcacatgcagtccatgtgggattctaacatgacatttagtgagttttctgatgtggaccatccctttgatgctgaaggtaatgcatctgttgaaagaagtgactgtagatttggattactgctctctgcatcttccagtttttctgtgttatcttcccaattaatgtggaatcttgtgaccctgggattagatgccaaaatattcctttgaagctagaggaaaaaggaaacatacaaatggtaaacactaagaaagttaaatcaccatatacaaatagaagcttaataaaatggttcatgttagtactcctaaagggctaagttcatatacaaaggtataattcaagttaagtaccttaaatataactaataagatgtaacgactagggctgtagcaaagaagttattttagattaacagaaacaagatacggagaatctgaggggattcatctggctttttaactatttaactcctatacttctgttttctaaaagaaagaatctcctcatttttgaaaatgaatgcttcagaagatgctttatttaacaagctactatgttgtttagattggtatgttttcaaaggaaaatgaaaaattgtcaaatacaacttattattaatggtttcctacaccttttaaagatggctcattcttagaaacagtcctgtttcttttgtgctatataaggtgcttcagggataacaaattggatcaatggaaggtacaacaagggtgaaaaatagtccggccttattatcagaaagaacatgagaacattctattctattgtcatgtaatttttcttgcatggttcaacttcatttactctgcactctcacaaaatcaccagttaccaaactgttatagttcccagtgaaaaatcagaaaatactaagtatctttaagaatgctgaatcc

SEQ ID NO: 40781 - DNA, 1032 bp, Homo sapiens
aaaatagaataaaatacttatatgacttgtatgcaaggatttaatcatagtagtttgatatttaaaaatagagtaaatcagaaactttataagccaaaaattttttgtttgtttttgtagacatggagtcttgcccaggctggtctcacatttccgggctcaagtgaccctcctgccttggcctcccaaatgctgggattacaagtgtgagccaccgcacctggccccagatattttttaaaatgttaaacataggcctgaacatctggaaatagcacataatttattaatagaatttagattctatgtcacattgagtaatcaattaaggactgtttatgacagttaactttctgaagattttctagttaaatcctttctcaaacgaccctatgtaaaagtacacagtaaaaacactatgtaatattttgttggcattccaaatggacccttttatagaaatttaaaacttcatgtatttgctttttcctaggagaatctcatcttttattggttggggatcctggcacagggaaatctcagttcctcaaatatgcagcaaagattacaccaagatctgtgctgaccacaggaattggatctactagtgcaggtattgtatgtgacaatttcaagtaatttaacattacttcagaagttaacacaatggttttttctaatgaaaaactacctataataggataaatttcaagctaatttttgagttaccactaaaaatggaaggaaatatgcaatgttattttggtagctctaagaaaatatcttgcaagctccaccttcactttgcatcttagttttgaacaatcctattcaattttctcattctctagtgattaccttcatacttttatgcaggaaaaagtccgtatcatctggcattttatcaagactcagcaactggaatgttaaactaaagagggggatatttcactttaccaagtagatagatggtatagagcttaaggcattttcatgctcataaatctgataggcaacagtagctcctactga

SEQ ID NO: 40782 - DNA, 1074 bp, Homo sapiens
catataggactagattttaacctaaatctgtaatatctgtctcagcaatgcagttcttatataagctcagcctgaacatgaaaatatccatcaattgagaataagatcttttcatgcagttcatctaaactgaattctttctgtactggaaataagtcttaagttgtttttctttcaaatgtcattaataatgaaggatggatagaagcaatctatcaacagctattttttcatgtatcattagctataaacctctgtgggaatcaaaagacaaatagtatataatccttgcccttcaggaatttacgatctagttaggaaccccactttggcacatgcagagtaatgaagttggagggtgtgtgctggtaaatgtcagtgccacaggagatccgagagatgggtctgactggcaatggctacagtagtaaagatgccgcagatgatataggggcacagagagactggattgtagaaaagtaagaattttagcttcctgaaaataacattgcttataacattagttttgaaaaatacagaagtttaaggtgaatatctgttgtcttggactatcatgtatacctcacaattgttctggtgattatatgaatctgccattcagtaattatttgagtaaagaaaacacgtatatattgaagggcttttaaaggtattaattactttacaaatgtaaggtaggtttagtataagaagagctaatatttactgagcacttgccgtcttctagatactgcattaagtaatttacgtacattatccgatctaattctcattatagtactgtgatgtaaatataatcattcacattttgtagttcaagaaacaggcttaggaaaggtaggtaatttgcccaaggtcacgtagcctatgggcagtggagctgggatttaaatccaaatctgatgaggtcagtactcttggccatgcttcagtgctctgtattttccacataatcactgcttattgacattagattattacttacgggtcatatatctaaacattaagttcctcatttaactagtttagaaacaacctaaacataatccatta

SEQ ID NO: 40783 - DNA, 1027 bp, Homo sapiens
gtaagacttcattgatacatcacttcatcacattgaaaatctaaagacttctctttcttttcttgcttttttttttttgagacaagagttttgctcttgttgcccagtctggagtacagtggcacgatctcggctcactgcaacctccgcctcccaggttcaagcgattctcttgcctcaccctcccgagtagctgggattacaggcatgcaccaccacacctggctaattatttgtatttttagtagagatggggtttctccatgttggtcaggctggtctcaaactcccaacctcaggtgatccacctgcctcggcctcccaaagtgctgggattacaggcatgagccaccacgtccagccaaaaatccaaagacttttctaaattatgctaggcagtctgtaatctcattgggcattcttcaatcatgcataacgtcagagtaacaccacattttctgtaatgtggttctcctgatcttagtttttcttgttttaatatactgactatataatttaaactgaacaatcaatttgcatctgaagcagaactgagatgaggggactagaaatgggaggcaaaagtgatatttctttagggccaaggaagagagaatgaatatttcagaaacccaaagaatttttgttaaagcaaattttctttacctattttttttctattctcctttttaccttccttcgtagaagtaattgttggtacattctgtttatatttcgagaagcaaattgggttaattatcatatttcccactcgagtatccttctgtatatgtacaatagagagtacttagtgactgtttgcaaacataaaaataaaattatttaaaaaaattattttaataaccatgtgacccagcagttctactccttagctgtatgcccaagataatcgaaaactgttcaaacaagaatttgcatacaaatgtttgtagttgcattattcataatagccaaaaagtggaaacaacctaaatgtccatcaactaataaatgaataaacaaaata

SEQ ID NO: 40784 - DNA, 1034 bp, Homo sapiens
atatttggagcagcatagttagataaagctcccaaaaaatgttttcttctatttaataatctagcactaaaacttatgaattatttatatgttcattttaagaatgaaactgaatactactcatattcctttaaatatattttaccaatattataaaacttgattctacctttttttcatatttctgaagaaaactaaccttctgactctgcttaagactatttcttgttgttttcttattgttcacaatcttctgcttatggtccagaaagagactccagccctggatacccaacagctgttcctggtttaaggcctaacatcttaatggaccttgggttggacatgtattttgttgcctaccaatcgtcagagaagggctttacttctctcagccttctgaccgttctttttggtttggtttggttttttgtttttgttttggagatggggtctcactgcgttgctcaggctggtctcaaactcttgggctcaagcgatcctcctgcttccagctcccgagtggatgggattgcaggtgtatgccactttgcccagctttatgaccgttcttaattaaaattgagtatgacttattttgatatttgttactctcttgggacaaaaagaagagccttgaaatagacatggccaagtcttataaatctttgtaccctagcttcccatggctccaatcatgttttgggtatagtaggtattcagtaaatatttgttcagttgcaaaatttcatcacattccctataagccaccacaaattattctgtgaataaaggaagtcataaagaataaatgattatatatatacatatatatatatattggcttcataggaattatgaatcttatggcagaaatcagtagtagaataaataaaagtgatagttccaaagctgtttttcaaattcagattttattaagtttcacgtcatgcctaatttttattaggactttacccagaaattttcctttcctttcacagctcgtaaaacttctctattaagaacactgaatc

SEQ ID NO: 40785 - DNA, 1033 bp, Homo sapiens
gtaagggaattgtacgtctttcattttttttaaaagaaagtctttttgatacatattgaatgtttaataatatgtcactgccagtatacaattaatataccattgaagtgtgtgtatgtatgtgtgttgcacatgtagtattaggattggctagcaaagaaaagccagcacattcatgcattagcctgtattgtacactaacaggttgagcatattgatttcctaaaatgtgtcctagcaaacactaatccaaaatttttactctatagaaaaaaaatgttccataatctagccacagaaaagttgcatgctttctcttggacggtcagtaacactgaggttctctcttggaaagtcagtaacactgggttcttaatggctctgaagtttatcagctaagaaaatacggatttaacaatgaatatactctttaaccattcatatcttcagctgaagactttggactttagcatgcaaaaagagcataagagcaacatgtatttctgaagtcctttttccttaatgcatctctgtttgcatttaggagaggcagcctgttgtctgagactagaagttcctgctgaaagcaacaggtagcagattggggatcacaggtagaatccaggagcaggctttggagagatgagtgtgtgctgcttcaatccaccagccacccaattttctacatattgtgaacatgagcacaggccttatagattgctgcatctggtagcagcagactcatggaaaattatatttcacacatgaaatcagcaagcatagtaaatgtattgaaactctgttccatataaatagctattaattcccagttcttactgaggaggtgttataattgtattttgtcctcacagcaaatacagtaaagcaactttcgaaagcagcacagctcaccagggaagagccaggattgtaggcaagggttgttccatactccttccacaacagcctgattccgtggactgtgaggcacataggtcaagattagtgatttgaatgacagtggtgactaaga

SEQ ID NO: 40786 - DNA, 1030 bp, Homo sapiens
aagtgaatctaaccaacagataaggtatgccattaagtacaacagaaggaatatgcagtgtcatctgaaaaactgttgtgctgatatttagtaatctatgctaattttgtgactagactggctctctagtaaaatattgaagacctctttttactttatttgatgactatgttataatctagaacacagatgaaatgtttatatcttgaatgatgtaacatgtattcattcactttggaaattgtatataattaactgaattctttttaaaatgttatttgaaaaagcattaaaggagacaactttaacaaagccagaagcttatagcagaaagtaagtagcttaatttaggctgtttacataaattttctatatattataccaaaaaccatttcaaatctggtagaataatagaaagttttgaaagcttgacttcagaataacattttcttaactaaaaataaatcaaacaggttgcatgaacaagatttaaacaagagacttgaaaaagagttggatgtcatgacagcagaccacctcagagagaaaaatatcatgcgggcagattttaataagactaacgagctactcaaggaaataaatgccgctttacaagtgtcgtaagtcatattatataagaaaattcatatgtggataataaatttaggagcactgtgtttaacctcagattagctgttattttgactctaataaaaaggatactttaaaaagaaaattttagtgctgtgttacagatggtaattgcagtgctatatgttctttaattaggatgaggcagttgaatgatgatgttttatcaactaagactgcaccagttctgctagaacagtaatctaaagaatgttccttaggatcatgaactatcatgccatggtgaaaactgaaaatatggctatatataatgttaagtaaaaagaatatatagtgaacaataggaatactatgatcctatatacacactaataatgtatattttaccaaaatatcaaaatatcttaacaaataccaa

SEQ ID NO: 40787 - DNA, 1750 bp, Homo sapiens
gaactcttgaatggataccatgtaccgccagctcccctcaacctcagccaaactgctctttctagaactagcgtccgttcactgtttactgctcagccatcttggactcctgtcttgtacaccagacaactagttcatcagcagtccccactgctctaccttcaaaatagatcctgcttctccctactacctctaccaccatctgattccaggacacttgtagttctttcctgtactgcaactgttaccttgtttctactctttaccacctacagattattttctaaccagccaaagtgatgctcttaaaatattaagttggattatattactatcctgtttcaagatgcctggtgactacctaccacaattagaatacagtccacactcatgccatagcctctagtacgctcatgatctggtctctggctgcattgccaacatcatctcctgtcactctctccctttcttttttacagccatgctggatccttgcagttcttggaacacacacaacaagctgaacccatcttggggactttgcacctaccagtccctccacatggaacccactttctagagatctgcacagcttttcccttcacttaatcagttatctactcaaatcttaactccacaaaaagagctttctttacttactttctctaaaatagcaccatcatcattcactagcctcctatgctttgttctcctttgtattccttcagaacatttacttctacacagtatatattgattctctcacctattcacatgtaagttccacgagacctggacctttgtggtattcactagggtatccccagcacctaaaactgttcctggcacatagtaagcacttggcagttgttgaatagagtgaacagaatgaggcacagagaccaaagacgttttcagatacatgaaatacaaataattctgcccaattaggacctggattaagtttatctcactgcaagtgcaagagaaactgtaaaaggatcaatcatctgctttggtagaagagaagaaaatattaaagttgacttgggtttgagccagacagaaaggaaatcatcatctgagacaaggaagtcaagatgagctatttatttggggtggggtgtgggtgactggggagatgagatggtaagttttctcttagatgtattgattttacaatcatagagtattttagaatttttcatactcagtaggaaagggcaatgactagactaagaaacagcattaaaataaatgctctttatcaagagcagttgaaaagccagtttcagtaaggtttgttgtaaactgctttctgatttttagaccaatgctatccaatatgatagtaagtatcctttctttttgctcttttaaatatggttactgaaaaactttaaattgtacatgtggctcacattcatgtttcagttaaagagcactgatgcagactatctagatcatgaaaatattgactaaatttggcattagagctcagtactcattctgctgttgtttttgttttttttttcccctgagatggagtcttgctgtgtcacccaggctgaagtgcagttgtgcaatctcagcccactgtatcactgcaacctccacctcctgggttgaagtgattctccagcctcagcctcccaagtagctgggactacaagtgcatgtcactgcctggttaattttcgtatttttagtagagacgaggtttcaccatgttggccaggctggtcttgaa

SEQ ID NO: 40788 - DNA, 1114 bp, Homo sapiens
cctggatctcatgcacaaatatgctgtgttcttcatccaccttagggcctgggctgtgttatttcaccacttatggaaatgaaaatgtaccaaaccaactattactgctgcacagtggcctgtctttgggaaggagaaagttttttgaatatgaggaatacaatgtttggtcacagaaccaagcaaaaccaaatgtgctggcgcagcagtgttaattctgactaatcaaacaaataaggcataaactagaggaggaatacagaaagcaatagcatgtaatttcaggttgaatggatttttaacaccaaactctgattgtcaggtgtattctattcttttttttttaatgttgggcatatttttagtataaatttgagaagagattacaaaatgttaaaaaataagtgtttttcacaggctatcgagactcatttgatccgcaagtctagcagcggactaacttatatcgcagagtggaaagggggcctcctggagcacaagatgggccacctgacctgcttcgcggggggcatgttcgcactcggggctgatgcagctcccgaaggcatggcccaacactaccttgaactcggggctgaaattgcccgtacttgtcatgaatcatataatcgaacatgtgagtacatgttattcttcatttatggtctattcccacatgctttgatttaatgcagttttgtcattgctgccctcaaaagactatccgctctgcctatgaagcttgatgatcgtgattaatgtctcaaaggaatgtatattttattttaaaaggcaatgcttttcttcctaaaaatatctacctttagtttaccaagaaacaaaaatccaggccataaagagttaaagccagcctaatttactgacttctgcttttgccaataacattgggcaagggtctctatctccctgcaaagagaaacttagcattttattaaccattattaatcttctccacatcccccatgaaacagatcatgaatcccactcccttcttataaaataggaatttgaaacacaaagtgtaaataactggccttctgttacgaaattacttaggattgtcaaccactaagtttctggctaactcaaatgg

SEQ ID NO: 40789 - DNA, 1084 bp, Homo sapiens
catgaaatcttgtctagtgcagtctttctttcaaaggtagctatccctctggtttctctcagctattttggtgatccccagtgtctcccttatagcatgtcttatttagtggtcatccagggatttcagcagagattatacccagtgttttggtcccacctcttctatggcttacttgtttccaggattccaccctgatctttcagctaccctgccagcctttaactctgtcctgtgccatcttaaaatataactgcaattttttaaaatcagatttttttaaaaagcctttaactcaaattcttactaattgctgttggtgtctttcaatggttaatgctctgttagtttgtgcctgctttttggtcactttctaatgcctttaaatagttgagttttataatatatatatataatgcccagattttataattgctattactggagtatttggtaaccaattttcttcaccattactagaggccagaagtccctccatttttaaaatatcctcaataattttctgtcattaagcattctctgacctttagtagctgcataatatcagatctcctaaataggccataatttttaacctgtctcccgtttttagatatccaaactcttttcagttttataatagtataattagtactataatgtataaaccatttttacttgggaatataagttttattggggataaaattataatttttagggcaaatttctagaaatgaattcagttagtaagtatgaatattaatacatttgatacatttttccaaacatccctgcagaatagttgtgccagttttcagtgccacctatgaaatgtaaggttacttttttttaagtcaaataactttaaacttatgagatttggtggtgtttggtttctgctaaaagaattatttgatttgttttataagcaaaaaaattattcctgattgttttataaactgcataggctatgcttacattaagaaaaatatcacttgtaatatggttatataaccaaaatagtagaatgagtaggagctttagtttatttagtttaattattagacttatttcagtaaat

SEQ ID NO: 40790 - DNA, 1051 bp, Homo sapiens
tctgagtttctgagtctagtgagcaagaaagtgataatttcatatttatgtttgataaagaagtttcaaaaaatggaatttgtggtgtaagcataagcactatatagaataatccttaagaattataaatttgcttttcaagtttttctaaagaagggaaaataggtcccttttcaaactgaagacgttacaaaatacattattgtgttgattctaaaggaaaacagagtaaaagagaagaggcaggagtcaggaaaattatgaatttagaagctataggcagccagataagctaatattagtgccttatgcttctgtaattttctatagcctacaaggatttccaaatatacacacacacacacacacacacacacacacacacacacatatatatgtgtatatatgaaatctcattaatttgatttaatctaatctggtacaagcatgaatatccaattttataatttgaatttccttttgaaatagtttggaactattggaaccgaaagaaataattttatgcttttaaacttcccaatactcagggcaaaggcagggaagataaaattatcttagtattttattggcattgtaggctatcactcattggcattgtaggctatcactctgtctatttgtagtatattgatcattaagtaattccaatgtttttcttttttttttttttttttttgagacagagtctcgctctgtcgtccaggctggagtgcagtggtgtaatcttggctcactgcaagctacacctcccaggttcactccattctcttgcctcagcctcccgagtagctgggactacaggtgcccaccaccacgcccggctaattttttgcattttttagtagagacgaggtttcactgtgttagccaggatggtctcgatctcctgacctcgtgatccgcctgcctcggcctcccaaagtgctggattacaggcgtaagccaccacgcccagcctccagtgttatttttaaaagttttccatgggtcaggttgaattctacgtacctaccagaactatatttcacca

SEQ ID NO: 40791 - DNA, 1093 bp, Homo sapiens
ttcatttttaagctatcagtgctcctgacctgttcaagctggagttgtattttcctctggcagaaaagagatgatggaaccaattggatgtgtggagagaatgtctcaatgtggtttatgtaggatagtggtggctccgtgctcaagcttttattattttttaaattatttgggatccaacctataggatcaaaactaaatttgctccctaaaattatatttattagtgaattatgtactaaaaactagaactgttcagccgattaggttttaaaaggatgcgaggcaatccagagttatgttcttatcctaagtcttacatgctagctagtgcctaattaatgtggtacaaacccagtctatgaaagtgtgtgtgtctgtctgtctgtctgttataaatagccacatagccctgtttcctagttcttggactgttctgctaagggtctgactgttctggttgctttgtatcagtgactctcaactttcccatgcctcagaataactgggattctaatatatatatacacacacatatacacacacacacacacacacacacatacatacacacacacacatacacaaacacacacacacacacacacacacatataattgctgccttcatctttcccttcccccagtctgtttcaattggtttggggataaaattctggcattttttaaaaacctcccaggacattctaatattcagctagggtcaagaatcattgttttaaatccagcatttatatgctgaggttagctttatttctcatctcagttgcatttgaaaacattgggtttaaaacgtttccctattcactgatggtcaatttaattattgaaattttaaaatcctagaaaattactttgaaaatacccagctttaatagaacagtgcttctcaaactttagaatatataacaattgccaggagagatcattaaaacataacattgctggatcataagcagagagcctgattctgtaggtatttactaagaattgataatttgcttttctaaccagattccagctgatggggaagctactgctgctgctgcttgcccaacgaccacactttgag

SEQ ID NO: 40792 - DNA, 1049 bp, Homo sapiens
ataatttaaaatgctcatctgtcagctgaaataaaactatatactctgtacccaaaggcaatttaaaggtatcagtgtataatatatgataaaggaggattatgcagaaataacaaaccacctgcctaatggtattaggtgtgtactggataggtttacatttgcttaaatagaatgaaaaaatgagtagcttacattttacattttttaaaagaaacaaaacctgtatacataggtattcagttgactttgtaaatttgcaaactattactactacataatatggtaattaattgctctttcatacctatagagtttaattgttcaaattcaggcatgtgacacaaaaagggaccatgtcctgaagcttgtgcccttcaccgtaagatagaggaaggacatttgacttatcagatccttgtgcaggtaactgtttacaaaatgagtcagcaactcagaaggagaatgaatacaacagtgagaagtctcattgtaatgaactgatagctagtaactcaaagaagcagtaggactatagaaagcagacatgaaagctcagcagcttttggaccatttagtgtgtggacaaaaggcctagtatccttctattattcctgaggaaaccactatcttatagccaagaataataactattgttgctcttttaaaaaacacttgttcctttaattataaccatcttgtgatttgggaagattattctctattcacttatttagaaactgaggcacagaaaggaggttaagtgagcgttcaagatcgtacagactgttcaagtgataatggaaaactccatcacctagtcccagctctgtatgcatatgatggtgatgctgagtaaaggcaggatcattctacatttcaccgaatcataaaaaaaagataaacatgtctttaaaacttatataaattattaaactataaatattttgatgctcttcagagatgaggttcagttaacaggaaaaaaattcactagtgtagaatgcttcataactaaaatatgtcagggaattatgatatgcagtcat

SEQ ID NO: 40793 - DNA, 1031 bp, Homo sapiens
tttatttaaaatttttattaaactttattaaaatgttcaagtttcctgaagtgtttagacatcaagaaatatttacatacatctctagtttatatttccatcctgttgatttccctattaagaattttaatgaggccaggctcagtggctcatgcctatgatcccagaacttttggaggccaaggcaggaagatcacttgggctcaggagtttgagaccagcctgggtaacaaaacaagaccatgtctcaaaaaaaattaaaaattagctgggtgtattggtgcatgcctgtagtcccagctacttgagaggctgaggtaggaggatcactggagcctaggctttcaaggctacagtgagctatgattgtgtcactgcactttagcctgggtgacagagtgagaccttgtcttaaaaaaaaaaaaaaaatttaaaaaaggcacttaaaagaagtccaaaatgtatctcaggaaagttgtacaaaatgtatctcaggaaagttgtacataaaataagacaggcctcattttacagatgtttctcaattatgttattccaaatctacagtattggcatagctttcactgttgaaaggtgttttcatttcttaaaaatgtttttaacctcctatcaccagtcctatgctaaaacagggtattttacccataaactaccacaaatagataaaaatagctactttacatataaatggccctttaaaactggatactattgtatgccaatttgcaacatagtctgtatgaaaagagaaaacagtaataaatgctgtgttatggaccaataattagattctcaatgtggtgtaaagtactcacacaaggttcattcttggcctcataaatttgaccatatcttttcattctaatgctcttaaatgacttagagacatgacttaacagtaaaataagctcctaaacaacaaccgcaagcacataaaaaacaaaattatgcagtgatggcatgccatttgttcaggaattggctgtcctatttactcttaaatataacag

SEQ ID NO: 40794 - DNA, 1042 bp, Homo sapiens
tgcagttggtgccgcagaaacaacagtgaataagagaaacacagtccccattgacaaatgttaattcaaatattaatttcacaacaaccctataaagtaggagtaggaactgtttttattctcattttatggaggaagaaacagaggcacagagtgttatttgcccaaggacatgcaaagtagcagagctaggcttcaaacttgggcattctggctcccagctactgagtagcagctagacattagagatctcaagcacagaagataagatattgataggcctgaacccatgagtcatcaacaactaaatgataattgaaagaatggacaggagtaagattgtccagggcattatacactgagaaaataggccttaatatttaagtgttgttgagaagaaagagctagaaaaggagactcagaagtcgtggtctgggaagtaggagggaaactagtagaatgtgacatcacagagtccaagagaaaatactattttgaaaacagatgttcagttctgtcaagtgctgctgctagaagttgtatatggactctctttagcatcttacaacatggaggtcatggatgactttatggagggtacttcagtagagtaataggatagaatccaaattgtttttgattgaagaagagaaggtggtaaggaaataaagattagttcaaggtctttaagcagttaggggaaggtggcattcacgaagacagatggcctttggggaggcatcctttgcaatatgagaaagcggaggagaaggtaggaatacaagtaggtaacttattagacttggtggcaaataaatgagatagttattctctggtggatcctgttaaatacaagacaaggatttctgctgagactcaggggaagaggagagatgtttgatgtgaacgtgtacattttaaaattgtcattctaaagggttgagtacagaaacatggtagaggttctggacagtgtctaggctggtagccatgaatttatggtagcctcaatccttataaacgtatgatgctttttccaaca

SEQ ID NO: 40795 - DNA, 1414 bp, Homo sapiens
aaccaccactggtccatgtggccttaaaagttgagtcgttttgatttggcctacaaagcctttgtaattcagcctcagcctaccttttctggtttccttcataacagtcctcatggaccttccactgtataacagaccctttttcttccaaaaaacgcaccaagcccatctgtgtgcttcttaaatctgcattccttctacctagaatgtctttcaccctgctccttccacccaccaagatagatacagcccctccgaggccttccctggctgcacaacactaagacaccccctccccaccttcacttccttttctgcattctctgcatacgatattattatagttcattgtttatggctctgtgagccctctcacctactcactcccttttccccagtaggatttgtacaactcaaaaatgacgtttctgctgttttcatatcctcatgcttaacactgtatgcctggcactagaaaacatttagtaaatgtttagtcatttagtcattgactaaaactcttcaacaggttttctgagacctttactttttaaaactgcaacagaaaattcttccagtgacttttaaagtaaaatctgtacatggataatataaataagcaactagcctggaaggcttggggtaggagatgagaaggagaaaatgtaatgtagtaaggtgatggacaatatgcatgatctctaaccacaaatagcctctgtggctccaccttcaacccccaccccagctagcaaaacatcatcctttttatctgttctgtacatcctgattctctgaaaaagaaagttttgaaaatcagctggagactatttgtagattatatcattactaaatacagtaggtcatttattgtagacctttaaaatagatttaacatagagcattctgaaattataaacctaagaagaaattataagaagtaaatgtgaaagtgattctacaaggtacatatatggtccttaatttgaggaaactaactaaaacttaatgacacatttatgccaatttcctagaaaggaacaattttaattatatttatcaggtgatactgattgttatattaatgtaattatataattatgtaattgttgtatattaatatgtttggccctttgatttcttagaggtttagatttagccttacatatattttaaatgttaatttactatttggcattattgaaatttttataagaaaggaatgtaaaatactgaatagctaatattttcatttaaaagtttaattcagtaaaacagagaattgtaattttgcttattatgtttataattaaatttccatggttaatgagttatagctgttacacattgactattccattatgattggtaaatttaatttgtactttaaaaggaatataggagtgtacagagt

SEQ ID NO: 40796 - DNA, 1050 bp, Homo sapiens
gacccatattcttagcatgttttttcttatagtttccagaatgttgaacagttagattattttcagtatctttttattttgaataatattgctataatcaatgaatatttattctctgaagtggtgttggcaagtgagaagtgattaatactggattgttttaacatcatcacttgcctatttctcccagttacttagaccctgacaattgattttcatttgatgaatgcattcaggggaattggccattaggaatgtgatccggaaaattttttaccccaggtctgttcttgagctatttgtattcatatcaaaatttttttaaatgagcattcatttaatagaacaccaacatagcaaattatgaataagttggttttaaatagttgataaagttttataccacacactttttacatagatcagacaatttactaaggtgtctaggacaatttgtctttctatgtatctcatagagggacttttaaaccaccataatttaacattctgatttcatcactgaggctcaggagtattttaagaacaaatcaccatcagaagtagatagaccccacattgatatcagctcaagattgttaaatttgtatgcaaaagcaggagaagaagtactactgatttgtgatatgtgtttcaggaaagttacagttagaaacactggacaatagttaagaatcccagcagaagtctaagctaccaaaaaaataatagaaacatgaagtacctgtagtaaactttgattacaggcacatattcaaaaatttgaaacctcgtagctcagttaaaatattttgtagcaccataaaaaagtcaagcatcagtattttcaaatgctatataagaagctcaaccacaagaattacaaacagataggatggggataagatgaatattaaataggaagaatcagtattaaaaataaatttaaaaggtagcactgctctattataagctggaagggagctaaaattctcactggagatagtaaatatagcagcatctagaatatgattacccaaaatatgttctaaa

SEQ ID NO: 40797 - DNA, 1001 bp, Homo sapiens
tttttaaaactggctttatcagtcattctgactctttttctaaagaaattgctattgctaaccacgctttcatttcactggggaattaatgctcagtggcacattagaattcatgcaatagcattaaataattactgtttctttatatatctcctgccaacttagaagtacattaaaattggctgtaggagaattcaggacacctcaatctgaagaaaatccccatccatatatatatattctccactcagtagataagaggcaacctcgagtacctggcaacaaacgaattgcacacatagcaacaagaagtcgagtaatacagaaagaggaaagagaagctggtccacattagctcccgtggtggtagtaaacttcagaaaatatcagagctgtagacagcagcttggcatgaggagaggaattcatggttttccataaatctagtgacaggccaggtcgaataggacaacaccatcttgtctgccccagtagcatacagggcaggaggagaaaagttaggtacagagctggagctgagagccgaagtggaggaggaggaaggctgtgagaattgaaggatgtagggcaggcaaggaaaggtggtgctgtgagggtcttcagttgagccagctcccagtcctgattcggcatgtgtcattttggtgccaggcctggccacagcttctcagaccccagatagagctgccttctgtgcatggaggagcaggagggctcagaggcctcagatgactgtctgaggtttgcaagcagcaaaaaagtgagggctctgttcagtgtatagtggagaaaatcagcgtgagagagtttccagccttgctcttctctacactaccttgggcctcagcttcatatgtaaaacagggataataataccccagagagggtgttgtaaggattggatgtgttaaattatatcaaattcccctcacagtgcagtgtggtagctgtttgacaaagttaattcacttcctccttta

SEQ ID NO: 40798 - DNA, 1052 bp, Homo sapiens
ttagaaaatatatttattcaggtggaagtgagtcatcataaatgtcttcattccttgtcttcgtgttgagtaggctgaggaggaggaagaggagaggtgttcatgctgtctcaggcagaggtggaagaaaatccaagtataaacagactcccacagttcaaacccatgttgttcaagggtcagctgtacttggatttggaaacttgctgttactgtgtatgttgaaacacagtgagagttaagataactatgcattacagttgcttatgtggaatttacctatattgtagtagtggtaaattttgcaagtccccaaatgtttttgccactgttatttttatttctgaatattatataaggcttatgtgtttgctctcttcactccgtctcatcccgtaggtatattgaataatttagaatttagggtattcttcaactacttttttctccaccacctctcctatcaattttagctatttgatttgtccatacaagattctgtaggactatctgagactctgttcattcttgtggttacagaatttgtccttttgatgataggtcacttaatcatcaacacttgcatgaccacagggtgcagaagctgttgagactgacatcctggatcatgtaggaaagaacctgggcacattcccataccttccactctgttaacctacttggagaaactgaaaatcacaagacacaaacaaaaataacctgcagttgttcatcattaagattaagcagaacactgatatgttgggcatcaactaagtgctaaaaatacttgataattgattacatgatacaattgctaagtattggttaaaaaaaatatgagattgtgatcatattagaaatacatttgtctcatggtatttaacaaatttgtggcttacatcaatatggcaaaaggaaggtgttaattgcagcgaggatgataaccactgcatcatttttgggtcattgtattacaactttgaatctataggcataaagggaaacacactgactccttatttaaaaggaagaaacaaaacctttttgat

SEQ ID NO: 40799 - DNA, 1023 bp, Homo sapiens
tgagttaatttttgtataaagtataaggaaggggtccagtttcagttttctgcatatggctagccagttttcccagcaccatttattaaatagggaatcctttccccactgcttgtttttgtcaggtttgttaaagaacagatggttgtagatgtgtggtgttatttctgaggcctctgttctgttcaattggtctatatatctgttttggtaccactaccatgttgttttggttactgtagccttgtagtatagtttgaagtcaggtagcgtgatgcctccagctttgttcttttggcttaggattgtcttggcaatgtgggatcttttttggttccgtatgaactttaaagtagttttttccagttctatgaagaaagtcattggtagcttgatgggaatagcattgaatctataaattactttgggcagtatggccattttcatgatattgattcttcctatccatgagcatggaatgtttttccatttgtttgtgtcctctcttatttccttgatcagtggtttgtagttctacttgcagaggtccttcacatcccttgtaaattgtattcctaggtattttattttctttgtagcaattgtgaatggaagttcactcatgatttggctctctgtttgtctgttattggtgtataggaatgcttgtgatttttgcatgttgattttgtatcctgagactttgctgaagttgcttatcagcttaaggagattttgggctgagatggtggggttttctaaatgtacagtatcaccattgatcccacagaaatacaaagtaccatcagagaatattataaacacctctacacaaataaactagaaaatctagaagaaatggataaattcctggacacatacaccctcccaagactaaaccaggaagaaattgaatccctgaatagatcaataataagttcaaaaattatggcagtaattaataccctaccaaccaaaaaaagtccagaaccagaccaattcacagccgaattctacccagag

SEQ ID NO: 40800 - DNA, 1074 bp, Homo sapiens
gtagagttagcatatactactgataacagatcatctttcctgtaagggtgatatgatttcttcttttgctgaagaaaccatcattcaaatatgtgttatttattcaagttagacatatctttctagccttattaccattaactgcccaaacacattctgcgcatttgcctcactaaatttttgctcctgttgttccttctagatggatgcttccctctccatgacatccacatgataatgcccgactcacctgtaaagtttcagctagaatgtaacctctcttattcctaagcaggattctctcttctctgctcctactgcattcactttaaactaccattttgatagttttattatattgtatatggctaaattgttacattaggtgtcaaactcctttgtatcttcaatatgagatttaattatatatatatacacatactatattcacatctatattcaaagaaacgtattatagttctgtaacaattctaaatatctaacaattcacataattagatacatgtgaatatacagatgaccctatatttatttacacataatgatatctaatgcaaacctgggaaaggggtaaaagagacttaagagaattaaaacaaagaaatgagaagaaaatacaagatactattaaacgaaagttaaggtaggtgaaaggaattgatatctattgatcacctcttttaaattaggtattatgttgaggcacttgatataccttgtgtcattcaaccctataactgttctctgaactagacataatcatcatatttaaaatgaggaaattgaggcatagaggaaagaaaacataaattgggaagagattttaaaggaaagcatttgtgaagaaaattatgaacttatgaatgaacataaaaatttatgtgaaaaacatacagctattaatggttaagttgggaagtaataggaaatgagtaagaagtgtgatagtcatggaaatttgcatgaccaaagtgggcatttctttagacttaagcataataatctccaattcgtatagctctctttttcacattgctttattggaccatattt

SEQ ID NO: 40801 - DNA, 1035 bp, Homo sapiens
tcagatgaagctaatatgaggcttagtgaaatgtggcgtgaacagcatcacattctgtttaaagttctgaattttaaattgccaagatcttacaaatcttacattgtaaatgactaatactcaagaagggtgctcctttgattagcctccctccttcacccctacgccttttctccctcttccaacttatccttttatgctagatcattcctattagtgtgaagacatgccttcatatgtcccatcttacaatgaaatacaacaaaccacccaaagaaatatccttgaccttgtgtctccttgcagccactgatctatatagcaaaatatgtctatacaaactgtcctcagttgctcacccgtatttactcaactcactttgatttgacattgactttataattttgtcagaactattcatcctgctcatcgctagatcacttgtaacttccatgctaatgaatctagtgaattcttctcttttctcatcttactataactgtcagtagcatttgatataggggaccatttttttttttttcctgtgtgaaaaattctcttcatttctgtgtatcacacactcttattgctgcggtttctttttctttctttcttttttttttttttcattctctagtcaacctctgaatgttggaatactcaggatttagtcctggacccaggaccaaggatcctaggtttctgtgcactctactcttaatttattacacttaaacatttgcctttaaatatcatttatatgctagtagatgcccccatttatatctctagcccagacctctcttttcagctaccaaacctatatatacacctgccttctgacatctcaatttatacatttctcacttaaacatgttgaaaattgaactcttgggtctcccaaacctccttctacaaaaacaaacaaaatacatctttcatttctgtctcattaagtgacccaaccgtctctttaattgcttaattttgaaagtcatcataacttttttctgtttttttaaacaatagttgatc

SEQ ID NO: 40802 - DNA, 1035 bp, Homo sapiens
ccagggttggaaaccactgatttacatgaggcagatagtctctattgagaaaatctagttactagttacaacattttgatccgttgttcattcttctaatttgtggattttatatttgtttttcaaagtagtttacatttttggcaattttatcagtatttaactgatggtataaggtgctcactagtgccagagtagggtcaaaatcagtgttttccactttggctgaatactggattcacttcggaaacttttacagtcctaatgtaaatctaggccacactcagaccagttaattcagaaactttgagggttaggacccaggcattatactattattcttcttcttcttcttcttcttattatttacagctccccaggtgatttccttgtaaaggcaaatttgagagccacaaatctaaataaattgttgttgacttaattttctttaaatgatatcagttaaatacagtctcattttgtctgtctttttcaggatattattgatagacttataattttgaattctgaagctaagattcgttctttattcaactatgaacaatcacatatctttggtctaaggtaaaatgctacattttacttttgatattatattttatgttccacaaaaaataagcatttgtcctgtatactttaaaaaagtatttaaaattagctaatatttaaaagcatgcttaaaggtaatttgtcttcctgtaacattataaacaaagtaaattaaggcaattagatatgtgtaccatggcctttgtctgaatttggattctatattattatagtgtctcccattccctaatttaatagaggcattttagggactatttcatttagtgtactcaggagtcaacttgaccttccctgggttggtatttggttagattcttgtcacaatataccctcaaaagaggcctagaaaaggatgatttatcctgaggcccaagttttgctctttggtgttaatcattacttttcaactttactttgcctgaagtttaaatctttctagttgag

SEQ ID NO: 40803 - DNA, 1028 bp, Homo sapiens
catcttacatggctgctggagagagagagagtgaaggggaactgccaaacacatttaaaccatgagatctcaggagaactcactatcatgggaacagcatgggggaactgcacccatgatccaatcagctcccaccaggtccttcctttggcatgtagggattacaatttgagatgagatttgggtagggacaaagagctaaaccatatcagaactctaccactgggtaaccaaatagtaggtgaagatagtgcctctttttcatgaattatcccaactaataatttttttaaaatgatggaagtagaacgtcatcatttgcagtctgcgagaattaattgagtcaccttaacatcattaaaacagaaatggctaaacattattaatgtgccctctaatgaaagaataaaccaccacctctagtcttaccaaggtatctaatttgatcaagcctttagattcagctgccagtttgcagaatatggaaactgcatatatccaaaggatggaagaacaggctgaactgctccctgactgtgcacttcctgaaatccagactggtggaaactttacaggtcaaatggcctgagcttgtcaacagatgaaatgaaaagaagggagagggagaagatgaatgcctgtagattaaaagaaactttaaatgacatatcaagtcttgaaaatgggaaagacaaaattatagtgtctagatatgtacacctgagaaataaaaccacaagaaaacctttgaaaatgattattgtaaaggtcaggatactgggtgttatggagggagggcaggcgaggtaattgtaggcacagagaaggctctctggggcaggtggcagagttctagaagaagttcactttaaagataaagataagttggatggaaaaaatatgtacaaagaagcaataaacattagaaaactgacacagccacatttagtgtcagagataaagtaaaggaaaaactatcagattaagagacacattttataatgataatatgaatatggtcaatacgc

SEQ ID NO: 40804 - DNA, 1037 bp, Homo sapiens
tttaatctcagatctcacccttggtaaaatcattaagcttctgagcatcagagtctcaaacttttcatgagaggggtaagtgtagttttcaaaggacagaaggaggaagactacagtttcttgagcttctccgatgtcgtaggtactatattaggaacttcacatgtattgtcctgttgatacttcatggcaaccttggattatggcatcattatttcaattttcaaatgggggaactaaggctccaagaagtcacaggatttttgcaaggatgaacagctaataaactggcatatttggaatttaaactctaatattcttgattttagagcccatatttttttctctcataccagaagaccctttctgatcgaatattgttgttatgaacttacttattttaggattcaatgttgtgtttgacacttttccacatgatttttctacttgattttttaatagactaatttgagaatcaggttttatattcattttcgtttagttgtatagtatgactcgtaagaatttaaagactgggttgaagcaaaagttgtatgaaatgcagaattcttcttagtgtatggaattacaaaaaaaaattagttatattggaataagggagcatacactctttggatgcctacctggcctcctgttacctctttctctcctcccctcacctctgaaaaacacagtctgatttcagactgccttactttgctggctgatttgcaaagcaaagtataaactttattatgtttcagaaaacatgctcagagaagttataggccaaagtgaagaagctgggactcaaaattcagcagtcttccagggaaattgtctctcagaatttagttattacagagttttatgataatgaagtatcataaaagtatattaacaatagcagatataatttctaccaagaagagattattttttatataagatgcaagtatgtgtcttctgtcagagtagaccagattcatcagagggatcatcatatctttccttcataatccaaagaaatattatgc

SEQ ID NO: 40805 - DNA, 1046 bp, Homo sapiens
tgatattgtctgtaataactccagttttatttctaattgagcttatttggatctgcttttttcttggttaatcttgctaatggttatcagttttatcttttcagaaaactagctttttccttcatttatcttttgtatttttttctttcaatttcatttaattctcctctgatcttggttatatcttttcttctgctgggtttgggtttagtttgttcttgtctctctaattccttgaggtgtgacattaggttgtctatttgtgctctttcagactttttgatgtaggcatttaatgctatgaactttccttttaacactgcttttgttgtatcccaggcgttttgacaagttgtgtcactattatcatttatttcaaatgattttttaatatctatgttgattttgttaaactataaatcattcaagaaaagattgtttaatttccatgtatttgtatagttttgagggttccttttggagttgatttccaattttattccactgcagtctgagagagtacttggtataattttgattttcttaaatttgctgagacttgttttgtggcttatcgtgtggtctatcttggggaatgttccatatgctgatgaatagaatgcatattctgcagttgttgggtagaatgttttgtaaatatctgttaagtccatttgttgtagagtatagtttaagtccattttttctttgttgactttctgtcttgatgacctgtctagtgctgtcagtggagtattaaagtctcccaatattcctgtgttgttgtcaatctcatttcttaggtctagtagtaatggttttataaatgtgggagctccagtgttaggtgcatataaatttaagattttaatatcttcctgttgtactaatccattattgtataatgtccttctttgtctttttttttttttttttttttttgctttaaagcctgttttatctgatataagaatagctacttctacttggttttggtttctatttgtgtggaatgtcttttttcacccctttacctcaagtttatg

SEQ ID NO: 40806 - DNA, 1038 bp, Homo sapiens
aagagaaaaagataaaagtataaagttaaagaggttaaataagaaacctaaatcttcataatagaaataaaattatgaacttatttttctcttgttatatttttcccagcactatcactggaatggtagcaactactttactgtgagctgttatctgtattgtctaaacatctttttgttctaagaagagacaggagtggctgattctgggtctgggccaggaagtatggaggatgatcctggggtatcttaccattttagaagctatctaagaccaatgggatagtgtcaaaagtaccccagagccaaccagaaggggcctcctactggcttaagatggacaatttgagaatcagaaaaataatgactgcaatggattgacatacataaagtatataaaaaaaaacatgggtttgaaaaggcactaaaacagaaaacaaacaaaaaatacactttatcggttacctgctgaagtcactaggacaccaacttgttagtatgcaaattgataaaaagaaaatttaagcatttttttccagccttttctttacaaactgtattttagtgtaactaaaatgttactgaggaaaagttcttcacagaagaattctagctaataaatgcaaactaaatgctataatcagaaaaatcgtaatttggtaatccttagtgaaatagtggatgtaggcaatgatcattaatggatgctaaaatcattaggtgaaaggttgatggggaggactacgtactagagaggtcagtgtgataccatctgaccagtgatctttagcaccactaaaattgggacatccagatagtgcttcatgcagtaggaggtagacagcggcaaccaactatgaagttattttaccaaggaaaaaaaaaggaaacgaaacaaaagaagttaaactttaaataattctctagatctgatgatcactttataggatatatggagaactagagaaaaaagttaaatgacaccatggtaaagtagttatccaaataaacatgactgtttttccaacaaatcagtgg

SEQ ID NO: 40807 - DNA, 1033 bp, Homo sapiens
taggtttttttccttattgggtacatggcctttctcctctcattcagagtatgtcctttcaattttcctaatttattttatgctattagtcttcaaatcttaatcagaatttcttgagttcaacaactgttttctggcctctactaaaatcttcaaagctctacaatgctctttttggtgaagaattctgcttgtaaggattttatactactgctgagaaatggcaagacacttatctctttttttggcaacatcactcagagcagtaggattagctacatcccagcctgtacttcagaagttcctccatgtctggctaccctcacttgataagattttaattattatttgttttgtaagcacaaaaagatggagtcataaaatcttaaaaatctctgcagaatttcacttctgtagaagtgaaagggaaagatagctaggatttttaaaagatgaacatagtagcattgattctgcagctgcctagagttaggcctgggacaggtggattatttggaagaggaatgtgtaggggcagatgtgaacttatttttgcttgctggcttgtttgtttggtaaaagtacaaaaatcagccaggtatagtggcgcgtgcctgtagtttcagctactcgggaggctgaggcagaagaatcacttgaactcgggtggtggaggttgcagtgagccaagattgcaccactgcactccaacactccaacctgggcgacagagtgagatgccgtctcaaaaaaaaaaaaaaaaaaattaaggccaggcatggtagttcatccctgtaatcccagcactttgggagagcaaggcaggaggattgcttgagaccagtctgggcaacatagagacaaggtctctacacacacacacacacacacacacacacacacacacacacacacacacacacacacacacacaccaccttagcttggcatggcattgtgtgcctgtattcccagtgatggggagctgaggcaggaggactgctttgttacgggaaaagtggtcttgacccag

SEQ ID NO: 40808 - DNA, 1034 bp, Homo sapiens
taataaatacgtgtatatatgtatatatacacacacactatacatgtatttattatcattttggatatatatgtgtatatatatatatacacataaacatatgtttatttcttgctatagtcatatgaaataggttagctagattgtattttttaatctcattttatagttgaggaaattgaaacttatttatgatgacagagctggctggtaaaatagtcaggatccccattcaagttttctaatttcaaattttataatttattcactatttttacttacatctttatgccttttttgttttaaatatagaaatttcagtggttcaggtcacatatgcctcatttgtaaaataaagagctagactatatttatggttctttctagctctaaaattctattcttagttcttttgaggatttcagtctcatattcatatggatgcttgagagtttgaacttacaaagtagagaaatttgataccagttctttttgagatttttagaccttccgaaagagattttaaatattatccaattcacactcctaatgatttcaggaatctttttcctaacatcctgagagtggatttcccagcctctgtttgaaaggacacgttgatagcttaactcttacataggtcttgggagtatacaagagctctcagttgtggctatgggtgtatataaagtatgggcaagggagaagagaaggaaagaaaataaaggataggggggtggagaaagagataggtataaggtaagaggatgaaggtgatgtataaaatagcctgggttttggtagtataatattaatagttgactttgttgctagcaattggaatccatgccattgaaacctcttgccttaggttcttttaattttactaccttgatccatgtaaccatgaaaaaacctaggaaataacatactttttgaattctctattaatttttattgctgttttgtgaattctgttctaccacttcttctttaagaaaaattgagttcgatttttctccttagcattgtgt

SEQ ID NO: 40809 - DNA, 1051 bp, Homo sapiens
cctcacattttcaaatttcaactgcgtttataaaattttcatttttccattctctatttgtgtcttcttgctcgatcttaccaaaatattttgttttagtgctttttcaataaacaagttctggcttattttacttggtttttgtccactcattttgtttttattcctttcttaaaaaggcacttaagaatagatttcccctctagatatcacttaaactgcatctcataaatctgggcatgtacttttctttttttttaatcattaacatcagtatttccaacattttttgtttggccccaaagtttagcagttcttttccaatttccagaaatgttaaagaagctcaaaatggttcttctggtttctagcttatttgcattgtggttagtctgtttgataccaattcttagaagtttgttgacttactttatgacctactatgctatattgattctcgaaaaatacttcatgtgtgcttgaaatgaaggtttaggctctaagtcttgaacgtgaccttttatatacgttaagtcatagtgaatgtcattttggtatttttccagtcgcagaccattcttctcacatctgaagctctagattcctgattatgccatctgtaatcaaacacatactgacacaacctaaaagaacatttagctgtctgtaattcgcaagcttttatggtcctagttctatctccctaagacaaaaaaaaaaaaaaagctggaagtgggataatgaggggtaccccctacactgtcttcacactgtggtactagtttcccagatagtacaggcagacttcctctggtacacacaagctagattgttttttaaagaaaccacatctttcattcctatgtgtgttctttcctaaaactgatctggctgaaacggtgcctcaggcctcaggacaaggcatccttttttttttttttttttgagacagagtctggctctgtcacccaggctggagtgcagtggcgcgatctcagctcactgcaagcaagctccgtctcccgggttcacgccattctcctgcctcagc

SEQ ID NO: 40810 - DNA, 1005 bp, Homo sapiens
tttccagcaattgtttctcaatttgcaggggtatagagagttaaaaataacttttgtttgctctgaaaaacatctttttaatatattctaacattttaatttggctttatattacagaaacaaattgcaacccaagtctactaagcataattggctacaatacaacaagcactgtcccaaaggaagggcagtcagtccagtggtggcatgctcaaggaattataggactaattctctttttgttgtgtgtattttattccaggtaggaaaaactatggaatttttttctttaaacaagaagtctagctgtttatttatgaatcatttcttttaaaaatgttcttttttttctctcctcctaaactctctttcatacagcatccgtacttcaaacaatagtcaggttaataaactgactctaacaagtgatgaatctacattaatagaagatggtggagctagaagtgatggatcactggaggatggggacgatgttcaccgagctgtagataatgaaagggatggtgtcacttacagttattccttctttcacttcatgcttttcctggcttcactttatatcatgatgacccttaccaactggtacaggtatttatatttcatgaaaactctggatgtgtgaattctgatggcattttatgattctcttgtgaaaccatgatgtgatatgaagtactttttatcctctgatatatttcaaaatgtacagctaaatgaatagtgagatcagcatgagaaatgcagtctttacttccttgctttaacagtaacacaaacattgaaatagttccaaatcttggagagattaaaataaaaattttcatgaaactaatactttttacaaaaatccatgttgatagtggatctaacattttttttttcaattctgtaaagatagtgaagtaaaggatacatccttttttctcttttgtttgaactgtcattaaaagctctgaaaatttttaaatttaagtatgaattcat

SEQ ID NO: 40811 - DNA, 1051 bp, Homo sapiens
ctttcttaactaagcttaatcatttctagcttttgatttaagtgagaaaggggactcttttacttgaacagttagaggccattgcagggttattaactggcctaatttccatatggttgtgtcttgaaataggcccaaggagagggatagagacaaggaaatggctggttggtggagcagtcagaacacacacaatgtttgtcgattatttcaccatcttatatgggtgtgatttgtggtgcccgaaagaaattacaatagtaacataataggtcactgatgagagatcaccataacagatgtaattaataataatgacaaattgtgaaatattacaagaattaccaaaatgtgaaacaaagtgagtacatactgttagaaaaaatggaaccaatagacttgtttaatgcagggttgccacaaaccttcaatttgtaaaaagaacagtatctgtaaaatgctaaaaaaaaaaaaaaaaaaaaataggcaaagcacagtaaaacaaggtatgtctatgtaagaaactgggtgaaattataagaaaggtatctgatttgcatagagcatataattgtcgtatatagaaagaaaaactcttcaaattcctgttgattcaattgtgaacagtataattttttcacattattaaattactcttttagcctgtgactaccttacaattgaatttgataattgggctttgtaatgcatcttattataggctagttatattgcataccatgagaatagaaacatatgttgaaaggagacaaattagaatagacaaaaattattacctattaaaaagaagaaaatgatctcttttcctaaaaaatttatctgatgttatatgaatctcattgagtttacaaactgtaggtattttatcataggtactttataacttggagaccaatttattttttgtttttttgttttgatgtattacacaaagatttcctgtttttttccaggtaggtggttagaaaaaaattattagtagtttgctttagagaaggaaatagccttacctaattggctttaaggtaag

SEQ ID NO: 40812 - DNA, 1006 bp, Homo sapiens
aaataatagctgtgataacctctgatccacagtgttttatattttcatactaaaaaagaggctctattatatttgtgactactaagggaatagctatttctccttctactgttaactttaggtggaccagtccacttacatagaactctcagttccctagacccagagagcagatttttctaggttggttgtattggacaacccagaaagaaacttcagggtttcttttatcaatcttccttcatatagagcactacttctggtacccttatttgactgttttaatatctgctgttgcttatctagttatatgtgctaccaaagacaaaaagtataaacaagtagaatataaatattaatgagaaaatatgtgacgggttgcttttcctttattttgttcctttggtcattgattattttattaaattattagagttttagatggaggcatttatcatgtgtttataaaaactattcatttatacagttcaccttatactttgatacattatcccacttatgtgaaataagcctgtgaaatggaactaacattctcatttttccataatgaattagtgagaaatacatctttctcaaaatggtcttaaaagcagtttatgtaattgttgttttttctgataatcaagtgtattagggttctctagagggacagaactaataggatagatagatatatataaaggggagtttattaagtattatctcacatgatctcaaggtcccacaataggccatctgcaagctgaggagcaaggagagccagtcctagtcccaaaactgaagaacttggagcctgatgttcaagggcagggagcatccagcacaggagaaagatgtaggctgggatgctaggccagtctagtcttttcactttttttttttgcctgctttatattctagccctgctggcagctgattagatggtgcccacccagattaagggtgtgtctgcctttcccagcccactgactgaaatgttaatctt

SEQ ID NO: 40813 - DNA, 1050 bp, Homo sapiens
tataaatatcccaataaaacttgttccgggcagcgggctgcaggaatacgttgcaaacgcaagagcaaaacaggatgcaaacgtgggaaaaatgggaaataagtggagttaggacggacaaagactgagaaagaggaagcaatcccctaaaaagcagagaggttcctcagatgaaggagggcaaaacgtcaaccaccacctcagctctgttctctactaatgcccaaatgcaagtgcatggtaggtaaaggtgggttttgctcacaccgttttcttaatttggcaaactacggtcagatccacattagccgttaagtttccagccagcagtccttgagaaattctccaggaaagaagacagccgtgtcgtctagtgacgcgcatgcgcagtctcagcgctgcgcgctccgtgttttatcctacccaggcctggaaggaagtgacgcgaggctgaggggcgggttgcgctgtgcgtccggaagtgtctcgcagatagtaaataatctcggaaaggcgagaaagaagctgtctccatcttgtctgtatccgctgctcttgtgacgttgtggagatggggagcgtcctggggctgtgctccatggcgagctgggtaaggtgctttttgcggcctctggggtgctagtgtgagagaccaaagagaaggcgatccgagccggggctgggtgagcccggcgggaatgtggtgccccacccaacagggagtgccctctctgtccccgttttcttcccgtctcctctcgtcactcagactcagcttcagagctttgggtcttgcgaagaactgatcactggccgtaaggtttagtggcgatgggaagatgactcaaattgaggaagagaactagaatagggcccctcccccacccctgcttcgtgaacgctgtctcccattctttgaggtcccttttcgtggttttgtttgtatctgcgcaggccatctctacaaaggtctttgcccctttccttcggtggggtacccactctgttgtcatctctttcctggcgacctcagactgccgcactgtcgtt

SEQ ID NO: 40814 - DNA, 1024 bp, Homo sapiens
ttttccaattttctttatgtttaaaacttttcataaaattgttgaaacaatttaaaattgttaaaatgttggaacaaaatcagaactatttgtgagaatgactaaaatgtaatcttatttaaagctcttgttgggtttgcttgaagatgttttagaaagcttctttgtgccccattcaattaaataagcatcaggggaaatttcaattccatattaatctctataatcttaaaatataattctaatgatattaatctaaaattatcaacaacccaattagtaatttacagataaactaaattattcatgaaaaggagagaaaagcacaaactaagtctaattgttttctacagaaattcagatttaatccagagtgaaaactagagaagatggtctctgggagaaatgtggcctgattggttctcatatgaggaataagctccaagtccctcaaaggcattatccattaacaaatatcttcttgctctctttggctctctataggaatttagacatgaaagagtggaatatattctgttttaaaaatattattgcaaattgttgcacctgtgcatctcttccagactactttgaaaagggactttccagctatcagtacactatctcacaattacccttgaaccagaagacaatgaatgatttgctaaacagatggcatagtctatgacatgcatcatatgtgtgagcaatcacagaaggtatgacttttctcatgaaatattttcagacaaatattttaagttaatctaacattcactaaatctacctactgattttaggtagattttctttctccaaatatacatttttaaataaaaattttcattgtattgcattgtattttattggttatcaacagcaccatgttcttagtttttttaaaaaaaatgtttaatgagttgtaatatttgtgtctttaagcaaggggttccctcatttttcctgtcttttctggcttgatttgaagttattcctgggtatcaatattctacacacattgtct

SEQ ID NO: 40815 - DNA, 1034 bp, Homo sapiens
tcccccaaattataatcgttctttgcatagaatttcatttgaatcgctgagttgggcttcctaatctctcataatacaaaaagaaacaaaacatgtaatgcaacttgccccccttttctttttaaggttttggtccaggccatataatgtatttatcaaaaagtaggtgcactaaaaatatggtctgcttgacatggatgcaaaatggttggaagagatgtagttactcatgactcattgggagatggcagaagataccaaaagtggcttcacaggagttcgttctgcatttacttgtttgttttggatgaaataggaagcatgctcagtgactgtacaggtgacatcagctgcagtgtcaagtaatacattgtaagggcgtaggcagaactaaattttataggattggaaaagtgtttcatggaaaaacaaactacagaatttggtgtaaagaaagacccatggatttggtacaagtgccacatggtacatgacagattgtgtgagaagatggcaggagtggacctttatagcagaaccttattttctcacaggacataaatatgactatgatttcttatcagcagtgttttcaaaaatcaaattgaaagcagggcatgtgaatggaaatgcagcacatagacctgcaagaaattccactcatctttaccgactcatgagtcattccctcagcagaaaacagtctaaggatccttaactaatgaacaatatagacattttggagaagacttagaacacaaaagtaaactgcagaaaataagctatataaaaaagggttatacatatctattatttagtctagtgggaaaaaaaaggacagagaaatttgtaattatttaggaagtgggaggtttgacacaaagcataattatcagctattctgcattgcctgtgtggacagaaaaagaggaattaggctttggccatgaaataggaagtatgtggcatgtgagtcttgttaaaccatgaacagtcatacaagcatagaatcactttcaggaggtcttcacaaa

SEQ ID NO: 40816 - DNA, 1033 bp, Homo sapiens
aacaccctcccccaacaaaagttaccactaccctgattttcacagacatcactagaatgtctttaaggtttaatcacttaactattcatttctagatattttagtttaatcatgctcactttttttaaagcttaatgtcttttaaatctcctttaatctacggtctgcccctccatttctttctttttcttataatttacctgttgaatccagaccatttgacctatagagtttcccatagtttcccagttgcacacttgtggtgcaggtcacgttcctctgttctcttattttatacagattggcagctagttccacaggctagatcacactcaggttggaaccttttggcaaaactatgggggcatattgggttcttttgtcatgcaccacataatgactagtttttcttcacgcttatatcccttaatactttggggcttcagaatggtaatattctaatattttatttttgtttttatttattagctgaaataattttgtgcttcactctcatctactctgattacagttcacataggaaaaggggggtaaatatgcttcttcgatagcagaaatggcagggcgttccagcttcatcttgaacatgttccaccctgacctcctgttttgttttttgtttgtttattttaaaatagaaaatggtattccaagaccacataatgagcattatggatggtcattgcacatataataccttgtgagttcatactgatgttttcaattcaaattcagtactacagagtttttacttaaccacttctctattgtggtgcgtatccttttttccacaacaggaatcctggctacgtagtacagagaagatgctagcattagaaagttctataaatactcatttgctttatccctctttacacatgaagcagtctcagaatgacagttgtatataccaccatcattaattctgattactgaaaacaattttaaaaatggttttgcctgtactatccgagttattgtatttttttgaatagttggactatatctacat

SEQ ID NO: 40817 - DNA, 1028 bp, Homo sapiens
tttatccacagatgtaaaatccttgaacacctctgatatttctgtaattgtctcatgacctcctcattgtccttttctatgtctgttgtgttgtagaccacaaaagaggtgctaagcgaagcccatatgaatgattacacttatttatttaaggtatacaactgcctgccttcctcacaagctataaatattgtccagtataggccaatttactctgctgcccctgtgagagttgtttgtaagaatccgaacctatttgtctgttgcagagtggttgttaactgtgataaatgtcaatataattaaagataatggtttaatatttcaggaagctatgaagcagataacccagctcctaccagaggacctcagaaaggagctctatgaactttgggaagtaagtatatatggtacgttactgtttttaatttgtatctgaatttatatggctccctgatgttgtacttgacttagatgatcttaacaagcggtccctaacttattactgtctggtttgtgtctgtttctcacttcccagctgctgcagaaatttctcctgatggatagaaattttgtatctctccaagttccccatttccctcgccaccccaactcctggcacttgactcagcccttgagttcttgctgctttgcccacacccacccatttttggtccttgaaaagaacatggacttggggatagttcagagctgggattgaatcccacctctccactttgaggttctgtgacctcggcacgtttccctcactgagtctgttgctcatctgtaagaccctggagggttgctagggttggatgaggtcaaggtgaagtgccacagagatgcctggcatggaacagggctctaccagtgctcactcccttcccagtgctgctcccttcccagtgctgctgacagtgaagggaggttaggctggaaggaaagggcaggttcagctgttgtttcccattgcttccctcttctactgttgtctttcatttgtgaagggaaaaaaaaattcccct

SEQ ID NO: 40818 - DNA, 1031 bp, Homo sapiens
aaaaatacagtggtccctcagtatctatggggtattggttccaggacccccatagataaccaaatctgcagatgctgaagataaaatggtgtcgtatttgtatatcacctgcacatacccttccatatactttgtcatctctgtattacttatgatacctaatataatgcaaatgctatgtaaatagttgataacactgtattgttttttatttgtatctttttttttaatttttttttttatctatggttggttgaatccgttaatgcaaaacccacagatatggaggaccaactatacttgataaacctggaaggctgattgttttggagaaaagtaggtattaagatgaaagggagaatgagggcatagaagaaacaaatttagaaaggagccaaaagcaatacttgtagtctggcctcattcctaaacatattaacatacacttgatattatgcaggttgataatgcaggttgataaatgatgtctgataaggatcactgtgatctagtgaggtggaacttgaagctggaatataatggtggcaggtcatattcctttgcaaaggggaaaccttattgaaacagagggcagagtcgtggtatgcctgtgtctgggagggttaaagttgctaaagaacttggagattacaaagagaatggaactttatcatagagtaagtatgacaagaaggagaaaatgaaaaacacagcaaacatttatagagtgcttattatgtggcagatttataaagtgcttattatgtgccaataataagcactttatatgtgtattaactgtttaatccctatgatccctttaggtaggtaccaatatttaaccccactgtgtagatgagaaacctgaaggacaaagaggtcaaatgacttgctcagggttccacagctagtattaataaatggcgagccgggtttgaaacccagtctggatctggtcttcagttgactactacactcttcagcctcatcagtgtctgaatgatgaataataccttccagttacttgtcac

SEQ ID NO: 40819 - DNA, 1105 bp, Homo sapiens
acccccctctccctccacactaactttcattagaataatgaaaatagctggaatttaaatgaatttgtaggaattctccatgctaaataagctttttggagagaagttctataaatcacaaatcgaatcattattgtaattattatttagtaaattttaagttactcctttaacttaggggttgaaggtaaagaaaagtcaagtatttgtattagaaagaaatgaataacatcaataatgtattaaattaacatcagtttggactctaaacccaaagcccagggcaaacgaggaagatatgtttgaagcagaagctggaaaatgaaggaagccttttttgaatgctgagtggttggttttcaattcaagagttattgctagctacttttattagaggcctaagagattggtcctaaattgctgagtagtaggagtctttattgagatggtttaacagggcaagtgtgtttaaatgtctattctcagagctggggagactggagcttgtgggggaaaagaaagagacatcagactgttactgtgtctttgtagaaaaggaagacataagaaactccattttgatctgtacacctgtagactaacgggctcagtagccagcaggatttttgcccttcaaaggtaagaagagccacaaggaacgagagtcccagtttaagagttccaacctacccaaaagtgtaggcacaaggggaatagtataaggaatgtgttcttcctgccaaagtttaggtccaagatacaggctgaccaagacaggaaaaggggaggagtctaaggaaatgtttctctatatgaatctgcactgccatgaataaagaactgttctgttgactggcagaattaatataaaaagaaaccaattagttcgagattcttagttgcagaaaggaattagcagctgaaccagaggatggtgagtaatgaagtataacacagagggaaaggaagggaaaaaaattcctcaattacacagctcattgtaggatagttttattcaagggtaaatctggacattgtggacgagaaatcatattctaaagtaccagtgagtcattgaagaccttaaggtgaagagaaggcaagg

SEQ ID NO: 40820 - DNA, 1057 bp, Homo sapiens
tctcttgtagatgtgtttgaggcaatttcacacaattttttaaaacatacagacacactctatctataaaagaattgtggagtacatatgttcaaagtatctatcaagagacacagagatgttaagtaacttcctaagatctagagatgaatcttcctctcctctttgtaccatgtttcttttgcctttgctgtattttacaatgtgtggatatgtagccagtctagtggccatcctaggatttcaagcccagcagtctggcttctgagtgtatgcacttcacatcaaagctgtacactcttccaattcaattatttatatttccatccttcatcacagaatttactagaagtaccttgctttaataatcaacattacaaaaaggctgtttttttgcaacttttccactaaaaacttcctattttagtaaaatttggtaatttctttttagaatgttcttgaatacatttgttcaagacctgaaacttaagagttaactcatcaagaagtagtaactcactgaacagtccttcctggtatcatcaacacttgactttgtatcacctgtcaaaggtgtaactctttccccagttatgagtagtctttcttataacattgtttcatccagacagtagtaacaagaaatatatccacatttgattaatctcatctcctttgccccaggatgtcagaggaaattttaaacattgccaatgattatgctattaaacagttagaagacacttatcattcttttacttgtcaaaataagcaagtttaatatggttttataaattgagtctgtcattagtcttcaaaattataagagctaagtcttccattactctacgtagattatcccttgcaataattatattactaggtaactgcatctaaactctagaaagaattagtgtataatcctgtagggtctatcaggaaactattttgggatatatcttgttgttaatataataatgtccttcttaaattaggtttttcagcattttaaattttatatttaaactttcatttttaggttaaaagagtcctgtaa

SEQ ID NO: 40821 - DNA, 1032 bp, Homo sapiens
atcacaagatcaggagtttgagaccagcctggccagtatggtgaaaccctgtctctactaaaaatgtataaaaatttagccgggtgtgatggcgcacgtgtagttgcagctactctggaggctgaggcaggagagtcacttgaacctgggaggcggaggttgcaatgagccaagatcgtgccactgcactccagcctgggcaatggagtaataagaccctgtctaaaaaaaaacagacacacacacacaaaagtagtcatatctatcaatctttttaaaagttgcatctggatttcaagtggtagtttaaaagcctttccatatatcaaggttatagaaaagttcatgcgtgtttcttctagtacttgaatggttttgtgttttacatttatatatctaatccattttgagcttattttcatgtatgctgtgagtaatggatcttatttcatcttttttccaaatggcaatttgtcccaacactatttgttttagaaagccttctgccttctgtgttccagtgatttgaggtaacacctgatcgtgtactagatttccacttgcagttaggtctgttgtttccaatttttctctaaaatgattaatgctgtgataattaccttatgcaaaaggctttatccacatttcagattatttcctgaaaaaatcatgtaagtagcacaaatacttaatgaaaggatatgcagtgttcaaggcttttggtaatagccacgttatcttctaggaaagattctactaatttatattaccaccagcagaaaataagtgtctatttgagagcatcctttcttacaatgagtataatcttttaagatatcttttataattttgataatcaaaaattaaatttgcctttttagagatttttggtgatgcataaattttcatatgttggttgatttatatgtgtatgaattctctgcattttcttttcccatttctcctttgggatattgagctgtttatacaccaaatgaaaagcacatttttattcctccctagtgaaataaa

SEQ ID NO: 40822 - DNA, 1122 bp, Homo sapiens
tttacaaaattattggtctgcaatcgattagaaagtttctttaaaaatgaagaagaaattgatccttgaccagagaaatttgacaagcactgtcctaggctactcagcccttttaaaacccgcataccaaaagcaactatagttcttaaatgttagaggctaatagagaggattgcatactgaatgaactacattactagccccagtttccaggaagtgataaatcagtacaagttcctctagctgattttttccacttaattttatcagtacctcatcagttactttctatgacagattattttaattatttcctaagaatgtctgcttgttctaaaaaaacaccgaaagctttcatagcgtttgctaaaaagataagttccttctttatatgtgttggcccttttcgcttgtttaactttcttaccttggagaattgcctggaattcactcaactgacattttcatccatgccaatggaagtacttcagcagatggagatacacttaatatgaatatataaaagaaatgaactcatgtagcattctaacactgtccccttcccgcaaaaccctgtgagcaccagctggtaatagatgtaatgtatacgtatgtcggaaacactcagttctactttgcatagatagaccctcacttgagtcatacttttcatgtaaaatattccaagagaaaatggcttttaaaaaacatttttaaaagtaaaagactaacatgaattaaaaattggtatttttcaatggtcagaatctagtcaagcattatgtttccattttagtgacaaaattaatgtgaggaaatgaaaagctagaaatgtggtaatatagcctctcattttttaatccaccttgacaaattaaagatatttagaatgaaatataaattaagaaaatgctaatacatgtagttttctattgctgctataacaaactaccacaaattctgtggcttaaaacaacacgttattatctcacagatgtataggtctgaagtctagctgggctcagctggtttttctaaaccttgtctcatgagaccaaaatctaagtgtcagttgcagtgggctctgaagactctaggggaggattcattcccaggctcacc

SEQ ID NO: 40823 - DNA, 1050 bp, Homo sapiens
taataatccttgaatttctgcagtatcagttataatgtctcctttttcatgtctggttttatttatttggaatttctctttttttttttctttgttagtctggctagagatttttcaattttgtttaacttttcaaaaaaaacaactttttgtttcattgctcttttgtattattttctttctgtcttttttttttttttctgagacagagtatcactctgtcacccaggctggagtgcagtaggctggagtgcagtggtgtaatctcagctcactgcaacctcctccacctcctaggttcaagtgattctcctgcctcagcctcctgagtagctgggattacaggtgcatgccaccatgcccagctaatttttgtatttttagtagagatgggctttcaccatgttggtcaggctggtctcaaactcctgacctcgtgatctgcccgccttggtctcccaaagtgttgggattacaggcgtgagccaccatgcccagtcaatatttttttaatttagatttcatttatttctgctctgatctttagtatttcttctactaattttgagtttggcttgctcttgcttttctagttctttaagatgcattattaggttatttgaaatttttcttgttttttgatgtaggcacttatagctataaactccctgttagtactgcttttgctgtatcccataggttttggtatgttgtacttcattatcatttgttctaagagaattttcagtttccttcttaattttttaattgacccattggccattcaggagcatattgtctaatttccatgtatttgtgtagtttccaaaattcctcttgttattgatttgtagtttccattgtgatcacagaagatgtttattattttaattttttgaatattttaagatttgtcttttgaccaaacatatggtctacttttaagaatgatccatgtgctgaggaaaagaatgtgtattctccagctcttggaggaaatattgcatgaatatctattaggtacatttgtttctatagtgcagattaagt

SEQ ID NO: 40824 - DNA, 1044 bp, Homo sapiens
taaatttatgtaatattctaaatcctttgttgtcatttcaacagtgttcacagcatcttcaccaaaattaaattccatcttaagaaaccacatattttgttcatccataagaagccattcctcatctagtcaggttttatcatgagattgtagcaatttggttacatcttcaggttctacttctaattccaattgtcttgctacttccatcacatctgcagttacttcctccattgaagtcttgaactccttaaatcttcctgagggttgaaagccaaccatgaggattgaaaacaactttttttttttaatttttaactttcatgagtacatagtagatgtatatatttatggggtacatgagatgttttgctacaggcatgcaatatgtaataatcacattatggaaaatggggtttccatcccctcaagcatttaccctttgtgttacaaaaaatccaattatactcttttagttgtttttaaatgtataattaggttattattatattattaactatagtcaccctgttctgtacaatagaccttattcattctttctatttttttgtacccattaactatccccatccccctgccaactccacactacctttcccagactctggtaattatctttttactctctatctccatgaattcagttgttgatatggtttggctctgtgtcaccacccaaatctcatgttgaattgtaatcctcaattttggaggaagggtctggtgggaggtgattgaatcatgggggcagacttcccccttgctcttctcatgataagtgcgtaagttctcacaagaactggtggtttaaaagtgtgtagcacttctcctttcgctctttctctcctgctctgtcatgtgaagatatgcctgcttccgcttcgccttctgccatgattgtaaatttctggaggcctccccagccatgcttcccatacaatctgtggaactatgagtcaattaaacctcttttcttcataaattacccagtatcaagtagttcttaatagcagtgtgagaaag

SEQ ID NO: 40825 - DNA, 1050 bp, Homo sapiens
caattactttagacctgcacctttgcattgtaggtcagaacctacaaaaattccatcttggaaaacattttagatttaccttgtattcacacacccctgcaaagtgggtctttgcaaacaggaaaggtaaaagatttatttttactgcaaaatcatgcctttatataggattagtctgtggattatttcaggcaacaatgagtagatttttgaaggaaacttcataacacagttttggagccctatcttctgtaacacatttccaacctttggaaatagccttgattttccaacttttaacctgataccaacaaaaatggacaaagataatatcacatggaattattctgaagagccagctgctgagaagttccaggagctgtaaattagacaaaagcatccatttatttgggagtaagttacaatatggctatagcttaaaaatatataatgattcagggaggtattttaatgaacttatgtggcatttattgtgaactattgtatgtttagtattacactgtttttcttctcatgatgtaaaggttcaagcttctgctatcctttgatgtgtgtttgtttttatgaagacagtgcaataattttgtttccactgcattttaagattttttaaaaaataacatttgtaaatgaatattgaaattaaaaatagtaacatcagttttttcttcaatatacagacttcctttaataagtgttgcgctggttcaaggttgggcattgggtggaggagcagaatttactacagcatgtgatttcaggtaggatgaaaatttcattaatttcttgcacaaatataattaacttgctcaaattcatttttgccttaatatcaatattttatatattcttaaataggataaacctattttcttttctgaatgttttctttttgtcagtcattaaagtagataattttaatctaataaaatttcatgatcacttcattactatgcattttcaaaaaattaacaaaacacatggttttgagattttgaatagagcaaatccatattagcaaaactcctg

SEQ ID NO: 40826 - DNA, 1052 bp, Homo sapiens
agtacttggtaactaactgagtgtgggagaattgtgaaacgggaaagtcaaacatagtaccaaaaatctgagccttattgaccgctagctcagaactcttacactaactttttccactaacacagaacacttatgcaatcttttatagagtttctaggtatattttcatctttctaaacatcctttaagtcaaatagtgcaattttttttaatttctcatttcttatgaatgaggaaactgaattacgtagtcatgacttgctcaatttcatgttgttattaagtggcagcactaggattcaaagtcagttcttttactttcagttggttttgccgtgctgagtttgaggtgctatcagaatgtgaaaatgtctagtagattttagcactttatatggaagtagatgagacttccaaaaaaaagaaattataaataaagaacagagaaaatcatggattagaattttgaaactgcatggatttaggggattagctggataagaagagccaaggaagaagactggaaaagaacaaacaaagaaataagagaaccaggtgtgtaaatgttgctagaaagtgagagcaaatatgagaatgaagaaactgattaaagaaagatactacgtgttatggagagagaaaaggtgaataaggaaaagtcatttaatttgacaagtaggagattattaaaagcttttgaggagagattttgggataaggcagagggccagattacactggattgaagaaagtatgtgagctaaaaaaaagacaaggcaatgagtttggactactcttaggaaatttgtttgtgaaaattataagttgtggcaataccaagataaagccttagaaatatttttttaaaaatcaaagcttaacataacttttcccttctttcccttcttctcttatatgtttatcatcttaaggataacagatgggtatatcttatgcctttcccctgtcattaccctgagtagaactccatagtgatctagggtatgtgatctgtctcttatccctacatctttgctaatacctcatgcaaa

SEQ ID NO: 40827 - DNA, 1045 bp, Homo sapiens
agggtagatgaattctttattatcctttaatgaaatctctgaagtcatagtataagaaatatatagcataaaagtaagcactttgaatatggataattttaagaattgtaacaatacatataaagtatggaatgtgtttatcacattatgattttaaaattaacaagaactagaaatagtttatgtaaagttcccgatatttccatgtttcctataaactatattcctatatacttgagaaggaactataaatctgtgtaaagctgaaacttaaaatggcctcaggacttttgaggcttatacatgtattatatatgagttacagctgcaacatataaatgcatctacccctcatggctgaaacattctgaaacttatcatggctttaagttataaacagtttgtctgttagtgaggctcttctttatccaaatacttactctttgttgttacagatgcatcactagcatctacttacttgctgaatttgctttctgaggatgatgagataactgaaatatatgacaattttagcaattagattatattcccttctaatagtgataaaatgcttggaagtgattaagtggcttttttatcataaaaatataattattttgatgtttttactactgtattttttcagttttaaaaagctttttattaatgtaaactacaaaatacaggtaaaagcagagactaatacagtgaaaccctcatgtacccataagagcatcaaccctatcaatattttattatatttcttatctattattccactttttttttcttttaagtgtaactgatcccataagaagttgatcgcgtcttggtatgctttggttattgtgcaggaaaagagctccaactgtccctattaggcagttaattcttggttcagatggtagaggccaggagatccactaggataacacaaacattaaccctgctgaaaagttatgtattggaaagacaaaggaataaaatagaaaaaaatatatttaaatattaagacttggatttgatgccacagatgtcctgtagg

SEQ ID NO: 40828 - DNA, 1172 bp, Homo sapiens
ataaatatataaatatatataactggcttattttcttttaatgtgcaatgatggctggatcatttaaagttctttttagaaaataacataagccaaagactcaagtgtaaatatgtctatatggagaaagcacattatatttattggttacttacattccttttttgatggctaaaatactaccaccacacaatcatcttttttttcctgaagaaagctttttctttagctaaaatcaattgtaaacgatttttgtagattattttttgtatgttttagtgtaagtagaagataaactttttattcataaaccaggaagcaatgttctttatagtgattctcttgtgtacatgcttgtgaattaaatttgtgtaaaatcccttggcaattgggtcttttaatataggaccaaattaaaacattttgctgaatatgtatagtttttcacaatttcattaggtaaataatggtttggtgatcatacatgagaaatgtacacattaaaaggccttgctgacaacttgcacaatgttgaacatagcctttaagcatcatttaaattttaaaggaatggagtttttcagcctgtggcccagcactggtcaagaaaacaagatggcaacatatatgctttcagggtcaaatttgagcaaactgtaaactgtcagggtgataaaatgtttctcttgatgtttacatgcacaagctttgcgttctgactataaaaagtgtgaacaaatcaatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaagatttaattaaagtaagaatgaaataaagtttttataattataacagttattgtttgcacatcattttttcctcttaatgtttatgcattcaccactaaatgagtagcttattcctatactcgttgatacaagtaggccacaaaaactctatttaaagagtaaaactgatttccaacctctagtttcttttatttttattttcttaatttaatgccaaaatgtccagtaggtggagatggaaaaggccag

SEQ ID NO: 40829 - DNA, 1034 bp, Homo sapiens
gacttccaccctttctacaggtgtcctcaaactccctacaccacctcatttccctgggttgttgcagctgtctacacaagattacattggttttgattggggtgctggctatggagatgagaaaggggggatgaatcggagggatttttgagggagaactctcagatcgtcttagcaactaaatgaatagtggttatgtctctaaactttgcgatttgaagatttcttgatgtaaactctgcctccatttttcaggtcaagtcttaaaatcatcagtgggatcatttctgacttcagaattcaacttttaccttcaaatttaactgatttcccaccttttttaattaaaaaaaaaatctatggttaaactgtgccattctgggaccttccaaaaagttactattttcctttacattcatgtcccgtgaatcctgaacaccccaccctctgatttgtgtttaatcagtgttgatgattagtttagtgagctgtggagttgagctgaggagtttggtgaggagatttagagtgaaggcaatattgctggagactgcttaaagagacataactatttctaggcacattttggttccttgaatgcactcgccacagtggtaggtgaatttgaatcataactacttggtgaatagtgttggaatgataaagacctcttaaggaaagttttattaccctagtttattgctggagacacctcgaacttctattccaaaataatatgcattttagactgttctccagcctgaattttacccacttgaatgaactgagttgggaatttttaaatgaattgcatattataagtaatagtttatgatatggtctctgaatttttctaaattcttattatggagcaagtccatagatgggcttagaggaaaggcagttttaactcaaaaattttattgccaatatgttgtcttaaacatataaaggcagcagaaatacattttcaggtataagtaggctcaaaatttaaggatcactaaccattcttgaaaaatttgcttaaatac

SEQ ID NO: 40830 - DNA, 1069 bp, Homo sapiens
gagtctgggttcagtggcagctcacacctataatcctagcactttgggatgccaaggcaggcagatcttgaggtcagcagttcaagaccagcctggccaacatggcaaaacctcatctctacaaaaaatataaaaaatagccgggtgtggtggtgcatgcctgtagtcccagctactcaggaggttgagatgggaggattgcttgaccctggaagtttgcttaaccctggaaggctgtggtgagccaagatattgccactgcactccaacctgggcaacagagtaagaccctgtctcaaaaataataatagtaataataataataaatgaagtttgtagtacatgttatttcaaaatagccctaaatgttttcactgcccttaaaacacccctgaaggtgggtgaaaataaaatcaagggcagagaccaaattctttgattgttgatccagtgctctttccaacatgccatagcttatcttcaaatatggcaagcccagatgttactacaaatgataccgtttcccagtgtgatgaagggtcattatcataatggactgcccgattgcattttctttggttaaggcaatgcattttgcaggtagcagtgttgtttagcgtaccttttccttttaagaagaggagccctgaacaatgtgtgtcttgtttctttgtcacttctcaggcttcattagctttaactacaaggtctatcagcctgtcatagtagcaaatgccattgcctcgcacaaatccttcactttctacttggccttctaaattcctgatggatctgtgttatactgttaaatgggtcacactgtcttttaacctgggttctcttttctttttagactctgaattcagtcacccctcgactacaagctgaagactgcagtatagcgtgcctgccaaggaaccatgacaagaaccgtttcatggacatgctgccacctgacagatgtctgccttttttaattacaattgatggggagagcagtaactacatcaatgctgctcttatggacgtaagagactgccctctttgttagtgtagagtgttgtggaaa

SEQ ID NO: 40831 - DNA, 1061 bp, Homo sapiens
taaaatatttattaataatttagactttatactaaattatcttggaaaagctagagctcaactaaaatcattttttaaatctggttcatctgtttaatattaaggcagtctctaatttagtaaataaacacctctaaaaattgtagtgcaacctctattaacgtgatttaaaccatgttgtgtattctcctgagatatgccagattaaggaattatcgaagccttggtggaaaatgacctactcaaaatgaaaatggaattcataactaaaagcatcccaaaaaacagctagtcttaacccttcatttcgtaaataagcagagtgggaataggtttaaaatgtcgaccatctttactattttagatcacatcacgttcttataatttgagcactagtaaaggttttatttgttttctatttctttctctaatattcaaatgtgattttgttcctgtttgtgctttgaatggcatgtttggatgactgtcccagatctggcattctgagattgtaccactaaaaatgtcaagtgcatttgccttttaattacatacagtacctggattttaatattttagatttttccctgaagaagagacttttctggtcctgtagtttgtgggagggaaaaaaatatcactgacattatcatgaagctttttcccccaacgtctccatatatccacatttatcatttcagaacaatttcattttgggtcaggtttagttgttctgtagcttactttgctataaacactatgtttaaatatataattccgcactgtttgtttgtacttctttctcttatttcccattaatgttcagctcagcttgttttactcttaataggccattactacttggatgtcacatatgtaataatcagtatgtggaaggtatagtttcttgtgatttacactcctttccttcctttacctttggcataaatgtgaaccagctcattactttccagggtatttctttttttacttccccaaattaaattttaatttcatcctattgttattctctgatttttattatttcaggtgggcaaaaa

SEQ ID NO: 40832 - DNA, 1043 bp, Homo sapiens
tgtctgagccagagacttcgttatatgaattcatacaaactaatgaaggaatacaaaacttggcctcacagggagagagtggagtgtcttatgcaaatctttgttgtcagccacattcctacatgcagaatgcaaaaaccatgtttcagtttgttgaggatttggaaatagcttgagataatcttaatttaaaaggactggcaaattctttcagctttgtagaatttattccacatatgtcaaagacaaacttgttgtactgcaaaataaactagtactgtgtgatcttagttgaaaaggtaaatattacaatttacattctattctctcatattcattcttttggtacatgttaataaattgcaaaactatattgctgaaaaatctaatgatcctgaaaaatctaatgataaattctagcaattatcagtgattacaatataggcctggtttgttgttgttgttgtttttgtttttgaaaaggaatcttgctctgttactcaggctggagtgcagtgccacgatctcggctcactgcaacctctgcctcccaggaggttgcaattctcctgtctcagcctcccaggtagctgggattataggtgcctgccaccatgcccagctaattttttgtatttttagtagagatggggtttcaccatgttggccaggctggtcttgaactcctgacctcaagtgatctgcctgcctcagcctctcaaagtgctgggattacaggcgtgagccaccatgcctggccataggtctcattttgtacactaagaaaatgtcaaattactaattttcatacttagtgctaaatttacatttatcataaatgtaaacatgtaatagagaaccagtaattttttattttccttaaaaatgatcctggtaaataagagaattgattcataagatcatggtttgttgatgccatagcaacataatcttatattgagaacatcatctgttacaatgcaagtagttgtggccatgtgcctagaatagacttagttattaaagtacattgtgatatgata

SEQ ID NO: 40833 - DNA, 1055 bp, Homo sapiens
ttggttttgactcttatttaaaaaaaataaaataaataaaactgctttgtattatgcagctattatttttctgacaagttcagccactgtggagacagtttgaagtaaatgtggctcattgttggtggtctaagaatgtctaaagactagagcaaataagaaaatgttaatagagagaaggaaaacagaggataaaaattgaagttcctaagaagtatgtagctaaaatttcgccttatctaattcaggcattttctcttggctttcccagcacagtacttcttagcgatgataacaacagcaaccactttattaatttgctttttttaaatttagaattcacatcatcatggtaacaacaaccatcccttgaatatgtctttgttagttgcttaatttgctacacctaactcttccaccaggcgctaaatattgggactattggccatccattcagaaagtattatgtgcttcctgtctgtaatgcactaaatcagacattgtgctccaaagaagagggttgtaggagggaaggcatcacacctgtatgcagttactatgcagagcaggcttgggataaaaatagacattggccacatctgtgttaaatcatgagctgtgacccttctcatgacagttccccagctctgctaagacacgttctttggaagaagttgcttcacttttcatttgggtagaatatttacagtccaagtaatagatttcctataatttagaatttactaatacttcctttaaacaagtatatgattatccaaaatgtatataggcttttttgattccagttttataaaacaaatcactaatccaatgttgtgttttaaatagaaactttgctgtatgtaatttcagttggcattcgttatatatttacttaatgtgggcatttcttttcagacttatttatgaacatagaccctatctgtatttctacgtctacctgagtatagaaaaatacactgttttttaaattgttatcctaaaatagtggtctgaagcttgcatttttgaacttaaaatagtgtcttggactt

SEQ ID NO: 40834 - DNA, 1034 bp, Homo sapiens
ttaatttctccaggatggaattgggacagcacatgtgaaatgctgtctatcaagaaagcttattagagactcggttcctaaggtttttagtgggaactggtcacatggaccccttcttgctatcatctgccaagattcccttctcccagaaggaaactagacttttagcataaagcacattatttgcacaatttaggcacaatgaaccactcttctcagggaatgatgggaaacctcccaaatccgagttcccggacatcagtccaaggtcaactttgcaagccgccctttccaagaatttcagtcttagtcctgctacgttaactcttttctgtacaatatctatatcaagtgtctcaagggctagttaaaagaatatttgaagaaattagagaaaattccaaaaattatacatacaattaaggaagtagaaaattggatgtagaaaaataattagaaaattaatcattattgacactaagagagaaatctgagggataatttaaggacttcctttagataatgagttatgacataagataaagtcacccatagcctgtatctcccccaaatccttccctaagtagagaatatgggcctactttatttgaaacacttctgaaaagtatttcttgaaaacactctttagaaccttctaagaaatgacagctcatttagtcatttgccattcagattgtataccagcttatataataccttgattcattaattatttgctgaacaatcctaaaaattatgtttatccattacccattcatacttttactatctttctacacccaatatgtatgcagttcaggttttcaaactcttacttgagtaaaaagggagaacaggtatttaaaagcatatttctagccaggcgccgtggctcacacctgtaatcccagcactttgggaggccgaggcaggtgtatcacaaggtcaggacttcgagaccagcctggccaacatagcgaaaccccatctctactaaaaatacaaaaaattagctgggtgtggtggcgggcacc

SEQ ID NO: 40835 - DNA, 1026 bp, Homo sapiens
attttctctgcattctttaaagctttttgatatgaattttctcttccaattgttaatatatctgcactgtggtttaatcaaagtacagaatagcaacaatatatttcacagttatcttggcaaagagttttaaagttgatgtgacttctacaagtagagattggtaatgccattagaaagttaaacagcaattgcttttaagaaatgaaaatcctttggggcctttatgggaatgtgaaataatctcttgcaggttaccatgaaggtctcaggccacaagtaatagaagtgcaacattttatttttaattactaattcccccctcactgctttattttaatttaaaaataaaaaaataaaaaatgcttaagtggaaattgtaaactcttttataaattatcaacatatagaactactcaagatagagttataaatgcatcttgcaaacagatcgcctctggtttgttcactggctttgataccttttctcacctcttgtgtattcagggatgtacgctgactcaattaagtcctagaggaggaagagtggggccaaaagtagctggcagggacatgtgtctcctactgccacctgacagcgttaaaaataatcatattttttcttgtcctttcctactgcttctactttgtatacccgctctgtctagcaagaggaggaaaattatgtatgctgagaaacatttaactcctaatagctaaattaaaagaaagaaagaacagataaattacaccataactatgatgtaatgttttgatgatctttctaactgctatcatttagctttttagtcatgctaggatccagatgaaagtatgtaatgttcagctttggtctcagtctacagttctcagatgaaaattaaatttatatttggaactgtttttattagctttgcaagtacatttttctgatagtttacgaagcactatacatgaaaatagaatgctatactacttgtcacaaactaacctgtttcattgcaaggtaaaaacaaatatttacat

SEQ ID NO: 40836 - DNA, 1050 bp, Homo sapiens
ggtgcatcagagaattgaattatagttttccttagaaaatgtatacaaacaatgtgttctcaaagcatgtaaaagaagaaaaggaaaaggtgaaactgtcatactgtaattgctgagtaccacattttcatgattttcttaaggccttccatttatgctataaatttcttctaaaaacaaacaatttatatacttatatattatataatactatatgagataaacatgtactagcaagttatgagtagcatcagttgttgaagtataattacatggattgcttaattttggttatttatcagaatgtattagtaaatgtctagctatgttgtcttgtatttaagacaaatcattctaatttcagaacaatccaaaaattagccaagtggatatttctttaaacccagttttgaagaatttatagtaaagtacctctgttaggccctcagatcatttatacttaccaaattcttttttatttacctttacaaaaaaatactaaaatattccaagaaagaattaaagtatattggaatgttataaatagctacagtttgatcatgacatttgggtgctagaaatgtgcttgagctctcatttatattgaagataaataaacgactaaactttttaaacaattctccccatagttttacattcaaaagaattattgaaatattcagtactaatgttaaatgatatattgagaatttcacttgtagataaaaagacagtttgcattcatgtatgaaaatgagtgggtaggcccaagggatttggtttagaggaaaagctttgtgtttagcagcattgtctattcttttgtgtagttttctatatgtcacacttctattagattttagtgcttttttttttcaagttagttgtttttcctagcgctttacacacacattttttcaagcacctgaaaatgggcaaagtaatccagaaatcatgcttttttcccaaaattatttagcttgacattttgaaaatcaaaactcaatgcttttattttctacagagggagtagaagatggataaacagcc

SEQ ID NO: 40837 - DNA, 1059 bp, Homo sapiens
ctatctaattccaaagctgtctaatgcatgttagcaacattacattgtgactgcaatataacaactattcaaaagttaaaatatttttaagtcagacaaatctaaaacaccattttagtacatttcaggtttaatatatttattctgttttagaattatcaatattattattatttcattaaccatgatatgccatattttctttattattattattattatactttaagttctagggtacatgtgcacaatgtgcaggtttgttacatatgtatacatgtgccatgttggtgtgctgtacctgttaactggtcatttacattagggctatccctcccccctccccccaccccacgacaggcccccgtgtgtgatgttccccaccctgtgtccaagtatttccgtaaagattttcttattcaatggcagtctacaccattatatcaagcagactgatttggttcatggttctctttgattaaaatgtatcagtcatttatgtaagatatcgtcaatgaattccccttgaaatcatggaaacaggtaattaaattctgtcattttcccaaactttggctttgttcttttcctggaaaggcataatatgatcctagaataaaccaagtctcattcccccaaggctaattaacatgcaaataaattttctatacactagtgtttttactaagtaaatcattgtagctggacatatcatttttaagcagaaattttttttatttttgtattttgataactctaaaatgttttaaaagtttgcaaaggtaagaaatgaaaggctaatgtattctttttgtgcaatcagccagtccttggtttctgctcggattggtatattgaagaaatgctaatagtatatctgtaacctgttaaggaatatcaagtctcttcaggaaaggaataataaaatgctaatgatcagcattaactgtctgaattggaagggattatagaggaacatttctgtccttttcctgtcaaaagaggatcaccttctacaataatcccaacccagccattacttataccttccaaattcat

SEQ ID NO: 40838 - DNA, 1100 bp, Homo sapiens
catgctggagaatggtgaacatgattaaatagattaaattacttttcttatactatgcattaatagctttctcaaccatgtcccagcggctgcagcacattgtgctataccttactgaggaaatcgcctgatttttttttttaatcagtcttcactatcttgccattttttaccattatcattctaacttagtgaaatcctggttttctcaagtgtctagtctttctttgattttgatttcacatatcatacacatcagttatttatattttatcttgttaatcaactaatttcttcacatattttatttttcttcccaaacacatttttgttcaacttgaaggcaaaaagtatccttggttctggatcattttcctcatggttctcagttgtagagaggtggaagacacatgacaaattctagtttaactggattctgtaatttaaaaaaagaggtgttacagagtcagtcctgcagatgtttgagttccagacccttccaggcaggtcaccaggtactgcctctagacttagatgatgtcccctgataattctgtcactcttcttccgcaagttgctccccctttgtgagtcacatcatataaatgatattattttaatactttctctgtcacgatctgtccactctaagcagaccttatttatttttaatcacccttttgccacgtgggtctgctttttctcattccttttcactttatcaccgtcttaggggacttaactagccaaatggataacccatttccttgtttttctgtttccatgagcacccacacactgctcagaccctttgatttctagcattaaacttatcaattcaacctcttcctcctcactacattgattttttttttttcctacccagcctcattgcaaaacccaattcctcagtctctctaagtttttctcctttccctaccctgtcaggatctgttcttggactatttcaccagtgtactcactccagctagggtgcctctcccctgatatccctcgttttgtcagacttcattgaataaatcccacaatcaatgtgacctgaagtcctgtcactgtgctcattggttctagtagacatc

SEQ ID NO: 40839 - DNA, 2061 bp, Homo sapiens
agcaaaatctgtatcaattactacagtatttattatttataatatagcagctaatgcttaccagccactcataacattctaaaaactttgtccagcatttgatacgattatcttatttaattattgcaatgaccctgaggagtcctgatgttgttatattttacatttgcagaaacagaatctcaaagaagttaagtgcctttcctgagatcacacagctattagctggttgagctgggaagtctgagtccaaaatctatgctcttattcacagaataaacatttttaaggggataaaatattaataaatcagaaaagcataccttgtcttaattctaaagataagaaaaaaaaattttctgttgggattatgcttggttcaaggataaagtggagcctatctaggggaatgtccgtaatgcataaccttcaggcaatccttgtgaatatctctttgctctttgttgttaccaaattattttgtcttaaggctatgagaaaattgactttctaaaagctgtgtctccgatgaacagttaatactaaagccaaggggaagacgtactggtcagaattatagtaactttatccttacatatatctagaagaaatactcttgtaactgagagctaaatctagaaattcttctgtcatgcagaattttgataaatgtccaatgctatttttagttttaaatgttttttacgtatatgttttatttttgtatcatctttcacttaactattgaactacagttgttctgtgatataaactcttacaaacaatatagatttggctttagtttcattaatttttcataaatgcttgagtattcatagtaccttatgaatttatgataaatttattacagatttattcaggcagagacatatttgaaaatttgtaatgaggaaaaaaaatcatcttatgaacagctccataattttactttcctaattgtgtgtaccttttgggtctattttatatttatttaagtttatattggtatttatatattcatataaatacttattacatatttatataggaataatgcgaagccatggttaacttcataatccagggatgcaggcttaccaaaagactgagacctcatcataggatagaatgattttccttctcacaatataaaaagtaaagaaaaataaattaaccaaaacctctctcatgcaaaaagaaaacattattaacttttggtgaaattcagacatctcttcctgtgtgcatactgtatgtaaagaggaaaaaggggaagaattaatggttggataaaataaatgtacacaatatactttatatgtattacttcctaataaaaattatttcttttttatataacaaaattggaaactaaggtaaaactgaaataattactgttgattagggaaaactttcccatcacatgtgtttctgtcatttcttttgtttctcccttgatttaggttttttttaatgcggtaggccaaagtcttaggtgatttgatattagttttagcataatttgcacacatagaattcacagaagatataatttcatgcaaacatgtaaactttcaactgtaaaatttgtatgaaggactgttatgtttgctatgatatggggagaccatttagtcaatgaggtctttgtacttccattgtgataatttagatagcttttattttctgaaatgtgtttgaaaatgtggaaaatattttaatatttccctggtttttttggctttcatgctaatatatacatacattctaatgtatattatattccatataatgtatattttctgccatttttcaagtgttcttttcccctggcctttcttctaccctccaataatttattaaatgtttttaatctccccccccagcctgtaatttagttttgtgcattttaaagcagtattggttatatgcacttcagcaaaccagtttatgccagctaaagattgaaaaggagaaattaatttaagatttagttctgtgttttttaaaacctttttaaagatgaagatattgatcttgtattactagtattgaagcaaa

SEQ ID NO: 40840 - DNA, 1031 bp, Homo sapiens
tctccttggccagaatatggaccgataccccattttaaaaacatgtcactgttaatggaaagaagactcaggttaacctagtgttaatggcccagtgtgtctccacgtgtaatatcttgatgcagattttgatacaatatatctaaagtgatctcttgactcttcatttgtaacaatctgccagttgatgctgatgctactggtctgtagaccacatggcaaggtgtttggttaatagcctggctggtgaaaatagatgttggagaatcaacctttattaccactatattccaccaggaatgaaacttgtcaaatgaatactgcatgcactgtgcatgatgaagctgacttagtatagtagaggagaggagtgataacattgaggattatagtgacttgcccagggttacttggtaagtgacaagttttatccagcaacttgtattggagacaaaataaatacagaagcctgagatggattggagggcgggatggaaagcaggtaaaaaaagtagtgctaggttataatcccttggatcatatatttgtgtgattcatttttcagtacttctcagaggtgggtatacatttgcaatggagaaatcatatataaaaactcaaagcagaataaagagcctataaaaggaaaagttatttttgacttctagaatttaaatgttttcaattgttacctttagctctaatgaatcgttggaagccaagtaaagaaagcaatgtctaatatagattatattagcccattggaacgatgccttgattaaacctcaatactaaataatcaatttgttggataggaactgtaaccaaaatgaacataacagctttggtttagtttagaggaaagtctgctgtattttaggtcatcaaacctagttttgaattttagtcctgctaacaggctatgtgcatcacatttctaatctttctgaactttaattggatatgactgtatcagaaaagttcataagagagagaagccacagaaccagtaacagctcacataatataag

SEQ ID NO: 40841 - DNA, 1066 bp, Homo sapiens
tataaagccttggtgtctgtctgtacctattttttctagatatgcaaataattgtttctaattaatcttaccagaatatgtatcacagtaggtcactctgagatactgtcatcaggtatgtggtattttctttcattatgtagtttataaactttttttttattttagaaaattttttgttgttgttgttgtttttgcttttttttttttttgagatggagtctcactctgtcaccccagctggagtgtagtggcgcgatctccgctcactgcaagctccgcctcccgggttcacgccattctcctgcctcagcctcccgagtagctggaactacaggcgcccaccaccatgcccagctaaatttttttttttttttttttgtatttttagtagagatggggtttcaccatgttcaccaggatggtctcgatctcctgtcctcgtgatcaacctgcctcggcctcccaaagtgttgggattacaggcgtgagccaccgcacccagaagttttttaaaaaactatgatttgtagtactttatctgtacccttgatcctgtagagacttctgttttctctgtttgatctttgcctgtcatcattgatcactttcaaatatttttattctccttattctaaacattaaaaattacccctttttcactcattattcaggaatcatctgttgactttactgtagttactcataatttcttttttttccctctctatttctttctttctttttttttttaattagactttaagttctggggtacatgtgcaaaacatacaggtttgttacataggtatacacgtgccatggtggtttgctgcactcatcaacccatcacctacattaggtatttctcctaatgttctctctcccctagccccctatcccctgacaggccccagtgtgtgatgttcccctccctatgtccatgtgttctcattgtttgtctcccacttatgagtgagaactcataatttctagtaattaataatgatatttctttaatttctaattttccttaattgtcatttcatttctgagttttgttgtt

SEQ ID NO: 40842 - DNA, 1034 bp, Homo sapiens
aaaagtggtgccacttaacatagcatgcttactgtgtggcaggagatgtgctaaatgttttatgtgcattatctcatttaatcttccctataaactttcctttatagaagaagaaattgaagttttcattttacataagttaaagttacagttaaagggtacgaactaggccaggtgtggtggctcatgcctgtaatcccagcagtttgggaggctgaggcaggcagatcacttgaggctaggagttcgagaccagcctagccaacatgttaaaaccccgtctctacaaaaatacaaaaattagccaggcgtggtggcatgtgcctataattccaactactggggaggctgaagcacgagaattgtttgaacctgggaggcagaggttagggtgagcccagatcatgccactgcactccagcctgtgtgacagaccaagaatctgtctcattaaaaaaaagaaaaagaatatgagttaaatatatatctgactttggagcctgggctcttaacactatgatatattgaaagaatattaaggggaaatttttttcagatttttctagtatctgtaatatcttgtattacatattgcatatattaattaatcatttcacatataccattcagtcttcacaagaaacccgtgatgtacggaaaggcagtattgtcaagatgagactacagagacccgagttaaatattaataacttgcttgggttacacgtgatagtagatcccaggcttccaaacacccagttcagctttccattataggagacacttcctgtggattcattcagtttgctagaggaaaaagttgtccttgttctctagggtttcccatctcccccaagtttaattcaactttatttcacttatttagttaataatccaggactgttgctggagtagcaaaaatttgattagaatcatcaccttcagtgtttcaggtaatggagtggagtaaaaatggcttagaaagcagagcctgttcattctgctcccaggctggcctcctggaaggtttaaag

SEQ ID NO: 40843 - DNA, 1050 bp, Homo sapiens
tactctgtgatatcagttttatgtaacatattttgatctttttaacatagtcaaatggatgttgtaacacttgcttgatttaacattatattttggtctttattatagaaattttaaggaatttcacataatcactattttcttatagaagaatatagggacaagcagaatggtgattttcttaaaggccttatttcttaaagagaataaaatttagtttatgtataaagaaaatgattttattctcagacactttcctccctgtgtgtatcccctcaaattatcacatttaaataattctcagtggtcctaattgatttctgaataaaatatattctggccatttttctttctcccaggatttattatgagccatgacaataaagtttaggtctatttacaaatcagagaaccttcatatttttgagaactggaactttgaactagattagttgagtatatcatgttggtttttttggtgacacgcagtatagagaaaattaaaaatgaatttccatcacacctatctttgaaaactgaatttagcttaaattgaaaggggtgaaaagttggcattttattacatcatttcacttatcttataaatcttagagtgaagacaatgtttatgacattattttaagtctgaaattaaatttaagtgaagcctttctgagacttatttattttaaacacttgttattgcattttggattaaaaaattacatacacaaatttgttttcctgaatatataatgtgtttgatctctccataaatatgtatgttaatatagcactaaaatctaaatctttccacattattgtacacgtaggtatgcaataaatatttcttgattggttgactaatatccaagcatatttaggcatactattacatgtttaggtctttctgatgagattccagttcttgaatctggttgttgctaccacactgacctttttaaggtgcaaatcacattatccctcatgtagaaccctttaaaggcattacaacaccttcaaaaataaaataaaataaaatgaaaaaag

SEQ ID NO: 40844 - DNA, 1048 bp, Homo sapiens
gcactgagcttggaatataaaataaataaagacaacatggaatttaaatttggatgggtaaaatagaaaatgaagtttagaggcttgatagattgacagatcaagaggggtaaaacagaaactattgctatataagctcaggatgaaatactaagtagagacctcagcctatacataaaaagagatggaaaaactaagaaaatgcatgtttgttttgcaatttaaatttttattttcagatcttagaggacaactatatcattaaatgttaagcttgctaaagcagtattttttaggtgtctttaaagtaacttactacaacttcctatatttttgcagcatcttctaatgtacatgaaagttcagtgaatgtacatgaaagttcagggaccacatgcttaaatactggagttgaacggagaactaagcttgttttgaaataatttttgttgtccctgcttccaaatttgttgtggtagtggttatatgagtcttttatttattaggagattaggaaactgctttcataaatggacattatacaagcatcttcaagaaacatgtttcgcttctccagctccaattagaaaagcggtaatctccatcccagccttctggatggctggcctctcttcctaactttcttacccgaatacctctttataggaggcttactacatgccatttgctatgctagatattgtgggtagcaatgataaaggccatcttctctattttatttttgggcatcctcagggttaatgccgtcatcttttccttcaacaactgcagtggtctccttaacattgtctctgcttctggatcttggtctcccacaaaccacttctcacagtcatcaaaacaaacttcttcagatcataattcagattatgtcactcctctgctataagcctgttctgttacatttagaatgaaatccaatcttttaaaaaatagaataaaaaaaaatatattttaggaagccatgtcatcagaagtgtaatccagagaataatatactctataggtctaaaaaaagattttctaa

SEQ ID NO: 40845 - DNA, 1029 bp, Homo sapiens
tcttttctttaagaatgttgaatattggcccccactctcttctggcttgtagagtttctgccaagagatccgctgttagtctgatgggcttccctttgtggataacccaacctttctctatggctgcccttaacattttttccttcatttcaactttggtgaatctgacaattatgtgtcttggagttgctcttctcgaggagtatctttgtggcattctctgtgtttcctgaatctgaatgttggcctgccttgctaggttggaattgagtagtctgagtgggcttcattgagttgatttttgagcaaagatgtgaagaagacgagggtatattctgaataggtatctactagaagagccagggtaaaggccctgtggtggaagcatgcctgtccatgggttgcaaggagtcactgtggctagatggcagtgagcaagaaggggagaggagaaagaggagaaggaggttaagacagggagggaattgagtcaggtcactttagaaacttgttttgcttcgaaggacttgcccttgactcagaggccatggagagtcattggaagcttttgagtagagaaacttgctaggaacttgatttcagtgatgttaatcgttttttatgttctttagagcacactctgtaaggatgtaagtctaaacttttcttttttagccttttcaacagtaagctatacataaaagttacagtgtagcctactggccatgaatagaagtgctatgtgactttatggtgtcctgaagtttaaggtatattagctctgcatatgtcctgtttccagaatcttaaaaatttaattttggagaatcaagctttgtttaaaataatcaccttaatatgtagatgtggaaaactaacttgcttaagtttattgaaccggatttaccagagctagaattagggtttaggtctcctgactataaatgagaatgagaagcaagaaccaaaaagtatcaactgtgatcagatttgtattcggcactttacttattttgtaccaagctaggc

SEQ ID NO: 40846 - DNA, 1109 bp, Homo sapiens
agcgttaaaaaaatcatttcctttctacagattctccctgaattctactttttcacttctaatttatttttatcaccatttcctggtattcttttgccatgcttttgaagtccattcctttgttatgctataggcaactgctagcagacctatttctgaaaaactctatttgacaatttaaaataaaagtcttatagtcagaacttggaaacagaacgagaagttggggctagagctaggggaatcactaagttgatgtgagagaaaaagcagtaactggaaaggaccaaaataatggacacatataggtcaactaggcaaatgtcatttcatgcagttgtgtgcctcggaggtcctaatctctaaccagtttttcttgtactaaaatgccattgaatttatagcttaagcagagtaattaaaaagctgagaaattggtgatgaagaatgaaatctggaatggcttctctctctctctctttttttttttttttgagacaaggtcttactctgtcaccagggctggggtgcagtggcacgatctcggatcactgcagcctcgacctcccaggtttaagcaatcttcctgcctccccttcccccagtagctggaactacaggtgtgcatcatggtgcctggctgcatttggccttgctttcttgagattattgcatttatttgtttttcagaaaagataaagatggtgattggttgggtgagttagtagttagggttctttcagtatcttagagttgactccacaaccacagttggaaggaaggaggctctttaaccaaagtatgaactactgttgaaatatgctgatgaagtgtgagaatgacagcagcagattgtaatggattttgaagtgttccaggttttaatagtaactaatagtagaactatagttcaaatctgtaatgacaacattgaaactgtagtcaaaatactaaatctagattgcattaaacctttttatgagaatacgtaaaattatcatatgctaacaagctatcaatctgagttagaaatgcttggcaataaaagtgttgtttcatttgattgatattgaagtagccgtttgttttatactaacttcacattatgg

SEQ ID NO: 40847 - DNA, 1046 bp, Homo sapiens
cttattccaccttaaatatgttcagaacatttacattagcctacagttgggcaaagtcatctgacacaaggcctatttataataaagtgttgaatatctcatgcaatgtattgaatactgtattgaaagtgaaaaacaggatggctgtatgggtactctaaggacagttaatactgaatgtatatgacctttgcaccattgttaagtagaaaaattgcaagtcaatccatcataggttggggaccccatcggtactttagtcaggataggtcattgaaattcattctgagtattcatttgtttgtaggttagttaacttgttgatgtaatttgtacttgctgttagtttgtctggaatgactatttaccacagatcttcacattgacatatttcttccagtcatcctagttcctcctcagggaggtatcccctctagcactctgtatgacgttcctagatctaactgccattgcttgtggaacgtagactccatgaacatctcgttgtctttactgatctcagtatgcttagaacagtgtctacatttaatatatatttactgaacagttgaaagaatagataacgataggctttagaccttagtagtctactaatgatgtgcatctttagattgctataattgctttctcctaagctggagtacgatgcttagcgatggaagtcctactataattctgagcagctaattcttcagttgaagaatggactcggtcttatcgctgagtgagtaactccattgaattcttaggaagcagatttgtcatttcacagtgtccacagattctcatatgatttctcatttcactgtacatggaaaggatgatgccaaactttttttttcttttttttcgagacggagtctctctctgtcaccaggctggagtgcagtggcgtgatctcggctcactgcaatctccgcctcccgggttcaagtgattcccctgcctcagcctcccaagtagctgggaccacaggcacccaccaccatgcccggctaattttttgtgttttttagtagagacga

SEQ ID NO: 40848 - DNA, 1030 bp, Homo sapiens
gcatctgaggtgcacaacagctctttgattcaatccccaaatcaaaagaggtaagatgaaggcagatgaagagagctagaagtagttagttggacagaagtagagagatgaatgctgactggctcttctccatttcctgcctgtggcaagcagccagctgtttccttaattcaaaattctgtgtgccctggcagtgatagagtagattcttcttacagaattccctgctggcgattgccatttcaaagaagaaacttacagtagaattattatggtttagagtgttactgtgtgtataagagtaggtagaatgaagagccaagggttggcatccattcaaaagtggcacgcagaattttcatttattcctttactccttagcagaggtagagatgtcagtggaggtcacctacaggcaagactctctttgagaaacgtctgtgatgttaggtggtttgactgagcgaatcagccccaatgtatgcacagccgacccttgaacaacacgggcttgaactgcgtggggccgtttatatacccggatattttttcatccaaatggtgattgaaattacagtatcccgggatgggaaacccgtatatggggagaagcaacttttcggatgttcaggttcttcagggctgactgtgggactttagtatgcacggatttgggtataagctgggatcttgaaactgatctctcccgcctatgcgagggatgactgtgtcctgttaaccctgcccttctgggaatcgcgacagcttctggccgaaggtgggagctgtttcaattccacatattcacactcctcatagcccatttgctatgctatacctcggtacaccccctcatcagccctgcctatactgctattttgggtctgccttcattatttctctgcctgctactcatttagttttgtctcattctattctttctagcaagaacatctttattctacactctcctcctgccttgggtcagcttaattaccgcctaaataatcgctaaggctttggagtcgac

SEQ ID NO: 40849 - DNA, 1037 bp, Homo sapiens
gcatagcaaactgaaatcattacattcctgtacaaatatgtattttcttcctccaaccttccctgctggctttgactcagttagtgattaatatcagaaacctgggagtcataattccttctctgtctctgcctcaccttcaagtattaagctgtatttagtttaataacagatctttctactttattgcatttcaccccaacctcaccgttttagtctctgccacttggatgactatacttgctccctaatctagtgttccctcaaatccaggctccagacaacttgtacctttggattataatatgataattttacttttcttttcccactttgttcctcctcctctttcccctttcctctcttctttcctcctctatttttctagtctccgcatcccttattccctcctacttttcttcttctcaattcacttcctcacccctcttccctcatctccttcttacgtctccctcctccaggtacctggcagatagaatcataaagacttgtgtgtttcagtaatctgtgatgtggtgcttattactgatttagactgagcatatttaaagacggtgtactgataaccatgtgaaattccaagaaaattctgtttttcagaatgacctcagtgttcctgtctgctaccattttaaataattaatcttattgtttttggttttttttttgtgaagtgtactatgttatcatgttattttaacttgatttgtcagctttattttaagatggtaaccaattactaaagttctgaactttacagttctgatgaaagtacacatatgtttgcgcttcaccaatgctatacaaattcaaattccttttacaataaatcttagtttttcttctcaattagtcattaagtttcctgattattctttaactgatactgtattaatgtactggctatgttaattagagccatgaagatgcaggggtccatcggtgaatgaattagactttttcccttaaccctttatatgcctctatcctcagttgttctgctcaggatatagtag

SEQ ID NO: 40850 - DNA, 1041 bp, Homo sapiens
caaaatatttgataattaaaaccttataaagagaatgtaatgcatccctaaaagcccatttggaagggaagacacagtcaacaaccagcaacttattaactggggaaaaagtaccaaatgcacttgtgtatattttaagtgaaaagaagagaggactcggatgaccatgcttagttaagggggagggtgaccttttatatgcaagttgggaaatacagagaaagtgaaaggggaccaaaatgaaaacacatgaaataagataagcagagatgaaaggtggcactagaactgtaagaagcatttgaacaggcagaacagtgctggagactttaggagagggctcaagctgccatgtggccggtcctcaaatagttctagaatgactagcatatctttttacaaaactataagcaacttgagggcaaaaataaagtatatttatcttgcatcctgaagaataaacatggtgcttggcatttggtaggttttctttatgtgtatatatgaaaagcatattttcattttattagaagattgtggtaaaaattctattgaaaaccatgctataatgtagatagctagacttagttcggtggtttccaaactttttggttcaagtacccatttatgctcctaaaattgttactgacagtctaaaataacttaggtttatgtggattatgtctatcaatatttaccatataagaaattaaaactgagagattagaaaaccaataattaaaaacccattacatgttagcataaaacgtatttttgcaggaaataaaacccctacatttccaaaataaacaacaaacaaaaaaaatttaccgaggctttttttttaacatattttgcaaatcttcagtttctagcttattagaagactaaatttttgtacctcttctgcattcaatctcatattttgttttgtttgaatgtattaaaaaaactcaccccacacaaatatgtggttggaaaaaggaggtgtgttttatagacttttcaaataattgtgtatatccttcttttatactatgc

SEQ ID NO: 40851 - DNA, 1052 bp, Homo sapiens
taggaaagcagggaggaggaagtgaggaatgactgctagtaggcactaggtttcttttaggagagagaaaggtaaaatcagagagtggtgattgttgcacaactctgactacgttaaaagcctctgaattgtacgttttaaaagggtgaattttgtggtatgtgaattatatcttaacagcagttaaaacaaatttaccttatcctttattaaaatcaactttgctagaatttaagtgtgtgtttttgttaacgtcaattgtggccaggtgctttcatcttaaaaaatgaaaaaaaaacaggtcaatgtgtgctggaacttttgtaagcagttaattcctttttaaaattggtgtgtgtgcaaaatttattttaatgcagtttttcccccaaggggacttgttaggcaaatgtatttaagtgtccttttaatgcattttatagcttcagtttattcctttataccacagtgatgttccaacatctgatgaattctggcttttcattaggacatctggatttcacacacacacacacacacacacacacggaataacaaaagataaaacatttttcacaaggtggttatacatatctatactacaaatgtataaatatgttttttcctaacaaatcttgacaatacagaggttgatgtgctgaagagaaacacttcgattaaattggtccattataagaaatgaaaaaagatgaatgtaaaggagtattttaaaaaataatttctttccagcttcatttttttcttttactattcttccttaaagatgactgtaaactggaatatcttaggttaatattatttttatatttacacctctaagtgttcattattttatatctgtccttcattttgacatggctaattttaaccttcaaaataaatatataaataaaccaatgtaaaactaatatcaactttgatcagcttgaccttaactaagcaaatagtggagaaatgaaagtttcttacagaagtttaatgtcttaaaatggggagaagcattttgctttcatctgctccatcagctacac

SEQ ID NO: 40852 - DNA, 1244 bp, Homo sapiens
tggcctaatccaaaatataatcataaaaatatatattttacattttatgtatcagtgtggcataaccttataattcagtatatatcctgaagactttgagttatgcacattgtcatacttagacatagttctcaacctttagaggatcagacagttatctggacagaggagcattgatgccactgttctccagcattcccttagcctcatcttgctaaaagcagaagaggatattgggatgcaaataaagtagaggaagggctctttgccaagtgctgtttattgaactgagtaaacgtctcccccatgggttggagggagctggttcgtttaagtgggcaagaaaagccagtattcttccaagtaatgaggtttcttaaataaatattccaaatgtagattctctgggctgcatcaacaaggggcaagcctgaaaagtcccctcagtatccaggagcccaggttgagaagggttctgttttgaaactggaaactgtccgtagtttggatgggagaatgcttggaatggaagctaggctgtgatttgtctttttaacattcttgacagaaaaagggtgttaaggaagcaggatgactacagtttcaggggatttatttacagctcctaagaaaattaattgtttttttgcttttgtttttgtttttttttacaactcagacaaacattatgctaatagaaaagtatctaaatctactcatgagaaaaattctttaaggatgcatattagtcaacctgttcttaaaactacttattgttaaaaatacttcgtaatatacacaacatattcttttaaaatgttctacagttcagattttaaagtgattcgtagtcatctcaccccacctccagttaatgagattttactgtttatttgttagctacatctaatagaaaggaaaaaaaaaaacaacctttttgataggtgataattacttaaaaatttggatccaaattaagagaacagagctcatcaaaatatggatgtattaacactggaatgtataataatgggaaagaaggtataagaatgacagagtgagaaattttaaaagaggggaaataggatgaattcaatcaaaacaaggaagccaaggtgtttaaatgggtgaccctctcactttgatgtttatctgattgaaatttgacattttctatttactcatttcaaaccaagataaaaatctcaagtatttaaagcaacctattttctgtctagtttgtg

SEQ ID NO: 40853 - DNA, 1061 bp, Homo sapiens
gattgcttgagcccaggaggcggaggttgtagtgagctgagattatgccactgcacttagcccgggcaacagagtatagatttcataataaagattcctcagactgtgcaaaacaaaatgtagatttttaactcttctcagttagtactctttctccttgaggaaaccaagtgggagaagacatagagacaaataatattcagaattaataaaggtgtagcactaagtcgattgtttcctgtacttaaatggttatataataggaaaaagacatatgttcatataaactctcagggatttatttttaaagagcaatctcttctgtgtgacctgtgatcagtagacgttaaactcaatctcttacctttatgcctataatactttaacaattaattgatattcagagtgatggctgaattagctaagcataatcaaaaatgtaattatgctgggtaaattgtaattcataaggctggaaagcttaccagtagtggccacagtgattgaaatgagactcccccccccaaattttcagttaatcacatgattgtattaactaggatgacccatttttagagcatctgtttctgacaacttctaatttgtattactctctatttcaacattctgtttattcagcagggcctgataaagatttttagttcatgtctcactatatttagccactccttcactgcagcctgatgacataatgacaacaatacatgagcatcaggattttacctgcctctgcatcagaaactgaagccattggtgtatgtttctctgggccatttacatgtcttgcctgagtatttcagaggtaaacattgtatcccttttgagtgttttgagtccaccaacctatagggacataactttaaaaattattttcaataactaacattttagtgtttactggtcctagcattgagctaagtatcagctcattattttcaaattgtatgtaaccacccatttggtgggtaccgaattcaattcagtaggtagcaaccagcttaaggaagaaaaccagaccaaccatgaaatagaatataaca

SEQ ID NO: 40854 - DNA, 1073 bp, Homo sapiens
acattttctagttctgtcaatgtaaaaatttccctctgtgtattcttctcagtctttacactttgatcatatgtatctggtctgtgttccttcttcaaatggtgtttctttttgcctaaaaaggttgtaattgcttttgaacatgacttgtttttttaatcaaaactcatgctgtttgtcatagtactgaaaaaaaaaagtacaagacatcaattcatgataggtcttaaaacagtatttgataacaaagtaagtgaataatacattaatcaggctattttttatttcaattgaagcaaaaagcaaacttgcatatccatgaactaatcttttaatgtcacagaacatttatttgttgctgtttctgaagtctttaagttcccttttataaatggggatagacaatttcagaaccacattgcttgatattttgagataagtgagataagttacatacaactatgccttggaaaactgaaaaaatgttatgatgtttgatatcagtgtgaactctgaatagtttgtaaacttcacactccacattagtgcaaatgtgttttgtgaaaatactcctaaagaaacgtagtttcacataaaaggtttttaaagtttcatgaagattctgttgtgggaagtatgtttattttccttttgtattcttgtgggaattcttttgatctgtatttaatattttaataatgaaaactaagtgtatgtaattttaaaacttagtttcgtgaggttttttttagattgttgaggttctgggaaaacactgggcctgggatctaaggatcacattgatcctctcgtggaacattgccatttccccacttaactctggttgaaatttttggcattctccttcgtgtgttgataatccataaaaattacaagtggcttattttgtcacttacagttgttttaggatcaaattaagttgtcctaaatggaataatccgtgtttccacttgatatgattattgagctctgataatgaaaatgatgaacagggcagtgctggctgaatcctccaacaggtgtcattctaggaattgttttaataaggggaa

SEQ ID NO: 40855 - DNA, 1015 bp, Homo sapiens
ttggagacagtgtctgcctctgtcacccaggctgaagtgcagtggcgcaatctcagctcactgcaacctccacctcctgagctcaagccatcctcccacctcagccccctgagtagctgggactacaggtgcaagccaccatgcctagctaatttttgtattttttgtagagatggggtttcattatgttgcccaggctggcctcaaactcctgatctcaaccaatctgcccacctcggcctcccaaagtagaataagtattttgaagtccaagacttaagagttaaataattaagcttaagtttaaaattgcataccaatctacctgctgtattaaactgacacaacatctattttaacaggggaacgctgccttgatgatgacacttacatgaaggatttatatcagcttaacccaaatgctgagtgggttataaagtcaaagccattgtagaagacttaacaagctgcagataaccatgtggacttctgtcataattcttgctgagtcaagagtgtaaataaaagaaatggcaggactcatattattcagttgtacccaagtatttaaaaatgactctcttaagccttaaaaagtcatagatttgtgctgctgccagaattatattaattattattaatgttattattagaaaaaaaatttctggagtgagagtaaagaggcttaattagtttgtgggcagttttcatatgctctgtgaaatgtgtccagatgtgacatagtttttttttttaatatgtggaaatgtcttctcttcccattcttttctcctaaaatcatatatactgtaatatatgctctctcacctctattacctcctcacatctaccctttcccagttaggtttgctttttgaccaaaaagataacaaataccaggtatggcaagttgtgaagacagcacattaaaacatacctaatttcacagtattcctgtcacgacagaatgttagtattcatctctttgaatcatttgctcaaataataacattcc

SEQ ID NO: 40856 - DNA, 1046 bp, Homo sapiens
cctggccaacatggtgaaaccccatctctactaaaaatataaaaaattagctgggtatggtggcaggctcctgttatgccagctactcaggaggctgaggcaggagaatcgcttgaacccaggaggtggaggttgcagtgagccgagatcacaccatagcactccagcctgggcaacaagagtgaaaccctgtgtcaaaaaaaaaaaaaaagagtagctgctgtagaaattttggggacaggtatatagggaagatgacttgggacgtatttagtttaggttagtaaaatgtttacgtggtttgcagttatttctttatatagttaagcagtagttagctgtcgtggtgtaggaatggcttccagaaatactcctaccacccaccgtgccaactctcatgcagtcgcgactcaaaggtgcgaggacaaaaggtcatatcaccatataaacatgtcctgtgcacttgacttcagaagattgtgagaagtacaggagaaataaggtttgaaatgaatggacccaatagttgctctggaaattgtttttgtaaatgtaaaatgataagcagtagatttgattctcattgatgtccagtgaaaatgaaagctgtccgctgcagtgaatacaattataaacacagtatgtactttcgtgtgagtcatgtataatgcaattggtcagagcgcctgtgtttgaggacaagaactgtagcagtagtactactacgatgagtgtacctttgtgtggtgttgcatgttttatgtgtccaaactattggattgcacgttagcatgtacaatggaccttgtcctcacaaaatatggtggttctggacaaaataacaagaagaatttctacctagtagtgcaggggcctgaagaaaaaaatgttccagcaacaaagctatatgtatttatgaaagttgaatgtatgcaatataaaagtaatttaataacataattacatagttctatacaacataatggaaagttaaaaataaatgtaattcctcttatgaatgccttcattccaaattaattttgtat

SEQ ID NO: 40857 - DNA, 1069 bp, Homo sapiens
cagatcatgaggtcaggagatcgagaccatcctggctaacacgatgaaaccccgtctctactaaaaatagaaaaaaaattagccgggcgcagtggcaggcgcctgtagtcgcagctattcgggaggctgaggcaggagaatggtgtgaacccgggaggcggagcttgcagtgagccgagatcgcgccactgcactccagcctgggcgacagagcgagactccgtctcaaaaaaataaaaataaaaataaaaataaaatttggcagtaagatgtgatgttttctcataatccttattattgccataataaattaacattttacagtatttaattttgcatgctgatattatggaatgaaaggagttttaacaaactgattttgaatgtgtttcaagatgactgtagcagtttttgcttttcccaatctttctgtgaattagagtgtatttcatatgtgttgccttcccttgggcatcatctacattttctcttgaacagttgccctgctttattgtaggcagatctttgtagatcagatactcaaagtatttgatcatttgtctgtagctacgtttggctcccatcagagcttgtccttgtctttgacttttcccagtgtggactgcacaaaccaacatgtagtaaatggcttggatcattccaatctccttccctctgaagacacacacaaacacaatgtagaactgcacccctgtgcctcctctccctttcctattcccattccagtcaacacgttgaaaagcttctctgcccttccctggaaccagatacctgctcccactcctgctccacgctagccctccagccattcactctcccgccttgacaaacacttctgctactgcccagattggagtctggttccatgttttatttctctattgtcccaacacaggtcactcacaagagtttgttccctggtggaaatttaagcaccctcaaatgtcttccaagtttctgtgcaaaaaattttctgtatgaaaatgatgtcttttttttttttttggtagctttacctttttttaaacgaaacgaggcttagggtttc

SEQ ID NO: 40858 - DNA, 1022 bp, Homo sapiens
attagaaaagtttcttttttttctttcttcttttttttttttttgagatgcactcttgcacattcgcccgggctggagtgcaatggcatgatcttggctcactgcaacctccatctcctgggttcaagcaactttcctgtttagctgggattacaggtgcctgctaccaagtctggctaatttttttgtgtttttagttgagacggggtttcactatgttgaccagactggtcttgactcctgaccacgtgatttgcccttcttggtctcccaaagtgctaggattacaggcgtgagccaccacacccggctggtgattagaaaattttctaattggtacttggaaagtttcagacactaggaagtaaatgttaagaaggtgaaatacaatgttgtgttaggaggggattaggaagaccgttttgtcattgtggtcaggaggagatgacatttgagttgaaaccttaatgataaccaggtggacatgtgaaaatgtatccacgtgtaaggacgagccacaacacaggaactgaaagaccaaatgacaggggcttggtgagcaagggggagcacgaaggaaggaaaattcaaagaggttagaccctaggtcatgtcacgatcttaaaggccatgctaacagtttggaattgtacaataagaatgatgggaaagcattggagagtttgaaggtgagtagtggcagaatcccacctgtttctgacagaagtccccctggcactggatgaggaatagattataggggctgtgaatgagaacagagattattaataaggaaacagtgattcccttccacaaagtagattctgttaattggtagagagtattcatcagaacacgtagcagggttgggaaaggaggcaaaataagtagaaataaggagtttatggtctagttgagatgaaatattttcagaacattgcaaatgagaaagataatgtcatgaagctaaaccaagtgacatatttatatactttaaaggttagcctgaaaccaaagccaat

SEQ ID NO: 40859 - DNA, 1578 bp, Homo sapiens
tcctttcaagtggcttaggcaggactgtatctactagaagttctcaaagtgacaagtgggaaaaaaaagtttagtcaaatgaatcaagtttttatccagtactcttgaagttgttctacaagtaaacctattctctcctaaagggttaactctagggcatcaacctgaggtaacacaatctcatccttaatatgtattaactagaacagagatttgtttattgatctggcattaaatcatgtgactcttgatcttgatctgtgcccactttttttgttttttttggttaaaatccatgattgggaatgtggtccactttcagtattctgtttgagaatatgctaattaaagaaattattttaattagaaagaacaagcaaaagtgagagagaaggaaaggagaaaaagaaagcccaatcacccaattatgaatgtaaagtgtaaaatatgttccccgtgtcacgtgagaacatttttttttcccttcttattttacagtagtatgtggcaatgtattcaatggagaactgcagctctcagtaatctgactaatctgtttggttgcttttggcagcttggtaactgatggaaatgtatttttgcttaacttactaaaatgctgtacagtgtaataagtaacattgctttgaaccaatgcaagaaatgtgcctgatctcaagccacagtcatttttccatgccatgcaaagatttttagattttcatgagtttttgcaaatggctatagaagctcatagatgagctactatgcttgtgcatgaatatggaatatctaattttattggttgcatgacctgttccttaaagtgggatgaaagctataatccacaggtggccctatgatttttgaaatataaataaatatttaaaatttggttaaaacaaatactatttatgagagccagtcgaaaaaaattccacaaataccatttatcagggcctgctcccatgaaaatggacctggtagtttttcttgtatatttgtctgtataaggacgatctggcagttgcggaggctagaccccacttttgtgcttggcaagtacatgagaccagtctgtggtttatttattctataaagaggctaaacagaagcagcctctggaagcagtaatttttattccttaagaattaaaagccatcactggaatttcctgaaaacaaacaaacaaacaaaaaaccttggcttttccagctgggggttgatcctggtctggctttttcttccagccagtgtgcttctgagtctctaccttcctctattttgtacttgatttcctatattcacagaatgcaattttaggagtagtcctaatcagaaaggtaaatttgctggaacaaagtcatagtctgagtttcaaatccaggtactggaaggaagtgttattagccattttgatgatcagttccatgtcatctttctgataatgtaaataattattcctttaaaaatcctaaatagagaagaaatcagaaccctttaaaatgtaaatcattgaagaagtacgcattgactttattttcaaattttgatgaattcatgaacttactcatagat

SEQ ID NO: 40860 - DNA, 1061 bp, Homo sapiens
cagttccatgatctgagtttatccttccaatacctgtggtttgagaccctggtgtagctcagtgcattaaaattcagaatactttcagaatttggtaaacgtttaaaaattagtttattttatatggtgggtattttcagagctcaagcaatgtctctgttcctgttcactatttatatgctgcctgtttatctcctgtaagggggaaattttccataaagtttatgattcatatgtcctaaaataatccaaaattgtcactctttactagctccgattggtgtcatggaccaaagtcttatgaaggattttcctggcgctgctggggagatttcagcctatggacctggacttgtcagcattgccgtggtacaagatggggacggcaggagggaagtgagaagcccaactaaagccccacatttgcagctcattgaaggaaaggtatggtaaattagcacagtatgtggttttaaacatttacttaacctagagggtatctgttgtattttctgtttcagaaatcaagtatttaaaattagttgttctatgttctctgctggtcatttatgttttcaaatatgcatagtggtctctaacctttgattgttgttcaaagcagaatatttcaatgtaagttattttaatgcaagtaagtaatttactggcctttttgactgtcctcataatcaccttatctaattgaatcctcaaagtagaaaagctatgatgatttgaaatttatttttggtttggtccaagtaaaatttaaaatgtagcttcttgattattttaattattgacttgaatttttttacatcaccaaagataatctttatgaacaaatgtattcattaatgatctataattaatgaaattctcaagaaaaggtaattgttttgtgaatagagagtgagaacatggtgtgttgcttttggctttatcttgtgcgtacaccatggtgaaatggagaagtaacccatattgtgttctcaaatgtgtcactgttatcttttgttaccttgggcagtaacatcacttgaatattgatttgagaagcc

SEQ ID NO: 40861 - DNA, 1878 bp, Homo sapiens
gtcattgttagtgttaaagcttttttaatgtctattgagagtgcttatataaactttactatggaaaatgttgttaaaaatacgtggaatcaggcaacatgttattcaatatggaattccaagtccatatagttcttgtattcatgtctaaatgaaaccatcgttaagggttttggactctctttaaagggaaaaatattgtcttgaatttttgatgttaatagtttggcatttggcccaaaatgacattataacgtcattttgctgcaagctatattgaaaaaggagcttgttagaaatgtagttgatattcacggctaactttatgaaaattagttgaagcagtcatctaatagaccattttgttccagaaactagaactaaaaactcaaatattaaactgtttgcatatataaactattctttaataaagttctacattcaatctagttaaactttataatcccacattctcccagatgtgtagtgaatgtttcactgtgatacagtgcctgtaacttttctcctaacaccagcattatggtagagttctcttaaacccaatttaggcaaaggtatattaaaggggatctgtttcagcactataaattcctgtgagaaaatgcagattctagacaaaactacttttaacatttagtcatacactgtgaattgggttgaatttgttaatttctcttacctggccaaattagagatcacctaaagcaagtgaggaaggcatggcgaggcatttgagaaacttcgaactctggggtcttagggtctaacttaaaggagaattaaatgaatgagatagatttttttggggggaaaggaactgttaaagaaaaacttattctaacacttgttaaaatggtaaggcagactttattcaggactgttgtaataggtataaggacctttgcagtggggttttgcagtaggcaagagagattgggctcagctccagatacgacaaggagaagtggaaatttatagtcaaggagcagggtgggggttagtagatgggaaactaataagaggaaacatcaggggtgcacttaggggaattctggttaaaccaagctaacaggattcttgttgaaggcaggtgagggtgatctgatatcacttgggggatggtggaggatgaggaaccccatcagatatcaagggtaattagttatcaaggatgggggtttcccactaaaccaacttattaacaggattcttgctaaagttggatggtgtgtagatggacacagaagtctaaaacctgaagcctaattgggaagaggattcagaggagcctgactaaagtttggtcaagaaaagactctttgtcttaactagaagatggattttatgactgtattttgggttgttatccaggtcaagcatggttaggaccctgctgtggacaactgcacacccagactactaatgccagttgatgactgtggttgcatatctcttctcaggtgaaagtggttagcaagtagaataaaaagacctggaattctttggtacagctgcttattgtgatggggaggagttcaaaggaacacttagatatgggaatgtggaaactgtgccctgccagggctttctgcaggaagctgtcaaaaattagaaggtttactcagtgaaggctgacaagccagtaggacttgaaaaatgtctctctatattgagctttcaggaaaagaaagaaatttctacataaaaagaactctagggctatcctactcaaagagtggtccaaggaccagcagcgttggctccacgcagaagcttcttagaaatgaagaactctagcgctcaccctagacctgctgaaatagactttattttggctagatgttcaggtgattcata

SEQ ID NO: 40862 - DNA, 1086 bp, Homo sapiens
ttgtaaagtagagggacaattcagtatgttgtacaatatgtagaataacatgttctcttagtaggcataggatatactacattaagaaatctgggctaagcgtggtggttcatgcctgtaatcccagcactttgggaggccgaggcgggcggatcacttgaggtcaggagttcaagaccagcctggccaacatggtgaaaccccgtctttactaaaaatacaaaaattagccgggcatggtggtgggcacctgtaatctcagctactcgggaggctgaggcaggagaatcacttgaacccaggaggcaaaggttgcagtgagccaagatcacgccactgcactccagcctggatgacagagtgagactctgtctcaaaaaaaaaaaaaaaagaaaagaaatctgatatttttgaaatactagttttgcataagaaaaggtagtatttagtagtatttatttagatagtaggatatactgtttttttattttgacaactctcaatttatgtcaattcagctttcactgaatctcagactcatattcttaattgcctactggatgtaggagttggcaattccctctgtctgtcatctacacatttagtacacaccttgtttgttactctttctccccattattctatgaattcctcgagggtagaggccatgacttacttatctgtatagcctccgtatatgtagacattaactgctatttattacgtgtgtgttatatcacacctataaggatctccactctcatgaaaatagaaaatagcaagtgttggcaaggatgtggagagactggagatgctgtgtactatgggtaggaaggtaaactgatacaaccactctggaaaacagtgtggaagttccacagaaaattaaaaatagaactagtggccgggcatggtggctcacacctgtaatcccagcactttgggaggctgaggcgggcagatcatgaggtcaggagctcgagatcagcctggccaacatggtgaaaccccgtctctactattaaaaatacaaaaattagtcgggcatggtggcatgcgcctgtagtcccagctacttgggatgct

SEQ ID NO: 40863 - DNA, 1031 bp, Homo sapiens
agtttttattttaaggtcttttggctggtactcattttgctaggtattagatgaagattctatgatgaggtgaagatgctgggattaggggtcattccctgcattcttactgagtttctttttaaaaaaatactttttataatggaggtgtatgcaaacatagagtagaataatgaatccccacgtacccgccttccaactaattactcccatatggccagttttcatctgtggaccttccaaacccatgttccccattccatgctggattgtcttaaagcacagtttatcacttcattcactctttttaaaataggtctgtgatgagtaagcattaaacaaaatgaaaaccacaatactgttgttacatctaaaaaacttactttcttaaattatcaaatattcaatgtgtgttcatatttatccagttgtttcataaatgcttctatagttaaagttagaatccagataagatctatattatgtttggtttatatgtctcttgaacacagtatcttaatatgtactttgtttctcttctttttctttcagtttatttgttgaaactgtgttgttttttctatattcaattgatttgttgaaactctattgtttgctctatagagtttcccacattctggaatttgttgattgcatccctgcctgtggtgctgtttagtatgtttctcccttctgaatttcctataaattggtagtagatctggggcttactcagattcaagattaattgggagttaggagtatagaatccttcctagttatcagtgtatatttcttactgcttcctatcaagtgatacaatataggattagttttctttttggcatgaagattgatcagtgagctcaggtgtttctagctggactgatccatccatcagtctgatgggaaaagcttgatttcccattaagcttttttgcctaatggtttttaacagccatcggtgattattgcctagatacattatttccttacattaactttttcccatatgttttttcctgaagtaa

SEQ ID NO: 40864 - DNA, 1039 bp, Homo sapiens
ctgaaggcagtcatgcccaaagcacagtgtttcttgtgattaggtacatctgaagcctgttagtaacaatatgaacctgtgatcaattaagcagctgaccaatccttacctccttctccctgctcttgttacccaataaatatgaagggctgtggaagctcaggggctgcctttgctcactagaagcagggagctcttttcttcttcccctggcccttcctttaaaacagttccttttgtttttttgttatttccatgtttgtcccttccttcagtctcgtaatgacggtctcaagtagtaacagtagtaactgttgtagtgaaggtctcaagtagtaactgtggcaatgtgccacaagtggcgcccgaacagggactatcagtgacaaacagagacctgaagagacctgaagggacctgaggaggcctacagggacacatagagataagtagggataaatagagatagagacagatagggaaagatagggacttgcaccaacttggaggaactaacagggaccgtagagacagacagggacagacagggatagataaagactagcaaatactagcagagactagcaaagactagcagagaccagcagaagctagcagaaacttgcagggacagacagggacagatagagacagggtcctatagggacttgaatgaggaagttctgctggaacagaaaaaactaaaaccaaccagacaaatgagaaaccccgttacaagtctgcttgacaacataaggagatgaacaaactgtgtgggtgccctcaaggtgtgtgcgaccatggaatggaagactggagagatccatggattctagctacaggccttgttcccctaatacgagccatgagccagttgaatctgaatgcgaagatggaatgaggaccgaccggagtcacactgacatcaaccctcatgacatggggatagatcaagaaaaccacacaggaagctgagacactgttagtgtcagggtcaggcaaagacccctgactccatgtttgtggccatgctggccat

SEQ ID NO: 40865 - DNA, 1052 bp, Homo sapiens
ctatacgctagattgctaaatggattgaatcaagattacatgtatttcaaactttaatatatttgtcagattactttataaaattcacacactagctgtatgtgaatattttctcatcccttcttgagcactggatattttagtcttttaaatttattgcctgttaatggatgaaaactaatatttctgattgctttggcttgctttccttagactactagtgaggcttatgctctttttatgctctcttctgtcagtttgctgttcaaccctttaccgatttctttttaaaacattcttttattgaattgcctagataaaagtgcacaaacagtataaaactcattgaattttcataaggtgaactgactcatgaaaccagaatcaagatcaagaatagagtatcaactcagaagcgtcctttgcgtcccctcccaggtactgtctgtccccagaggtcaccagtttgctgacttaaatcactctttactaattttgcctgttgtgaattttttgtaggtagacagaaacgctagtgctcttctgtgtctggctttttttgccgaacgggatgtgcaagttggccatgttgtttgtagaaaataatgtgttcattttcatctttgaatttcattttctgaacataccagaattttttattcatttttattggttagctatttctgtgaaccaaaccaacccaaagttcaacaactttaaataagctttaaatgaagaagcacatgttatagtttacaagtcagcttggtggttcttctgtttgtagctgggctacaaacaggtatgtaaccagcttgggttgggtatgcagctttctaatagtgcctgggctctctcttcttgttgggagtcagctggttgtaagcaggtctaggaggcctcagctgaacaagtgggctctcctttatagtatcttgttctctagaagtctagactgggcttgttcaaatggtgatggcacagttccaaaagagagagtagaaactgtaaggccacttgaggcttggtttgggattagcacgccattgctc

SEQ ID NO: 40866 - DNA, 1027 bp, Homo sapiens
tctagatgttgatagcacaatgggattaagaggtgtggtaacattaaattatgaatgacttttacttacatgcaaggaagtatgtaggtaaaatactttcttgtttttttgatactttaaatacattatttcactaggttttcacagcctcccacaaagtaagttgaataaccaccactttccatatgaacacactgagacacagcaagcttatgtagcttgctcaacattacacaaattaggtgaagtagagccaagacttgaatgcagatcttctgagcaatactaatggggctttttccatacaattttgctagccttctacttctaaatatctatccaggccttattatttttttcaagatgcataagttacaatgaaaaataatttgcgtggaagaagtctgatagcttatatccagccatgagttctttaagtaaacttgtcagaacctgagctactttttattttttgacagctttgttgaggtataacagatatacaaagaactgcacagttatagtgtgtaccatttgatgagcttggaaatatgcagacacttatagtgacatcaccaaccaaggtaatagacatattcatcacctcccttgtttccttgagtctctttggttttttttttttgttttttattgtggtaagaacatttgacatgagatctacactcaacaaatttggaagtgcaaaatactatattctgctggactacttttgagtcctacggaattaatgcatagacacaggacacaggactgtgtgagcagaccccaccagaatcttccagagacatcagtccagagatcctggaaagtgacttagatctagtcacatatgagtacacagagactgggtgatttcacccttggggattacaaatgctcattaacaatggatgacacatacgaagtttcatttgtgatttaggaagtctttaaagtaagattagagtaagatgattaggctaaagattatggctgcaaaaaggcttcatgttaaatcttggagatg

SEQ ID NO: 40867 - DNA, 1050 bp, Homo sapiens
atcttttattcctttttttctgcaagtttttattatgaattttatgttgaattttgtcaaatgctttttctgccttaatttacataatgccatttttcttctttagcccattcatgtggtagatacattgattgatttttgaatgttgagccattgttacatccctgagataaactccacttggtcgtggtgtatctttgtatatatagcttaattcttttggctaatattttgttaaggatttttgcatctgttttaatgcgacatactggttggtggtatcagggtaatactagcttcaaaatgaactggaaagtattcctttctcttctgttttctaaagcggattgtatagaattggtgtcagcgctttttaaaacatttgatagaactttccaatgaaatcatctgggcctggagattttgggggagggagttctttttattgtaatttccacttttacaatagttatatggctgtttaatttatctatttcatattgagttgtgacagtttgtatttttagatgaattagtccatttcatctaagctctcagatttatatgtagagtttttggttgtattttttgttagacttttgatgtctgatattccaaaactccttcatttatcatttcctttctgtttagagcactcctttagccttattattattattgtagttccattggcaacaaattctctcagttttctttcatctgaaaatgtcttgattttcccttgatatctgaagaatatttacattagacatagacttgtaggtttatagttcttttctttcagcacttgaaaattgttctgccacttccagccaagaggggtggctcacgcctgtaagcccagcactttgggaagccaaggcgggcagatcacttgaggtcaggagtttgagaccagcctggctaacatggcgaaaccccgcctctactaaaaatacaaaaattagccggcatggtggtgcacatctgtaatcccagccatttgggaagctgaggcaggagaatcacttgaacccgtaggcggagatt

SEQ ID NO: 40868 - DNA, 1026 bp, Homo sapiens
tagtatagatgtaccacagtttgtttaactgttcacctgctgagagacattgggccagtttttggctactataaataaagttgctataaacatttgtgtacaagtttttgtgtgaacataatctagttttctgggtcaaatgcccagcagttatatagtagttgggtcatatagtagttgaatgtttagtttttaagaaattgccaaacttataccaagtagctgtactattttatatacccaccagtggtgtatgagtgatctagttgcttcatgtccttttcagcatttggtggtgtctcttttttattttagtcattctgataagtgtatagtgacagctcattgcagttttgatttaccattttcccttcgctaatggcaatgatgttgagcatctttgtttcatatgcttatttgccacctgtatctcttctttagtgacatgtttcttcatgtcttttctaattggattttttttctgttgagttttgagggcttttaaataatgtgtgtgtgtgcctctgtgtgtgtgtgtgtgtatttttttctagatactagtcctttgttggatgtgtgatttgcaaatatttcctcccagtcagtagcatgtcttttcatttctcttttctgggcctttcacagagcagaagtgtttaattttgatgaagtccactctatccatttttctttttatggatcatgcttctggtatcaagaactttgcctctctccttagatcccccaaattttctcttttatgttgttttctaaaagtattatagtttacgttttacttttaagtctatattccattttcagttaattttgtataaaatgtgagacttaggtctgggttcattttttttgttgttgcctatggatattcaattactccaacatgatatttgtcgaaaaggctcttttttgtccattgaattgtttttgcacctctgtcaaaaatcagttgagcaaaaatgagttaatgagaaatcagttgggcacattcgtgtgggtctatatctg

SEQ ID NO: 40869 - DNA, 1030 bp, Homo sapiens
ggcaggagaatctcttgaacctggtaggtagagattgcagtgagccaagattgtgccactgcactccagcctgggtgacagagcaagactccatctcaaaaaaaaaagaaaagaaatatatgtgaagaaaagttgccaatttgtacttactgatatcttcagagaactcatttttaagaaaaactttaataaaaggtaaagaatgtttaagctcgtaagctgttctttatttttattcataggtaacctcagtctcttgtttaagtcagtaacttatttagtggtgtcttctttcttaaggtcagccacacccttagaaaaattaccaatgaaagttgaaaaattgctcccttaattgtagcattagttcaagaatttttttgaaagaatagtgccatatgtattaaagagatttttgaggaacaaaaaaacacagtcaaaaatttgagggcaatatactactactgattttactctagaaatgaaccaaattatttttagttgctgtagaggtactccactaaatctgtaaacatgtttttttgttttgttttgttttttgcgtctgcagcgcaaatccagaaaaaccctgtgcatcatcattcttatccttgtcattggagttgcgattatcagtctcatcatatggggattgaaccactgaagttataaaggagcacactgtcgcactacattgtctaaattatgtaggaagattcctgtaatcatgtttttttaattattattttaaagctattgtataaaggatggttcccatactttgttatttttattgggggggttggggtggttcctttggattaaatctgatattttctaatactgaaagattttctaaatgtcactgctgacataactcccttggtcttcaatttaatagttgttaagtttttgcccacattgcatatgcctttcatttataatttatttaccctgcttgacttagttttgggaattcgtaaatttaaaggtgtgtgtattctgtttgcatctccctgtcactgtgaca

SEQ ID NO: 40870 - DNA, 1028 bp, Homo sapiens
ggcacatagtagctgactcctccctcccaattacgggctataactatcttttgtcaattgatatttatcatctctacaattcttataattatatcatagattattaagtattagcactcaagtatggttcacattagatagtcaagaaatgtaaataagaagctgaacacttaaaaaaaactgagaactccctcataagacagttttaaaatacatggagcaaacactgacaaaactgcaaggaaaatagacaaagccacaattatggctttcggtacccttctctgaataattgataaaacaagtagatacaaaatcaggatacagaagattcaaagtactaatcaccttgatggtgacagccacttatagaacagtctattcaacaacagcagaacacacgtttttctcaagtgcacccagaacatttattaagatagactctattcctgtcattaatcaagagtttcaacaaactttaaaagattcaagtcatacaagataatattccttgactacagtgaaattaaattagaactcagtaacagaaagatccctggaaaatcccctaatgtttgaaaaccaaacacatttcaaataagctatggatcaaagagaaagccaaaaagaggaattggaaaatattctgaactgaacgtaaatgaaagcatcacatatcagaatttgttggatggtattaactcagtacttaagggagcactaaacacctgtattagaaaagaagacaggtctcaaatcatgacgtcagttttcaccctaagaaatttagaaaaaacaaccgaaattgcaaagtcagcagaacaaaggaaatacaaatcatagtggaaatcgaagggagaaaaaaaatcaatgaaaccaaaagctatttctttgagatcaatagaactgataaacatctaaccagactgaacatgaaaaaaatagaagaaacaaattactaatatcaggaatgagagagatgatatattataaattctacatattttatatgtaaaaatctatacata

SEQ ID NO: 40871 - DNA, 1050 bp, Homo sapiens
gggaggctgaggcaggagaatggcgtgaacctgggaggcggagcttgtagtgagctgagatcacaccactgcactctagcctgtgtgacagagcgagactccatctccaaaaaaaaaaaaaaagaaaaaaaaatacaacacccaataacctgttgcttcacacttcacctacaaggacatgcatagaatgaaaatcaagagatgcaaaaaaaaaaaaaaaaaaattccatgcaaatggaaacccaaaaagagcaggagtagctatacttagacacaatagatttcaatataaaaactataaaaagagacaaggtcattatataatgataaagggtttaattcagtaagaagatataacatttgtaaatatatacgcccctaacatcagggcttccagatatttaaaatattattagaactaaagagaaaagtagactcccaatacaataatagctgaagacttcaacatcccactttcagcttggacagatcatcaagacagaaaatcaacaaagaaataatgaacttaatctgcactgtagaccaaatgggcctaatggatatttagagaacatttcatgcaagagctggagaatacacattctactcctcagcacatggattgttctcaagaacaggccatatgttaggtttcaaaacaagtcttcaaaatatttctttaaatgagattatgtcaaatatcttctctgaccacaatggaataaaactagaaattagtaacgaggaattttggaaactatacaaacacatggaaattaagcaatatgctcctgaatgagcagtgggttaatgaagaaattaagaaagtaattaaaaaaattttttgaaaccaatgctaatggaaacacaacattccaaaacctataggatacatcaaaatcagtgctaagagaaaagtttatagctataagcacctacatcaaaaaaaatctcttctgatggaaaaaaaatagaaacccttcaaataaacaacctaatgattcattctaaagactaagaaagcaagagcaaaccaaatccaaaattagt

SEQ ID NO: 40872 - DNA, 1040 bp, Homo sapiens
aggaacaatgtgcaattgatatgtttttagatgagagagaaaaattaaagctaaaattagctgcaaagaagtattaataatcacctctgcaaaaattctaagttgccaactggcaaagaaagtctaatgttaaaaacaactttgcctttgaaacgttaataaatggatttactttgctaagatttatggcaagtgtcaaaaatagtatctgaagatactgaatcatcatgaaatgaactctacttctggccaaagcacaatgtatttgcagttttctcttttgattcaattatactgcacatgttttaaggaaaagtaacttaattgggtttttcaggcagttgatatttgacctaagctttttttttttttttttttccagttaatgctaagaaaagatttggggaaggttataataaaagtattttgtggtgaccataagaatgtccctccccaaacaagtaaacttgtgaaagtttaatttggaattagtggaagctgttcctttgaaagccaagatattatttaagttgtaaagccagctaataaaatgccttagtttgagcataatacaaactgtgttttgttctttagacatttatgagattctctgccactaacagtaaatatgatttaggggttttgtgggatctttttcacctaagagtttcctagctctgtcacatgaattcttttttatcctaatggcagatccaatttcatctcattcatttttttaaccataacttgcttttcccattctcacttttagaattatacctatgatggccctttctttatcttgcttaccttatagattataagtcccctgtgagtaagtaagagtcatgtttttctttaaagtttcaacaacaaaccccaaggtttatttatttaacaacaggtattcgttgaggtgccttctgggtgcaaggagctttagagtagattttgacctcagctgaacctggaactctgatctgatagactgtttatgataagcttttttttttattagcagcgtgatttgtatatcgatg

SEQ ID NO: 40873 - DNA, 1057 bp, Homo sapiens
ttgctgcaaaacacactatctctacccttgtatggctgagtagtattccatggtgtacatatacgttttctctatccactcattggttgatgggcacttaggttggttccacattcttgcaactgtaaattgtgctgtgataaacatgcattcaagtatctttttgatataatgacttattttcctttgggtagatacccagtagtgagactgctggatcaactggtagatctacttttcgttctttgagaaatctctgttctgttttcctcagaggctataccaatccacattcctaccagcagtgcacaagtgttcccttcttcatcgcatacagggcaacatctattgttttttgactttttaataatggccattctggctggagtaaggtggtatcccattgtggctttgatttgtacttcctcgatgattaatgatgttgagcattttttcatatgtttcttggccatttgtatgtcttcttttgagaagtgtctgctcatgtcacttgcccatttcctgatggaattgtttgcttttttttcttgctgatttgagtcttttgtagattctggatactagtcctgtcagatgcatagtttgcaaatattttcttccattctgtggattgtctgtttactatgttcaggatttctttgctgtgcactagctctttagcttaattaggtcttatctatttatttttatttccgttgaatctgctttgggggtcttagtcataaattcttacctaggccaatgtccagaagaacctctcccaggttttcctccagaatttccatggtttcagttcctagatccaagtccctcttgagttaactcttgcatgtagtgagagataggaatccagttttcgttcttccatatgtagctatccagcaccatccattttcccagcaccatccattgaatagggtgtcctttccccaatttatgtttttgcatgccttgtcaaagattagttggttgttaagtatttggctttgtttctgggttctctattctgttgcattggtctatgaatctaccttta

SEQ ID NO: 40874 - DNA, 1021 bp, Homo sapiens
cctttatatatctgagttcctcactagattgtaatcttttaagagtggtagttaactttttaatttctatgtcattttctttttgacatcagtccctagtatatgttgtagtttttaataaatcaagtgtttgttgaattaatgaattaaagctccactgtcaaaaatgtttatgaactgtagtcatttagagatatctcccctcggggtagtatttgagtaaaaaagatcataagtctatcatgttggaaggatgagttgaagtaaaactatattttagtactaattcatctccagtaatatatttggtgccaattttacaaaatatctccttcataccattgattttgataggatggattatatggccaagactgtgggcttgattttgaatttcagttatttttcaacattattttcttcttatcttcatttttggtacagtttttctcatgggatcttccacggttgtatttgtgtggtttgagtctagctacttatcatttccaccttaacagactttagctacttagcagagattatttctggtctggagcataaaggattatgaagaaacagtttctctgcccttctgtcattgtaggacatcaatagagttggtttcaaatacttttttcctatctgccttctgtagagtatcttctgaagaaaatggtcatagtttccacacacctcaaaaaggaccgcccattgaagatgccattgcttcttccgatgttcttgagactgcttctaaatctgctaatccaccccacacgattcaagcatcagaagagcagagttcaaccccagcaccggtgaaaaagtctggcaagctgaggcagcaaatagatgtgaaggcggaactggagaagcggcaaggagggaagcagctactcaacttagtggtcattggtaatgctctttgtccctctggatcgtcagccagccatgccttagcctgcccactgtctggaggcagcatggaaactctgagtttctccatgggtggaatggacag

SEQ ID NO: 40875 - DNA, 1050 bp, Homo sapiens
attctttcacataaccatttataaaaatagacacatacatatagggatttttgattatgcttttgtaaataaaaggcctattatatttttcattttccttttttccccataatacactgtcaagctagatcaaactacaatagttatacatctacatagcagtccctaaacaatattaatttccttttcctttattaattgctttaaaattcattatatttgttactatggagttatttctggatattggtgccattactaagtcttcttaagccatcttgctcacacatgaattcaaaatggtgtttggaaataatgtattatatctggagatatacaatgatcttattgtatgtcttttttaaaactagaatttttttaaggattattcaaatggagtaacctctccctgtctttaaggtcatgtttctgaaaatcccaaaggtaaaatgtattaaagaagttgaagactaggttgaaataaggattacgccgaatctatgaaggcctgtgtatgtgtattctattgtcactaaaaacagtgtgtggcacctaaatatacagaatattaataaattttgatgccttttaaatttgattaatacagtttaattttcatttatcatctctgattctagaacccttgaagttttcagtaaggtccttataaacctttttttccttatttcagctcatgcatactatgaaatttttatttctcctgaactttttcttgtctccaagtgtgcactatttttctgatttttatgaccagagttgattctcactgctagtttccacattaatttagaagagcactggtacttgtgttagactgcttggatttagatttcaactgaaccaactactagctgtgtggcctttagcaaattacttaacactatgccacagtttcctcatttgcaaaagtagggttatagttcttattttttctggtggttgcaatgctgaatgagccattatagcatatattaagtcattatagcatttcttggtgcgtggttggtacttactcaatttagattattc

SEQ ID NO: 40876 - DNA, 1046 bp, Homo sapiens
ctgtctgtgagccagaaagcgggtgttcaccacacacagactgccttgatcttggacttcctagcctctgaactgtcagaaatttctgtttataagctacctagtttatggcattttgttatagcagcctgaatggactaatacatcctccttgtcttaattaccctctagtccgctgggctgtcttataaactgtacctgctttcatcctatttttagcctctgcagaccaaatatgccccttctgacttttataatttctttttctttgtaaaggcatagatatgctagaagttgtctttatcatatctactctgtcatccttttcctgttaactggttattctgaaatgcatctagctctttatgtacaggcctgctcttctggtcaagtacttttctcatttagcttaatcatggcttttcctctcatcttttaatgtttcactgttatcagtctatattctgttaggagataaaaattgcaccagttattttatcagagaacatttaacatcaaaagttgttaatgaggtattatagaacaaataatgcaaaaagtgcaaccaggatatcaagaaggtagtaagttcaggaagcactttactgtccctagttcttaggggaacaaaaggcaaggttgaaaccaccttttagaagctgatggaggctccttgcagctgtgacttagaccttgaggagagggttctttgctgctttgcctctgaagttcacaagagggactgtggggccaggactcagacctctgggcagggaggcactgcatggctgatgctggtgcctcagaaggtccctgaatcttagagctgggattcagccttttaaagaggggattccgccttttaaagaggggattccaacctactggctggtcgtgttgtctggggagtgaagaggcaaattgaagctggttctgggagttttggaaaaactgaaaacggatattaattgcagttactggaagaaactgcttctggaaggtgaagtgagtattgctggggtgatactggaacaagaagcaaaagg

SEQ ID NO: 40877 - DNA, 1028 bp, Homo sapiens
gaaaaatgtaataacctaattatataaaagtaggcatagccatagactaaatgaaagaatgctatttaataaaattatctgtatccttccgaatcactaaccctgaatatcatccatgaggactttttttcccattcaatgaagaatttcatatactctgattgcctgctcttcatttctggaagttacttatggtttggagtttttagtgtctatatttggggattttatttctttcttgcttacattaacctgtcaatgcaggagcaggccttaaacaattgctaatgatacaaaaagatgctaacaatgtttgagaggcaaactagaagataggaaattagtattttggtcttttttagttgtgtttgtatgtgtttgtgttttacacaatgtcctttattacctgtgctgttgcctgagcacactaagatttggttgtagtcagaagacattattcaagtttatttagtacattttgtgtatttttctttccagtaaagaattgaagaaaagttaagagctgccgaaatgcacagaggtgaaaatgacaaaccaaatggaatttctcttcagagttcagaattttcagatactaaggaggaagaaaggatccactacttcttgttcttatgaatgactctagaaaaatcagaatcaagttgtgggtggaaaaatcaacgtggcctttgagttcagttgttataaaccattgtgactattgttggtcaaagtattggtacttatattgttagtaattgcatcataattacattaccagtgttggaaaactaatgaagaaaacactgtaattgctactcagcaaatgtgaataaaaggtgtttgcgttattaggatgtctgttaagtaatcatttaatattattatattggtaatggttgtatgtgtgatgctatgcccagaatatgaagtatctgtttttgaaattcactttatttaaaagataagcagctgactgggcacggtgcctcatgcctgtaatcctagcaccttgggaggctgaggca

SEQ ID NO: 40878 - DNA, 1044 bp, Homo sapiens
aagatagtgccaaatcttgctgaagaatgatcttgcagaaatctgattgtgaagaaggaaatctaaaaaggccaaacaagcttcagtagagataacaccaggaaagcagttactcaaacaagactgaaagagaaggttgtattccttttctttcatttcattttgtttttatgttttctggattactgaaataattaggaacatatggtatatctgtttcatttgtatattattgaacttaaacatagtaacaatttatattttctttgtgagtgttaaacgaatcctttccataacgtgattatctctaaaaaaaattgcaattcgttttatagcaacattaggttgatttatagattatatatcatatcaaactcaatttcccacagtatactttaatatgaagttaatgtttcagattctaaaggaagtatccgatgctcagggtaaaatttggtacccttgaaagtgcttattgtttttctcacgaaggtgccattaataaaacaagatatactgaacacattttgtagatttaaagagctttcaaattcaaactcttgcatacagatcaatgtgtattactatgaaaatatagagtatactataaagaatatgaaggaaagatgcaggctaaaagatatatttagagcttaagtaatataccacattgtattgggagattaatttaaactgattcacaactgattttttttttttttttttggtcacatacctgaaagctgactttacttataaatgagtgtttgaactctctggagaactacttccttggtttttcatgggagcaaatatattgtcctgatagacaatatatgttcaggacaggcatagatattcctgttcagaacaggcatattctctccccattcaggaagttggtgggttttcagcatgtgaatattgactgtgttgtcttttctcattttttacttactacttgtttttcctcttcttccacagcaatcaatcaataagaacaagtcccaggacttcagactaggctcagaatctatgacacag

SEQ ID NO: 40879 - DNA, 1050 bp, Homo sapiens
ggggtttcaccatgttggccaggctggtctcaaactcttggcctcaagggatctgcccacctcggcctcccaaagtgttggcatgagccaccgcgccctgcccccaaattagtttttctgcgtacctctgactggtaaaatcctacctagtcttcagagtctgatacacctaccacttcttccattaagcattttccatccccacatcagagtttgtctttgtaattatttcactttcaaataatgtcacatttattttatggttacttgtaaacatgtctttctctgaccagactgtaagctccttgctaatgaagactatcttttgatgatctccatatgttctccaacagttcctagcagatatcctggcatttagcaggtccctggtaaatgtgtattgagataaaataaaataagcatctgtctgaccagataataagtgaaaatgacaccttctgcatttctgaaatccagatgattaaaattttccaatcatagttcttttgataactaatgagtaaaattgcaaattgccgtaacaagtaagttttaggtatcttattggtacaccaaggaattgaatatcgatttctttaatttcatatttgcccctaccatcgttgtttttcccccatggagcagtgctcctcaatttgattacatgaattcctttttccaatttcagcactgtatcaagaactgcctcctgagataaaggagcgatcccctcctttaagccctgaggaaaaaactaaaatagaaaaatctccagctcctcaaaaggtaaatgtttttgagcatacgtattacatatgtactttgattttcactctctctggataaaatattactttattttttatgcttattatccttcattgttcacattattttttatgtcttggtacaaacatcattatgaaatacataaggcaaacgttatagccattttccagataaggaaactgaggaggcccagagaggttaaagtagactccaagtcacagcctaagtgatgggacaaggacccaaagtagaacttgtggc

SEQ ID NO: 40880 - DNA, 1081 bp, Homo sapiens
agctgctgaatattatttaattacaggagatagccagatattaaggacaagaacatatttcaagcttgagaagtaaaactagttcaagaatcaaagggagcacccaaggaaggatcccagttaggtcaaggagatcaggaacaaggaaacctgatgaatgttgcctcccacagcttgtttgtgtcttagtcaattttctttctttttttttttttgttttttttgttttttgttttatttatgtatgtatttgtttattgcatattgtgactcttccctgaaatcaatgcagaagttcagttatgccaggacaataggcatgaactgggactatctcgggcaaccctaaatatatgatcaccttattcatcagttctgtaagtcatgatagccaaagtgatctataagtcagaatgggataacctcctgctttacaccctcagtaacttctccttatgtttaggataaaacccaaaccctttcctagggcctatagggctttgcatgatctgctgtctgtctgtctcttcagcatcatcctatggtactctctgttctgagtttcttgaacacaaccaacctttctcccactcacccaaagaccttcgaacatttgatctctctgcccctgaatatacacaaccttttgcataataggccttttcttgagatcccaggtaaatgttaacttttcaaaagaccttccttcacccccattagtctttattattacactttcttttttttccttagcagttatcccaatttggaattttttatttattttcttatctggtcttccttaactggatgtaagttccataacagcatggactatgtccatcttactcaccactacttataggccttcagtagatactgcttaaatgaataaatgtatatatgatgaaactgtaagaataagtaagaacagagagccggcctagatgtatgttcatattttgaaagctggaagaagagccctcaaagaagacaaatggtagaaagggaggcaggagatcagggataatgtagcatctcggaaaccaatgcaagtatggaaatggagtgtgtttttatg

SEQ ID NO: 40881 - DNA, 1053 bp, Homo sapiens
tttgccatcaaaaataagtccaggactagatggattcacagctgaattctatcagacattcaaagaagaattgttaccaatcctcctgacactattccaaaagatagagaacaagggaatctttcctaaatcattctatgaatcccgtatcaccgtaataccaaagccaggaaaggacgtaacaaaaaaaaaagaaaactgcagaccaatatccctgattaacataaatgcaaaaatcctcaacaaaatactagctaaccaaatccagtagcatatcaaaaagataatgtaccatgatcaagcagggatggtttaacatatgcaagtcaataagtgtgatacacaacttaaacagaattaaaaataaaagtcatgtggtcatctcaagagaaaaagcatttgacaaaatccagcgtcctttatgattaaaaccctcagcaaaattgatgtagaagggacataccttaaggtaataagagccatctgtgacaaacccacagccaacattatactgaacagggaaaagttgaaagaactccccctgagaactggaacaagacaaggatgcccactttcaccacttctgttcaacataatactggaagtcctagccatagcaatcacacaagggaaagaaataaaggacattcaaatcagtaaagaagtcaaactgtcactgtttgccaatgatatgattgtatacctagaaaacgctaaagactcatccaaaaagctcctagatctgataaattaattcagtagagtttctggatgcaaaatcaatgtacacaaatcagtagcactgctaaatagcaacagtgaccaagctgagaatcaaaccaagaactgaaccccctttacagtagctgcaaaacataaaataaaatacttaggaatgtacctaaccaaggaggtgaaagatctctacaaggaaaagtaaaaaacagtgctgaaagaaatcacagatgacaccaaaaaaagatggaaacacatcccatgctcatggatgggtaaaaccaatattgtgaaaatgaccgtactgccaaaagcaat

SEQ ID NO: 40882 - DNA, 1032 bp, Homo sapiens
atttccatttctcttaaatggaaatcctaaaaaataaatgaattatagtctagacctgaagattataacagataaaatgaaaattcattagatggacctaacaacagataacagcagataacaacagataggacaccttaaaagaaaggaccactgaactggagggcaaaacaataaaaattatacagattattcaaattgaaacaaagatgaagaggaggcatgggaagaagaaagagtcatatctgtgtgtccctgtgaaatggattaaacatgcaactggaattgcagaaggaaaacagaaaatatgggtgaagaaatatttgaagaaataatgggctagtagttttcctctaattaaagacaacctatagacataaaaagcttagcaaggagaagcagtcatcagcatttaaagcttgtttccataactgtgttgatgctgtctcaaaatggcagataggaggcaggactaacttgcagctcccacttggacggacagagcagtgcacagagaatcacactgtgaacttttgctccaagaactactaccagaaaagccaagagaatccacagacctgttagagggggcagcttgctgctacatgctctgtgagacagctgaaaaacttagtgcccaaagagtgagagagggaatgtccacccctgaacacacatcctcactggggaacctgaaggtccagatcaccagaaaaggatttgaccttacctggagctgagacaaatttagagagccgagtgaaatataggggtagaggaagcagtgggaagagccctgtgggcactcttggtcctcagggaagccattcctgcattcctgactgtcttgcaggagtccttggggagggctgccagtggaattgaagaaagacaacaaggagaaggaaacttctagctgaagtctgtaacaatttcaactgaaggcaaagtttcctggacagaatccaaaggagggagcaaatgaggagtgcagatatgagcacagaatccacagcaggtgggaaggtgcaa

SEQ ID NO: 40883 - DNA, 1050 bp, Homo sapiens
aggtggtacaataggtaaaaggcattaattcactattgtagattaataggtaatctacaaaattaactgatttctataggcagatgcccttaaatgtcttttatggtactaaaaagaatcaaaaatgtttttattatgcagtttttaacgacaagaatttgttttccagacagtcactttgctgaattcaacacatgtatattatggtggaaaaagcactagactcagggtcagccagccagaagaactgagccgacctgggatcccaccacttcctaactgttttgttaggtagttcactttctctcttcggataaatgtctccacatttcctacttcatagaattgtcagaatcaacacaatacatttaatactttgaaactcataaaatattgggagaataaacagtatgaggttatgggaggcttttttgatttttttttttagtttgaaattatacagtttgttttattgccaaaagagtggaagatattttaagatacaacttaataaaatttgttaagtgatgattataggaaaaggaacatgtcaaagagacaaataatggatatagtatttttagaagcatgccaaaaaaggcattaagatgaagtaatttcaagaagaaagttgtcaagcatcttaaacttgagtaatccactagaacacttaactttccaaactttagctttctacacgagtaccacccttaagccgtctttggcatgtaatgagataacattgagattttaagatgattaaaatcaaagtattctctcatctgtgtaatctggccaaaatctacagggcatgggttcggttgggggacaatcctttattccacagacattaaaatagaacaaaagcaacaacagaactccatttgctagcctctgtttctcttagaatttgaccatctctaagaacataatccccagaggtatcaaaaaatcttgagatacttcatataattccattttgcaacctgtagtttttcctctcttaagaaaatgcttttcaacaaggtgctgtgtctcatgcctgtaatc

SEQ ID NO: 40884 - DNA, 1085 bp, Homo sapiens
ccataagagggatatttatatccctgcacatactatctcagaagcatgaccattaagccatttggttactaatatgtctaacctcattttaaggcgtatctttcttagaaatgtcattgagatatcactgaacagaaaaatttcaaaagcataatatgtggtccatctcaaaatggccaaattaatctcttttattaagaagccagtgtttatgaaaaaaaatcctgccttaggaaccaggtgagctagttttcagacctaactctatttctaaacatggaatcttgagcagtttcttcaggccagagttttctcatccctccaaataaatgagggctctggctatggtgagtttctgctttaaaaattctgtgattctattcagtgttcaaatcagtttgtaaagtggataaataattaagtgttgattgtacgaataatctattagaatctgaaatacatgactacaaaaacaaatcatgtaaatagaatgtttaaaaataaaaatctcactgaaaacctatctgaaatatacaagtcacatctgtcgatatttgcctttggacagtataaaagaaagctatttacacagagctagtaagtatgagcccattagcgctcatgctaggagacttaagagtaggggttgattttatatatatgtaagtgggtttacatgctagagtgctagactctgcagtgggtttatgttctgttgtaacttttattgatctttttcaaggtgagttctaggtaacggagactgctagaaaagtaagcatttctctcttctttgatttgtattcctcacaatttctagaatgcttcatttattcattctaaaatcattttaagtgaccaccttgtttaaggccatctatttagcatgtggagtaaatgttacagtctctgccttcaggaacctctagtctggctagggagacaaataagtatgcaccaaattaagtcagaatgtgacaaattctgaaatcacagtgtaaacaaagtgtcaccagaataaagaggaataggagagctaaaatattctcaaactttatgtgttccaatggaactcttgggttttt

SEQ ID NO: 40885 - DNA, 1075 bp, Homo sapiens
tagtaatccaggaaattacactgtagtttctgatttgttttcctaatacaggtcaacaaaaatctctcatttacttcaccaccagcagtttcctcacaacagtctaagttaaagcagtcaaacatgctgaccgctcaagagattctacatcagtttggtttcactcagaccggtgagcccctttcttactttgacaattcttttaaatgttcagatgcttgttgtgttgatgaatatcacttatttctttagaaataaagctcataatggtcggtttttacacttgacaaattatattctagcatctcttttgtccttaaaatcaccaaggttatttcaaaagtaagtttggaattggtaacagtagatacactgaacctatgtgctattaacagataataatttaaaactagcaaaacacgtgagttttaaacctgcatgatgttaaatctgattcagtttcccaattagataaagaacccatcatagatggataatcccatgttataattcatttcaaggaaagccaaggtaaaatacattttggcagaaataggatgtaacctgtagtgatatcacatcccattaaagggcaaattaacaaaatatgcaaaaaagcttgttacataactatactgaatcactgaagtgaactatacaattgttttggcaaatattttaaatgagtttcaataaggtttttaaaggatgtcaaaggaaaaacatctaagtgagaaatgtttttgtggtattgaaagatgactttttctgttcattagctatatgtttttgacagtattttttctattactgaattcttttagaaaggtaagaaagctgaaaataacaattatcttttacaaaaattatatgaaaaagaaaatttgcgtatgagaagatcagcataatttacttagaaatttgaggacaatatataccacttttttaccttgaaagtatttggaacttacatatacaagttattttaatattgctgtataggttacatgttatagtgagaaaatgcttggattcacaactcttatgctcaaccctggctgtgccttttataacc

SEQ ID NO: 40886 - DNA, 1081 bp, Homo sapiens
accctagaagtaaagacataaggataggtgggagaggtccattctttcataagtttggaaatgagaagttcaggggttcaagaccaaattttctctgtgaagcaaggcagtgaactaagagagaaaaggaggtaaaggttttgagaaaaccaagatgcattgaggtaaattgctttaccctaaagaatattgctggataattggtttgagccaggactagatcttaattttgaaattgacatgaaagtgtcatatcagtaatctgtgaaccaccagtccttggtacctatcagagggtcaaaaatcacgattaaatataaccaaaaaactttatagtgactgattcaaatttgaatactggttttagctaatgtagtagtaatgaactggtttgggggtaagatttttctggtatcttattgctgtagaaatttttctttaacagttacagtgttgtcttccaaatccttcacttctctgtcctggcttgtaaagaaaacatctgaggactgaggggtcatatttgaattgctctttataataccatagactactcattgcttagactttactaagctagaaatcacaagagcataagctactcttaaaatttatattatgagaatgtaaaagatacctgacttcaaatatcttgaacctcactttggctcaagttttctgtttaactttttctttaatactgatattttaatttttacaacagatacatgatttgcaaaaaaaaaaaaaaaaaaaaaacatcctgggtattattggtttctttttttctaatgccaccagaactgccatcagattaaaatattatctgcattattattcatattagtggaaaaatatgacagctgtctgggagagagatgaatttgtgaacttttaagtatacagacagcattaacattctttcggttataatttaaaaccaacttgagatatgatatcatcacagcttgaaacttcataaacaattcttcaggtgaatgtagcgtgttatctaaaattagctaaaagggtagacttgtaagtatacatggaaatgagtactatatatctcccaaaggtt

SEQ ID NO: 40887 - DNA, 1029 bp, Homo sapiens
tgcaatacgatgtacatacgatacatctacaaatgtagaaatacatttgttttctacgttctatatggcattcatttgtaatacttatgaatagttcaaaagcacattcagataacataattctcatacttatacaagattatgtcattaaaatatacctaatagtagggcagaattttaaatatttatttttagcctggtaggagaaattaaaagatagaaatgccacattttaagacatgccaaaactacctgtttcttggttatatgctgaagtacctattttaatattattcacataataggtactttgatatgaaagtttatatcattcaagaactcaagacatatggaaaacttaacttgatagttttgagcataaaccagagccctgacttcctctttaagacattttttttaatgtttacagtggtgtttttaattgcactaatgcatgaatgatatgatgtaaaatagacaacaacaaagactggagtaagagagcgctggcattctagacaaaatactaccactctgtatttgaccctgatcaaataatttacctttctgcacttgttttgttctgcttgtaaaattagaatagcatatattctattttatatcaatatttttatcaaaggataaaatgaaactataaaatgaggcatgaagcataaatacaggcatacctcgttttactggtgtttgctttattgtgcttcatagatattgcgttttctacaaattgaaggtttgtggcaattctatgttaagccagtctgtgggcgccatttttccaacattgtgtgctcacttggtgtctctctgtcacattttcgtagctctcaaaatatttcaaaccttttcattattatgtctgttatggtgatctgcggtgagtgctttttgatgttacattgtaattgctttggggcaccacaaactgtacccatataagatggcgaacttaattgataaatgttttcagtgttctgactgccccacccaccagccgttctcccatttctc

SEQ ID NO: 40888 - DNA, 1048 bp, Homo sapiens
gggcgcagtggcttatgcctgtaatcccagcactttgggaagccgaggtgggcagatcactggaggtcaggagttcgagatcagcctggccaacatggcgaaaccctgtctctattaaaaatacaaaaataagccgggtgtggtggtctgcatctgtagtcccagctacttcagaggctgaggcaagagaatcacttgaactgggaggtggaggttgcagtgagccgagattgcgccattgcactccagcctgggtgacagattgagactctgcctcaaaaagaaaaaagaaatatgctcaaattgccttatcttaaaaacatcattttcagttcttcctgccttctagactagcccattatttttctttttctacaccatcaggagtattctacacatactgtctttacttcagcccagttattctggctttctttcccaccatgctacataaacttctttcttcagaggttggcagtttcttgctatttttaaatccatttggacagtttaactcctgctctgcttgccttcactgtagtaattgattattgaccagtcttgaaatattttgaattcatagttttcattgacaacctcttctcttctctttttattactctgaccagttctatccattgtctttctctgatttattttcctctgccgatcgtctatatgttttatccccaggatcctttagctgatcatctcctggttttatatgcttatcctagtttctcttacctttcccagctttgactcttgctgatatgctaatgacttctagcgcacaccttttttatgaatttgacttcctattacacgtttccatttgaatggcccattgccacctcaaatccaaaaccaaacttacccacctccttaaattttgttttcctcttttaattctcttacatatattttaatggcatccttatccaccatctcccaagctgaaaactcagagtggtgttcatctcttctttctttcccatcatttctttcacatctaactagcactaaagtctgccaattctccctccta

SEQ ID NO: 40889 - DNA, 1004 bp, Homo sapiens
tggattatcaacctagaactgtgaccagaattggtagatgaccccagatgaaaagttgctcttggtccttagtgtaaattgaccacaccctccagggcttcacctttgcctattttgttttggtccccttcccctggcagatcatggtctgctagcaccacaagcctgggagatttcactacctctctagcttctctgtagcatcagaattcagttttgtgagaagaattggtcatgtgtttgaggcttctcaaatctccagttttatcattttagtcctgtggaatcactaaaagttttgcttatttctcattctcctggcagtgactttctgcctaagccaaactctcatcttcagctcacaccctgaatcagcaaatgtccccagagacaaaaacagctgccagtccatcagctgacctctgactgattctccctttctggaattttaatctgtctactatatcttctttctgtacttttctgatgcctttaaaatttaaaataagatatttgtaatttatttggctctttccagttgttacccaaagtgtttacctgctgcatcctactgcatcccacccagaattagaaattctagttgtcatatatattctacttagaaaatacctggataaagttacttttctgactttgactctcttttttttctttttgtgtttctcctacttattaggaaaaatataaacaaggatttttcaccttatttgtaatgtattagcaaatgtagtattttactttcacactatggtttgctgttgtctggctttttctttctttccccctgaagttcctttgaacacagtgagatcatcacagatcttaaagattaggttatatgtaaatactactatgggaacaactaattataacattgatttttttttccatgcgtgtagttgcagataataatgaagatgttgatggtgatggtgttcatgaaataacaagccgagatagcccggtttatcccaaatgtttgc

SEQ ID NO: 40890 - DNA, 1050 bp, Homo sapiens
agattactggtgtggtaaggcttgataaatgctttataaactccctcaaacctttctttactgtttttttgttttgtcttgtttttgtttttgtttttgtttttgtttttgtttttgtttttcccttgtctcccctgggaaaatgggaaattttacagttggtaaatctaagccaaaattattttgaaataaaggaattctggatgtccagtttagtcctcgttttcttacgttaatctgggaccttatcacccataatatggtgattacttctctttctaaaaacatagtagctagtaaataagtaaaaagaattgtcttttcattcactttaagtaagatgtggtataattcttaccatgtgccatcctgtcagttttaacaaagcattttcacagaaatttgtgtactaagacaaactgacacattttgactcatacaaatggcaaattagtccttaaaaattctgtgagagaaataactctgtgtgtacatacatatgcatgtaaagtgttgtgtaagatcattggtagcttaattatactggataattgtaatgttatatacaaatttcttatataaaagtatgctgcattattaacatttgtttaacttttcttatttttctttttctgggtttcaactggaatcccattggtggggatgtaccttaagtttccttgtggaataatagactttcacatccagaaagagaagttcagaggcctttctcaatttacagagttgaagaggaaaggcaaatggaggaataaacttcattgtcattgggattaatttggctagactcaatctcttgagccttaaaatgagaaagtaatatccattacatgtttagagttctcaaatagttgatactattattaaatgtttcaaattttattggggtagatactaaaaattagtacactgtcctaatgaagtttaaatgaacaagttttacatttcttaggattcaggaatatatggaatctagttgtatttaattgacttgagagccacagagattgtgttgatttatgagctggactc

SEQ ID NO: 40891 - DNA, 1683 bp, Homo sapiens
aaatagaaaccccatttctactgaacatcctagttttaaacagaagaaaaactgtaatcctggggttggtatgtaggaggtctatcctgcagaataagttgatacattagtacctgatttcatatcttacatatttatttgagctgaacattagtttgtagtgtaactattagtaaaaatagagaaacacagcatactgttcattaatagtattttaaaaaaattgtttttcaaatgtcaccaataaaagttttggcaggaagcttgttgcggcattgatctaacctttttcccccccatttcagttgcagtttttgtagaatggctttttctttttcctcttaagagttctattcttcaggtagataatttttcaaatgtgaattatcttttgtgtctatattgatagctcttaaaggagtgaaaatctaaaatagtaaatttcaatgttaagtgtctgctttatgggcatatataaaagtagacacatttcatttgttaatttagttgtgtgtgtgtgttaaaaggagctaatgcttattctgttaatgtaaacttttgaagatcttaagtgtattgctctttcatcttaaacactttcgaggatttgcagtgcgtctagcacctagattacagccaggaacattggttaagaactgttggaaacaaaactaaaagcaaactcaacatatgtgatgtttatggccctcagatccttagtattgtgtgattttcccccgttaacatgtctttctaaaattgtctattaaagcagaggaaatacctgccaaaggaagtatgtattgcattaatcagggcataactaatattctcctgttcagaataatacttatttacgtgtgaaagcaacatggatgtgattcccaacacagaattttcatgacccttttattgtatacaaataaataccataacagttacttggttagacatcaaatctgtgtgcatgactatgtgcttatccacttaagacaataggtaaaaggggatctgagaaattatgtaatagggagtgggaataaaactacttaattcctgtgggcaggttatattttaagttcaaatgcattgctttaacctttggttacttttattctgttaaacagaattgaagaaagagtattataccagagtgtagtaggctagggtgattgtaagaactctgtaatagaatgtcattgtggatgttacctttttcagatccaagcatataaaaagcctgtatattttttaaaaacacatcttaactccacgctttacgatattataaaagttgaatggttcctcttggtaaggatatttgcttacaagtgctaggaaataactcactgatacctgcgttaacatactttgttttgcctagagaggggcaataaaaatgaaccaaaggatatttccagaaaggattaagaaagctgtttaagaaggccatgactctttaggtgtgtatgtgtacctttcagcatcctaggaatttttatactaaaagcaaaatgttttttccagttagtcttcttcaaggaattactattgttccttttgtcacaggtaaaatcagtgttgggaattataatttgagaaaaatattacccagtaacattgaatgtagatggctaaacgattcttactcagtgtgatgtataatgatgcaacagggaccct

SEQ ID NO: 40892 - DNA, 1049 bp, Homo sapiens
ctgtcttcatttagaaatgccattttgaggtctagaagcatctgtataaactaggtacttttcttgacttcgagatcaataactgtacctagtccttaaagaccaagagtcaaggaaagttactgatttgtaataacatttctttaatcacttagtttttgaaaaggtaccttaacgccttaataaaacccctgtatgttcatctctgtattacagttacattcattttgcctgctttcttcaaatccttgcttatatgggtatcaatcatagaaatcatataaatatttcacatagcatatacattatccccatgtttctgtaagtcgttataattattaatataatgacttccatggtagtgcatcttcttgcctgtttaatttcaagattcacactcctaccttgagcgagtatctagttgggttttggtggagttcatttattagataatttgggaaagagaagagctttgcttgtatggtgataggtatggctgaatacttggggcttctatgataattcaaagaaattagacaacttttgactagtaaaaaggaaaaacaacttgattatttaaaaatattagttcagtccatgaaagtacagtattctaacacttaggttgatcatttcttaacctactcaacttttagttggcagaaattttttgcctatgatataaaatggccatccttttcatcctcaatggccatgagatttagataggaaattagggcatatgttttttgttactgcagtaaaattagaatttgcatgtaactaaataccttttgattgcatcactaaacaactttgttaatgttaatcagtttcgaattagaggcagaggaagagccagaggagtttttgctgggacaaatactggtccaaacaactcaaatactacttttcaaaagagaccgaaggaagaggaatgggatccagaatataccccaaagagcaagaagtacttcttggtgggtgttagacatctgtgtttatttggtttgcattaattttcgaagcatactaggtgaataaatttg

SEQ ID NO: 40893 - DNA, 2507 bp, Homo sapiens
ggaagagagagtttttaaagaagaaaatcaaaaggtatgtttttgaatgtaattttttttcgtgttaagttcagcttagttaatgatattgtaccaaatatagtttctcaaggcaaaatgtctatagatatcttctacttttaattcataactatattatggtagtgtacatactgtttcttcctggaagaaattaaggtgacactatactaagtgtcttaaatttaaaccaagagtgttttttcaaaacactaatgaaaggaaaaaaaatagtcctaagaaaagtgtaaagaatcagtgggtagacaaagggaaattataaaatcaaagatacaaattagaattttgagatgagattcattagccagagtaaatatttctcgatttgtgtgtctaaattaatatctctaggttcttcacagataacaagaagtaatccccatgctactgagcatttttgatgtggattaagaaataagcattctaagaactggtttacaaatgaacgtttggaacaaagacttgtcactcttggaatgtttggggattgggggaatgtcttttaaacatgagagaggagcctgtgaaagatattgaggggtcttggtgagaatggaattcagtggttaaggggtctccaatatactcttgacaattcaaaatgacctttgccaggtagactaatctatatcaggccataaaatgtctagtagtagaaatgtggggaaaggcagaaagggagcaactgttttgaagagattaggggacttggaagtactgcttggttccaattctggctgtcactaagtactatctacatgatatttggaaaataacctcttgaaccttgcttttctaattagaaaaatgagaatgcatctgttttgcagagttgttgaataattgggttattttgaaaataggcacgtttgttactagaagctgttatggacagtggtagtatacaagtttaatagggcatgctattaacttactagatgtggaatctagagcttacaaacaaggtttttttttgttctgttattttttttgtttttgttttgcatggggcgtattgatgttgaaagaacagattctgagtagtgaatactttttttggtttttaacttaaataatatcttgggttcaaagttgttaatttagttttcccaacagtttagtctgtcctcgtgctctgacagtgagtatcttctctcctcattacatagaccagattttgatccagaggagaaaaagtagagataattgatgaatagacaagaggatatgccattggtttttatcctcctgtctggatgaataacatgttaatatgtaattatgtatatatcgtttgtaatttacaaagtagtttcatttacattatcttgttacttgtggacttggtaatacctaggtgaataggaaggtttttttgctcttgattagatttttttctttgtgactctgggagcaaataggtgagtagttgatatcatttggagatacgtactttcagttttatgaatgcttatgaatattatagccagacttcccagagtaaatactacttattgttgaatactagcaaggatgtccacattgcttagcatcttactgatgtataatttctcttcattcctagatgcctctttccatcttcctaaattatatagtatttgaaaaagcaatggaacaagaaggaggtgaattgtgacccagttaaactaatgtccgttgcaatacctgaattgagaaagggcagtatatggcccaagatactgagtacaggattgcgaatatctttctggctttgtttctacccttgttcaaccaattggtttcattaataatattttacgtgcatgttatggaaattatagaattcttacttctgaagtttttttttttattgggttggtcagattatttgggaagagcttgatcataatgaggcttaagtaatgagaaccattatgttaggatctcttttatttaggtagaaggctacattacaactacagattataacatctgtcattgttcaactattgaaaacagcatttggaaggatgagggataataaggatgtgctgagtggaaaaaatatttgtatcatttactgtacaaaaatttattatagattgttttggataaaaacctgcaaaattctcaagataattagcttttaataatttccccagtcccactgcactttgtatacacaaatgtttagtaaaaatagtcaagtacattttttaacaaaaactaagtgatagtatcttatatgattcattattttctgatactaaaatgccagtttagaagctggcataaaatttaactctataatatgtgtatatatattttttctatttctcccctgaaatctgtattttatatctgtcttttatagggagataaaaaattaaggtgtgactctgctgaccttcggcatgacattgatcgccgtagaaaagaaagaagtaaagaacggggagattcca

SEQ ID NO: 40894 - DNA, 1048 bp, Homo sapiens
caaagattttcaagtatgtcttttgggcagttaggttaagttttgtttttgttgttttgtttctgtgtttaaaaagcaacttactatgagacatattctttctcaggaacttcaaagactgttggcctttaaaattaatcccctccccgcttttaaaaaatctgtcgtttgacatgagaacagctcaatgtaatagatgaaacttgcctctagcagttctttatgcagttgatacatcagaacagtgaatagttagatgaatttcttttgggctgtaattatttaaacacggtaacaagacagttttgctatttggctctgagtaggtttgtgaaccagtttatgaccatattactgtggtacataaaatatgaaacattcttttttttttaattttttaatcttttttggcctagctccacattttacaatttattactgaattttgagatcaggttttgataaattttttcctttttcttttttctttttttttttttaaaagaactgtagtaatgtttcataattggtattgtgcaaccgatctgaacagctcttactttatatagagctgaaaatgcccagtgatgttttctttttcattgtaactaggtcctggaatatgttttgaaatggcaaaatccatgtttcaaagtaaaatagctgttgaaagatacaggcaaagttgaatcttctgtcttcctggcaaaaatggcataaaaactgagttgctagctcaaattcctgggtttcatggaattatgattgaggcactacccttgtagtggccgtttcaagttttaatgattggttatgagacatgtgctggatattgggcggtaagttgacaacagatgtatgttgacctgttaagcagatagcttgcttcataatgtgacatttcatagctcatgactttatacgtctttctattttacatttacaacatatcttgaactggttttaaaaataatcagtattgatattactagtttgaaaattgtttaaagagagacaaaacagcaatatcaaatttgctgttgggttt

SEQ ID NO: 40895 - DNA, 1054 bp, Homo sapiens
gattgggcaacacatttaaatatggaagcgatctacagtgaatgcaatccagagttactatcctcttctttgcttattcgcaggttcacagatgaagagtctagagtattcctgcttgataggggtaataccagggataaagaggcttcaaaagagaaaggatcagagaaagggagggcagagggagaatgggaagatcaggaagctctagattacttcagtgataaagagtctggaaaacaaaagtttaatgattcagaaggggatgacacagaggagacagaggattatagacagttcaggaagtcagtcctcgcagatcagggtaaaagttttgctactgcatctcaccggaatactgaggaggaaggactcaagtacaagtccaaagtttcactgaaaggcaatagagaaagtgatggatttagagaagaaaaaaattataaacttaaagagactggatatgtagtggaaaggcctagcactacaaaagataagcacaaagaagaagacaaaaattctgaaagaataacagtaaagaaagaaactcagtcacctgagcaggtaaagtctgaaaagctcaaagacctctttgattacagtccccctctacacaagaatctggatgcacgagaaaagtctaccttcagagaggaaagcccacttaggatcaaaatgatagcgagtgattctcaccgtcctgaagtcaaactcaaaatggcacctgttcctcttgatgattctaacaggtaattccatattgatgcccagtaaataatctgtgggcagtcagtattccagttaattatcttaaactttctgaacataccatttttatatttaaaccaatggtatattttgtgtgtgtgtgtgttatcaatatgttccagacctgcttccttgactaaagacaggctgcttgctagtacacttgtccattctgtcaagaaggagcaagaattccgatccatctttgaccacattaagttgccacaggccagcaaaagcacttcagagtcatttattcaacacattgtgtccttggttcatcatg

SEQ ID NO: 40896 - DNA, 1023 bp, Homo sapiens
caatcttgcttggctttttgactttgctacttttttagtgtttcccttaataggttccgattcctccttcctaggctgaacctcaaatctctccccagttggagggccatggatattttaggagacgctattcttgattcaccagtttaatgttaccatttcttctttgtatttccagtctcgttttatttttaaaattggatcttggtaagagttacagatttccatttaaacttgttcatgaattctttgagtgctgatgtatattaatcttgtattccttagtttctgttcgcctggtgcttttgactatcctttgcacatacttgatgtgaatatacataaagctaaacttttcagtattggtaacttgaatattttgtgcaaagtttatttacagattaatgataaattattttaggaagaatattgactttcagtagataaaagtttcattgctgactgttcttttatttgaatgtagacgtatcaagatgcttttaggcacagaatttaaagttactatgatggctgttaacgtggatttaaaaatcagtttcacatgaaactaaattgtgtgaaaggaagtaccaaaagagaataagtagcagagcattaaactcatattttagatgttataaagtagagcattatgaaaattaactacagattaccttttttttttttttttttttttttttgagatggggtcgtgctgtgttgccaaggctagagtgtgttgccaaggctagtcacaggtgtgatcacagtgcattgcagtgtcaaactcctgggctcaagtgatccttctgcatcagcctcccaagtagctgggactacaggcttgtgctaccttgccccgctaccaagatggcattatgttagctacgttggaattttctgatggaacgacatatcatatgttttttaaggctcaaattactaaaattagaattcaagtagttaaaaagatgctgtcagtttcatgatacgctactgcattgtggtttacaaaaaagttga

SEQ ID NO: 40897 - DNA, 1047 bp, Homo sapiens
cgcctggctgatttttgtatttttagtagagacggggtttcaccatgttggccaggctggtctcaaactcctaacctcaggatccgctcacctcggcctcccaaagtgctgggattacaggcgtgagccaccattcctggcctgataaattgttttctagctggtttctgatcacttatgttctagctggtcattatgtattatttcatgaaagataggctctgtttagatatttaagaaccttatttttaaaaataaaacctgctttattttatcctgtgttcctcattggttggtctgtcaattggctaaagatacatatggcaatttattccttatttctgtatacaagtgggaatctattaacaaatgatcttggttgtaataaagggaagattaatttggcattttcagttttgtatttgggttttggaaacatcaagcaccttttagggtattgaagagagagcaccggatttggagtcaggagatttcagtcaaattttggattaaccatttacactccgactgtgggcacgaaaaacggcaaacacatcttttgttttctcccccaaacttgtcctcccagatgcttgaatctaaaacctagaatttaagggcactagtgatttttcatttttcctcactctctgtacttcacacccctaacaatccattaacaagtcattttgacaaaccacatcttggatttgcctctttttttcattgctgtttattttttatatagcagccatcttaaaatgtaaatcagatgagtgactcacccaagcaaaaaccctgcaagggtttctcaaccgagtaaaatcctgatcccttttgatgatctactagatgctatttcatctggtccattcctcctcctgctgccctatttcataccctcaactccttgatcacgttgtctcaaccttcttattggtctttctgtcctgaatttgctaagtttgtgtcctctgcctagtatggtcttccctctgtgaatctttgcagtgttccctgtctttaggcccaaatgttacctcctta

SEQ ID NO: 40898 - DNA, 1561 bp, Homo sapiens
aggggcggcggtgaggtctagggggtctactcagaacgaggcagagacaccagcgaaaagcgccgtatggcgaagctaactcaggcctgacaaaacacccaccctactctaccgcctctccggccaaggctgacgctacgggccagagggcggagccgtcacatcttcccgcgagaccagccacgcgacttcccagaaggccgcaggcaacatcttaatagcagccaggaagccggaccggagcggaagggtgggcggggcttgcccgcatatttagcggcacccgaggccacgccccagatcggaagtgacggagacgtgctagcgcgtcgaaggtagctctatggttttcctcgcgttcttgagtcgggaaatggccgctgtgtggttgcaacggagataaattcccggaaccgcgattcggcgtgtcaggtaggcctcgcaatgtattcaagttactccaggggcagtgaagaccgaggacaggccatatttttgactcttttgtgggtggtgtcgggttggcggcgaaaggagaaccaaggagacgttgcgccgttatttatgcgttttttcgttagcttctctcaggttttcgaggcactacgggccgaaaaggccgggcgggggcgctgagcagtgctaacggcgggcgcgcgcgtgtttgcgaacctgcctggagacccacagcccgcgcggcctcccgtgcgcgtgcgcatatcttcctcttccacccttcccccatttcttcagcccgtacctctgcgcgcgcccgactgaacgctccgcgcacgcgcgctcgttcatttttctctcccccgcctatggcgccgacggccgctggaggtgcaacttgtgtccgcctctcattggctgggactgccacctttcttcgtggcctgtggggttttgagaaaataactgtgacccgcagcaaagtgcgttgagtaggtctaccccttttcgcgtggtctttaaaactgccctccggcttcagaccacccgtcagttaatgcctcgtttttgtgatgctactaggttttagtgctctgttctgcctctcgctgctgaccctggttctctggagttaatttcggtacccgcggcaacctgctgttttgaagcgagcgcgcgctgttgactggtgctggttgcctagttacggttccctagcgagaggattgggtcttagctggtggttctgagcgtggccctgccccatccggctgaaagtgcggttcttcatgagtactagcgaagccgagtcttttcaagtgattcagcccatttagtcgtgtcagaaatgttgcagccacgattggtggacagctggtgtgagaaatgggtgggagtggcgaattggactttgccttcattttaaattcatgagttggcttgattcgcttttaagatttatttcttcagaatcaagctgaagtaccagcagctactttgctacctcagacttttttaaaaagcattttagaactggaaacaaattaagactgaagttgaaagcaagtgtggctaacactgacgaaaaagatgagctacttcagac

SEQ ID NO: 40899 - DNA, 1177 bp, Homo sapiens
ttccatcttgagtaaaactgtaaaggttcttcacggttcaaccttacatttggcagatctaacatatttctgttctattcaacattttaaatagatatagctaatctccccatatgctctaatgctgcttcttatgaactatcaaatgccttggcttttgggaaaacccggaagcatgcatttggtttgcctataaataaataagacatgtacagaatattttcctggaaaagtattacttatcctcgtgacaagtcttaacacctggtaagacttgttcacttaacattttttaagtttggttgcttttttcccctgctggctgttgaatttgaatcctgaaacagttgtagtatatcttgcttgcctgcttgcacgcttcctctctttccaccttttgttccatcttaaagctaatttaggaaaagtctggttataaactagtctttatataaaaattatcttttatcactaatgtagttttttttccagaaccatcagctaataggaatataagaccattgctctccataattactggattacttctacatctttcattagtatttaaagagccaaagagctaacaatatattccagattttttacgtggacatgccttccttttggactcatcataaattcataggactgtaaggacagttgagtatgatggttctgggcacctttaggtaataacatcttcttcctacttttctctctatctctgctttgctccttttcctgaacctgcttttggctttcttcaactgctcctctggcactcttgtgtgtaaaaccaatcacctgcaccctagttatccccatttgtcctcgttcagcatcttgcagccccatcatcatgccctacaaagctgcacactctagaaattcgatggatcgaccaaaactctttgtaacaccacctgagggctcttctcgcaggaggatcattcatggcacagcggtgagtagctgttgggagcagctgggcaagtctgggagccagtgctgttcctgtgcagactgtacatgaccctgagctgtggtgtgggcgtaagagggggagaccgtgacatccaccatcccatctttcccattgatcatgaatctggctagctgggcagtagtgtcccctcacttcctcttcacttggggattttgctctccctaaaca

SEQ ID NO: 40900 - DNA, 1165 bp, Homo sapiens
agcagtagctggtgggatacatattaaatctgttatacagatcatttacatatgagattttgttgatgggatattttttatatacctttcatacagtaaacctggcagggtatatatttttataatcatatatttgttttacctgacttcctgctttacatgtatatggcagatatacactgttagatcatcagacatttttgaggagatggtaagctgcctagcttaattttttgcctccacactcaaagcttaatatatgacatttatttctgccactcagaacaagagaaaccagtgttgcattcgcaagctgttgggtaaaattcattttaatacgggttgtgaattataataaattgttcctatactggaacagagaagtttgccagaaaataaatgggatttgccaagttctcaaagaccagaaaatgatttgctatgatcttgagaacagcaaccaggtcttattcattttgaataccctttacttgacaacaatacctgatgtatgatgggtactctatcatggtttgctgaccaacaaacacatcatagaaactgtctacattaaaattcctgtcttggccagctgctggccatcgactagcactggtctgtaaaacttgatacgatcagcagggtgcggtggctcacacctgtaatcccagcactttgggaggctgaggcgggtggattacctgaggtcaggagttcgagaccagcctggtcaacatggagaaatcatatctctactaaaaatacaaaaactagccggctatggtggcacatgcctgtaatcccagctattcaggaggttgaggcaggagaattgcttgagcccaggagatggaggttgcagtgagctgagattgtgccactgcactccagcctggctggcagaatgagactctgtctcaaaaataaaacaaaaacttgatacattaaaaacttattcttttgtgtgttttgttcggtgagaaaaagaaatgaataacaactgtcttatatattaagtaataaacaaattcatggtgtgcctccataattttaacaatttatggcagatttagatgctttactactaatgatactttttaggatacaaggatccactgtaactcattttttccacttactctgaagcagaattaaatgtttttaa

SEQ ID NO: 40901 - DNA, 1022 bp, Homo sapiens
cactgtcagggcacttaactgacttctctgttaaaataatgctgccattgaacttatagacaggtgctaccaggctgctgccaggaaaagcatgtgctgaggtgtctgatttttctcttattacccaaggcccttgtgacgttagcaactgcaatatttgtcatataatcactggaacctggatcacaggactatcttagcagaagctgagactagagcacttagagattgtacagtcattgtcttctaaaacattgggcaaggaagcaggtgccaacccctcctttactttgatgtccatttatgtaaacttgctaaaacaggatactctcttgaaatatacctgaatgatgtaccttggaaaagattaaatgcctggtcagcatgtgcgtgtacagagtgcctgggtattctgaaactagactgacagggtatcaaaattttcccaggagatgacctgtaacttcttaaagttgttctgcattttgtaagagttaatgtttcaactggggactctgcccctatatctcatccctttattattcttattccaaagcccaaatttgtgaaatgtagtggaagctggttttcaaaagtcttttgctattgtttacattctttcaactcagacttgtttctgtcccttgccataatggccatatgaggtcatttcttttgcttctgaggttttttaggcatagatttcatttgcttactggaagtgaacatgctctgctgtttttctgtgcctagagtttcctccctggcctgatgggttccctgcaggcaggtaggttcttggggagcaggctgtctgtggtcaccagggctctcccttcctcctgtgaatatgctcattgctccctactaaggttgctttgacaagcaaaccagaactgagagaggatgaaggcagagctgctgaaactggaagatgagtaaaaataagaaactgactactgttttagggtggctgttatttacactctgttttcaagtccatgcgtatgtccttttccccc

SEQ ID NO: 40902 - DNA, 1033 bp, Homo sapiens
gttcatcctacctgagagcaccaggaggtataactgtggctgagctgaaaacctctggaaacagcggctgacccagaccttcctgccactttagtcacttgcccccaggaccccgtcaccaagttaacataggtttgctttctctcaaatccctgaggaactagaagcccagtttcctgaagagagctaaaaatactttctaccatttatcgtgccttgctgtgggccaggcaatgaactacctttctgtacgttatctcgtttaatttttacagctctgaaagtagatgttttccccatttacagatggggaaattaagacttagagatgttaagtgacatgctgaggattcagctggtaaatggcagaaccaggtttgctgactccaaaacacactcaaacctgcatgggtgctatgggtatgggatgcccaggactccacagaaaagcatagaagctgggagaaagggccttgaatacttgttaaacaccttctatgtgccaagtcttatggtagatttttaacatgtgtcttctcagttaatctttcaacaattctgtgagttaggcagtattattaccccatgtgacctacttagagaggccaaataactttctcgccactcaactggttatgtaccaagtctcacttttgaacccaggtctgtctgtgtcttttgctgttacaatgttcaccaaagaagtttttgaagaaatacagactcttaaaccattgaagaagaaaaagactgatatgaaagcagagagatggcctgaaaactttagaaatacatccaacctaagagttaggaattagcaatatataatcttagaccaaacagcctgacaattttcaaaaaattatttttattttacgaaatttaacctattactaatccaaatggcttaatggaaaataaaataacataaaataaaattaacctatcaattttatatgagcacagaaaaatttaaaatggattgtatatttgtctcatggtgaatatgactcagaaggtcttctgggatgga

SEQ ID NO: 40903 - DNA, 1052 bp, Homo sapiens
atgtaatagacatttctttcttaaagccagccacagtgactcacacttgtaatcccagccactgaggaggctgaggtgggaggattacttgaggccagaagtttgagaccagcctgagcaacatagtgagaccctatctcttaaataaataaataaaaacacttcctttctaagataaaaagaataaatgggctacctgggtcacagaattatgggctttttagatgttattttcatattctttctgtagtatggaaaatctaataaataaaagtaaaattaggctaaatcaatagataaatttactttctttttataagcaaatgtgcagttgatacctatctagtattaaaggtttatttgtagaacagttgagagagaaggtaatttaacccttctgtaaccaacctgtgagttgcacttcatataggaccttagaatactaagtatttgagaagaattgtggctcaggaattatcaggagctatatgaggttagtgggtttgatcggggaacctttcacattctttttagaattccactggctgctaaggcgtttgaattcctatggaactgatttctattacaaatgttattaaaacttgatgtggcatctctcactcattttttctcctgatattgcttctcccactattttcaaatctaaagctgctctgctttaatataacgaaccaggacctgctttgctttctgacttttggaacagattaggctacataggattcatgatggatcaaataaaagagttactgaataagaaataagacatttggaaggctaagatgcatggactttattctgtagccagtaggatctctgtatcagtttagggattttttttttaatttatgagtacagaatttcttaatgattttaacaaattggggattttcttttctctaacctatcgggaacatagaagtgaagagttgctgatactagaccagcaacttaaagatgtcagggcctgagtctctgttgttccctcagcctttccctcctgatagcctcctggtttccagatagatgct

SEQ ID NO: 40904 - DNA, 1035 bp, Homo sapiens
cagttataatagtattttggtaacgtctttaggcttctccaaatatgaggtcatatcatctgcaaacaagaataatttgacttcttcctttccaatttggatgcactttatttctttctcttgtctgattactctagctaggatttccagtactatgttgaatgacagtggtgaaagtggacattcttgtctttttccagatcttaaaggaaaggctttcagtttttcctcattcaatatgatactagctgtgagtctgtcatatatggcttttattatgttaaggtatgtttcttctattcccagttttttaggatttttatcatgaaaggatgttgacctttatcaaatgctttttcagcatcacttgaaataattatgtggttttttattttgttgatatgatgtatcacgttgagtttgcgatgttgaaccatcctttcattcctgggataaatcccactgggtcgtgatgaatgatctttttaatgtgttattgaatttggtttgctagtattatgttgaggattttggtatcagtgctcatcagggatcttggcctgtagtttgttttctttcttttcttttcttttttctttttctttctttctttcttcatttccttctttttcttttctttctttcttttttttttttttttgatgtgtctgtttgattttggtatcatgcctcttagaatgactttggaagtactccctcctccacttttttttctggaaaaaatttgagtaggattagcattagttcttctttaaatatttagtaaaattcagcagtaaagccatggagtcctttgcttttctttgctgggaaactttttattattactttgatctcattacttgttattggtctgttcaggttttggatttcctcatggttcaactttggtagatttgtgtgtctaggaatttatccatttcttctaggtatattattggtatatagttgctcatagtagcctctaatgatcctttgaatttctgcaatattggttgtaatgcctcctttttc

SEQ ID NO: 40905 - DNA, 1720 bp, Homo sapiens
ttggcttcaggctgttactgtcatcagctgtgtaactaggcaccgttacctaacctctgagtcttgtttttctcaaaccctgtaaaatggtgataacagtacttaccttggggttatcgcatgaagccccatattagttaggattgtgaacaataaatgaaactattggcacttgtaaatcatgtgttcagaggaggtgggtgggttctttttctccttggaagtgaaaaagtcacagagcctcagggctgctagcccaaagaggaggccagagctaagaaatctcaggccggacaggatggcttatgcctgtaatcccagcactttgggaggccaaggcaggcggatcacctgaggtcaggagttcaagaccagcctggccaacatggtgaaaccccatgtctactaataatacaaaaattagcagggcgtagtggtgcgtacttgtaatcccagctacctgggggttacctggggggcagaggcacgagaatctcttgaacctggaaggcagaggttgcagtgagctgaaatcatgccactgcactccagtctgggtgacagagtgaaactatgtctcaacaaaacccaaaaaatctcagcgaaatggagctagtatcctaatgacttcctgaactttcagatcaaactgaagccttttctacttttgggcctgtcagttgtgaatgcctataaatttctttattatttaagtcaacttcgttgggttttccacacacacacacacacacacacattgccatataggtacaattgcccaagccacctgtgaccgaatggcttgtgggatctcttggttcacacagtctttcatctcctccatcttccatttttccaaactcttaggtgatgtttgggactctacctttcatctccctctaaccaccaaacattctcaatccatttcctctgcacagataagcatgttcccttagacacaggtgcatgtgaacacctgagtctcaactcacagagacttctggttttcatttcattttagaaccagcgtctgcactgtcttgtccaaagtcagttggaaagaaaagtacataaatttgtgactgtttctcctttcatctcccttcctatccatgaatcgggcaggtcctggtgttcccagtgtcctcagttacttgtgctactctatgtacgggccctattccctctactcctatcctatcatcatgctgatgatgaacatcacagtttttaagtgttcctctaaaaggcagatgggtttaactttacagtgtgcaaatctaaatataggattctttctttgtatctgaagagggatccctaaaacttttggggtccacaaattatcaagtatatgtgtatgtcctaatgtgcatttttctggggaaaaggtgtagctttcatcatcttctcaaaaggacacatgacctaagaaaaggataaagtctctcacctttgtcagttgagaaaaataacaagtctccatcattttaggaggtttatttgtcaaagttaaggatatgtggtcaggagtcaggtctaatgcctttctccaaagatgattttgagggctccaaatttaaaggggaaagggtggtatattgagaagtacacaattttcatgtaagagaggggctagggaaaaacagtcattcatgcctttgtctggctcagtgaatctgctttcttttttttttttttttttttttgtgacagagtc

SEQ ID NO: 40906 - DNA, 1034 bp, Homo sapiens
gaatcacaaagaaaggaatgtagtatacttatctggccagggaataattctgtgtgggatgtctatgtgtgtataccactttaggaaattatgtagcatgtgtatgcgtttgtgtgtgcacacacagagcacttcctaagagattcttcatttgctgctccttggtacaaaagccatgagctggatctattgttgcaaatggatgaattacacttttaaaatggcttttggtagattccttgacaagccctggtgtatttaattttaaagtcaaaattggacccctgctacataaaaaatctataaatctaacttggctgttggtgaaaaatgcacaaaaaggcatctcagcattttctagttcttggtttggaatctagtggcaaatactactacctctgtgaatgccaggctctggtccatgaagccatggctgcctgtggccctctgaattcacaggaggaatctttccttattctgcagcctcacacccagactgtgatcctcccttcctactccagatgttccagtgagtagaggagaagagaaaatttgtgatgggaacttaatggcttcatctggagccttatctgagagctgcatgtgagcaaaccatggtggatctgtctattctctctgttctggaaggatgagtgcgatgaaagttgtcatgctgtggtctgatcattgcgtaacttaagtttgacatgtgcaatatataaaaaaagccatctgggcataaaaattggataaataactagggtaaaataaatgataaataagattaatgagacaggagtggaagggaaaatctgaaaaaatttccatttccagcattataatatttagttagtaagagaaatgacaaccaccatcatgagtggagcacttaccatgtggaagccatgagggtgttctcttaagggaggtatttaccccattttacacaaggtaatacctaaaccccagggtgaagtaactagcaagaaatatacacagctagcaaatggtggagcagctttcaggcccctctg

SEQ ID NO: 40907 - DNA, 1043 bp, Homo sapiens
gtttcatgttgaaatatgacatccaatgttagaggcagacctagtgggatatgtctgggccatgggagccgatcttatgaatggcttggtactcctcttatggtaatgagtgagttctcattctgttcgttcatgtgagagctggttgtttaaaagagcccgatatctctcttgctccattgccatgtgacacacctgtttccctttctccttctgtaaacgtcctgagccctcaacagaagcaaataccagcactgtgctccttgtacagtctgcagaactctaagccaaaacaaaactttgtaaattatccagtctcaggtatttatagcaacacaaaacggactaacacagatgggattgaggaaaagtcttaaaacattctgaaatgaatgttcttcacctgtccgatgctttgctgtcctaaagacttaatgctgtcactatccttaaaatgcccaaaaagtcatacactgaattggtttgctgttctttagtatcgctcttcatttagatttcatctctcaagtcacatagctatagggatccacctataacaaattggctcattgaggggaaaactctcttattcatctttatcagtaggttttttgttgttgttttagatggcgtttcactcttgttgcccaggctggagtgcaatggcccaatctcggctgactgcaacctctgcctcctgggttcaagcgattctcctgcctcagcctcccgagtagctgagattacaggcatgcgccaccatgcccggctaattttgtatttttagtagagatggggtttctccatgttggtcaggctggtcccgaactcccgacctcaggtgatccacccgccttggcctcccaaagtgctgggattacaggcatgtatatcagtaggttttcattacattgtgggtgagagaatgtgggaagtctggaagccgcaggtgcggagatcagagtagtgtggccctcttctaacccaaacacctggagaaggttcagttgtttctgtgatttagcatttaaggctaaaacctc

SEQ ID NO: 40908 - DNA, 1046 bp, Homo sapiens
aaaaaaataaacttttaaaaatgggtaagtgggatataaaattagatggaggaaagggagaaaaagatgcaggtgtgaaaaagagcaaagttttggtcatattgacacatgtgtaaagctcaaagaaagtcctaggtcagttaggaatgattgttcatcgaagtcaaattgtggaagggctgaaggccaaactgagaggctagtacatttttctggggtagggtagtgggggaagtgttgaggattcttgagaataaaggatattgattaaagcaggaataatcaggtagttctgtgcccatgaatcttgaaatattgattgcaagttctaacaagagctcagctgtgcctttagctaatgaaagcaaagttcctccctctgggaaagtcattctcttccattgatttttttttttttttcttttactgctttgggaagggtgcacctggagggatgagaatgcatgaggaatatctgcctagccagattagccaaatctctggagatcaatgaagggctaggtctactcagctggtcctcatttcaaagtagcaacgtggacttgaggatggactgaagaagagttcagcgacatacacaccaactttgagattcctgcagaaatccaggcagtcattagcatggcaataggaagagacgattaatttaaggttctgcaggggcatgtgtcaaaggattgcaggtaaaaaggtgacatatgagacttttccaagtttgagtttggctcattgacttattggaaaatattcatgaggaggacctgttttgttctttaccccaaagagatggggggcgggtcttgctatgttgcctgggctggacttgaactcctgggctcaagtgatcctcccggcttagctgttcgagtagctgggactacaggcatgcaccactgtgtccagcagaatcaggttttggtgggagaaacaggaaaaaaacctctctgctttagacatgaaaatgtgtggtacaagagagatctgtaagtggaaatgttcaaaaggcaactggaagtataggacta

SEQ ID NO: 40909 - DNA, 1042 bp, Homo sapiens
agggatgatgctggagtggggagcaggctcagatcccaaagggctccttatgaaatgttaaggaatcagcaaggagggttggggagccggggaaaatttttatctgaaataatattatagaccagcactggacctatgattctacagtaagagaaatgtcatttatctgccctgtccaatacattagccactagtcatatgtggctattagacactaaacatggctaccatggctgaggcactgaatttttattatttaaatgtcagtgttaataaccatatgtgggtagtagtgaccatattggacagtgaagctattgatggatcattccgatggctgtgtgaggatggtttatttagtaagatttattccataacatttttaaccctctgctatgcacttggcactagaatgtaggcacaaggcactaggaatatagctatgcctcagttggtcccagatcctgcctgcatggatctcttgcaatgcttgttaaaaattaaaatgcctggcccttctcagaatctggaggtgcaagctggaattctgtacttttaagtaaacccagatgattcttgtcatcactgcagtgtgagaaccactattctatgtttggccagttggagactggaggcaggatggccagttaggagactctgtgttgtggccagactgttcctaaactgtctaggagaaggagaaccataaagatccctagtgatcatgaatagctgttaggatctgaggccaccctcacagcaatggaagggatttagaaaatccccgttttcccaaagcaggaatgtatctaattccttaaaggtcgcactgtctcccttccatagatgggagctcccagcaatctggagtccatagggttgccagtcacccctcctgactccagcctactcctggcctcttggtaaagctatctcttaggggatatggggctcacaccccttcccatcagcccctgaaataaggcaatgagaatcatctccttagagacacacctttgacatgtcctatcctcagagaggt

SEQ ID NO: 40910 - DNA, 1045 bp, Homo sapiens
tcaagacctaatcacctcccaaaggcctcacctcctaataactgcaccttggggtatgatttcaacataggaatttggggaggatacaaatattcagtccatagcaccaagccatactgaaaattatatttttaatgttaaagtgaaaatgaagaatctatagctcaccagtctaattggcatacttatttattagatcactttgataatgtcatctcataaactaaaatttttatagaaacactgaattagtaaggtaacagttgagaaaaaaatttaatataataaattgtttgttttttgagaccggctcttgctgtgttacccgggctggaggtggagtgcagtggcacaatcacagctcattgtagcctcttgacctcctgggctcaagcaatcctcccacttcagccagagcatgccaccacacctggctaacttttttttttttttttttttttttttggtggagacgggatctcactttgttgcccaggttggtcttgaactcctgggctcaagcagttctccctcttcggcctcccaaagtgctgggattatagggataagcaccatgcctggcctataatagctagttgttaactctgcccgtagttaagttctatgattatctagcaattgtatagctttgatatttgtagttaagcctaagcctctttcattaaagatgtaaaaagatgacaggcctaatttggaaaaaaagatttcctgtgcattagcttgctgtctatagaagtaatagatactacttcttatttatgtatgttttatattttacaattttttatttcttattcaagtgattgttaggaattagctttcttgactcctacttcagggctcgtttgattataccttgttatctttgtttctgtgttaaattttgcatcacttgatacatagcaacttgccaaggtaaaacttaaagaaattgaaaatgaaacaattctatcaatcatatagaattatgaaggggatgactggaaaattcatgaagtattcttcaatgttacaaatttctggc

SEQ ID NO: 40911 - DNA, 1049 bp, Homo sapiens
tggttccttttgataagtggtggagtgtacttcctaagcaatgcaaagactgtctcttggcttagcttcatgccagcccgatgtatgcttttccttaatactgcagtcacgttgacacagtcttcagtattatctcccgtattgtggtgaaaagtatcaggcttacctgcattgttatcccatccccaccacccattacccaggtgggtcagagttagatgtaatatccccaatcactatttacaatgttttagaccatgggaaatgacttgcagtttctggtctgcagctcatttttgctggtctctagtggacttcagacatatagatttaaatgtataatacacacacacacacacacacacacacacactttaaaaaaatttattgctcttctcagatggtgccatgcccctctggatggttcttaatatcgtccagcatccaattcaagaattactggcaactccctgtatgtacaaatttctttccacatcaaagtgatgccataaatctctctgagctctctaatctctatcttccatacttagaggcggtgacagttctcaattctttttgtgaaatcttgttttctagttcttgttgataggatcatctacttcacttaattaaatccattgctgacatgagcatgctttactcttgcttccagatgaagccttgagctcagcagggtccttaagcgaaagcctttctaactgaaacacttcactttattttctagcctagataatgtgtagcctaggaaaatacttaccttagaatgagctggcagcttgcctgtagctggtgctctcagtagcagtaaatgtagtgaaagaagagaacatagaattcaggtatttaattgactattgacttgattgactagaaaactggctatgaaaggaaaccattcaaattcgtcactttgagcccgtttagattagtatcatatgaatttgtctgtcatactataaatataagtgaatataaaaaatatttgacagaatttgtctgtcataaatataaataagtgaatgtaaaaa

SEQ ID NO: 40912 - DNA, 1065 bp, Homo sapiens
tgctttgggttttgtgtgtgtgtgtgtgtgtgtggctagcttattttgctaagcataaggccctcaaatcttcctctgcattgtagcatatgtctgaattttcttcctttgtaaggttgaataataattgtgttgtatgtatataccacattttgtttatccattcatctcttgatggacatttaaatcgtttccaacttttttggctattgtaaatgatgctactttaaacattggtgtataaatatctctttaaggttctacttttaattattttaagtatatacccagaagaaaattgtggttttgaaaaatgtttaatagtaacatgcgtcatgatatttcatcaattaaacagcagatcataaaaatagggtgattctctttttttggaaaaaaaatatgtgcgtggtaaaaggactggaaaaacacagttagaacttggggttcttttatttttgttcctgagttttctattataacaagatatgtacacaaataagtagtctgaattggagggttatacccccaccagcagatcacagcagcagggtgattcagcattagtttcttcacatgctgtcctgctttgtttctgagttattttatgagtgttaatttcagaaatatccctagagataaaaaaaaacatgaaattctaattaaattacctttgtgtctcatagaaagaatcacaactgttatatcacaaacaaggaaaaatagcaagaacttgacttgagctcagtgtcttctttgttggaaagtacatattccagctagaaatgatcagtccaagaatatttcctttatttttgatttctgttgaatgtctcagtgcggatgcaaaaagtgaaaagtctttttttgtgaagacttcatcactctatatcaaagacttaactgcttttaagctagtttgcaatcaggtgacaaatacagtactaatcataaggcaattctggaacaaaaacctattgctttgaaagctcaaaagagaagtttacatcttttaaatgaaataatgaattaaatagtgcaaattatttgcccccttttggctgg

SEQ ID NO: 40913 - DNA, 1118 bp, Homo sapiens
aaagcagcctatatccacacacagatacacacacatatgtgtgtatgtatatgtgtctatagtatgtttccatggcagcattcatgccatcctttccaatatgctgttcccttttcccttttctaaatcgtgattccccaacctcagtgaagccttgatatgacagggttttctagatcgtctctccagtgtctgtaatcatgataaggtataggaataacaatactgatagctagcttatattgagagctagctagctcaatatagtataattacatatacactgatatatagatatctttatctattttctacttgaagagattgatgtaagttcctaagtattgtattctgcctctgagaccacactacagaattcctaccctccacacagaattaaacaaatgtgaaaacatgagaaaagtaaattttaaactttaaaaatgctgcgtgaagaagaattataatataaagtggaaacagccttgttaggccaatggttgtggccaatggttgtacatttatttcagaaagtaagccagtatttaaaaaccttaaagaatgtacctctgcaactcggagtgaagataatatacaatatattataaaagcctgcacaagatttgatttaagacgacaaaattaacaatacaattgctaatttctccttaaatcagaaattttaagcctttttttatagtagtgattatacaactctgaagtaattttgaaacttatgcttaagatttaaccagggcagaggcatatttcagcataaataatgttgccattataaactcttatccttcctatctcaacaggaaatgagcaattattgcttcatgcttcaatgcactgttttaaaatactgtttaatttgttaaaggtgtgaaactgtttaatttatctcacacgtttttttaaacaaatactgattggacatgcgctgcacgccaggctttgggcttggtacctcagggttctcacaggggaggctggaagtggaaacaagcacatgtgtaactgttgtgtagacagtctaattggtagaaaatcagcgaacaaagaagcagacaaattagaaaatgaacgtaaggtgatgtgctaaaaagagggta

SEQ ID NO: 40914 - DNA, 1058 bp, Homo sapiens
tctgtcacccaggctggagtggagtgctatgatctcagctcactgcaacttccacttcccgggttcaagtgattcttcagcctcagcctccctagtggctgggactacaagcgcccgccactgtgcctggctagtttttgtatttttggtagagacggtatttcaccatgttggtcaggctggtctcgaactcctgacctcgagtgatttgcctgcctcagcctcccaaagtgctgggattacagacgtgagccactgcgcctggtacttctctccttcttacctttaaagtatcccttttcccccatggttgacttttctcctctgtcatagaacccaacccatctgtctcatctgaaaatacagagatcgcctccattaattagcactccctttaaaatctttctctttttttcttctttcagcttgacttcaaaaatgcgtacaatctccacttgttctaataatgttcaagtacaccattctaacactaaaagcttttagatctttctgtcccattaaagtattgtctgatctcttgctttccttactgattgtaaaggtgcctaccatggaccttggaaaacgtttatcaccttttgttctttgccagtctttggagaatcctttgggctcattccctccatttcctcatcttgtattcagcaccttttgttctgttgtacttaccttcgttatcatgcagcttctttataatccttgtggtaagctaaaatttgtccctcacctcccctgccaccctaatatctatgtcagaactggaacatgtgcatggtaccttatttggaaaacgagtctttgcagatatgatgaagtgaaggatcttgagataagataatcctggatcatctgggtgtgtcctaaatgccatcacaagtgtccttgtaaaagaggcagagggcgatttgacaccacatgcatacacatcacaagccaaggagtgccgaaaacttagaatcttgaaggggcaaggaactgattatcttctagagcactgcctacaccttgattttggacttctggcctctagaactgtg

SEQ ID NO: 40915 - DNA, 1042 bp, Homo sapiens
tttatttgctactaaggactaaatatattatatttttgagggttgtcaaccattaaattgtttatcatttgcctggatatagtttcattatttcttacatttagttaagaggctcacattgctactgtcatggtctatatcgacaaccaagacagtcttattgatggaaaagcaagtgcatatattataatgaaatgtggtgagaactattgggaattcaacatgaagaagtaaatagtctctccaggagtgaaaaaaattcaccatcttaatgtgaccctcattttcaaaacaagtaaaaaatctagctctcgtacagagcagtaggatccaattaaatggtagaaaattgcccctttgtaatttagcactcaagctccttctcagaagtctggtttatttatgatgacaggcacaaagggaagattcagagcagtttaagaaaataacttatgtagcactttttctaaaagtaagctaacataaaaactcactcgagaatccaaggaaaaatgtcatctggttaatggtgggattatggatggtggaatttcaggtaacatttcttctttttttaaatctttctttttttttattgtctcagtcttgctcttaaataaatcacacggaggtagaaagagctggggagaagtctttcagatatgacgacctggtttaagccagtttccaaagagtatttgggacttttagtccaggactcaggggacacgtggtctgcattataaaaccagctctggcttgttgatgtctaaaagaaacttgacgtgacatgaatattttcagtaagaaatcataagtaaacagcagaaattcaagaagacaaagatcagcccttggaggaagatgtagattccaaaaaaggaaaaccaagattaaaggtgaaagagggggaaggtaaaaagaagggaaaaacacttcacctcccccgtccccagccccgctgtgcacactcccacacaaacaagaaatgaccaaagaaaagacgaaaaattgcagcaagatgaaatgcaatttactgtga

SEQ ID NO: 40916 - DNA, 1089 bp, Homo sapiens
atttgtgcagagaaatctgcattagagcaaaagaatgctactcggggatgaagtggtgaaaaagtggggaaaaaaacaactcactggggttataagtcatgagaaaatttgacctcagaagggtcccaaaagagaggaacgtattctctggttagtcattctgatgagctgagttgaaaagttatttcagaaaaaatttctgaagaaactcagaacttttgacatcccgaaatactaagtaggaatatttgtggaaatttttgcattttgtagttgatccttaggagcaggagacaattgtgtaaacacactgcaggactaggactcaggatgactttctttagaaggaggaagaagatgaaatgtgtgagaatgacaggattttcacaagtttaagacctttctccaattgaaacgaaagataaattaggggaaaaggctgaagtttttcatctagattcagaaatgctttcaaaaagcaacacattctaaatctatctaaagatgccacatgatcttgtcgaaacggtaatttgacaaattatttttaacaacaaaaatactcaagtgctacatgaacaattcaccccttcatcgttgaagagaactgctggttctcagcagtcctgcaaaacacctcactggcatgagaagaggtatttatggtcttttagagatctgcaggaaatgtttttgaactaatctgtattaactactgaaaaactggcaggacaaggctgggtgcggtggctcacgcttgtaatcccagcactttgggaggccgaggcaggcagatcacttgaggccaggagttcgagaccagcctggccaagatggcgaaaccctgtgtctactaaaaatacaaaaattagccaggcgtgctcgtgcacgcctgtaatcccagctattcaagaggctggagcaggagaattgctcgaacctaggaggcggaggttacaatgagccgagatcatgccactgcactccagcctgggtgacagaacgagactccatcttaaaaaaataacaaaactggaaggacagaaggccaatggggtgtggagagaggatgaccacaccttgtctcta

SEQ ID NO: 40917 - DNA, 1069 bp, Homo sapiens
tgtggtggcacgcgcctgtaatcccagctactcgggaggctgaagtaggagaatcgcttgaacccaggaggtggaggttgcagtgagccaagatcacgccattgcactccagcctggaagacagagcgagactccatcttaaaaacaaacaaacaaaaaaacccagctgaaatggcagatatgacccaccttcccacccagctcccaaccttcctcctcaggaagagctgggctctctgactgtgttgtttcctcggcaccatccctgtttctaatacagcccttattgatttgaaaggtaggtggtgtgcttaaaagtctcctcccccactaactgtaagtccctaagaacagggactatgacttgatcatctctgtagtgccagggcctagaaccttgcctgggacagggtagatgctaactcattgtggagtgcatgaatgaatgagggagagagggaacgggagaaggagggatggaagtaggaatgaagggaggcagagaaccaatgtaaaaattttttttgaactctgaagcacactgagaaaaaggctctagaatgaaaagtaaattaagatgacttaaaaaataataccagagatgtttctataaatttaactagaatccaactgattactgtggtcactgggattctatcaagccataaatcaaactgaaagttcacctatgtctcaagggtggcaaccttccgaaagtaggagtggcttggcttcgttcttttaagttcatgtgttttcgatattttacatgtttggtggcttcgattacaagaatgcaagcctaaatctactttctgtataaccacatccctttagcagcctgcattagcaaatcatactctgggccagaaaaagagaagcataccaatatgctttcttcctcttaagcagtcttcacagtttttctaggctgaggtcacatctttaaacttcataaaacattactgcctgattgttgagtgggatgggaagggagcgtttaattcagcacctgcaagctgcaactgccagcagatttctgcattcagaggcattttggtgtttgtgt

SEQ ID NO: 40918 - DNA, 1025 bp, Homo sapiens
tactgtcttatacatttgattgggggaatctaatgatgacttcctaatttttgttaggatactgtataaaaagttctccattgccgcacattggtggctacatgatagaagagcatgatcctgaaaacacacatggtaatactgatccccaaagcagatacatgttcagagagctgagaattgaccccgcagagtcacttgtcccagcttctgagatgcagtgagacaaacacatcaattagggccaggaagtgtgccttgagtttcagttctgcctcttacataatctctctgccatgagaaagctgatgtcttagcatagttttgagcattaactgagaaaatatatattaaagaagcaggcctatagtgggtgctttgctaaaatttatatattcacagtgtggacttgtgattttgagaggtctgcgtttcatttttctgttgcggcataaccacaaaaaagtgtagtggcttcaaacaacaacctgttattatctctcacaatttagtgggttgagtgggttcagctgtgtgactcttctgtttcacataaacttggttgggtctgaagccatctgggggtttgacaaagctggaacatccaataaggttcattcccatgactggaaggtggtgtgggctgttgggcctcagttcttttccatgtggcctctccacatgacccggttggacttctctcatggtatctgtgttctgagagggagcattctatgagtgaatgttccaagaagaaggacatggaagctatcagtctgttaggttttgatctcgaaattctcagaacattatttttgtctgcatcctattggtaaaagcagttacagcaccaactcagtctcaagggaaggggggtaactgaatgggagaaggggcatatgcatgcacaggggtaaggacttgatgggggccatctttggaaacatctaccatggtctgaacattcttgcatatgtcatctgggtgtgcacatgtacaggtggctggctgatcagcagggcagt

SEQ ID NO: 40919 - DNA, 1023 bp, Homo sapiens
atttgtttgaggggagccatgaaatatacaggtttactgtaaagcattctgtttttaagttagtttttcctcaactttttttttaaagaacacttaaattgtaaacataaagcagggtttctcaaccttggcactgctggcatttggggctatattattttttgttgtggaggctgtctgatgcattgtaggatatttagcagcacccttggtctctgccctctagatgccagcagtacctcccccacacacttcttctccaggttgtgagagccaaaaatgtctacagacattgattgcctaatgtctcctggcaacaaaatcacttcccacagagaaccactgcaataaaggaaaaaataatcagaaaaggaaaataataatggtgatagcatttaattgtccattagtgcctattatttacctaaaaaactcttaatccatgttctgctttgaaaatatatgtgttaaataattgtaaattaaggcaatataccagtttggtcttgaatattggaatttttgtttggggaaaatatagattttcccttcagcagtaagcaaatatcttagggatatgaaagtaacacctcatgacagatcaggaaatctgaagtatttagcagtgtggccaagaaagaacccaaatttattaatgtttgacctagggagtatttttcttatttaagcagtctgcttgatataaatataaatcatcatcattatcatccaaggcactttggaaaaatagaaacttctgtccctctcacaatttttgaggatgattataagttatgtttggaagccactgttcctatccacatggacattcatttatttgttttagttatataagtaaatcatgtttaatagagtgttccagggaggtgagattgaataaccataaatttggggtcacatcgctaactgtgtacattcatgtttatctgtaaagaagtgaagggagaaaggagaagtgtgtgtgttcagttttccaaggggtgttggataacaaccttttac

SEQ ID NO: 40920 - DNA, 1028 bp, Homo sapiens
tatgtatggtaacattgtctccctcacgggatggatgtgatgagtatctgaggtaatgcattaaaaaggtaagcacactgtgtgtcttgtagtaaatacttaatatgttagggattattcaataatgtgcattattattttaacaaatatatctttaaatattaaattcccttagtcatatgtgagaaattgtgttggcttttaaaaaaacaaacttaaccagatcagtatgagaaacttaaaacaggctcagcagctaactcattcttccatctcttccaacagacaaaaaagtttggttttttagtagactggaaaggcctgcattgttttttcatttcctcaactgtttttcaattcagaatgagttagtccaaaagagaattagtgttgagaaatgacttctctcagggactagattggtctggtccagtcagaactaatgccagaccaaacccaactagatgaaattggataaataggagtaagaataaagccctggatttcaagtcagaaaagtggctgagcagatatttattggataagccccaacttggtggtggtgcgagggaaaaatataggggaggttagttacttacaagttcactgcaggccactatgtgttatgcctggctctttaaaaagaaaaatttcaattagaagatttcaatgaacacttgaaacatcacctgcaagaattatcaaaatgtctgtactcagcttaaacctgggggatgcggctccttgctacggtgaaagttggaaagcattaagaaaaatagtcattttatcaccactggaagccattcgggagggagattgtaatcaaatatgttctgacaaaaatacaaaggccttgatttggtacttttcatttattcagtgtggatttcttatgctggttctgtttgctgtgcagatgaaacctttgtgacagtccccattcctgtccctgtatctttaacatggggaaggtgttagatcttctctgagagttgttcttaaggaaaagatccagatgctttaat

SEQ ID NO: 40921 - DNA, 1025 bp, Homo sapiens
tgattgtaaatgatccccctaccttcaagattctctgattgatagaattttttctttaattaaaaaattttaaatattccttgagttggaagcactgatcaataagtggattgcttagggaggttggaacgaatagattcagtcccaacttcctcttttaaattccctcttcctcactcttcctgcaacacttatttttacagttgagttttaaaaataagtaatatataaaataatttctgtagtgtggtttcagatttaaaaattcctgcagacaggctgggcttgcaaccccatcagtcgatggtcagagccctttgctttttgagaccatttttaggtgagcttggcttgcctggatacagtgtgcagtgcattcttcctgaattttgcaattctggtatctgggtgtattttctaggtgtgtcagggtgagtgtaatccacctagggtgtggaaaaagccaagaaagggaaattaaaagaggttcctatccagtcatgttaatgatcttccacttgtactatcctgtgcttcgttgttaacctcgaaaacatactttgttggctgcaaaaataaacaaagggaaactcagaagtgtgtgagcatgcgtgtgtgtatttagagatagttctctggtgaagaaatggaatcctgctgatttaaatggcacaagattgtcttcgtgataatgagtcatcatataatcataatagatggttgtgtaatggggtgacccagccagtttttccagtgcaaagactcaaggtaattaacctgctattatcaactgcttttgattaagttactttcaagaggaaatacttagatttgaaacataaactctgaatttcatcaataaaagtaaattgccaagtgagactttgaaagcaagttccatgtggataccctctgtttccctattctatcctttctatcgagttgaaatgcttcagtgaaaatttgcatttccaaatgccaccccacccaatttccaaagtcaagcaacacctcaatgcttaatc

SEQ ID NO: 40922 - DNA, 1088 bp, Homo sapiens
agtatatataatgcttatgtaatatagaatggatctccaatgatttttttgtgtgtttttcacatatttggcatatgtgtgtgatgctgctcagtgccaggcatctcttacacacagtagtcaagaatcttttttggcctctgcctaaccagattcctcctgcctccaggtagattttatacttatttcaaggcagaaacttggtggaaggaggtaatctgtcgctaatgtgtatttattccttcatgcatgtatgcattcataccctgggatttttttcttccctttagctgtgttccagatcatctccctggtaatttaccccgtgaagtacacccagaccttcacccttcatgccaaccctgctgtcacttacatctataactgggcctacggctttgggtgggcagccacgattatcctgattggctgtgccttcttcttctgctgcctccccaactacgaagatgaccttctgggcaatgccaagcccaggtacttctacacatctgcctaacttgggaatgaatgtgggagaaaatcgctgctgctgagatggactccagaagaagaaactgtttctccaggcgactttgaacccattttttggcagtgttcatattattaaactagtcaaaaatgctaaaataatttgggagaaaatattttttaagtagtgttatagtttcatgtttatcttttattatgttttgtgaagttgtgtcttttcactaattacctatactatgccaatatttccttatatctatccataacatttatactacatttgtaagagaatatgcacgtgaaacttaacactttataaggtaaaaatgaggtttccaagatttaataatctgatcaagttcttgttatttccaaatagaatggactcggtctgttaagggctaaggagaagaggaagataaggttaaaagttgttaatgaccaaacattctaaaagaaatgcaaaaaaaaagtttattttcaagccttcgaactatttaaggaaagcaaaatcatttcctaaatgcatatcatttgtgagaatttctcattaatatcctgaatcattcattttagct

SEQ ID NO: 40923 - DNA, 1050 bp, Homo sapiens
ggggaagggcgtattctacagccctttaattaggtctcctgttttggcaagcctctgctcctgggctgtaagcttcacaggtgcttctcattatttccttcccactttaggtgggacaggatgtcgagaggggctagaggggctagagcaagtagttcccctctccatgtggaaggctagtgggagctgaagctgggaatttcccttcccccaggtcagttaggctctggtaaaataaattctcctgagggcaggctgtgttaagaacagaacgttctggtgcatttcaaaatggttgcttcctcccatccctgccagaagcacaaggggattttctctgattttcactctaagaacctaatagggctcctggagataatactcacaaaagcgcgggggccctccgtgaatggcacccctagagtttttaattctcagagcttccagcaattcatcaattacagttcaggttttctgcccccagctggttcctggaggtttctgctcaggtaagttgtgattctctgtgtctgtctgtctgtctctccaactttggggacagtggtttgtcctgtgacctcagttctttaatggacttaagaagagttgatttttctgtttgttcagctttttactattaggatgactcccaagttctttacaagtcagggtggaaagcagacttcatttcctttttataaaatgataaagatattttctggtccactgttgcatttagtgaaatgtccacattctattcactaattctatttcccattcttaactttttcttgctaaagttattttttcccaaactactttttagtggttaacggtttaattcctctatttgcgaattttcttcaactccactttttcttggagtgctaacaaccagattacttgtgtttgccagttgtgtcaacatttaaacaaggatgtactgtttacactgttgttacctatgttctgcctgcaaatcctgctttgtgagttgaattggctgcagctgcatgtttggttaatggcgtcaggaaacaatttacagag

SEQ ID NO: 40924 - DNA, 1028 bp, Homo sapiens
cattggggacagtggctcaatgtgatacgttctggtaggcgctgctcttcctggcaaggagcgcagtgtggcagtcataagacagagtatattagcaagagtcggattaaagtgactgacagtgcagtcaggaggaggaatgctatgttctgtggacttaggatgcacagactagctccatgggactctcttcctaaagatgttttagtttattctaatttttttcattttacagaaaaaccacagttatacagagcaatttctttggctgcttaagtgtttctataaaagagtacggccctttaagcgggagcaaaagaatgacttatgcttgttaatataccactagtgccatctactggcatcagaaatcgttgggtttaaaaacaaacaaaaagggtaaaattttcaaagtaatggcctgaactgttacactttttatatgtggtcacctttaagagtaaatatgatttagcactgaagttttacttactgcatcacttttctgattggaaacagctgactactcccacacagtgtcatcgtaaaagctgatgactgtatatgtgcaactacgttaagccgtaatgctgtataaaccttttgcttccttctagacttctctaccacggtatttccaggtaactctaatgaatgtccttatgctgccaaggccttattttgccctgaatgaagatcctttctttttttttaacctcctgaaacaaagcatcctgtagaatcatttgattctgtgtgtgaatgatcttatgtcagcactgctttcccaattcttggactctccctgaaaagactattgcataagatgaaaaacatagtgctgtacctacctgaaactcttcatgcaacacattaacatctaacttggtgtggggggaacgaagccggtgaattaatgttcttgtcaagaattacgctctttacgtcgctcctctagtgttggtataatagatcctaaagactgccccttttaacatggactggtttcttcagtctcattagaagtg

SEQ ID NO: 40925 - DNA, 1037 bp, Homo sapiens
tattgcaatacagcaagtcacacgaattttttggtttccagtgcctataaaagttatgtttacactgtgctgtggtctactaagtttgcaatagcattatgttaaaaaaaaatgtacagtgtaaaaatacctgattgctaaaaaatacaaaggatcatctgagcctacagacagttgtcatctttttgctggtgaagggtcttacctcaaatttgatggctgctgactgatcagggtggtggttgctgaaggtaggaatgactgtggcagtttcctaaaataagacaacagtgacatttgccacactgacagatccttcctttcttgaaagatttctctgtagcacgtaatactgtttattaacattttaccgacagtagaactactttaaaaatttgagtcaatctctcaaaccctgctgctgctttatcaactaagttcatataatattctgaatcctttgttgtcattttaacaatgttcacagcatcttcactagtagagtccatctcaagaaagcattttcattgctcatctgtaagaagcaatgcctcgttgttcaagtttgatcatgaaattgcagcaattcagccacatcttcaggctccacttctaactctagttccttgctgtttctaccacatctggagtcacttccttcacttcagtcttgatcctctcaaaagttatctacgagagctggaatcagtttcttccagactcttactaatgttgatattttgaccttctcccatgaattaaaattgttcttactgtgctagagtagtgaatccttttcaggtttccaacttactttgctcagatctatcagaggaatcactatctgtggcagctttggccttacaaaatgcattacaaaattaagacttgaaagtcaaaattactctttaagccatgggctgcagaatgaatgttgtgttaacaggcatgaaaactttgtacatcttcatcagagctctggggtgactaggtgcattgtattttttttttttttttttgtgtgtgtgtgtgtgtgt

SEQ ID NO: 40926 - DNA, 1082 bp, Homo sapiens
gagattatattatcactctttgttcatggttaagtctttcttgggtaaatccaagaaagtaatatttcaaaacttctataaataacagttcaatgatatagtaaggtatacaagtaatatacagcaatcaataactttcatatctacaaagtcaaattagaagatacaacaggaaaaatctatttaaaatagctattgcaaagtacagatacatttaataagaaaaggacaagatctatatgaaagaaactttaaaaaatactatatggtcaggcgtgggactcatgcctgtaataccagcactttgggaggcaaagttgggtggatcacctgaggtcaggagttcaagaccagcctggccaacatggcgaaaccccatctctactaaaaatacaaaaatcagctgggcatggtggtgtgtgcctgtaatcccagctactcggcaggctgaggaaggagaacccaggaggtggaggttgctgtgagccgagagtgtgccactgcactccagcctgggtgacagagcaagactcttttctcaaaaacaaaaacaaactatagaacacaaataagatttgaataactgaaaagacatatcacatcctcagaggcgttaatatcagaaagctcaccattctgcccaagttaatttataagattaacacaataccaataaaaacgtgagtagattttttctgggtttttttttttgtttttttttttttgagacagattttcacgtactctgttgccaggctggagtgcagtggtgtgaacttggctcactgcaacctctacctcccaggttcaagcgattctcctggctcagcctcccgagtagctgggactacaggcacatgccaccacacccagctaatttttgtatttgtagtagagactgggtttcaccatgtggccaggatggtctcgatctcctgaccttgtgatctgccctccttggcctcccaaagtgctgggattacaggtgtgagccaccacgcccagcctaatttttgtacttttagtagagatggggtttcaccattttggccaggctggtctcgaacccccggacctcaagt

SEQ ID NO: 40927 - DNA, 1047 bp, Homo sapiens
gtcacctaaaacacaggagagagatcagagtcaaagccggggaacaagtagtgagaatgtggagtgatgagattggggatggagagggccagtggtgaggaggggggcggttgaggcttggaagctttactttagggcactgggagggagaagtctgcaaaagagcacaactggggaagaagaaagtttagccaggatgaggcagtcatcatggcgctcacaggtggggagagagtcattgtaagaaaaggctattgaatcggttgttaggtggtgattggtgacctttgaaagggcagtttcaaggaagtctttagattaagaagccagatttcctgagataagaaggatttttataagcagaaaaacaataaaagtaattgttttaaagaaataaaggtgagtgaatgatgccaacagaacagagagggaagggatagtattttgaggtggtggcacggtacagctgatattattacatgttttaaaaactagagcttatgaaaacagggccgtagacaaaaggagtcagcaggaggggaaaggattacagatatggaaagagaatgggaggatgttctctgaagaagcaggaaggaggcagtcaactcagggcaaagcggagggtcggaggttgcggcctctgtctcctagagggaattggggaagcgtgttatgagacggagccagagatcgaggctgttcattacatggtgtgggagccttgcttgcaatgtggcccccgccatattgttagttctttggtgaaaaggatgactttatttggtgctctctcgctcaggtcttgtgaatttaattaggttgacttttcaaagacaaatgatattattaaaggcttaaaaaaaatatgtgtggtatttcatttggctctattggaatttttgtcctgagggaaagttgcccagccgggtgaaaccacggattaaatgccctattgagaaaaagaaaagagcagacaaaaatatgggattaacagaatgggaattatatacaaaaaggggctatttaacttctcctattgaattt

SEQ ID NO: 40928 - DNA, 1028 bp, Homo sapiens
ctacaaaatatggattggaatatggcccgcttagctcagaggaggaatgtaagaagcataaatgaaaagaaaagtctggcattcgttcacaggctcttgtgtgaggctttctaatcactaatgactttggcttagccagtagaagtatgtggcaagtcacttaacttcccgaggtcccagctctttcatctcaactacacagatggtaattccctaactcataagagcttcatgaactttaaatggggcaatgcatgcatagcttgcctggaacctggctagacccaggaactgttaactactatttttctttctgtcatgtgtgtgtgttcaatgctacacagcctctgaaaatctaactggtatttgtcacgctggagcctcaaagaggatcttttcactttgggttttcagtctcctaagtggattggtaaggggcgtagtatgtacccacttctttccactgttcatatgtaaatgctttcaacaaatgcctggacactggtaatccggctgctctctgacttgccatttatcttgagctataaattcagccgctattcatggatgcaaatgaggggatttgttttcatggtgctgcaagcctcataagccttattactcttttgtcacttcagattaaaaaaagaagagaaacttttttttaaattttttggggcagggggcacttttgccctccttcttttagattcccagactgcagtttgtgagcaaactcagagcgatcctctaaatgtctgtatgatttttggtgtttcatagtggttttttttttcccttctgtacttaatcttagtttcccaaatatgtaaccatgaaagaaatcctcatctgcacaaaatccaatgcagcctcccagcgctggtcttgacctcatatgtcaataggataaagaggaggagactgaagagcgacggctcggatttgtgtgctgcctacacagctggctcagtttgctttcttgtttaaacgccccaaagcaaagacaaagacgctaatgttagaca

SEQ ID NO: 40929 - DNA, 1030 bp, Homo sapiens
aacagtgtgccttttcatgttttattctcagacatacagttgtaaacacaagggctttttaaaattattttattattttttttttggagatagagtctcactctgttgcccaggctggaatacagtggcacgatcccagctcactgcaacctccgcctcccaggttcaagcaattctcctgcctcagcttccggagtagctgggattacaggtgtacgacaccacacctggctcattttatatttttagtagagatggggtttcgccatgttggccaggctggtcttaaactccttacctcaggtgatcagcctgccttgtcctcctaaagtgctgggattataggcatgagccactgtgcccggcccacaagggatttttttttaatatgataactttatatttgacattaagaaaaaccccttttgttgtcattgctcgaggttaatgctgtgaagttttcagatagtgatacctataatttcagcaatttaatagaggttggtatgtgtgctgtttagaagtgctataacattttgctgcagtaagtacaagggtatggaaaaaataggttttaagcctatgtaaacataaattgaagacgatttaaaagaaaaacaaatcatgcccatctcacgtaattattaccttgctaaatgtataagttccctagagtcactgtaacaaattaccccaagcgtggtggcttaaaataaccagtttattctctccctatttaggaaacccgagttctaaaatcaaggtggtaacagagtcctgctcccaccagaggcagtatgggagaattctgtcctgcctcttccagcttctgctggttccaggtgttccttatctgtgacagcatccctccagtctgtgcctccatcttttatgaccttcactgtgtctctgtatccttttctgtctctctctctttttttgagacagaggtttgctcttgttgcccaggttggagttcaatggcgcaatcttggctcactgcaacctccgcctcccaggttcaagcaat

SEQ ID NO: 40930 - DNA, 1035 bp, Homo sapiens
ctgaagccatagagataattggtatagactggatttgaatccacttctcgtgacttagtcccacactcttcatgacacttcaacaactctgctcaatcaaagagtacaatttaacctcgttttaatgccctggtgtcactgtgactagtcattggacctggtgatgccctgatggccgctgaatattgtagagatctttgctttggcatgaaatggatctctgcagtgttctttaacttccagtgactgttttgtatttcacttttgctggaagcctttctctttcgacagtgtacttgcacctgtctctggtagtccccaccactctttggcttggtgttgctcctgtgttaccttgtgtgggggggtctgggtaacccagtgtattgcaacagtattgactggaagatgcatgagatcccgagccacaatcctgtgggcagtgctgtctggtgggaggccattttgatttcttctttgccatattttgagtggttgaatttgtcagcaaaatgatccgttgataagtggatgttactctaatatgtaactatgttttttacatgtttatcttctgttggcttttcgttttggtacggtggaataaagtacatgtttgtgttaacatcatggaccggtgactgtatttggccatcccagtgttttctgtaaacattacattttaatcactcctgtaaaaatcactccgagttttcaaggaggattatcatctactgctttgtttcacttactaagcaagtatgcttttaaaccttgatttcaccattaaccactttctctaattacttgttgattgtcactctcttttctccatctgatatgtagacaccaagtttatttactcatttttcatttggttgaaattgcatcccccagatttctatttcatgttcttgtttgtatcctctatatttaaaaagtcaagaaatagtgaaggtaagacgtatttcaattatttaaaaccacttctactctactaaacatttttggccaaatactttaaacgatatttga

SEQ ID NO: 40931 - DNA, 1063 bp, Homo sapiens
cctctctttaaaatcctctttgaagttggactgaattaacaaatggaaggcttggcaaagcagtttactaattcataactctatccctcagctttctttgtgttgctaaatactataatctttgacccgaaaggaagaatactgctaacaagtaaatatttaaaaggtcccatgaaatataatgtgcatgagtttgtgcctggggagaccgtctactggaagaaagaaatgactcacttttcatctcctaatgaaagtgagtttgttgttttacagtaggttgaaaggaagtattttgagtgctaagggctagatttccttttatttttaagtttagttagccgttggcctcactgatttgagaattgcatgttaagtcataattcctaagtgcgtcagcactctctctctgtatgagtgaattagcatgattgtgaatgaatgaactctgtgctaccaaagcccagcatttggaacagtgagaggaaacggaaacgtgactcactgatgtacttgaagactatgaacggggaatcacgaacttcagagccagacctgaagcatgggagagtgggcagagcctggactggggcaaggacaacgggattctagtcctagcagtgctcctgactgcctccgtgtcagtgctggaatcacagaacccgtctacctcctgtgattaataggacatgtgaattatttgtcactcggatcctttacagtttcaggattcaataagtctttgaattctactgattctctggtttgtgtggaagtgggtgtgtatgttttaatggctttcagatgggattcatccaggctccattaaatcaactttatttttaattttgaagtgaactgccatgacagagtttggctaggaaagtccataacagaaaatgaggaagcaagtaaactgatttataaggctgtgggcaactgacttcctgtggctgtggcatttggtatatagaatgatatatatgtgatgcttttggagaaaggttaattattgtctacaggcaaaatttttgctccatcacaattgcttttaaaaagctga

SEQ ID NO: 40932 - DNA, 1048 bp, Homo sapiens
gaaggcctgcagaggcctacaccctgtgatgtatattgtacagtaggcttggcttcagcatagtgggaatctctggttttgaatttctaaagtgacttgcaaaggtccaagacatatagtgaaatgttgagttgcaaattagggtcatgtgctggatggggcttgtgctggggaacagggtctgggctcacgtgtgaaccagcagccagctaaccacagcaggcggcccctgaacgattttgtggtgcactccttgttttaagcactttgctcctttcaaagtacatttttctttctttgtgaaaatcatctagaaaagaaaaagtccacttttgagtgagtgatacagagaaatctgtaaacttggggtctcattaaaatcttgctatgtagccctttccttgtcagtgtcaacgtgctcaatttaaagtacacaccctctcaattatttgtctgttgtctagctcttcctaggaagcagaagagtggttttcagctctcggtgctgcttattggggatcgtattgtattttgtagatttggcaatgggcccatacatctgtggagtgaaaagctccctaggtgattctgatgtacagccatggtcaaaaaacattgaaatagacaagtgcatgaagatcaaagagttgagggaaaacactcaacgatgtcacgtcagtccccaagaacaggtacaggggctgtttttgcttagagccggggaggagttgcagaagccccgcgaaattggcagtcctattggcagtaaattaagctctcaaggattgagttctacgtagcttcattctcccaaatgactgaatagatactcccaccttgtcctgaaatagttgtgaatgagagtctaactgttctttgctactgaataccaaaaatactagtactttagccaaaccctttctctgttgcttagaagctgctgaatcagtgtagtgcatttctcctattttatccacatcccccaaccacataattaatgtgatcaaaataaactgacccccaccacatccctggaaatttacagcaa

SEQ ID NO: 40933 - DNA, 1053 bp, Homo sapiens
cacctttatcattatatggtgaccttctttgtctcttatagtttttgtcttgaaatctgttttgtctgatgtaagtatagctactcctgctctttttgtttgtttttgttggcatggaatatctttttctatccatttatttttggtctatgtgtgtctttgtaggtgaattgtgtttcttggaggcaaccgattattgagtcttgttttttatccattcaactgctctctgtcttttgattggagagtttagtccatttacatttcaaagttattgataaataaggacttactcttgccattttgttgttttctggttgttttatggtcttctccttctttctttccttcctgtcttcctttcagtgaaggtgattttctctggcgatatgattagtttcttgctttttattttttgtgtatcttttatgtttttggtttgagtttaccataaagcatgtaaatattataacccattattttgagcagataacttaacactttgcataaacaagcaaaaatgaaactaataaaaactctatgtcttaactttatccccctgctttttaactgtttgttgtttctatttatatcttattatactttgtgtcttgaatagttgtagttattttttgtttggctcattgtttagttttgctacttagaataagagtagtttacacaccacagttacagtgtcagaatattctgtgtttttctgtgtgcttactattaccagtgagttttgtacctttaggtgatttcttattgctcattaacttccttttccttctgattgaagttttccctttagcatttcttgtagaatagttctggtattgaaatccgtcagcttttgtctggggacgacaaatttctttctcctttatgtttgaagaatatttcaccaggtatactattctagggtaaaagttttttccttcagcactttaagtatgtcatgccactctctcctggtctgcaaggtttccactgaaaagtccactgccagatgtattggagctccattgtatgctgtttctttttccttgc

SEQ ID NO: 40934 - DNA, 1033 bp, Homo sapiens
ctcttcaaagtcttttcctgactcatccaggttttggtatttttttgcatgtgtgtataaaattgcaaattaattagagaatgtatacagcctgaagtgctcattttaatctaacacttgaggagaaatataaattaaaaattttaatttttaatttttgtgggtagagaaatacaaattcttgtagaattaggtattctataacagagtctggccaagtattgacaactcaaaaatttaagtgatttgattctctaaactcttatttttaaaaattgattttttttgcatgaatttgggaacataatatgggttataagagaaagtttaatgagatgtcacctgaatttttaaaaagaattcatttgtaataaatgtaacatgataccttaaattttttctttttatagtctgaaatgatatgttagagaacatggaaatttgttacttcagaaaactttttatgtgagggaagcattgaaatatttatagaaatcgaagaaaatataggagacaggaggtggggactgagagtgagggaatatcttttcaggcaggagtagaaaggggcttcatgtcttcacaggccagaggaattcagcaaagaatgagggacacttgatcatttaagggaggaagaaaggttgggtgcagtattcctgggaaggtagtgatggctttggatagggcatactgaaagcagaggagttccccactgccatgattttttttttttttttttttttttgagacggagtctcactctgtcacccaggctggagtgcggtggcacgatctcagctcactgcaacctctgccttccgggttcaagcgattctcctgcatcagcctcctgaatattttttctttattcagtttgactttccatgatttctaaaccatttagtggagacacacaccaaccaacactgtacgtttcacatgcattccttgaagcttttttgcccgtgccattctttcctcttacatggttcttcatcttctctgccttaagtcaacattttataagggt

SEQ ID NO: 40935 - DNA, 1061 bp, Homo sapiens
ctctttgctggggctccagcctgctggcctgctttgcagatttcagattagccagctccgacaattgcatgagccaattttaaaaataaatctttctttttctaggctgatcagtagataaagatagagctacagattggtctgtatgtttgcctatatctttctgttgatttgtgtcatattcgttctgtttctccggaagaccttgactaatacagattttcacatagctagagtcaacattgtgttttctatttattgagcttgttctttagcatttagctccatccttgattccttgagtcctttgacagacaattcctctctttccaggcagttatctgattttccttttgcccagtagtgctctgtgtgtacctctcttaggccattatgttattgtaattcttggcatatgtgttttttccctaaaactaatctgtgaacttcttgcacactagaagctcctactagcttgtgtggcttgggtacccagcctacttggcgcgtaagaatttgtcactgtgtgtttgttgagtgaaagattagctctgatctaactcttaagtatgacactaggaaagaaatgaaaaggagaaacattaaaatgtaaagtaaatgtgaccaaaaagccaggagaggttggcaagcacatggtgaatatcttctggatcttcccctggaacgcaggtgtgaaatttattgtggtgatctctggaacaccacagtgaccattatctaatccgcatttgtttgtttttcaaattgtcaatctttatccagacttgactttgcccagtgatggctagataaagccagactttaaaatatttcagagacatttcaggaaaacacagaagtatcaagaaggacaaataaatgcttgtaacctcattatctgtggttaactatgaacatgttttgtgtagattttcctagaatgattttttttctttgagatagagtcttgctctgtcacccaggctggagtgcagtggcacaatctcggctcactgcaacctccgcctcccagattcaagcaattttcctgctttgacctc

SEQ ID NO: 40936 - DNA, 1065 bp, Homo sapiens
ttttatacacacaatttctgggttatcctgttgctcttcttcattcatatatataatccaaagtattattttcctcattgttctgtatgtcttttagctggtttcttttttgtgagatctcagttacatttcgttgttgttagggaagtcttttgatttgggaaaaaagattaattaacattggaataaattgttaactcttaatttttttattgcttgatttttaggaatagtttatgagcttcccaagagatgattaagcctttcctatattaagaaaggtaaagggggctgggcacggtggctcatgcctgccatcccaacactttgggaggctgaggcaggcagatcactgtgactcaagagttcaagaccagcctgggcaacatggtgaaagcccgtctctacattaaatacaaaaattaaccaggcgtggtggctcgcgcctgtggtcccagctgattgggaggctgaggctggagggtcgcttgaacctgggaagcagaggttgcagtgagctaagatcacaccactgcactccagcctgggtgacagagtgagaacctgctttaaaaaaaataaaataaaagaggaaaagggaggagaggcttctgttaaatgtctgcaacaacatagttgggtttatttaaaagtaggcattttctgccttttaatctagatatccacatgctaaatgtgaattgctttctgacttaggagtatgtttgtatctagaactgtgtttgaattttagtgtggaatgttttactctgagatggtgacttcatttgctaagtaaatgcaattggtcatgagtcctgtttggtgtatttgatttcactgggttggttttaacaacctgactgcggtgtactaggtggtgctgcgacagtgcagagtgacactgacagacatttgaatagagcagccgtggtcagtggagttatttttctctagtggttagccagtttaagaccaaagatttgtgctgaattactacagaaatgactaaaaagagcattattcataagtatagactcagacacataatcattgaattacgta

SEQ ID NO: 40937 - DNA, 1051 bp, Homo sapiens
aagttatccaaaataattttttgtcatgccttggggagaatgcatgttattattctgttcattgaagactcctactttctttccctgacacccccaggttgaggggctgttcccatggcattggttcacctcgatcaccacatttaccaaggggacttctgcacccctctgccagacagcaggacctttgaggtccaggatggccgagtctttgtttttctagagcttagaacaatgcctggatgtgatagctcaatagatgtttgaattgaattaatacttagtgacttagtgcttactgtcaggaagaataactataaaaaccttagggaggaaggaggatggatcttttgaggcaggtggatcagttgaggccaggagctcaagactagcctggccaatatgttgaaaccccgtccctactaaaaatacagtactaaatacaatactaagtacaagtacaaaaatacaatactaaaaatacaatactgctaccaatgtaagtgatcgagacaattactttacaaaaataaaaatgtaaactttctgcctttaatgtttagtgcttaaccaccaatctctgctcctgtctgtaaaagtcagacttcattaattttgctgacacagtaagttctcatggaaaatagtgacaacagccagcaatgtgaatagttacatcttggctctgtaaatatcaaaacagactttgctaagcagaaatcaatagacactcgatcaaatagtctgtttctatttttttatttttattttaatttttttgagatggagccttactctgtcgcccaggatggagtgcagtggcgtgatctcagctcactgcaacctctgcctcccgggttcaagcaattccctgcctcatcctcctgagtagctgggattacagatgcccaccaccatgcctggctaatttttgtatttttagtagagatggggtttcaccatcttgaccaggctggtcttgaactcctgacctcgtgatccacccgcctcggcctcccaaagtgctgagattacaggcgtgagccactgt

SEQ ID NO: 40938 - DNA, 1057 bp, Homo sapiens
ctcacacctgtaattccaacactttgggaggctgaggcagttggatcacctgaggtcacagcagcctggccaacatggtgaaaccccatctccactaaaaatataaaaattagccgggcatggtggcgggcacctgtaatcccagctacttggaaggctgagacaggagaatcgcttgaacccgggaggtggaggttgcaataagccgagatcgtgccactgcattctagcctgagcaacaaagcaagactctgtctcaaaaaaaaaaaaaaaaaaaaaaaaaaagacttcataggagggaaggatgaacatgtactgaggaagttgaaagtagatggagccttgaaagcatatgttgaccacagcaccctccccaccaccgtgtccccataatctaacatcttgcactggccagcattaaaggacacatcaaagatgtcaagaacacaggaacacaatgaggccatcattctggaggaacaaaggcatcaacacactctttctcttgtgctgagtcatcttccctctcataaagttccctgcagagctttaagagggtttgttttctctttggactgtgactttactgtctaagccccaagcttatgagaaaagatgccctgactttgctctgagcctaaagggaagacatacttgtggtttctaccttgtctagcccagctcacagagtagatgaatatctggcagaaactttggtcctaggactaataaatgtgcctttccctggaaagggctctgtgtcatatctctctagagacttttatgctatgccaagacagtatagcaatggtaaatgactaagggcttggggtttgaagtcagcagacctgttacatgtctccgagatggttgcagtcagtatagctgtgagagttgagagagccccagaggccttcaacagagctaatagcagaatttggaaaaattccagattattgttctactgccctagaataagttagcagaccttggtgctcaggatacctgggatctgagactttctgtgttgctacgtggttcacacatgttcatgtga

SEQ ID NO: 40939 - DNA, 1022 bp, Homo sapiens
cccagctactcaggaggctgaggcgggagaatcccttgagcctgagaggcagaggttgtggtgagccgagctcaggccactgcattccagtctgggtgaaagagtgagaccttgtctcacaaaaaaaaataaaaataaaaaaatatatatatattcttacatggtggagaggagaaaagtaccattttgaaatatgcccagaatattttgttcttaacaaaggcctgacctcaagggaaacttgtactagaacctaaccaactgggactttaccagtgcctaatcaacctgggagaagggaaatacccaactccagccacctctaaccttacgtctcatgttagaggtggggaaaaaaaaacaaaaaaaaacaaaaaaaaaacaaaaaaaaactgagaagcacttgtgaaggtcacagtccagaagtaacagactcaaaattgatcatagaactatagaatgtttctcctctgacatcttaactaccacagcagtagggctctggtataataatgggattacagctaaaataactgtaaggctcagaccctatttaagaaggggtctctaaggaaacccaaagatgatagggagagaaaaggacactggagaaaactgtagcctctgatgccaagctgcaacaaacagttaatatgacctaactcccagccaggtaaacataaaacttcacactgaagacctgtttagttccttttacctgacacatcgtgtctgctattcaacaaaaagttataagcggtgctggctgggcatggtggctcactcctttaatcctagcactttgagaagccaaggtgggcagatcacctaaggtcaggagttcgagaccagcctagccaatgtggtgaatcccatctctactaaaaatacaaaaattagccagacgtggtggcacgtgcctgtaatcccagctacctagaagcctgaggcaggagaattgctggaacccaggaggcagaggctgcagtgagcctagattgcaccactgcactccagcctgg

SEQ ID NO: 40940 - DNA, 1026 bp, Homo sapiens
ccaccccaccctcccactccccaattccccctccccaccaggggtggctaagtgaagcaaactaaatgttttaatagagcataattgttttccttccagaagcatcaagcaaccctcaggaagttactccaatgaagagtccatatatttatgcttgttcaggtctcttatttttcttcaccatttttgtttaatttttaaattgtcggaacataaagtgttacaaaacgcttaagtgacatcaatccctgctattggcttttatttagtgtacctctttcccctctacttttccacatagcacagcctcacccctgtcttcactcaggtcacccaagttatcaacctagtacgtatccttccactgttttatacttgctcaggtacacacacacacacacacacaatctatgtacaggaaaggttattgccattatcttacaaaaatgctaagattttccctactcttttcttgcttttctcaatcagcaatggaaatcacttcaagttaatggataggacttttattccttctttttaatgactagtacttcatggtgtgggtgcaccatcatttattcaactcttctgctattgatgggtgttctcctttgatggacatttgctttgtttagaggcttgggtcccctcctttttttccctccctctctctcttacttcatttttttttttctgtattgccactgtgaatgttgcaacaaacgatttcttacatagaaacaaagtcctaatatttgttcttctgtcagatacaattcctgagagtaggacggattggtcaaaggctacacaatagtccccccttatttatggtttccctttcttcagataaacctttacataactgttaccactttatgtcattataattgttctattttattaaatattgttaatctcttatggtacctaatttttaaactaaactttatcataagtatgtatgtatatcaaaaaacgtgatgttatagggatcagtactctgaggtttcagccatctactgg

SEQ ID NO: 40941 - DNA, 1043 bp, Homo sapiens
aattatagaaaactttttagtactttgtagtggtatatctttaatgctctctagaggagtacattcatactaaggataagtgtgacaagtttttgagtaaattgccatttgtatttcttgtccttttttttttcttttttttttgagacagaggttcgctcttgtcacccaggctgaagtgcaatggagccatctcagcttactacaacctccgactcccgggtacaagtgattcttctcctgcctcagcgtcgcaagtagcagggactacaggcgtgtgccaccatgcctggctaattttgtatttttagtagagacggggtttctccatgttggtgaggctggtctcaaactcctgacctcaggtaatctgccacctcagcctcccaaagtgctgggattacaggcgtgagtcatcatgcccagccctcttatccatattttaaatcaataattgtttcatgaaaatgttaaaaatggtaaatcaccaacaaattaaaatatctttctagactgatcacttaagaaacactttcattctgcttttttcattagatcataaaacaaagctttacacaatgtgcttgctctgtcttaggtttcatcacatcaaattactctaaataatattatccatgaaatacagctaccaaaagaagtagttcaaaattttggactcaaaatgtacttatacattctacataagtgagcacaagtgataaagtttaaaagttggaaagatcctatgggtcatcttagtttatctcatcatccatgacagttattctgtttcttactggatattttggaacagaaaatacatgttgtctgtctttgctggggagaattggcacccctgaagttttcaagttcggtctcacttctccatactgcttttgattgcatttcgaagtactgacagccataggaacttatcatcctctatttctgtagcacaaatccatttatattttggaccctgaagaataaatgcattcttgacatctgtaaaagcatttgaggtatactaattaatctttgca

SEQ ID NO: 40942 - DNA, 1029 bp, Homo sapiens
tggaacctacagatacagaaccacagatttggagggccacattgtatatgtactattttgtgacttattttgaatatttctgcatcattaagtattcattattttttctagactataacttgctttgtctactgtgtaaatatgccatgatttatttgtagttaattttttacagttaataacactaggatgaactgttagcctattagccaatctttgactatctctggcttgaaacagcatatcacttatatttgtttggagtagatagagcaaaaagtaaagaaatgattattattaaataggacatatcccatttatcagcagatggttacagtagttcagactcttttacttctgacccagaacagatcgggagcaatgtaactcgtcaaaggtcagtatttctgtcaatgaaaagcatgttaaactatcttgctgcgttttaatgtttaaaactatttagaaccaagcacaaatgattttgttctctgaaagctgttaggttactttttgatttatgtaaaagacaagtaattttgatcctttccaacttgaatagaaaaacaaaaagaaccctgactttctaaatggtatgttgtggaagctctaaaaagaggtgataacttcttgacgatagaagttttataagtcctttttgtacctaaacaacgagaatctgtcaagtaatacatgtatagccttatggtaagtaccaaaagaattctgtgttttaaaacaccatccaaaagcacagcccagtggtgggccacctccccaccctgaagttctgcgttacatataacctttcaggcacaaacaagaagggtgtgggatagggtggaggaggctagagatttgtctgcaagggctttaccatccactaaaagctgtgtgcaggacagaagcatctttctctcctcactttttgcacgtgttgagtatcattttgctgtgtgcccagtggatgtagcgaggatgcagaatctccaagcagcttagagtcagaaggctgcttgtcttcctttc

SEQ ID NO: 40943 - DNA, 1048 bp, Homo sapiens
acagattgacataagctctacatatattaattccagaattctttgcattttatctcaattatattttattaaatatctatacatatgtgtaaaatatgtgcacgtacataatagaatcatctttcaggggtcgcactggcaagtcgcactgacttgctttgttttgaacaaaactttgattcattaggatcacaaaatcagtacattaacatttgaatgttcaaagaagaatttgatgttattctttctttctttagtcaaggcatgcctctttagcatttttacttggtggacatttatatcacttagactttgctcctgtattgtgttttattttaactctgtaaggctttaaatctcttccatagagattgcaataaatcattactatacttttgattgtgaactcctcaccttacattacaagtgacccagaataaatataaaatgttgacggaaaaatagaaattactgaattttgttaaacctatgaaacacaacttgcagtgcaacctctgaattactttgctaaatcttctccagtgatcttttactccatctttctcatcatgctgacttgtctctcctctgtctgttcagcagtgggagacatttagtgaacgctcttcaagctcacaaactctgacccaatttgattctaacattgcaccagctgatcctgtaagtcaatcacttagcttgcttgtttgagattaattttattaacccaaatttccattcattatcgtttttagctgatatgcatgattcagtggagtgcttagagggaagtggcggcaggctttttggtttttgtgtgcttaatggtgggaaagacattttttgccattccttttttctagttattttgttgagagaaaactacgtttttaaaatctggtacatgtgtctagagaagcattttttgtgacaatctattttgttaaccttatcatttgctaattaagtgtatattttatatacatactgtttatttcagtgtagtgactctttatgtattatctgtatgcttacacatcatgtaata

SEQ ID NO: 40944 - DNA, 1050 bp, Homo sapiens
gcatgtaggaaatgctaaaaatacaaaagtttgttcactttcaggaagaaattttaagcttctgtcctttccatgccttttaaagccagaaaaatgctggattaaagagcatgctagatattaataattttggacagttggaaaacagaactaactggtggttttatactatttcctgctttatgacataattgcagccaggatacttgtgtctgagacattataacatcacaccatccatcctactattggatgcaaaaccattaatacaagtgtttttctagatgaagggattacaccttgaaagaatttgctaatagagagggtttatggaaagtaaggtaattgttgagacactactatttttgctgcatctattcatcttgtgtcttttttaaaaaccagtattacattaaaagaatatttgtattccattgatatcagtttgtaaataaaaacattctttctaaagcatctcaaatctaaagcccatgttcattctaaataaaatcgtatgtgatcattagagacagaaatggaagtcccttctaaattcaggtagtagtacttgcattttccctacttaaatattcccataaagttttatttatagtatttggtaatgaggtcatgaatgtcataattttttttcgatatgtgaaaaatcaaaatgttaataaatcattgattttgagacatctaatgatatttctaaaaatatctagttaggatatggaatttagattacattttaattgtcttccagaaagcactagtaatctttcaacatagatttatttagcacctgtggttacggataagacagtataggagatgaccctaataatctctaacctttatggagcacttttgatatgtcagttctgtttaaaaaacaatacaaaaacaaactctttatatatattaactcctttagtcctctgaacaatcttatgaggtagataatatgttacagatggagaaactgaagcacagagaagttatacaacttgcccaagtttgcacagcgtaactgggattccagtagtc

SEQ ID NO: 40945 - DNA, 1032 bp, Homo sapiens
aaatgcccgcgcgatacccaagtccgaattattatagattatcagctgttctttcaggaaaaatggtgttccacgaaaaaagtggcttgttcagcttacaactgaatcacacaagtacttttctctgagacaaccattgtacttacatatgcagcagaaatgctgtgtgtatgtatttcccattttgacacacagaggaagatgtgtttttagggctgagatttaataaaattaatttgtactgcttcatgaacattcataagtgagatcagcatgcatatttatttatatttaatgcttatgtatgtgggggggggtaaggaatacaataactgtaagtgaagaatacaataactatattttgtcgccactgccttgattcagtgcaaatgtcaacatgggaaaagcattattacaagaatagttttcacctttcaggtctcttttaaaagagtcttggggactcttaggggtctgtggtccacagtttgaggtctacaactctaggaaaataactctattgaaatagcggtaaagtataattatttgggtgactagcatttcactttgcagcctcaagcagctagacccacttcagctttgtaccagtgaaccagaaatattcccagaatctgtcccaaatcataactgccctgaggtgggggtgtggtacagcttggccctaaatttgtcagtagaagaaatcatgagaactgtggtcttgaaaacccaaccaggacttgcagattgccctaagattgatgtttaaaaataaagtaatagagtcttgctttaaataaattctttcgaaaattagtcatcttgtagttaatactgttttaattctgtttattttcttcagtactcacctgctttggggaatcccttgaagatacttctttattattctcctggtagactttcactttcagtatattgtcaaatttatagctactgtttccctttccctttgttatcactggggataaagtttcataatttttttttcccaatgaaaactatccaatgagg

SEQ ID NO: 40946 - DNA, 1060 bp, Homo sapiens
taagaggccttccttattctctggactctcattcttttgggagacatacaataaataacagtagagtgctcaaggaaggcctctgaaagcatgacatttaaggtgaaacctgaatgacaggagaggtctgaggggaaaacatactgaagatacagcaagtgtgaagcagtcttgacttactgaagaaagaagggaagaggtattttagaattcttgtattatttattctattggaatatgtatttaagggctgtactgacatactggtgaaggatgagataatgtattttttagtaattaatttcccttggttactactcagttgtcttaataccttgagtcattttgccagataacaagatcttatataaagctattatattttatatatataaaaaatatgtaataattcattgatggccttagaataatttttttttctgggcatccagtgtcttaggcagctgaaactctctaggaccattgtatcattgggaagggaggttaatatataataatgcctgtatgtaagattatctttcatgaaacttggttttacccttctttcccaccctgcccttaacctacttgctaaaggacacaaagggacattattgcagtcttgccatttattttattgccatttttccagtattgtgaatacctttgggacagaagatgcaagtaggtggtccaagtgttgtgtttggtctgcatattttaaaaaattattttgactccacactagcacttgaaaatgggaatatattatagaaaattccgtgtatccaactttagaaaaatctcttcatggtgtcattaggcaagtattcttcaatagcagcagtcagctagagttgaatagcagctgcttcctttacacctgcactccttagttcactactttcctcaccttgccagttttgctaattcatattaattgcttgctcccataaggcatggttttcagtggctgctttaagggaggtgtagtacacagtgatgggatcaaaaccaagaattccttctatcactgtcctttatttttactctgtaataa

SEQ ID NO: 40947 - DNA, 1028 bp, Homo sapiens
ctgtcccaaaaaattaataaataatattagctaaatgtgatggcacccgcatatcattgaagctattcttggaaggctgaggaaagaggatagcttaagcccaggtgtttgaggctgcagtgagctgtgttcacgccagtacactccagcctgggtgacagagcaagacctcatctgtaataacaacatgctaactgtcaaaccaaatacaaaagagtacatattgtgtggttacatttatatggactgtctacaaaaagcaaatctatagagatatagcagattagtggttgcatcaggccagagcaagagaaatggtatggaggaaaatacttgggtgatagaaaaattctaaaattagattgtagtgatagtgctctatacactgtataattttcttaaaactcaatgaattgtacacatatgatggttgaattttatggtgtataaattatacctcaaagctatgaattaaaaattacaaaatagtcatcttggggaatgtaaaggttgaatgtggtggagaatgaaggactgtgtactgcttacatagtttaattacaaaacttcagcataatgtaatctggcattttgataaaggatttaaattttgaaagatgatgtactgatagatttttatgtgtagaggagattgccatatctcatcttccaagattcattagaactgagtatatttacattacattacattagcatcaagctaacatttattcactgttctgtgtgacagggaccgctctgcgtgctttatatgtgttattttacaagtacattatttattgaccttagaaggggctaaaaataatatgatttagaatgaagaccagtttccatctattgacctttggtggtatgatgaatttttgtacacttaactcagatatcttaatattatgggaaattatagaaatataatacctcaaagaataatgcaagtttgaagtagtcatgactgacaagtaataattttaatgaaatagtagtttcagtctacaggactattttgg

SEQ ID NO: 40948 - DNA, 1028 bp, Homo sapiens
cagttatgtatactaaatagcagtctagatatcttgaaggcaatttacttaaaaattggtctaagacatagaaatatgagacaaaaggagaatatgtgcttaattcccttaagggagtttgggattgtctgaaaacacagtcctccattgctttctaagtgggaaacatttggggcagctcatatctaatgcttagttctctacttaacactgggctaggcattgcaggcatcagaagaggagtaagaagctcttgaggatcttgtcaattataggagtgctcatgtataacataaggtataatgtatgccataggagaggtgccaagtgttatgaaatgctaaggaggtatgaccaagaaaggctttttgacttaattcagatggactttaaattagggtggagtgaggggaatggaattatgagggcttccaggcagagaaaagtgatcagaagtggaaagtgtaggagccttttcaaggactagtgttttcgggataacagaatataaaattagaaagaggccatattgggaaagactctgaagaagggcagcagataacgatatttcagcaagcaatggagacccattgaaaagtttttgactttgagtggcagaaagggtaaggaatgacactctttcagtggtctggattgggtgctaggtcatggacatccaaccagggtgacagcagtagaatagaaagggagagactggatatgttattgaaggactgctgggtagccactatatgaggtgctttgtggaataatgtttaattgaggccagattatcaaggttggatggagagctttgaactaattgtgtaggtaacagggagtggtagatttaagagaaatgactcataaagcagtgctttaggagtcgtttgtcagggccacaggaattagaggaataaaactgtagacttaacttgggggctgattttgtatggcagatacgaagtgagaaactgggccagtggtactcaaacatgggaatgaaggtgacaatggggaagaggcat

SEQ ID NO: 40949 - DNA, 1044 bp, Homo sapiens
agcagaaatactattcagatctcttctcctactgcgacattgagagcaccaagaaggtggtggtcaacgggcgggtgctggagctgttccgggccgcgcagctgccgaacgacgtggtcctacaggtaacgtcgcgtcccggggccggcgggcggcttaggcctgcagtcactggcctccaggagtgggagtgggcgccgattccttggggcccggcggggggctggttcctcggggggtccccgcagcgggcaggggccgcaggtgcccgggaggcctggactcgcgccgcggccaagggggagggggttgcccttagaggacggaactcctgtggtgggggtctgaagagcctcagccggtatcccccacgaccctgagaatctgtgctctgtactgcaagagctatctcacttgaaggatcttaggttgttaatgtgtgtgaatcctagaacctggcatatagagagcttttcggatcctgcagagtagtaaagttatcagtatgggcaaaatggtttttttaattcttggattaaccgagaagacgtgataaagtgagttctatagatttaggaatcgaagaagcagtttttttaaaggaagcaaaattcttagggaaattttttaaaatgtgaactacttagtagttttacaagtaggcatacaagaagttgtaattatctgtagaacgtgtgtatgtgatgagactgaacaatgtttttcaacaggcattcgaaagcatttgtggaacttgtggatttgggttgggagatgagtattgaacagctggtaggcagaagtgcgttatttgccctaatctgaagccctggaggagcaaaccctgtaggtttaaagcctttttttatcatatctgcttttgaaacagaggacttcctagaagttcttatctaatgtatgtggtgagcattaatgctactctgtttaatgattcatagctgctagtaggagtctgtctaaacagtatgttaggaacaggttttaagctttcatcttttatattgatccaagctagttatccac

SEQ ID NO: 40950 - DNA, 1029 bp, Homo sapiens
ttctttgagaagatcattacaatttataacatcccagtcagatgaatcaggaaaaaatagacgactcaaattatccatggcaagaataagagaagtggcatcactacagattctacaaatagtaaaaagttaaaagcagacgatcctgaacaattttatgtcaataaatataaaaatgtgaattaaatgagcaaatttcttaatagaaacaaccattaaagcaatttcaataagaaatagatattctgaatatttaatatctactaatttaatttgtagtttaacatgctcaatacaacacccagtatttgacagttttacaagcaaattcaatcagttattgaaagaaaaataataccaattctaattaaattcttcgggaaatttgaagaggaggaaatacttctagccatattctggtgctaaaagcaagaagtcatattacaagaaaagaaaactacagaccaatatccgccatgaacatagatgtaaatattctaaaggctagcaaattaaactcaacaataatataaaggataatacattgtgatcaagtggagaagagttggtataatagtcaaaaagcaatcattaattccacatattaacaaattattataaaaacaaaacacatgacaatctcaaaaaagaagaaaaagcatgttacaagatctaatatcagctcttgtgaaaactctcaggaaattagagaaagaataggaatccctcatcctgataaagagcagtcatgaacaatgattgtaaatgactgaatgctcttaccctaagatcagaaacagaaaaacatgtctgatttcactgtttcttttcaagattgaacttaaagttttagccagtacaataagacaagacaaaaaaataaaattcatccagattttaagagaagaaataatccttatttgctgactacatgtttacctatgtgtgtatatatgtatgtatatatacacacatatatgtacacacacatatacacacacacatatacatatatacatatatatatat

SEQ ID NO: 40951 - DNA, 1072 bp, Homo sapiens
aagaaatccagtaaaaattagctttatgttaggaggtaaaaatcactatgactcaaagtctaacatattccacaataaatatttttaaatggcattaaagttcctgaaggaagaattttaaaattctggtatctacagatctatttgattatactgttttttgctcctctgagctaatacagcacttttactttaccccgcctatattaacaacgaaaatgtaattgaactatctttacaatttcagattctcacctaagtgctgaaacgacctcatagcacaaaggggagacagaaattttaaaaggtaattatgaaacataaaacagatgctaaaatgaatagatgggcatagacctgtgggactgcaaagcaaaacaaattattaagggtttgatggtcagtgttatctaaacattgtgtaaacttttaaatgtttatgaatcccatctcagaggtgtaactaatatttgtttgtgtgtgtgtgtgtgtgtgtgatacactgagcaactgtataccacctagcaagtggcattcttgcttagcgacttacactggcctgtttactcaccctgctgtaaagatcttcattgtcctttccgaaggatgtatttcttccttactctacccatggtcagtatataaccttctggtagttcaagctgtctgcagcaaaatcctctaaggaaagatggctgtctaactcttttcttcagtctttgaggtattacacagctctcagctctctgtgggccctttatccggaaggcagtcttggctccaaagcaggcaacattcttgtatctgtgcactgcaattctagtctgcccctgtaagtaaaaacacatttatactctttttcttatatggataattcttctccaaaagtatataacaccccaattgttctttggttcacttttatttctgctcaatgagcacaggagagtaacttaagatcacagtctcatttgtaaccaaagaaaggacctctcgtctcacaaggtcatggtaaagaaagaacaagacgattaaatggaacttattgtaaaattatattatagtccaaaag

SEQ ID NO: 40952 - DNA, 1103 bp, Homo sapiens
taaagcattcttgacaggtgccctggagatatccaggatattgctcagcaggtcggtacattgaggtgaaggagaaactgtacctcattatgtagtaagttcagagcctaaaagcacatcacaatggagtaaaattaacttctcattgtcatgtaaagcatggtataataacagtcaagtaaaactcttaatgcaaagagtgtattatatcaggttggcttggattgtataaaaatctaatttcagtttcagagtctggacaggaaaacaaatgcaattagaaattaatgttaatctgctggtaatattcctatagggaaactgatatagaaagacatgtccaagacttgaaaattgtataataatcatgtatgtatttgaatccagagaggtttgatcctgggaagtctttttgcctaacagctttgactttctgaaggtcagaggtttggcctgacatcatgtatcatgtcctggattctatatggtgtcatatactagttgttgaaatgagatatgagaatgcctggccaacaagtggggagaggagagatatgtgaagaagaggagcgttagcacacgaacagtccccagggagaaactagaaacatggagtggtatttttagatacattacatgttaacgttacattaatttgttgtgaagccaccctcaaggactttattatacagagaagaataattttccttcatctttcagtgaaagtgttgttctaatctgagaactaatgttgaccagctgacaaggtattagaacctatattctcgtcctctattcttttcaatcattcttctctgttatttttttctctcctcttctgtattattttttagtgtgatgttaggcaatttacttaattcttcttcagctgttctctttgtaacctaattttcttttatactattaagcacatccacgttctattatgcatgaaatatatggaaaaatcaataaatgaattaaatatgttattcttgtttataaaaatttcatattcaaaaaaagaaaaaaatacagatttggaagcatcataagagggtcttccaacaaaaaatgctgagcagaaaccaatttatgtccaa

SEQ ID NO: 40953 - DNA, 1058 bp, Homo sapiens
cctgatatgtggggattacaattctaggtgggatttgtgtggggacacaaagccaaaccatattagtgttcataataacactgtgatagcaagagagtttatactatatcttatgttttaatataggatagcccaccttttctttcctacacatattctattatgccagcatataattttaatatttgctattgaatcctctcacttgtagtctaacagtttactatatttcacaatgtttgtcatggtccatgatatacctaactagtgtaccaagtggctggctggtgtggcattgttggatactttgttttatcacagagtacaccatattttgtctttgagggtaagatgttagttactattcaatgaaaataaacaaaacaaaacagagctgaatcattggtgttcttccatatgtaaaagtaaagttctattcactaaacatgtctttcagactcctagatgaggcaacttagacctattttgatgcaactataaatactactacttcattgaaaaatgaaaactccacaataagttataagctgggactatgctgggcaaactggaacatatgattgccctaatctgatccagcttattatgtgtcgaacattgttcaaagcatttttcatttaatttctaagtgttttaagtttcttaaaactttccacttaattttcataacaaccctgcaaggtaggcactattatttactctatttgagtatgagaaaattgaggaaattgagaaattgagacatggagaatgggtgtctaagtccatttgccctgctatatcaaaatatctgagactgagaaatgtataacaggtgtattttcttactgttctgaaggctggcaagtccaagatcaaggctctgatgggattagagtgtggtgaaggctactctgtgcttccaagatggcaggcagcactttgctgcatcctccagaagggagaatcactttgtcctcacctcctaaaataaaataaaataataataataataaaaacagaagggacaaaaagagtcaaactccctctgtcaagtc

SEQ ID NO: 40954 - DNA, 1030 bp, Homo sapiens
gtaagactttgtgaagtaatgtttcatgccctatgaataaagcacttgggcagcaacggtgtcattgcctgaaggcaactacctcatttcaaatccagggagcaggagtgtgaagatttcctccatctaacctgcccatgcttatcaccatgttttattgttacaattctcatgatgatttattgagacttgctatggaccaggaactatcttaattgctctctgccattatctaacataatcacagcaacaatctgagttgttgtgcagatgaggaaattgaaaatttagacacattaagtacaacgatataaactccaagatagcagagcttttgtctactttattcggggctaaattcccattgctactttgtaggtgcctgtcatgggcttaattgcatccctgcaaaattcatatgttgaagccctttccctcagcacctcagaatgccactgtacaggttgagcatctctaatctgaagctctgaaacccaaaatgctccaaaatccaaaactttttgaaggctgacatgatgccacaagtggaaaactctacacctcacctcatgtgatgggtttcagtaaaatgcagtcaaaactgtgttttctatgctaaattatgtaaaatattgtataaaattacctttaggttatgtttatatggtgtttatgaaacatacatgaatttcatatttagtatggtctcatcccttaagatatctcattttgtgtataaaaatattccaaaatctgaaatcagaaatctgcaacacttctagtcccaagcatttcaatctgtattgggagatagggtctttaaaggggtgattaggatagaatgaggccattagggtgggccttaacccaatttgatgatgttcttaaaagaagagaaaatttggacacacagaaagacacacacgtgtgtgtgtgcgcacagagagacaacaggatgtgcacacacagaccaaagactatgtgagggcatagagagatggcagccaaggagagcggctctcagtagaaa

SEQ ID NO: 40955 - DNA, 1661 bp, Homo sapiens
tggtgaaatcccatctctactaaaaatgcaaaaattagtcaggcgtattggtggacgcctgtagtcccagctacttgggaagttgaggcaggagaatcgcttgaaccccggagcgggaggttgcagtgagccgagaccaggccactgcactccagcctgggagacaaagcgagactctgtctcaaaaaaaaaaaaacaacactacaattacatataatattatgtgtttttctgtgtacctagtattaacagtgagttttgtactttcacaggtgaatatttactgctcatcaatgttattttctttcttattgaaagaatatttttagcattccttgtaggataagcttggcattgatgaaattcctcagcttttgtttgtctagggaagttattatttgtcctgaatgttggaataatattgtctccatatataatattctagggtaaaagttatttttcttcagcactttaaatatatcataccactctctcctggcctgtaagatttccactgaaaattctacttccaaacatactgaagctccattatatgtatttgtttcttttctcttgctgtttttccaatcctttctttatccttgacctctgggagtttgattattaaatgcctcaaggtggtcttttttagggttaaatctgcttgatgttctacagccttcttgtactcgcatattgacatatttctctaggtttgagacgttctctgttattaatccctttgagtaaacttactactcctatctcgttctctacttcctctttaagagcattaactcttagcccttttaaggctattttctgaatctcatatgtgtgcttcattgttttctattcttttgtctcttctgactgtgtattttcaaatagcctgtcttgaagctcactaattatttcttctgcttgatcaagtctgctattaaaggactttgatgcattatttagtatgccaattgcattttcagctccagaattttgcttgattctttttaattatttcaagatctttgttaaaattatctgatagaatcctgaattccttctatgttaccttgaattatttgagttccctcaacattgctattttaaattccgtctgaaaggacacacatctctgttctccaagattggtctctggttccttattttgtccattggtgaggtaatgttttcttgaattgggttgatgctaatagatgttcttcagtttctggacataaaggagttaggtacttattgtagtttttgtggtctgagcttatttgtagccatctttcttggggaggctttccagatatttgaaaagacttggatgttctgatctaagctgtgtcttctttaggaggcaccacaacccagtcatcctgtggttcttgcagactcttagaaatactgccttgatggtcttgaaccagatcggggagaattctctggattaccaggcagaaactcttgttctctttcttactttatcccatacatacagcgtttccctcactgttctgagccacctaaaactaggagtggagtaacacaatcacccctgtaatcaccacttactatgacctgaatccaacacagtgctgggtctcaccaaggcctgctgtaaccactccctggctactgcctatgttcaccca

SEQ ID NO: 40956 - DNA, 1030 bp, Homo sapiens
gagtccttcccactcttccctctcctctcctcaagttaaacaaaggggtcccttttggagccaggagctgtgcaacctggggttaggggaggggtcaagccagcactcccttagctggctcaactgatgtctcagtaggtagttggccctactcacccagtcccctggctctgagcccagttcagcactaggactcacctaggaattgcagtctgtgtggcttaggctgcctttcaagattatttagaaccccggagcactttagcctgcagtggcgaggcttgtggaaactggagttcagactactgggatggaagactcccctctggctagggctggctaaaatgctacctctgtgggtgagtgtcagctgagtttgctctgggtttcctttctgctctaacaggacagcactgattgctgtgctctgtctctccctagtgcacagaaacgcgccccttgcaccatactgtggctgacaggggatggggaatggggggatgatcataattcaagacttttttctgcctcttcagtgcttctttcagcgatatgaagttaaaaccagctcacctgattgagtgctcacctgattttggtttttatgaaggtgctttgtgtgtgtgtgtgcgcgcgcatgtgtgtatgtgtgtgtagatagttgttacgttgttgtccttgcccagggggttgttgtggggaacgactggtggagccttctattctgccgtcttgctccactaataaagtagagcttttaacttgtttattgaccattggatatccccaccaacaatgtttctgttcaactcccttgacatttttccatttgcttggataattttgtcttagttgaaatttattgtaaaagcaggatatgaatatattttcccattatgtaccttgttttgcattttgagattcttaatttatgtattattagttaaaagagaaatcaatgttttaattttttctttattactaattctttctttgtcctgtttatgtggcaatgcacttatcctgtttg

SEQ ID NO: 40957 - DNA, 1036 bp, Homo sapiens
agcctgtgatctaacaattgcttcatcactcacttgcagaatagtaatgtgaaaagatatctttctctcccatcaatactaatattagaatacagttttctataatcaacaattaaatatttatagaaagtatgtaagatgaagattaaaaatgtatataaatatgtaaaacagtaaaaacatcttttataagggaagtattatactacgatttttctgatttctgatgtcttgtcacaaacacaaaagaaatacatagaagttgacagattatacttaagttacaaagacagagtatccccagcttgtattgaaaatgatggttcatgtatgccaactgtctacatgtatcaaaataacattgaatgtaccaattaataaaagaaaaaagaaagacgaaactgggagaatataaagacaaaatttccatataaaatctagtgctgggttacaaagatatttttatttaaactatacatgcatttttacatatatatacacacacagaaagatttatatatgtaatgtataaggatgacattattttatttctaagaggtgttcatgcgaatttaagatcttgattccctagggacaccgaatcccagatgagcaaaatacaggagatatttattataaaaattactttttggggctagatgaattccccttccaattagcactaggtcataagctatattttaaaatgtagagttcattgtttatttgcatttgatttctctctctaataaaaaaggagaaatagatacaagtaagaccaacttcttttacggtatccacaaatctttacaacaattatatataatatttgtaagaataaaaaataatattttctactaggacaatgtgcatttcagagtcttccccatcatttcctaccatgaaaaattttaaatgcttacaaacgtggagagaataatatgataaaacatggccatgtactgataacttagcattaacaattgccaaatttgggctaattttattttatttatatccctcccacactccctca

SEQ ID NO: 40958 - DNA, 1026 bp, Homo sapiens
aaaaaattagccagacctggtggtgggcaccagtaattctagctactcgggaggctgaggcaggagaatctcttgaacccaggaggtggaggtttcagtgagctgagatcacgccattgcactggagcctgggtgacagagcaagattctgcctcaaaaaaaaaaaaaaaaggaaatctggagacagacccacacaccgggacaaaaccacaggaagataaagacagcgattgtggtgatggttctacatgacaaggaaggtaaaaatggccagcaaaccaccagaaactagatgagaagcatagaatacattctcattcacaaacctcaaaggagacaacattgctaacaacttgatcttgaactttctagcctccagaactgcaaggctataaatttctgttgttacagtttgtgttacgttgttatggcagctctagcaaagtaatatagggcatagccttggttatctcatagtcattctggtatgacagtggttttgacagctctctttgaactctttccttgacctcattcagctgttctgttccagtaattgccagttgattgctctatagttttcagcaatattctgaatcataaattgatccatagacaaagccaatcaagttcaggctccttggaaaggataatttgtgagaacactgtttgagattttattttttctcatcccaagtgggctcctcccacttatttctttttctggttctctcaaagtatctggcataaagttttgtctatgtcaaatgaatccagtcatctcttcccaatttcctttcactacaacctctcttgcttttgagagcactcttagacttgaatttctccacattctattgcatgtaaagagaattactttgagagaagattaagagctatgtgttctatgacatgcttctccccagcctccaggcaaaatctctgagccacatctctggagtttgatatggagacagtggtgttcttcactctgagtgacaccttgctttagtaactgagtgtccc

SEQ ID NO: 40959 - DNA, 1057 bp, Homo sapiens
gtccataaacattggattttttaaattcatttaagtatttaattttttgaataatgctttataattttcagagtatagctgttcttcttttgttaacatatatctgataaggaattaatatccaaaatatattaggaagtcacataactccatagcaagaaaataagtaattttaaaatgggcatgtgatttttcttttcttgtgagctctttatctaattttggtgtcagggtaatagtgaactcatcgaatgagctgggaagtattcccttctattcaactttttagaagagcctgcgaagatttggtattaattcttttttaaatgtgtggtgtaattcagcagtgtagtcaactaggcctgagctttctttgtgggtagcgttttgattattaattaaaagccttcacttaatgtaggttaattcagattatctatttcttcttgagtgttttaagcaatttattttaaaatcaatttagcaaagacagaagaaatatgcattcatactgtcttttataattatgtaattgcctttactagggttctttgtttttttgtgtgagtatatggatctaaattcctgtctgggctaacagcctgagaaaagtttttttagtgatttttgtaaggtgtctattttaaaaacaaattttctcagtttgtgattatcgggtaatatttctatttcactttcatttttgaaatacagcttcagacttttggttgaccgtgtctatgaccactttgtatatgatatgctattgcactgccttaggcttcccttgtttctaatgagaagtcagttgataattttattggagttctcttgtaagggatgagttttgattttgggcttttcttttcttctcttggtactttcaagagcttggccaggtgcggtgactcatgcttgtaatcccagcactttcggaggcctaggtgggtggatcacctgaggttaggagttcaagaccagcctgacaaacatggagaaaccctgtctcttctaaaattacaaaattagccaggtgtggtggcacattcctataatg

SEQ ID NO: 40960 - DNA, 1035 bp, Homo sapiens
aatcataaaatattagcttcaaactattacactatttttaaaagattgtttttattgtgtttaatatcgttttccaatttaattctaattttcgtttgatgtttttatgtaatatgaacaaacatatgacttgaattaacaacatcaatactttaaatctcagatttgctacttgtttttgtgtgacagtgtatacgtcagtttagcttgcatgattctcattttattcatgtgtaaatttaagaatataccatttctttcaccaaatgttagttgctgaataaatgcatagatgtgtgtgtgtgcacacacatgcatgtgcacagaggtggggggagagagaaaagaaagggagagattgttattttgttttggatcaaaatatttctcccacaggatgttctttgcacaaaggcaaatccctatatgtaaatggtagaacacttgaataagatactgtggttttatgggagaattttaatcaaataatttaatttgataatatgtgcctattgcacgtatatagaattagactaatccctcctccacatgacccctctgattgaagtcaattccaaattctagctgatacctacaaaatgtaactcaatggatttgaaaaaactcattttaaaagaaatcaattaattttttttcaaaaatatatctagagagccaaattatcagtttgatcctcccatcaattcaccagttgactggttgtggttgtcagttatgcaggcctagacttaattgaagctgaatatagtgtttttctgaaagcggaggaagccatcctggatcccagaagctattatagtttcattacatgtagttttgtgaggcaagtacccagactaatgaagtctaatttcctgcagattaaaaaagagaagtgataagatatcactgatgttaggtaaagaaattctgaatatagcacatttattctgttaaattactcatgaacacatgaaaacgtggttgcaagctaacgggagggccactagtattttcttcctttgagagctgtgg

SEQ ID NO: 40961 - DNA, 1383 bp, Homo sapiens
atcctttgagtggggtggtctttctcaaacttgaagagataaccaagccagatttgattagataatttaaaagtttatccatgtgcccagctctctgcacaaacaccctaaagaaagtaaattctttgggagaggcaactgtataatttttaaagcttaggctaaatatgatgtagtgccaaaactacagattttttgagaagtttagatgtctatctaaaaagcattttaaagtaggtttgaaaaaaattcaggattattttaagaatggacatctctatgagaagggttaagaggaacattgaaaacattgccctgcaaggttatccaaggcatgtatcaatgtctcagtgaacagtcacttgcttagaagcctttggtagtgaggatttgcatattaaattactggacacctaccggaaagcaggagaagcatccaagatatgcatattgattctggaaacgctgaaatagcaagttgaagagagaaggggactatcactgggaacatcatatcagaattcatcagagaaaatgccaacaggagctgtcttttacttaatatagtgagaaaagtgtgagcttccaatgacaacaggaccaggcacagctcctgtggagagcacgcagaagataggagcaaatctttaggccatcctcttctcctgttccaatggatggttacacaaggatgggagttgggtggggtaaaaaatgcaatgggaaatattatcctactttgggaggtgaaggataatcagataatgattttcaaaactgaagggagacagaggcaagtagaaaataaggcaaagagaattacctagaatgtttactcttatgtatagcttggttttatgacctggctggttgtgattcccatatattaataagtgggttcatggtcaggacttacagggccagggccagggtgaagacttttaacatgaaaattatttgatttaacctcagaatttaatgttacagaaattctcaaagattgtatcaaggtacattgctcagtgtcatagtacacctactactagataggattctttcagggacatatgtctggtgtgtaaactaacattctttctctgtttgctagttgctctgaggttactacagcagcccctgatttatctatgtggacaatatccacagaatttaagcattatggtcctgttgccttgtgataatgaaaaagcatctaactctacattactagatgtcaattttgctacaaaacttggattttgacaatcacacttccaccttatacacacttgggcaagaaagtttctattagagcccggagaaataccacctacagacaagatccttagatttcagagattaaagatgttgtaaagcagggactcc

SEQ ID NO: 40962 - DNA, 1031 bp, Homo sapiens
aaatgcaagccaattttgtgtgcctgtatatatttgttttgtggaaatggcccagatttatttttatttttctgattttagttttcttgctaacttcacattaaacaaataaattagttaagtgcgaagtaatattattagaggaacggtttcaagaatgtctgtgaaattgcattttaatacccattagacatggttcttcttctctataaacttctctccaacattgaaaatgcaattctgcagcattaagcaaaaggcatatttgaaataaagcttgattttcaatcactgagctaaacctatttcaaataaacaccagaattcaattaaataggagtaaactcttcagcttgacccactaccatttcaatgcttcgtattctgaaagttttaatagggaacacaagacttgagttgaatctgatttggagaatccgaatgatctggctgaccggaaaaatgataagagatggggagaatgattgctctttgggagataaaagtttttgagaaacaagttagtagagaaacgctttcgaaacgctgatgctgacaaatgtgaagcaggttcccggtgcgctgattaccaatttgtctgagtccagtgaaacagaacactcacatacagcacaagttataggaagcagatttatcacttacagataggcaatgagggacaacagaagcctaggatgcaccacaagccagtctcccatggctcaggaaagctacccagggtggatcaagtctctgctgtgcatgcccaattacaccacagtggagggaccctcaatggcagcctgccccaagtcatacacctcagggtcacattaaccactggactaaattgttgaagaataccctgttctgggaagatgagggagctgcaaaagagcctatagtattccagccacttcctccttacctcaggattttacattcccagaacatcctagttattcttgaaacctacaagcaaaacggggaactgggttggtccaaggccacccaaagaacagtcttgtaac

SEQ ID NO: 40963 - DNA, 1025 bp, Homo sapiens
ggattgataactcaaaaattctcaattggaaaaattctactataatacttggttcttggaaatgtggccattcaattaattaagcactggaagaattgctttttgcaaattattactaagtgattcatttttgcttcacttgcctgcataccaggaacatactacattctggggtattcagtttttcttatactgaaagtttcctctcttttgattctactttaaggtctcagttctattcctaataagatggtagtgactacctctgtatgtttactcatataccatattgtatctaatctatagcataccatataactgatgttattatgaggagtggagccacatcaagtgatgctttagaaatgtatatggattttttggttgtaaaagtgtattgggagtaaccgcacacatttcactgggggatggctggggtaccagatgtcctgcagtgcataagttcatcatataacatgaagaaaaacttttcagcccctgcaagaccttttgacctcttttgaactcctgtcagttattcatgcaaagtcgagtgaggagactctgtattatttggaccaagaaccaaattatcttttacttataaacaaaataatttgtactgttttaatttaaattttccagaaaacaactataaggtaaatttaaaaaagagcatactttgttgtttgaaatttcaccaaaataaaattgcatcatcaataagaatgtcactttagtgtttgagggaataattccaaactgtacttttctgtatttgtagttactaggtttgtatttattttatgtatcactgtgatcttctgaccactcaactgtacctcatatacttttatgctttttaaatctgtaaacgtatcaagagattttaaaaactgaaaatgcagatggaaacctgcattttatttctattctccttgttgggaatgttttctcataatagttcctaaaaataactactatggcgttaatcatttataaaataagataatgatcattttata

SEQ ID NO: 40964 - DNA, 1050 bp, Homo sapiens
aaattatattgttctgtttttcaaagattgcttttttgcttcttcattaaaaaatgagattataaaaatgtctgtcagaccattcacctttcagtttcttgacataaatgtgtttaagaactatattttgaagactattttttttcactcggtacttcagtttttttacttacatttacaatgtgcaaaatttcaggaatggcaggtaagagagataagtgactaaaataagatggatttgatcaccctttccacattaagaaagacattgaaattgcttcatttgggcatgtaaacagacaaaaaagcaaacagggaaacaactttttttcattgtcatccctggactcctttctgtttcggcacaatacatttttttcttctttaatgtttttgaggagaagaatcattataatcttaatagttcagtaaatacttgtttacttcctcagttgctagactcttaggagaaaaagtgattttgacaatgcttaggaataaaataaccgaatactacttaagtgtttctgcggtgctttatgggctggcaaatggtcagttacacacacaatgccacagctttcttctgacataagcttttcattattctcccttgctgtgtgttgtgtctcttctttgtttctttcttttttttttgagacggagtctcgctctgtcacccagactggagtgcagtggctcgatctcggctcactgcaagctccgcctcttgggttcacgccattctcctgcctcagcctcctgagtaggtgggactaaaggcgcccgccaccacgcctggctaattttttgtatttttagtagagacaggttgtcaccgtgttagccaggatggtctcgatctcctgacctcgtgatccgcccgcctcggcctcccaaagtgctgggattacaggcgtgagccaccgcgcccggccttgctgtgtgtctcatctagcatcgttggcggggctcacaatagcgcatctgattttatgcatagcttactatctttcaacatgctgaagcagcaggagttgaaaaaaaaag

SEQ ID NO: 40965 - DNA, 1027 bp, Homo sapiens
ctgattgagtttagcattgtcttccaactgtcactgtaactgagtcctcaggaagccaattctatctttctattaagccagtgacttctcaggtatgtgcaaatacaagtaaactatatgagcataagccaattgcttcacttctttttctataaaataaatttcttgataagaagcaattttatgcagtatataatgatggtagataggtagtccataagtcaactggatggcagagctggcagaagcattactgggagataaagcaaatctgcgtctgtatgcagaataagtgcataccccagagaggcagaatctctgctccctttgtgaagaagaagttcaatgtaatcaacctgccatcaggtgcctgatggtactcctggggtatggtgtcataactgggtctcagcactggttactactagagacattttaggtacttagcattagtagtagcaaggtcagctttggtaagaggaaaaacatatttttaaactcattagtagtcttactcctgacagtatagacactttgtttatagtcccattgagcaaatactgtggttgcctgagaaagaagtttactgatattcacagtgtcattgtgtccacttgattactgagagccttctcaacaatggatgttccttagtgtttattcatatgagatataaatatcttcaaatctgggctcattctgaaagctctatcctcttccctagatttccaattttccaatattattctttccaagtctctgacctttcagccaaactcttaacaactgcctgtgaatcagagcacatttttttcctggccaaatagagtggccaatgaaagtaaaataaaattgtaccgttcaagattctgcacactggaaggattttcctttatgactctgcttcagaatcacccctggggagggttgtaatttctcagccatctacttctggatgggatcatatcatgtagatccatcttttaactaggctcaagttttaatttctcattcaactaattgtaaa

SEQ ID NO: 40966 - DNA, 1050 bp, Homo sapiens
tccagttgagcaccttaggaatattatactgtattacaaataaactcattaactaaagaagaaatcataataaaatttagaaaatattgagaattgaatcaaataaaaatactaggtaaaaatgtatagaatgcagaaaagctcagaattagtgagctaagcaacaacatgaagagtttagaggccaggcaaggtggctcactcttgtaatcccagcacattgggaggccgaggtgggtggatcatgaggtcaggagttcgcaaccagcctggccaacacagtgaaagtccatctctactaaaaatacaaaaattagctgggcgtggtggtaggcgcctgtaatcccagctactcgggagactgaggcaggagaatcacttgaaccctggaggtggaggttgcagtgagctgagattgtgccactgcactccagcctgggcaacagagctagatgccatctcaaaaaaaaaaaaaaagaaagaaaaagaatttagaataactcaaagtagaatgtgattaagataagagcaaataacataatagaaaactacattaatcataatataaaactataacatattaatcataatagaacaaatttaccaaaatctaatcaaaaagaaatacaaaactgaatagttctataatcatttaaacagtgcgattggttattgaaaatatttctagatataagtgtcagtcccagaaagtttcttagagaacttctttcaaacctggaaggaaataaaaattataattttacacaaattctcccaggaaagagaagagaagggacacctttcaattcattttattggacaaacagaatggtaatattagacaaagacagtaaaggaaaaatattgatcaatcacttttatgagtatagatgcaataccataaacaaattaacaagctaattcatcaatgcattaaaaacaatgcatttcgatcaaattgagttcataaaaggaattccaggttggtttaacatcagtgaaaaaacattaatttattacataaaatcattaaagtaggaaataatatta

SEQ ID NO: 40967 - DNA, 2271 bp, Homo sapiens
ttgcattaatcagttgataaaaatattgtaaccagaggcttgagggaccataacctgtatttcccataggaacaatggttcaatattgactgattctgtgtttgcagcaaatttatagaatgtatcagccactaataataaaaatcagttgtatataatttatatttctcaattctctgccaacttgccaatataacaactccaactagtgctatagtatttttttacattgacctaatcttgcacttcccaactcattttaagattgagttaatgtctgacttccaaacccttctaggacaatttgtaatggcttgttgaaatcctgtttttctatagtgtagttgtaaatcatgacagattttaagttcactaaatatttgacttcagcagcatccaaatatgtttctactatttgataaagaggaacatgttctaattctcatcactgaggtacatggaacaaagttaatatactctgttaaaacatgcctttcactaaactggaaatttagaaactgaaaatgttaaggaaatagaatggtgggaaagtagatttcatgaattgactcaagcataagaaaacttttcactgtcctgtgttttagatgcaggccgctccccatcttctggccatgttaacacctttggacctatggctgtttatctccattagattacataaaatggtataaagcacactatactacagtgttctatacaaattacatgcttttggaatgcttttttcttattaactattaatatacaaatgtattttacagtttgatccttggaattttttttctggcttatttattttattcagatgtattcatttaaagcattaggaaagattttcaagagatggatacagaggtgaacagcacaacttaaatagccaaaatatttactcatgtgaaattatgaattgttaattaacagaagcaactgtcaaaatcatgaaacactatttctaccatttatttttattgctagagtacaggaaaaactcatgtctgttaatcattcagctttagacaataaccaagctttcatatactgtgtttgatgatgaatctactaatgccaacttcctttttttcttacaaacttcctaaaagaagcaaagcagtttagatagcaagtcgattaaatcaattaaattaaaaattgatatttttattttatttaaacgtaaacttttttgtgaactataaaatgaaatatatttaatagtaaaaaggaggcattaaatggttttggctattgttaaatgactcgtaggttaaatttctatcagaattttagataacttacattttaatctcagaatttactttggcttttatgattttatgagtcaaagtgcagatgcccagtttatttattggaatatttgctgcatttgtaatatgaaaggtcattaggaatgactcaacaccacaaagcacagttaagattctaaaactgggaaatgacaacttattatttttacaccagcattaaagccaattctctttttatttcataatagaagtaaaatccaataatgaagtcaatagaaacaatggtagtcagggttgatatttatatttttattctaatgtgtgttttatcaattaataactttttctctttcaaacaagaactcaaaaaataaattcctagcctaaagaagttcaaagatttctgattttaatatcatatattttatttgactcatcaatgtccatgtaacctcagacaagaagaatgtggacagcataataattgtaaaccatttgctactgcatgatcagaaacagacacataaacaaattctggccaaacgcattaacggaagtgagagggtttctctaaaatcatctcttcatatctaaataagaaccatagcaaaattaagctcttcacatcctctgaatcagttttgcattttatggactagctgaaatggctgtagccaaattgccaccatcttttaagaaaagccaatgtcaaggctggagcaggagagaaggggacctgctgttaatgacaatgctgagccattgactccacccatgctgaagactgctcaaaggctagaagttgtgctattatatatgcaagattcttattgtctaggtatttaggtaagtgtttgtaagtttaatcaaaatcattccaatagtttttgtttgtttgtttgtttgtttgtttttgagacagagtctcattgtgttgctcaggctggaatccagtggcatgatctcggctcagtgcaacctc

SEQ ID NO: 40968 - DNA, 1063 bp, Homo sapiens
tgagttcatatggcatattaattttggcttttcttcagctttgaattcccactatttagtaactttgaaatttcatttcctttttggacatttctcagcaccaccatgagtctaatatagtaaaattgggctaccatccaagtgacacaagccccatgcactggggaaacgtagggatggtggattctgctccaagactgagatagaatagctctttattttgcagacctttcctttatttttacttaactttcctatatttgacatgagagcaacacaatctcatgagaggtgtgaaactaaaggaacagggccaaagaggcccatgcagtctcttttgagccaaagtcctgtagatttacaaggtcttcctgatctatacttgatctaatccagtggttctcaaaatatagttcctgagtatcactgtcacccggctagtacaaattttcaagccctaggctagacctgcgaagagggcgtcacagtctgtgttttaataaggccttcggatgaaatctgatgcatgctaaagtttaaaaacctgagttttcaaatcaccttggctaagctctacataggggtttaagtctatgcaagtagagcaatacgtagagtgatttttgtttttctgcattgttgctgaaccgtaaataatctatttgtaaatctttgttagtagtaatgagtttgaatttaaaaatttggaggttaaaaattatgatcttttttttttctgcctctcttgtatgtacaggttaatcctcattacttacaaattccctacttgtgaagttgtctacttggtaaaactttttgtaatacaaaaatcaattttgtggatataaacagataagtccggtgtagtaaaaaatgtgaattgtccaacaagcacatttccagctgagttcaaagtgatgtcttgccttcttttttcagctcacaaacaataaacaagtgtccttttgtgatctatttagtgccatactttaggcatttttttttttgcttcttcttggtgatttcactgcttaaaatgtcccccaaggatattgctaaactg

SEQ ID NO: 40969 - DNA, 1035 bp, Homo sapiens
ttttcatgccaactattggtacttataagttctcaggtgagtttgctacacaactacctctttaaattgactttgttggcatgatattaacttccaatgacatagctatatgatcagttcacattgaaggcaaaaccctgtaatagacaaaattaccttgtcagattgactctggtgacaaaaaaaggcctttattttcttcaaactattatgaaattatttatattctattagaggaagaggatttaggtaatttagcaggccaagtgttttgcaggtgcacggtcacagttacagtgatttgtaatttggggaccctaatagcactagaagctgaactgctccctgaatactctgcagtgcaataaatggtgcctataacagtgctgtgaaaaatcaacatacccaaacttacagagaaaattagcaagttcacttgggggaaagatacatggcctgagcagatttttttcctctctcttcaagagaaatcatttaatccattattttgggaatcaagactgatagttatctgaaactggatatttggaaaaaaaaacaaggaaaaaagaaatattaaccaatttatgacaaaataaaatagaaatatactaatagatattgagtagtatttatacactaggtaattttctaatccctgcaaagtaggatctatcacccacaatttgcagatgaagagaatgagatagaaacatgtaaataaactggtctgagataaccataaagtaaaagtcaggagtggtttttaaatgcatgcagtctgactcaggttctctgctattaatctgatagaagtctcttaggaaatttgtcatcctggtcagatagaaaaaacagcccaagtaaaataaccagaataagcagctcaaacccagagcttgagattcccatgtcccatcagaaatatgttttgtctattcctcaagctccatagtttgtctttagaagtacatgctagacacttctacagtaaaagtagtgaacaaacgccactgatgtaagctacaaaagaca

SEQ ID NO: 40970 - DNA, 1034 bp, Homo sapiens
ataactcagtactttaacaaaaataagaagtagacactgggaaataggataattcaattttgctaatttcctttagggaaaaatcaagctattacacttttgttttacactttaataattatagaaatgttgttttcatttgtattcctaaagtgttaagatagctattaataaaactaaattttacgtcaaagatagtgttaaaaaggagacaacaatgtacaaaaataataccttaaaaagagaaagagaaatgaattatttgaaatataccaatatgcaacagatgcacattagttaggatgtgtggttaaacttaaggctgtagattaggttaaaaccaaagtccaacaatatgtttcttaaaagaaatgtgcaactaatttaaaaagagatttaataatgaaaaaaacaaactaagataaattagggtaaagataaagtaaaataaatgatggcaatttatttctgtaaaattaaattttgagacatcaatctctttgataaaaggaacaactaatggaacaattcatagtcacaaacttctatgccatttgttaacaaagtaccaaatatataaaacaaaatctgttcaagtgtatagagaatttgtgaggggtacaatttttccatgttttaacattcataattgattatgcaagtgaaataaattgttcaaaatataataatgaagttgatgtaaaaatatgtatttattcattctgaaaacatttagtgagggcttactgtgtgtcagacattctttcagatgccagaggatgctatagaaaaatgcgtgccctcttgtaatactttgttcaagttctgatcagaaggatgaatgatggagcccaagaagccaggtacaaattcaagcttcttccattcataagctaggcagtccttactcaaatttcttatcgtatctattctttagtttcctcatctgaaatgtaggtgaggctaattgtatatgccaacttgactggtttcaagacgcttacatatttggttagacattatttccgagtgtg

SEQ ID NO: 40971 - DNA, 1054 bp, Homo sapiens
tactttaaaagttaaaatgcttgtgcaaaaaaagaaaaatattaaaatatgagttacaaggtgggataggatatttgcaatgtatgcaactctcaacagatggtatagattatatcaggaatacttcaaaatcattaagaaaactgtccactgtataaatggcaagataaacaagtaatatggagaaaatttatagaagtaaagcctcaatagtcaaaaaataagaaatagaatttcactaataatcagaaaaacccaaattacaataaccatgaagtaatttttgtgtccatgaaattaacaatatgtaattgtaccaaaaaggctgtgttataccatgagaatgttaattgctacaatcaggtggaaagacaaatttagaaactctctagtgcatttgaggatggtaatatccccgccattcttgctggatagcttgtagatctcttgtatattgagatgtagaaaatgttcaaagcagcaatgtttgtaaaacaagaaattttaaaagttttaaatgttgactcaagaaaaaatatattttaaatccacaaatattatataacagataagtgaattaactagagtgacctgtatcaacatggatacacctcaaaaacacatctgagagaaaaaggtggccgagatcgcgccactgcactccagcctgggcgacagagcgagactccgtctcaaaaaaaaaaaaaaaaatacattggtttcattcagaaagacgggacaatttaaatattttctgattgataattggttgagtttatctgaagacctgggatcaaaggaaatgttcaggttaagataaaggattgtggagaccaagttttattgtgcagaggaatctctcagatagctgacttcagagagagagcaggttgtaaattgtttcttatcagacctaaaagggtgcctggctcttagttgattatcttctggatctagaaagagaggaaggaaaacaagggggaaaggggattttctatacaatgtggatttttcccacaagagactttgcaggtcaatttcaaggtaaggcaag

SEQ ID NO: 40972 - DNA, 1068 bp, Homo sapiens
tcttcatgtaaatctgggatttgaatttatacaatatatgttcctaggaatttctaaaacagtaaattattattattattattattattattatttttgaaacagagtttcgcttttgttgcccaggctggagtgcaatggtacgaactcagctcaccacaacctccgcctcccggattcaagcgattctcctgcctcagcctcccgagtagctaggattacaggcatgtgccaccacgcttggctaattttgtagttttagtagagatggggtttctccatgttggtcaggctggtctcgactctggacctcaggtgatccacctgcttcggcctcccaaagtgatgggattacaggcatgagccaccgcgcctggccagcagtaaataaaattttaaaacttccacatttagataaatcattgtaaaacttcaaaactcacaaagacaaaaacaacatttaaatacagccagaaaagtactcttcccttaaattttttagactgatagcatgcttctaaaacaacaataatatccagaaatgtaaaattatatcctgaaagtgattacacagaaatatctgtcaacatagaattcttataataatgtagaaaataatttaagaaggtagacaaaacaaagaccttttctggtcagaaaaacaaaaccagagatttattactaaaaaacccttatgtagggacttccaaagtatgtactttggatggaggaaattaaatccagaaggaaggtagaaagactgagatgtaacagagtcaattaactgaaaaaggagtaagtaaacacattggtaaaactaaacaaaatttgactaaataaaataagaatcaaaactctcaattttgtaggtgaaaatagggtaggactaaaacactggcttgtaatagtatgcaggttgcataagagtaagttgaagatttctaatggtttggtattgttcaagagaaaagacatagaaatatggaaactgtaaaatgctaaaatactaaagatttgatgttgggctgggcgcggtggctcacacctgtaatcccaccactttgggag

SEQ ID NO: 40973 - DNA, 1657 bp, Homo sapiens
acatttgctgaggagtgctttacttccaactatgtggtcaattttggaataagtgtgacgtggtgctgagaagaatgtatattctgttgatttggggtggagagttctgtggatgtctattaggaccgcttggtgcagagctgagttcaattcctggatatccttgttaacttctgtctcattgatctgtctaatgttgacagtggggtgttaaagtctaccattattattgtgtgggagtctgaatctctttgtaagtctctaaggacttgctttatgaatctgggtgctcctgtattgggtgcatatatatttaggatagttatgcttgttacctgtgtgacaaaatagtatgtaaaccaaacttctgtgctatgcaatttatctctagacccaatctccgcacgtacccctgaaaataaaataaaacctaaaaaaagtctagctgttattcctgatcttcatcatctactctctctcctctacataggtagcaatatcagtttatgacttagacttttatttaaaaaaataagaatataaaaatgaatttgtaaccactcaccatttatgtagataaataacaccaaacagtatacattttctttgcttgttttttcagattattttgtatcctgaagatttgatagtagtttacgtagtttttccttatttcatggtagagctgtgtattcttccattatgtaaatgagccacactttattcagccagtgcctactagtggatttttgggttgtctccagttttgtcagtttagcttctaccctaagggattgaccacagtgtaggtttattcctgaaaggaaatttcattttggttaatatcaattcatagggcccagacatctcagtaacatgaggtttacttccattcactcacatttccttcttgcacacaaatgcaatgtaaatctagcaaatctcatttcagctgattcttaaattgtgtttctaaatcatctgttgactgtcttagagtgatttatgggttttagctttcaaggcacaagaaaccactttaacttccccttatgttttcttgcaaagaaaatgataccacaaaggtcttggtgatggttttcttttttttccctgcctatttcttcatatatatctattgttgttgtctgtgaacattttggttttattattgtagttgcttagtgttttgtgggagaatctgtagaaactaaaaactatcactatctctccagaattctatattctattatattataatatgataattattttattatcatataacatatcttctgtgataagatatattatgtcatataattattatatcatcaaagattttatatatacaaaataagtattttatacagaaaatacataattttgaccacatcttaaggttaaatatgatttaaaacatattcttcatgttagtgttttgcctagtttcatcttatgattaaggtcagctaactttagtgtcttctttcttctctataaaatgagccataaaaatgacaaatatatgttttcaatgacaaaaatatgttttctaattatctgcttttcattcaaaagttgccataaccaagtgggattatgatacataattaaataaggctactcagtatatatgggaaaattgaagaacttc

SEQ ID NO: 40974 - DNA, 1127 bp, Homo sapiens
gctattttcattttctacctaacttcagccattttatattaatttctctttcatcttttgttaaaaaatctaggttcttgatggctttacataacgacttggtttatctgttatatacagtaatttacctgcatccatgggggattggttctgggacccctgaggataccaaaatcccaagatgctcaagtctctcatataaaaccaagtggtacaattggccctcctcatctgcaggttttgatccacagttggttgcatttgtgaaagccaaacctatgaacatggaaggctggttgtagacataatagtttctgaataacaatacaaacagtattaccaaaaatttgttttctgaacatagctgtagaatatttttgcagttatttttgctcttaccttatgtatccctactaggtattacaatttattatgttttttggtcacttggaataatgtctttctgtctctttaagccataaacttgatgcaaatttttcacttgctttcatatattctcatgctgatttaaatttgttttgtacttgtgtaaaatatgtacctgtctgtagtatgaaatctaaaaaataagatcaaatgaagaaagtctagctgttaaaaacaaccccattaaaaagagggcaaaagacatgaacagacacttttcaaaagaagacatatatgcagccaacaagcatatgaaaaaatgctcaacaccagtaatcattagaaaaatgaagtcaaaaccacaatgagataccacttcatactagtcagaatgactattactagaaagtcaacaaataacatgctgatgaggctccagagtaaagggaacacttatacactgctgatgggaatataaattcattcaatcactgtggaaagcagtttggcaatttctcaaaaaacttgaacaacagttcaacccagcaatcccaataatgggtatatatatatttttttctttttttttaattatactttaagttctagggtacatgtgcacaacgtgcaggtttgttacatatgtatacatgtgccatgttggtgtgctgcacccattaactcatcatttacattaggtattactcctaatgctttccctcccccctccccccacccca

SEQ ID NO: 40975 - DNA, 1042 bp, Homo sapiens
gtaattgtattcatcatgttaatagatgaatgaaggtaaaccgaatgctaatcttaataggtgcagaaaatatttgacaaaatttgatatccattcataatagaaactattaatcaagaaaagaaaatgatattaagctaataaaattttcaaaaagcctatagctagcataatacttaatgttaacataatgaatgtcccccaccccaagtttgagaacaaagcaatgttttcctttcttaccattcctataaacattttactggaagtcctagaaaatgcaataaggcaagaaaaaataaaatacacttttctatgttacaatgtcaatataaatgtctattatattctcatatattagcaatgaataatcaaattttcaaataaagaatacctttttagtataacaccaaaatagaaaagttatcagtttaacaaaaaatacagtatctgtgttaactatgaaacactagttaacaaaattaaacaggcaaacaaattaagagatgtaaattgttcattagttagaggattgaaaatgtggtgatgtcaattctccttaattttacttatggatttaattctattccaattaacatcctagtaataaaattgtgaatataacaacatgacactaacatttatgttagttataatatgtttatattaaggcagagccaaaacagtattaaaaaagaaaaataaaattggaggtttgtcatctctgatcttaagacttcctataaagctacagtaatcaagacagtttggtacatatcagcacaaggatagacacattcattattagaaagaacatagagtccagaaatagacttacacagataaaaatgtacttgtttttgataaagttctaaaggtaattcagtgaagaacaacaaaaaccttaaaaaccttatgtcacatcttgtacaatattaatttcaaatgaaacataggtctaaatgtaaacctacaaacattttagaagataacatagggggaatctttatgtccttgagttcagcaaagacattttagatat

SEQ ID NO: 40976 - DNA, 1044 bp, Homo sapiens
ttgacaatgacatcacaaagataggggagggtgattgaaaaaatttagtgtaagttctttaacccatacataaaatagtgcaatgttatagaaacatagaatcagattaatttaaaatgcatattagaaaccctaataaatttactaaatctgatttaaagtactgtaagccaacagagcaaagcaagctagaatttcttaatgctcagttaatctgtaaaaatgagaaaagaagaaaaaactaacaatgaacaaaaggaacaaataaaaattacctaccagattagtatattttaatccaactatatcaaatttactttaaatacaaatgttctaaacacaccagtttaaattaaaacattgtcaaatgggataaaaatgtgagacgcaagtatatgctctcagcaggaaaaccatattaagtataaatgcgtaaaaatatgaaaagcaaatggattagaaaaggtacataatgcacaaaataataaaaaatagaattatagccgggtgtagtggcttatgcctgtaatctcagcactttaggatgctgagacaggaggatcacttgggcccaggagttcaagaccaacctgggcaacatagtgagacccaatctctacaaaaatttttttaaaaaatagctagatgtggtggcacatgtttgtagttccagctatttaggaagctgagatgggaggatagcttgagcctgggaagtaggggctgcagtgatccatgatcacactactgcaggccctgtctcaaaaaaaaaaaagaagaaggagaagaagaaaattagagtgtctatgttaatatcaaacaaacatcaaaacaataaacattatcagaggtaacaaggaagattactttatgataaaaaggtcaattctccaacgagacataacaatcttaaatttttaaagagttttaaaaatatgagacaagaatggaacttaaagatgaaatagagaaattcaaaattataggtagaaaatgcaatatgtctatctcagtatttaataaagaagtaggctgaaaattagg

SEQ ID NO: 40977 - DNA, 1414 bp, Homo sapiens
cactgaggtggagcctcgggaagttcacgccctttgcagcatggcctgcctggcccctcctcttccttccctggaaaccagggattccaacagcaagtgggaaattctctagcaggggactctggccttgctgaggatccctgtttcccccactcttttttccccttttcgcccaataaaaccctgctttgctcaccctttaaaccgtctgcgagcctaaattttcatggctgtggaatggagaagaaacctgtctttagccgaactaaggaaagtcctgcaacagtttcatgagtgttttcttcttgtcatttagatcaaactcatcaattcctagaagaatcttgttcattccctagttcaagctgcttctcattcgttgagtctctctctaacacattatcctatttgtgcctgtcatggtacactgtacctaaaatgattgaatagtttctttgataatttagtttcctgccattagaatataagcttattaaagacaagtttactgtttgtcttgttcattcctatatccccatcacccacaacacaacccattccccgtcttgcataccactgccatttagtttatttggttgacagttgccgtgatctctgtattcagttcaggatatgcatcctttggatttatagtggcattctgatcaggaatatcagcatcattcttttctgtggattattcatctgtgaggctctaaatggttttgtttatgtgtttgtttttgttcaaaggtcagctcaatcttatatttaattctgaaaaatatgacatgacaaatgttaattataattattattcacttgtgcttgacaaatactgctttctaaagaaaaattatcattgtgatactatttctttaaaaccccaaaatgtaaccagtggacttctctctagtatactatactaagacttcaatacttctaagctattgttttcgttttttattactcaaactgtttatatatggagactgcttatcagataaattcattctgggctttttgcaattatacttcaactagcattcttaccttaaaaagctaatagtattgtgttttaataaaattgaataaaactcaaatatacccagttttcacaatctttttaaaagagtctattgacagcaatttttagttggaatttttatcagaaatatcctccaaaccaaaagctttggacaaaatatttagtttgatttatttggtcattattgtggctgtaaatgtttgtgtttatgtaaactgtttttgtctacatggtattgaaacatgaattttttttgtctcaactaaaaacaattgtattccaagatatcttgaagtgtcttcacgtgtgtaaaatagtacttcagcattactgtatttacaatgatattaattataggtagatcca

SEQ ID NO: 40978 - DNA, 1159 bp, Homo sapiens
gggctgtggccaatctggtgtgctttgcgtgtctgtatggtttggttgcagcctccatcttgctttgcatcctgggggcatggccagtaactgcttggcaatccctcttgtttggtaatccctcttgagggaatgagccttctcagattagatatctgcatgttttcctagccctgtctcttatagggccccacccagcgactgggttttcttctggctggctgtgtaagtactatgcgtgatgtttgtaaaaagagctctaataatttggcctaaagaaagaagtgtttggatcaagtatttttttaagggaagttaaaagctgtggtacctttcggttcacatgactttaatctttcagaaataaaaacagccctaaagactactgggaaaatgcaggtcagatggaagtttgctaagcgttttgaggttacaaactgcttcatgggttttgagaactctgtcttgcctgcttcacaattggtaaggcctgcagaagtatgaaactaaatgcacccttaactaagaaggcaaacgttgactccagttagcacaattaaagcaacttaccaggatttaccttaaagttaacaattgttaagggttaccattataacatgtgattgaaactactgaaaatagatttacatgcaaggtgtgtaagaacagtaaaatgtgttttttagtaaaaggttataagaagggatggaaataaaaatctttgcctagggtcaaaggattgttttgagttaatttaggaaaaagctgaaagttcaaagaagtggtagaagaattgtggaaaataatcttgcagaagagactctctgtgtgaacatattgactaaattttaaaaagggtattatatggtttttctgtaaattgagcattgaaataaaagcataacaaggttttcctacggttctaatctgctctttggcaaaatttgtaaagggttataaaaggtctttgtttctttaaaatttctgagtcatgattttggcaaaataacttacgataatctggaattctattttataatatcaagtgttttaaaccttaagtatttaacagccttcccaaaataaaacttcagtttcaaaattgtcttctctggcacctggctttttgaatgcttcagaggacccatgaagtgttcag

SEQ ID NO: 40979 - DNA, 1281 bp, Homo sapiens
agaataaatagataaataagaattatgtcttatttatctctgtgagctcctgctcaaagcctacctctagaaaagcctgccattataccttgaatatggtaaattttccataaatatttctttgatgaggaactgaatatggtttttgaattagagaattcacctcccaaaaaaagggatttgtgaaaatagtgatcttaggttttgaattgccagagacattcccaatattaagtattaatagttctcccctttgctctgagaagtgttatgatttggataacacatggttttttagagtaaagtgaaagcaagtttattaagaagtaaaggaataaagaatggctactccataggcagagcagcctggataccaaattttatgcagcctgtttattgaatatttgcatgaattttccatagtatcttttccactctatcatttatggtttcatgtaaatattttgtttctcaaaggagattgtaagctacttgagaacataagccattttgtatcctatttctccaaaatgtgagtatattgggagtactgacagtgaataagactaaggcagatctacagggcagtaacccagtaggtacagtaatactcagtacaggtattggtattgatgatgaaattttttaaaatactgctttttagacgaagatgttagttaatgtgtagatgtattgagatctatccaggttgagaacagtagttctaacctgtgttgagagggctgtcctctaggcacaatttctgcagggcagacggagatgatgtctgattccccattgtagacctggcaccaggcaaaacatctgacacttggtatatgctcattaaatatttgttaaattaatgaaaggtaaggcttttagcaccctacatattggtgtttcataagcctctaccagagccctccaaattaggcccttggtaggtggcattataaaatctatgtgcagtctgaagagctcttgtatgcttaaatatgagctcagcaagttgatgagatggtagagctaggtcaggagacacgcagtcttctcagaccttccctgaaactgttcccatatgctattttctgtataaggtcctcgccttgaagaaaagtagatttttttttttttctgtaaaactctgccctacttggaaagccctgaagatgagcaaaggaaggcaggattcctttgtctctctgtgtcctcttccaccaacagaaagagcaagctctaagtaaaaggttcccaagttgggatagggggcagttgttg

SEQ ID NO: 40980 - DNA, 1138 bp, Homo sapiens
atttttctcctctttataggtcacacttttccactttctacttcataatttcggattagatgccagaattttaccttattggctactagaaacttctgaattcctaaaaattttacggaggtttgttatggggcatggtataggatacttagaaacagtatgatctttttatgtcttgctttttaaaaagctttgttaggtaggaccagggcagcatttagtctagagtggatttttctccactatcaaggcaagacctttcttagtactctaaccaatgccccataaattatgggattttcccctccggctgttgggaacagagctggcggccctttgtgaatactaggcactgttccctctaatactttcaggtggtttttccctggctgcaggtagtttcctcacgtgctgatcaatcagtactcaactgaatattcacagctctttggatttcgctcggtgtagtgctgtcctccctggtatttcaccctgtgacctttaaccatcttcggctccctggacttccatctccaagtcctccactcggggactgctgatctctgcctaggtcaccctttcctaggccatggcctgaacactctctccaggccagctgctggggcaattgtagagttcacctcatttgcttcccttctttcagggaccactgtcccttcctgccaggtggctcccagcatcttgagagctattgtttcatgcatgttgtctacttctatcgctgttttcaggcaggagggtaaatctggcttcagctactccatgttcatctgaggttgaatcagaacctcttttggatttatttactcattgatatgatatccgttagtttgaagaattaaaggcactgttaggataattgctacataaaggatttaacttagtgtacacacttaacatggggggtgaggtctgtgaaatccgtgtggagagaatgtgttaggaagtattctcataccatgatgtaaggactgttggctctgcctttcttacttcaactgaaagttgtgtaatttaaatttagttgtgaatttttgagactttaaaagaatggctcttttttctccttgtttctaatctgacattcttcaaagcagctacattgtgtgtaggggga

SEQ ID NO: 40981 - DNA, 1048 bp, Homo sapiens
aaacatttttatagggaacttaaataaaaattcatatagaaccagaatctatcttagtatttgaacaactcattggcagtaaactcagttccttctgtacaggattaatggtttccaagctgtaaattatgatttagagccttgtgcattaagattgactttgagccaggggaggcttggaagaggacaatgtatagtttgctttaggaggtcttggagcacatttgtgtggggaaaacagcagtgagttagagtgaagaacgagaaatgccagacgcaggggatggtatctggtagtctatgtgtcctgttgtgcagagtgctaggaaatccaaagcgacttcagaagtagaactgtggattcttagcggtgctaatagtgtgagttgagtgatgaggaggtggtcgtagttgaaataggataggataacagagctcgtgaccatgagaagtagacaaagagatgaattaaggaaatataaggaaggaaaaaatatattctggaaatgggctgaactgggggcaaagaacagtagggttgaagattttgctaaataaatcattggctgtgaactcttggctctcgtgagatgcatgaccattcccttgctcaggcatttccacctcctggaaagccttgtctttgcctgtcagaatattcaagccctaatttaacttctaccagctgcataaatatttgtttcatgacattagctcatagcaatctcttttttactgcactcatgtactactattataaatgtagtagcacttaattgatgtttagagctataatttaaattttcacctgcatgctttgtgtctccaataaggttccaaatttgtatagaattgggtagtgtaaaaaaaaatcctctctattgtccaatacaaagttatgtgtatagcaagaacttggtatgttatcaagagttttaaaggatattgagtttctattatgtccccaaaactttaccagatggcacaaaagaagggaattataagacgcagttcttattcttaaagtacagataatcaagttggatat

SEQ ID NO: 40982 - DNA, 1077 bp, Homo sapiens
gatgattatagtgataggtaccaaggagaaaaaaatgggactacgcctaataattagtcaaaagacatacgtatatatacacacacacactttgaagagagaaagagagagagggagggagagagaacttattgttgattaattgttttcagaagagccacttcaattccaataagaatcacctcagagaactgaaagtaaaccatatctgcttctagtgtctatgacacaccttgcactgtgccttaataggattactaatatttcccacagaggaggaagtcttgcttctattcttgcaaaacccctcccccaaatctgtctcttcaccaacagttatttgtttgtattaagtttcatgatgtcccaagatttttgtttgtttttgctgttttcttaatgtaaatgttttcataatgagaacacgttacatttttgacaacctagcatgaaaaatcttaccagctcttttctgcagtagatgcagcgtgcagcctgcaaagaccccatgtccaggttaggccaggtcacctgaacaggaccaggatagaaaggggaagagatttgtagaagacacacttcgtggtctcactagggtgtgcctgtttgcattttgtttattgtttttgcaaccattcatatgtgtttattgtttttgtaaccattcataagtagcagtaatttagcattctcatattaatattttttttcttgtcactagtgagtgtttgcatgtgtgtgtgcattggattgacgggagggaaggtgactctgttggtacatcctgaatactaggatcttgttcggcccaatcgcagtgttacaggtatcttgttaacattcaagccttgatgctttgaaatagcagttttgccgtaattcattgcctaaattctgacttccttactaagaacaggaagcatagtgaagtttggtaggagagaaacatacctcggacagtaactgtggctaaaccatagtcatggcatttaacattaatgtgaaacataagatttgtaagtcttccaagtaccatttcttaatgcttacaataagatgacgaatttcatagttccc

SEQ ID NO: 40983 - DNA, 1044 bp, Homo sapiens
tggtgggaactgttctctgctggagagagagcaaagagagaatatgagagctgagtttagaatcctgggaaatattcctgctttggggacgaatgaataatagaatctaataaagatgactaagaggagtagtgagggggtaggtggacgccaagaaaagcaccattataggagagatgaattatagagtttccaaattatcaatttcattcactgaaattggtgttcaattgagggtattctatatgccaggttctatgctagtccctgtagatacaatatgaacaagacatagtcttggtcctcaaagaattcattggaagtcagagatcatggcccatgtggcactattgagtgacttttgctgggattgcagtttaaaccagggaaacagaacgcagcctgtgggtgagccatgtttggagacgggcatgggagggtcagaaggaggctggaaggctgcctggagaagagactgtggaagcctggggagggtgttaatgaagtatctgactgtgtgatctgcagctgctcagacagctgaagtcagatggcctgggatggttgagaatcagggacccaaagtcaacatgagagcaaagagccactccagcagctgtgaagaagtgaaaaccaaggagagaagggggtcttgcattagcaagtggggatctgagtttgagatagaggagaaggagcaggtcaagaggataatggggttgaatttgcagtgctagtggagggctcaagaggttggaggatggagtttattataacgggagctcagagaataatcatctctaatttattattgacgctgtgctcaacattcaacatccatgttcttcctcaaaagctccctgctggatagtgtaagtgccactaccatagaaagattctacttcatcatgcctggtctactacagcctcttagctggtgctcctgactcaaattactctgtttgtggtcagttccttattccactacaaggctcatcttcttaaaacatcacgtttaataggttactgtgaagatctaaaagc

SEQ ID NO: 40984 - DNA, 1060 bp, Homo sapiens
ttcctggctgctacacattgaaataaataatacagtgtgttaaaatctttggtttaaatttagcacataaaatgccccatattgtgtgacactctcagctgaagtctagagagtgaagtttatgtttttataaaactagcacatacacactgctaaatgaaaaaggcttcaatggaagaaccacttacaggaatcagcagactgaaaatcttatgatttatcccagtatgtagagaattcaccttggcaacttgctgaaaaaatgtagatttggagccccagccctggagataatgatgtggattgcccatagactcaactttgaggaacctactcttaagcatctagttttggaagattgctatacataccatcctacatcatttgaccaggaaggaaaaaaagatgagaaaataagatgaaggcaagaaaagagacaaaaatttaagtcctgaaaaaaacatttctaccagatttttattgtttaaaaaaaaccaaaatttcagtggatgctagatagaatcacaactgtaagacaaaacagaaaacaatgtgaagtgtacaagactgcacagaaaacatatcaagatactgttcaagaagaggtaactggctataaatttaaagttcaagtgttaaagttaaaatgtagctctaagttttattttcccaacaacttttaaaattgtaatgtgatggatgtgctacttgtgatatttttggtcatggagcaggactgttataaacaattaaattggtttacttaatttttctcctgaataccaattcgtgccagtgaattatcaaggcgactttcaatttccaagatgattttctactggtcccagcgttgttgtgaagatgaattaaggtctgaggacagtgtctggcatattatcagtggggacagtgtagtggagtggttctgaacacatgctgtggatgccggagaccctgcgttcaaatgactgctctaccactaactagctctatgcccttgtccaagttaacttgatttagtttcctcatctgtaaaataaaaaaaaattagtgcctaccc

SEQ ID NO: 40985 - DNA, 1030 bp, Homo sapiens
aaagcatttctgcatcattgtgaacctgtttatatgtgctgaccaagtagagccattggagagggaaatgtagatgatatagaggaaagatgataattgagcagaatcctggagcagctagagtgctttgagcaccagaaaggactgattggggcagaaggaggtatactactaagtttatgggtagaaactgtgcattaaacataattttctttgaaaaattcattattttattgttttttcttttttgtgaagtgaaaggcaaatttatttatctggaaaaactggataatattgacaaaaatggggaacacttggaattgtctctgaaggaaatggcagagagtgctgagcagagcatcctggaatgagaggccgacattcagagggctccacagaagtagcccagcctgtgaaattggtgctttttctcagcccctctagattacatagggaccgaaaaaccagtgaaccaaattgagtgttttttaggatgggtatgaaggacaaggtatcagatgagttgggatgctggcaagacaaagggcaaagtggttcacagtggaattcagagacaatagtgaaagaaacccagagcaggaggaggaggaagatggtgaactgctggaattgaggaactgggtgtctccataaggttgaagaacaaacactaagtgtgaagattaggaaggtaggtgatgtgacacaattgactatattagcctctcttagagacccacatatagtaatctgaacttcctgtcaggttttatggacaataatcaaacatttcagcaagtgacatctcaaaaaaggtcacattctaagttttagcttatctcttgcattgttagtaattaaataatttctattaaatgaaaacttctgatgaagttttatttgaatgtttttctctaacatcggccattaattggttcaataaggtagtttttaataatgaaggttaattgagggatgcaaatggtcaggttttatatgaaaatgaaacaccaaaaataaaaatctattg

SEQ ID NO: 40986 - DNA, 1050 bp, Homo sapiens
atagtgcatttcaagattttctttatattggtttaattgatcttataattattttaaaataacctaagttatctggtaatagtttattggtagatggttgagcagtatctttcttaactcttatttagagatgggaattcaatatgtcttccaatatttcatacaatggaggaaggatttaaaaagtgaatgaaaggttgttttcccttagtttaaaaagataaattgtaatatccaaaatattataaagtaagtgggcaacccaaatcatcaagatagttaagaaaatataattaagtcggttttaacaaatcttaaaaggagaggagtcatacttgttaggacaagcttatgctaatgacatatcagcctgtgttatcccaggtcaatagatatgaaaaccacagtttacccagggttacttaactgataataatagtgtgaggataacaaattgaactgatacaagtagaaagactaagaatgatcttcgggataaatgaaaacaaatggataataaactgatcttgctgagtaatataggttatggtgttatgctttaaaatatcagtattaatagaaatattcttatgttcctttgttcttttaaagggtaaaaagggctgtttatctttttttgatcatgtcatcagtttcattgggttgccttattttcattcagaaagagtatggactaatatccatattgaattatgatttagacttgagtgtactggtaggaaatttatcagttgtgtgtgtgcaatagtgcttggaatgaaatgtcacattcacctctgatactgcacctactgtgttttctcataggcttaattttgccttttcaagtttgaggtcctgttgttcaacatgaacaacagctttacaaggaactatgtaatttacattgttaaaggaaagtatatgtgacactgtaacctttttactctagcattgttttcaaaatgttaattactaatttttccggaaatgatttttaaaggtaaatgtataaaacagatgggtaaataatatttggggaggataagt

SEQ ID NO: 40987 - DNA, 1043 bp, Homo sapiens
gaacactgctgtggctggagcaccaagaacaagggagctgcacagggcttggtccacacagggtcttataaactcagtttaggattttggtcttcatcccaacttgaatggaaacccatagaagttgttcagacatggggatgaaaggattagatttgcattttgaaatttacttggactatgtagttgagctttgcatggtgaacaaattggagggtggcaagattggatctagaactagtcaagagattactgcagtaaaccagggagtagatgactacactagactaatccactacagtgaattaaagaggtagaggtggagaccagagaaagattggtgagatttgagagatttccaggaggagaaatagatagggcttgatagtacctgtagagagtgaaggagaggacgtagcctagaatgagtcctaagtgtgtggtctgcatgcctgaatgggcagaggcacaatttattgggatggggctcactaaggggaaagccaggtttaagaaagtggtgacttttgtttttggatttgttgagtttaaagcggctttgaattatctaaatggagatgccaagtagtcagttgatcataggagtctggaggaaggggtggtctggagatggaagtgggtgtccttaatgtatagatggtgtctgagttgtagtggatgagagggtgtaaagagaacagagacgaaaagagagtgtggggctaactctggagaaaccctaacttttacaggcctgattcaagggagtgatgccaccaagattaagaaaggctggctagaggtccataataaaagagagtccagtgtcatagcatctatgtgaggagaggtgcaatagagattttgccagggctgctgtgataaagtcccacatgctgggtggctgaaaacaaaagacatctattgtctcacagttctggaggctgcaagtgtgaagccaaggtgtcagcagggttagctcttctgagggctgtgaggggaaatctgttctgtgcctctctcccagcctctggccatggttt

SEQ ID NO: 40988 - DNA, 1008 bp, Homo sapiens
actcacatgtgacggaggactagaccaaggtcagctctgcatgccgaacctttggaagccaggacttcggagatacaaagataattgagtgacaaataagtagcagaatatgatagaagggatattatccttacatttgtgactttctttttagctataactctgtgacctcatgtagcagttacacaaaatgggactgtaattcttacctttggagataaaatgagtggtagaggaaatgtttgttaggcttatagaaagatccaactattgtgtctttacagtgaacagaataattaaatttgatagaaccaactttcctactgtagaaatacttttaaagagtttatgtctaatgacataaaaatatacttaggaagctctgtttttatacagaacaaagtgtttttcaacttctgttgttacatcctttgaataggttaacatttctgcctcctttgaggactaattctttgctctttcacatcagtgaccaatgtagagtttgcttacatttatttacaacttattaacattactagagaatagcacactaaatgtgaaaggaacagagtaagatccatgtcagggtatcaatttttaactcaataaacttatcagtattttaaaatgccattttattatttttgcatagataatgtatattacatcttatttcccaaagcttaataggtttgaacatggactttatttgtagaaggcaagtaagagaataattataaaagtgggtctttgagtagaataatgataaacttacccatattataaactgcattgtgacatgtgtttccttaaaagaaatgtgattctgaaaaaaatggcttgcatttgagcctgttactgtggatctagatttgcatagaagacatttatagacggttcctgatgtgagctgcagctggtaaaatacattccttacctatccaataagaatataataggatttgctttttaatttttaaagcacaattatgagtcaatattaaa

SEQ ID NO: 40989 - DNA, 1047 bp, Homo sapiens
atttgattattgttagagaagagtgaaaatttagtatgcccttctgaatatttttagagaggaggccagtttgtgaaacaagtcagcctgtcagatacagtctggccatatcaaagacttttcaaagtctatgaaaatgtggagactcttgagttagagaacttggatctcagaagcatggagagccaaacattatggtaacaacttactgtttctctcatattctaactacacatttaaatgaaaccaatcctgaatgaaacaatgagttttaaaatggttagtttgggaaacttcaagtcttaatccttttcattgtatgaaataatatatcttcttaggttggaattgcgcacttcatgatgtactttaagtaacaaaagtggagcactttaatttttttctaaagagaaagtgtaaaatacattatcctgcaaaacttccttttatcctcacagttatttcttctctttcatggtgtaaaagaggtgcatttgaaaatagcaccaggaacctgaagaactcctttttttttgttctggtttatattttcaattgtgtatttattcataagttaatttatcttaccgttctcatactgatctttatatcctcagtctatactaaatttatggtaatactgattttatttagcctgtaatcaggattataaaataaaacatttttaagtcttccctctttgtcctttccaagtgccatcatcagcaactaggtatagaccagagagcatgaattttgaataaaatcttcactgagcttaggcagtatttggggagtcacatgcagcttggggagtgctaattgtataccattggcagatgatttgaaggaacaagtataagtatgttcaaatcaaaaacacaagaattgctgcagagatttaatggataaaagaacaattgatatgaaggagaaaagacaccccaaaaaaagttggtgtaagatcattcaggaaacagatatccactacagtatttcctaggattggatacagtggaatcacatttacagtcaagaatcatttga

SEQ ID NO: 40990 - DNA, 1069 bp, Homo sapiens
tcagtcactgcattacttttcagtgtttacaggatctctgcttttatagtggtctctcttaacccaaataacaaagaaacatcgtaagacttattaaatcactaatgaaataccccatttattttatatatatgtgtatgtgtgtatgtacatatatttcatagtaaggtagtttttgacacctaaatattatagcactagattttttaaaaattcatttttatggttcagcattatggcccttcatacctgtagaattagtagaattaggtgctggtggtcgggcggtggctcacggctgtaatcccagcattttgggacgctgaggtgggtggatcacaaggtcaggagttcgagatcagcatggccaatatgatgaaaccccatctctactaaaattcaaaaattagcctggtgtggtggcacgtgcctgtagtcccagctacttgggaggcagagacaggagaatcgcctgaacccgggacgtagaggttgcagtgagccgagatcgccccaccgcactccagcctgtctgacagagtgagactccatctcaaaaaaaaagagagagagagagagaattaagtgctggctgttttattatgggcaagaaaaaaatggtttacaaatgacacatcctttttttttcttcttgagacaagttctcggtctgtcacccaggctggagtgcagtggcgcgatcacggttcactgcaacctcgacctcctgggctcaaatgatctcccgcctcagtcccctgagtagctgggactgcaggctggcaccaccatgcgcggctaatttttgtgacacatcctattgttaaatgcatttataagcttgccaaagtgaagtagttaaattatattcagagtttatatttttaatcttgtttaagtgaattattcatcttttaactgataatttttgctataaaatttctagtggattaggatggtttcactttcacaaaagtgtgctcaatacagtgtatgacatgtgctgggcatacagttgatatttggtggatgtttaaagtcataattctcaagaagcttacggtccaaa

SEQ ID NO: 40991 - DNA, 1048 bp, Homo sapiens
attatccaacctgacatatgtgaggactgcctttggcaaatcaggacacatcatgaccctccaaatgatcatgttacaggttgatccttggagaggcaattttgaggggtaggaccttgaaattggaagaaccttgtgcataacgcctgtctcttctcagtgcttccacatcaattgttttggagcacctggaatttttaatgactctatatgtaatgacttcagtttgaaggacttacctgtaaattaactattattatttgcagatttttttaataacaaataatttaagttctaaaaatacttatttggtgctccagttaacaaaaatagccagcatcattgattcaattaataaataactaccaattcagaagtctttacaaggtcgctgtgtgaagtaaccaattaatctttggagccctgcatgagctagatctatatattttcaaacaactagcaaagggctgagacattcaagtatcccaataatttctcctcatgattgcaagtatcaggatctttggagaaatttagttctgatttcttactttccatgtgattaggggtctgtgtgatatgaaaatatgaagcaaaagagtagaaacagaggttagtgaaaatcactttcctttattttttccactgcatcatttgattacttttttttctgttttataatttatataatgtaggagattcaatttaggtgacaaaaagagtctattttatgtagtagttccaagcttgggctctgcagtcagatcaagagtcagaatgagcaacagagataaaaggatgatgatttccaacttcaaacattttacaatctagaagagacatggcttatagtaaactttattaaaacttacaattgggagtagagtataaatggaagcaggattttttccaactggaaagattagagggttcttatgagaggaggtgattcttttttttactgaggatcttgaatgttaagtagaatttcactgagtaaagaagggagtcaggagctcctcatactctgacctgggatgggagggga

SEQ ID NO: 40992 - DNA, 1063 bp, Homo sapiens
ctgataaaacagactttaaaccaacaaagatgaaatgagacaacgaaggccgtgacataatggtaaagggatcaattcaacaagaagagctaactatcctaaatatatatgcacacaatacaggagcatccagattcataaagcaagtccttagagacctacaaagagacttagactcccacacaataataatgggagactttaacaccccactgtccacattagacagatccacaagacagaaagttaacaaggatatccaggaattgaactcagctctgcactaagcaatcctaatagacatctacagaactctccaccccaaatcaacagaatatacattcttctcagcaccacatcacacttattccaaaattgaccacatagttggaagtaaagcactcctcagcaaatgtaaaagaacagaaattataacaaactataattttataaatttatatatataaatttataattataataaactataacagaccacagtgcaatcaaactaggactcagggtaagaaactcactcaaaaccactcaactatatggaaactgaacaagctgctcctgaatgactactggatacataacaaaatgaaggcagaaagaaagatgttctttcaaaccaatgagaacaaagacacaatataccagaatctctgggacacatttaaagcagtgtgtatagggaaatttatagcattaaatgcccacaagagaaagcaggaaagatctaaaattgacacgctaacatcacaattaaaagaactagagaagcaagagcaaacacattgaaaagctagcagaaggcaagaaataactaagatcagagcagaactgaaggagatagagacaaaaaagcccttcaaaaaatcaatgaatccaggagctggttttttgaaaagatcaacaaaattgatagaccgctagcaagacttataaagaagaaaagagagaagaatcaaatatgctcaataaaaaatgataaacgggatatcaccaccaatcccacagagatacaaactaccatcagagaatattataaacacctcta

SEQ ID NO: 40993 - DNA, 1029 bp, Homo sapiens
acacacacacacaaacacaacacaccatggccctttaccccgaaatgcttcagtatagttattgacttaagtaaatttaacattgatatacttgaatctatcatttgtattacagttttgtcagctgacccaataatgtcctgtaaagaagttctcccactaccctataatcccaggtccagtctagggtccagcattacatttacttgtcttgaatccagctttttcttttttttttttttttttgagataggtctcactctgtcgtccagtggcatgatcacagctcactgcagcctcaacctggctcaagcaatccttcctcctcagcctcctgagtagctgggaccacagactcatgtcaccacacctaatttttttttttttttttttttgtagagacaaggtctcactatgttgcccaggctggtcttgaactcctaggctgaagcaatcctccttccttggcctcccaaagcactgggattatagacgtgagccactgcaccggtctgcctttagcttcttttagtctagaacattttcactggctttctttgtcttttatgacattgacatttttaaataatacagtcattttgcctcctttctgttttcttcttctttttttaaataatagaatggtccttgttttaaatttatttgatattttcttgtgattagattcaggtgctggttgatgttaagttcctcacaggatatcacatctggaggcacacaaaggccgtcacaccaaggtgatgtcaattttggtcatctggtcaaggtgttgtcctattccttcactatatagttaccttttttctctgttgcaatgaataagcagtctgtgggaagaggagctgttacattttaaacagaaaatgtatttgacactgatggaaaggagaggaggaaaattaatgacataaatttcaaagcaactattaaattatttgattgcattcttcctcttttactgtctgccaaaattgataaaaaaaatttttctaataagaatgttttaaa

SEQ ID NO: 40994 - DNA, 1024 bp, Homo sapiens
ggagcttatattctagcaaggggagatggatatgatagattacacagtttattggaggacaataagagttatggcaaaaagcaaaaggaacacagggtaaaggggataggtgccatttggtggtgagaatgctgactgaaaaatagaatgatcaatttaatctgaaacaaatggttatttcttttataatccatataataaatttaaaatctaaaatgtaaaattttgaacacaacactggaaagggtatccacagcaggaagtccccagttcacctccatgactacagggcagctttgcacagccctctgggcgcactgtgtgcctctgcccagaagggggcctcgccgttccaccagaagctcagctccaggccctggaggggctgctgctcctcagttgcatttcttcagtagattcatttccttgatgcaaagcatctgtatttgttggttctgtcatttgagcgatgtctctgacttgtttgttttgaattacattacaggctggaatgtaattgtggtgaaagtatttttatattgctgagagtagcagctaatcacagttacatgcttcagaggacttataattgcttggttttgtgtgtgtgtgtgtgtgtgtgtgtgtgtgtgtgtgtgtttaactgcatttgaaaagttttatggagaatatgcatgattttaaatctgtgataatgttacatgcaccttcaatttcatccactttaaaaattatcttctcattgaattttagtgcttctactagtttgttcctttttgcagttggtcgtaattcatttctggcttcttatgctttcctgcaagcagatttcattgcatttattgtgttcatatcattttcttggggattatttgtaggacaaccaacctggagttttgcctctctagagtaccacccagtaagtctggctgagcatcttatgtccagtaggttcttggtaaacatttgctaaatgaaattactgattgaaatttggggaaaagtgaataagaagactatctag

SEQ ID NO: 40995 - DNA, 1032 bp, Homo sapiens
agtaaataagaagtaagaaatcctttatgatattctgattgtaaatggaaaatgagtaaagttacagctctttggattgtcttgcatggattaagcaacttaaatagtgcagagactctgtagggacttctaaagatctttttaaaaaattatttgaaaattgaaaaactcagctttttagttccttattttttatgtacttattttactatgtacggatggataattttaacactttaaaaataatacagaggtttttgggtatgataaaatgtacagtctctataaaagggttgttataggcaacttagaattctctcctcatcctgccttacagagtggctaagctttagtctattttgtattagggcacaggttatattttatttggggcaagaacagggaagaatcttttatttctaaaaggtgaaaatccctggattaaatttctgcatcctttctggttctgactccctaatgattctgaaaaagtgatttaggaaagagcagagagagccctgaactgtgaactttaagcaaacacatactcagttttcattctgtttgcagttgttaaatgtcaatttctcaatactttaaccccttttcttctgtgtagctggattgtatggtttataagacgaatcctaagcttcactggtttgaagagtagcatgagcgttcctctccaggatggctggtataaacctactctgattttgtcacgatacatacttgaaatgtacattctatgcaggaccttaattctgtcttataaatcccgctggttgtatatggctgtcagaatgaacgatttggtggttgtggctctgttctaaatattgcctctgctgacctaccaaacactgggagaccatttcaggtaatacaaactgcttatgctttttctttcttgctaattattttcatctctttatgggcttgtgaataactagtgtgtggccagtatacgaagaaacgatgatagaatcagacatctttgatctcagggcctctggtggagttcattta

SEQ ID NO: 40996 - DNA, 1050 bp, Homo sapiens
tcaagcgattctcatgcctcagcctcccaagtagctaggattacaggcacccatcaccatgcccagctaatttttgtatttttagtagagatggggtttcacaatattggccaggctggtctcaaactcctgacctaagatgatccacctgccttggcctcctaaagtgctgggattacaggcatgggccactgtgctcagcctattttttactttttttagagatggggtcttgctgtgttacccaggctggagtgtagtggcatgatcatagctcactacagccttgaactcctcttgccattttttttatccttaaaatttccatgtctcactctcttgccaactgttctctctcatttggtcccttgattcactctaaactcaaaccctgataaagcagctgatcggtgaagtgtctgttgttactaaagtagaagttagaggcagaacagtggcagagagccctggaatctggcccttggtaggtgctccacaaatgtttgttgaacaaatgaataagtggagccaggttgtctatgccctagtcccagctctctcacatgcgctagtgagagatatatacatgtataaaaaaaaatctccctgtgcctcagtttcctcatctgtaaaatggggaagatcattataggcttgtaaatgaaatgaattaatacttataaaatgcttaaattagtcctggatcaaagtaagctttcaataaattgtaagctcttatgttcaagctctcagaaccagaatactcgagatgcagacaaaacattacctctcttaagaggtttgttggggaaagtatagctggagttaaaaatttaacctcttagataagtcactgttcaagctactggttttcatctccaccattccacctaaattgccaccaccttgctgaattagacacacttgaccacccttccttcttggcctagtgtttttctgggattgtccgtaacaccaaatatttctctaaactcactaaacatctctttttaattcccattgcaaaatcctttttgtttacctgtactt

SEQ ID NO: 40997 - DNA, 1091 bp, Homo sapiens
ttttctttttctggttatgtaaataattcatggtcataaaaaattcaaactataaaaaagggttaacaaattatgtaaaaattacctaaaagtcctactattagagataatactattagtattttgggagcatccttccatatctctctgtccatatgtaaacagccatatgtacttttgcataaatggaattatatgttctctttttgattatcagcagttttttttggtagtcttaatatattagtcactcctccctacctcatggtatttctgttgctatggagtgactacctaaaatgggacaaaggatgtatgtgctttgaaattatatagatattcctgtattgccttctaaaaccataatgcctaatatcgtagccactaaccacatgtgtctatttaagtttaaattaattaaggtgaaataaaataaaatctagctcctcagttgtattagccacatttcaagtagtcagcacccacatataaccactggctaccgtattggacagtacagatcaaaggacatttccatcactacaaaaggatctgttggatagcatataaggttatcaactttactgctttttaataaaaccattatttttcatggcaggtttctttctgagagctaagcatagcatcatcataggttatcattttaatcatcataacatgttcagcataacattctaaagataggcttggaaaaaagaagtatgactaagtaatagtgttgcactcttggtgtgttccagatactatgctatgcacagtgttttcatgtgggccatgttataagccccacagaagccctatcaggtgagtattattatggtcctcattttcagatgggatattgaagctgagaaagttcagtaacttccccaaagttagagagctgggaaggatggggctgtgatttgaggcctgtcatctgctgttaaatactggcctggcctgcctctcggtgttaggtagctcactgcttgccaacatatcctctgctctctttcttccttttcagtttctttacctgaatactgtgtatctactgtgtaatttaattgaacatttagatttttttc

SEQ ID NO: 40998 - DNA, 1031 bp, Homo sapiens
cctgtcttctaggggtcttgtccgcttgacctttgttacctgttcctttgcattatcaatatacaaggtcatattggtaatgcaaagtcgaacttcttactcaacacttccacttggatgcatagcatcttagacctgtacgtccacaactgaagccctgagttttaaatttttgctgtagactagctccacccacggtcttctccatctcagttaatggcagctttatcctttaggtggttgtcaggccaaaaaccttggtgtccttaacttccctttcttttataaacatactttagactttgcattaccaataactgaaccccttccacggctccagtttgaaggattctgccatctacctaccacttcttatattttggctcactctgcatggcacttcggcttccaaagggatctataatccagtgatcatactatcttttaatcctatcatcttttctctgtctttttccttatccgggacagattctgtggcccatcactgtaactaatctattgcatacacccaactcctgaacccttgctccctctgccatactcacttgacggaacatcaactttaaatacagatctacttattccatgcctgcttctggacagctaactgttaactatggaaacacacacacacacacacgcacccagacacatacaatgtaaaattatctcacttttggctttaaggtcaacccttgtgtcctgatcccattgcaaatcatccacccaaggattgttatagcaattctcccctttaactcaatttcacttgcatttctagtgatcttcccatttctctcctttcctttgtagtaaaacgtcttgaaaggattgttttcacttgctatctctaattccttgctacagtttttctcttgaaccccctctggtcgagcttccacccccacactccagaattgctcttctcaaggcccacaataacatctgccttgccagttccagtgatgagtccccagtgctcattttcttaacttactggcagtgtctgc

SEQ ID NO: 40999 - DNA, 1022 bp, Homo sapiens
catttctttttgtataaaaagcttataccttttgttttaaaaaattgtatgtttcatttcagcccagttcggggcacagtagtcaccaatgatcgttggggagctggtagcatctgtaagcatggtggcttctatacctgcagtgatcgttataacccaggacatcttttgccacataaatgggaaaactgcatgacaatagacaaactgtcctggggctataggagggaagctggaatctctgactatcttacaattgaagaattggtgaaggtacagtgaaatgtctggtggctattaacataatattcttaatagtgtggtcatgtaggaattatttcttctatggctcaatggcctataaatataggacattgttctatcctgtgtttgttcttctaggcagtgactatatatacatgtataaatatataaatgcaacatattagcacattaaagatggaattattttatttatctaaaaacattattcttaattttttagcaacttgtagagacagtttcatgtggaggaaatcttttgatgaatattgggcccacactagatggcaccatttctgtagtttttgaggagcgactgaggcaaatggggtcctggctaaaagtcaatggagaagctatttatgaaacccatacctggcgatcccagaatgacactgtcaccccagatgtgtggtaagtcattcttgttaccaagtactcttttataaaggaagagatttaaaatttatcagacatataaagaagagtaggataaaaagagaaattggatgaattcctacatatacaaagcactttccaaactttgcttactctaatataaagagaaggggaagaatttgcatgttttgaaacatttattgtttatcagattgagcttacatcatttctaggtatctcccagtagtggacaaattttggctgaaagtactcagctcttagaaaaattgtaagctgttcagaccaatgaaaaatgctgaatggttagtctaaaacggaga

SEQ ID NO: 41000 - DNA, 1044 bp, Homo sapiens
ggggcccaagagggacattgtcaaggaacttgaggtagccattaggaacagaactgacctgcgttttggactgtactattccctttttgaatggtttcatccgctcttccttgaggatgaatccagttcattccataagcggcaatttccagtttctaagacattgccagagctctatgagttagtgaacaactatcagcctgaggttctgtggtcggatggtgacggaggagcaccggatcaatactggaacagcacaggcttcttggcctggttatataatgaaaggtgtgtatgctatgagattgctgcagttaccctccatattcctaatatatttctaacattttaattccttcacctcttgaaatatttcattttaagtcattggtggtatggggggagaaaatcattgtaaataatacttattagatatatcactatttactcaacataatcaagggtaaataaatcaggagtaaaatccaactcaatggtctgattttgagatcagactaaaaatcacaggatcaagaactttgaaggtgttaattttgtgggtcccccctttttctctcctaccctggtcctttatggcctctattctgggacaactctgtttcttcatcactatttctgactatttgcttctgaatcccgcagactgcttctttttatcctcttaccttttggtcatctttgctgcccagccaatgtcacccttgtttgtctcctcttttccttcatcgcagccttttcactttctccagttttttcctattgcttcctggtatgttcaaggctgccctattagaacagggagttctgattaaactcctccattaggcttaaactatatggaccaaatttgcatgtacactagaaagcactgggtattgtgctacgaagtcaggcaaccttctgcttgcacttcctgggcccacaaagggcacaaatacaaatattctgaagaactcttgatacttaaaacagcagtgtgtccaggtactccttccaagggaaaaaactgggagccatcacttc

SEQ ID NO: 41001 - DNA, 1020 bp, Homo sapiens
cacaatgaaatgaaggcattttgttatagggttccatgaaggtgtgaaataagcaattcagaattcaatggtgaatttggaaacctcttagttatatttgttccgtgtaggtaaccagtcagagtaattcattttctttcatagtccctcttgctctctcctctctccttgactaaccatcctcaccccaacaaacacacaactcatttatacacaggagcttggattacccagtttgggtgattacctggatccaaaaaaacctgttatatctctgttcacacttttgttgtacaaacagaatttatgcaaactaactccatctttaagttgtgttgctttctctggagatcaccccttagggtaaccctagaaactgcagctctggagatcaccccttactaaggtaaccctagaaactgcagctctgaattcatcacgttgtagtagcttattgggtgtagccgactggctttagcacagcagtgaactaatagaggctgcgtgtatagccatcttcctctggctattagaacgaaccattcgattgagaataaagtttccatatagtttgggtacggtgacatgaaagaagttgcagattgttcagtgagactatcgcttgtagggttgtaggatggaggaagaaagggagagtgagagggagaagtttatttatggaatgtcagggggccattgaagctcagcaggccctagaagcagaggacttccccccgtgcttgttttctccctctgaccttggatgaactagcgagcagtatattatgctgggtgattgtgctggtttgtcatggttagcattctgaactgtcactggaatgtaggaaacggatgaatttgaattaaaccatgaggtggtctgctgagccctctccttgtctcaaggaaacctgtcgctgtttgtctgggctgggcctaatgaaagcaatggagggaaagagaggtgggcctttgatctctttgttgcagctgctccctgggaactcgctgaaatcaatg

SEQ ID NO: 41002 - DNA, 1133 bp, Homo sapiens
tttgcttctgtgtttggcccctaaagcctcactgctcatgctgttgggtggagttctctggacctctcctgattttgaatgctgcctaattcataaatccttttgctcaaataaactctgttaattttattttgtctgcaatttttcttttaatgtacatacgtatgtagatatacacaggcatatagatgcatgtgtatatatatgaacacatgtatgtatttatatatgatatttgaatatatacagttagctttctgtatttgtgggttacacattcatggattcaatcaactgcagattaaaaatatttttttttaaattgcgtctgcactaaacaggtacagacatttttcttgtcattcttttcttgacaatggagcataacaactatttacctagcatttacattgtattaggtattataagtaatctagagatgatttacagtagatgataggatatgcatagattatatgcaaatactacaccattgtgtatcagagacttgagaatccacagatcttggtatccttgggcatcctggaaccgattcctcagggataccaagggagaactgcatatataaagtgtacttagtttactactcaaatgtatatatgttttccctatatttatgtttaattatttattcagtagccatagagtgttgtggtcactatggtgagggtgggggtgaggtgggaaaagttttgcagaattccaaaacctgtcctaaactttaggctaaactctttggtgcaagagagttaggtttatctgggtacacaatctcaaaataaataaaataatgttagagacattcattccattgatttgtctcttcttcctatttgactgtatgtagatatcaggttttatcaagcttgcaataaaatcctgatttcatgtcaagctaccagattttaatggctttctattgcacttaccatgaaatccaaactcacagccatgactcagtgagccctgcatgctctggcctctctaaccgcatcttcctctgcttgccagattcccaccactctggcctctttctgttcctcaaacattcaaggactttcaccaccgtgggcttttgcgtgcattccttttgtctgggatgctcttcctct

SEQ ID NO: 41003 - DNA, 1042 bp, Homo sapiens
tcattctgcttgccagcattaggaaaaatgtaaaacacaacacaaaacactctcttttgaccatcattaaggtgtggtaaaaatcacttggcttggtgtaagaaataatgatgaaaaatgtggttaagactttggaaatgataagaaagtaatgaaaggagagatttgaaagtgagttaggaaataggaaatgaaatggaacttgccacacatgaaaaatcactgaagagctaaacgcagaatcagttggatcagaagttaaagctgaaagtgtctttagaaataatctcatttaatgcctttattttacagaggagcaaacagacccacagacatcaaatgactttttcctattgcaaagagttgtaactgggaccaaaggtaaaggataagtcaggaagaaaggttcggagatttattgtgatattgagatgtcataggagaattaatgggaatgagagcagacagtattgttagtgggtaagaagtggtgcaaggattaataaaaattgtagtaagaggaagaaaaatggctaaaatgagaaaaagcaaagaccagtgtcttttccaaaagaagaaaaggcaggtgttttctgtggtggtgagagcgagaaggtgtgactgtagaagcagagggggagattcaaggttatgtgcctgggaaagagatgtgctgtgtccacttatttgtctgtgggactagatcgcagtaggaaaagggagcagctagatgtaacgtgctgatcaaatcatggcataggtgtgccgtcactgagtacctgctagaaaaagaagaaaactgatagaagatgagactgagaataaaggggaaaggattgatgacactaccctcattatagcaataatgacaataataagaaagaggaagaacaaccataacaacaactctgttctttgcttctctaagtcgttgctctgaaagtcttccctgattccattaatggaaatacacttgcagctgctcaggacccaaacctcagtgtcatccttgactcctctctttatttcaaatgtcacattc

SEQ ID NO: 41004 - DNA, 1026 bp, Homo sapiens
gagaggcctttcaagccacactgtggtccttggtaaactctgtccttctcaggtgctgatgcctcatctcagtgtgttgtgttggctccttcaggggcacttgtatttcaccaaaggacatctaaagagggaagtctaaacatgggagtggctgtcatgggagaattctgggcctcacggcagatccccaggtgaaatctttcgagggaggggtgttcccatctctttggtcatccaataaggatggcaacgtgaaagccacaaagaactcttgtgtgtgaccgtcggaggatcctttcgggccactgtgttcctgtagctagagaatgccaagtcatgagccctcaaaagagggctttctcatttccctcttcctttccctttgaaataatttacattgatcacccgctgaaaacaaacaaaaaacccaacttacaaaatatctctgtactgagaacctgtgagcaggagaaacttcaggcatccaggagctcaaggaagtgactgtggggcgcttctctgtcccacgggatgagagagcggagcagagtctaccaggcctcagcagggcataacgtgtcctctcctggcgtgttgagaagatatttgaataatctaataatcaaaatggtaaccttgaagtaaaccccaaattataaaatttcctgaaaatatagaaattaaatcagttttagtattcattgtaactcgagggaataaatgaacaattggttatccatctgtatcgaatgatgttagccattccattgaacaaatgaaaatgagtgtatgttgaatgaacagattgattcctttaactattatgggccgcttctgtgttttacatttagctggaagatacttttggatttactgaaattcaggtggccagacctgacaactatttttttttttgaatcctctaaaattctgaccaatctctgcaaaaacttcatgtgaaagtgcattctgatgacaggcgataggtcacttttctttggagggatatttgcatggatggcgaag

SEQ ID NO: 41005 - DNA, 1025 bp, Homo sapiens
atcctataactagaaatatatcacctacttttggaaaacaaactgaaataggatgcacatgaagggcactttagctgtctgattaagcagaatccattgatgtgtttgtttccaacaggcccagtctttgtctctgcatcccatacaatgattcagtacaaatcactttataaccttacttttctatctttcaatatagtgtttgttttcagagtttatctttagttatctgtctctaggtttagaacatcttgttttaaagtagcagaaattagttcatactcatttcttaaatatggactctgacttccaccatgtctggatgtatattttaagggcttatttccatcagaaatgttatgtgtgagatatatgtgttaagctactggctttgggcctgtttatctttgacttgttctgagtttccctatcaccttaaaaacatttgaaggccagggctgaaggatatgatagaataacacctcttttagcaacaacatgtgactctatagactgactctgatttgggatatgctgactctgatttcttatattgcaggctcaaatgtcctaatttaccctttgtgtatctctatgaactattcttgagcttttatgcaatcctgtgtgaaaaatcagccagccattttattttggcatttaccgactagcgaaatactaactagtacccactcaaagagtgcaatattcaagaaaatgctgagtggtatttggattttagcttgcctgtcatgaaattctctttaatattttaccagtcctctttaaaattttgccagttgaaaaaaacaaacaaacaaataaaaattactgtcttataatagtttctatttcttggttatgtaacggaagtgtccacttccctcttttccagcttaggagctttagtgtgctcagttgaaccccaaagtatacatacgtgagcccagcactatcacctcactaggcatccagcaggtccctgggtaagggatctttgaaagatctggaaagagggatgggac

SEQ ID NO: 41006 - DNA, 1050 bp, Homo sapiens
ttgactggtatcaaccttttacgagtttgagtgaattttagaaaacttacctcctttttcattcgtttgtccttcctcatttgcaatataattgccttaaatatttcctttacatacatgtagaatagcatcagacaatgttagaatgtttgcttatttacttataattttgtttactgtgctcattcttcctgttttcaaagagtttctttttgtttagacatcttctgttagtcatttttaagataattcagcggcaaaattttcttagttttccttcataagcatgttttgattttccctttttttcctgaaggaaatagtcacaaagtaagattcttggttgacagttgttcttttttacagcacttgaaaaatgacacttcctttggtgacttctgatgagaaatctgctcatattagaatattttttcctttacattgctgtttttctctggctacttttatgattttctctgttgttagttttcagaagtttaaatatgtcatgtctcggtattgatttctttgggtttatgttgtttggactttgctcacctgcttgaatttgtaggttttgcctcttgccaaatttgaaaagttttccggcattattttcttaagtacttttaagccctactatcttttccctcttcttccaagactccaatgacataaatttagatcttctgttaatagtaccacaagtccctaagtgtctgttttttttttttttaattcagcctacttttctgttgtttgctgtttagattgggtaatttccatgattctatcttgaagtctgtgaattctttcctctgtcccttccatattgctcttaaacccatctattgagttttgaaaatttcaaatattgtgtttttcagttctaaaattaatatttagttcctcttttcatcttccattccattgctgagacattccgattcttcatttgtttgaaatgtgttctaatgggttactgaggccttaaaatctttatcacataattatcacataattctaacatcattgttctcttggtgttgg

SEQ ID NO: 41007 - DNA, 1052 bp, Homo sapiens
atctctgccttctgggttcaagtgattcccttgcctcggcctcccgaatagctgggactacaggtgcatgccaccatgcccagctaatttttatatttttagtggagacggggtttttccacgttggccaggctgatcctgaactcctgacttcaagtgatccgcctgccttgatcccccaaagtgctgggattagcaggcgtaagccactgcgcccagccacctctagaaattttggtcctatttatgctcctgtcttaactttcttgacttcatgacttcatatttttctaattttcctattttaatttctggttcttttgctgatttccttttcctgacccttcttttcccacttatggctatccatgtctaaacttattattttgtactcttttccagtattgatgctgtttaataggaatacatctcaatctatagttctatgtgtatatatatatcaaaatacctattggatatttacacataaatgttattatttcagactgcaatgaacagccaacatcttaataatcttttccttaaaagtaactgtatacttactacataacccaacaactcttctccttggtatttcctcaacagaaataaaaatgtgtccacagcaagactatacaaatgtatagcagctttgttcttgatagctccaaaccaaaaacaactcaaatgtataccagtaagtaaatgaataaacaaattatgctataaccatacaataaaatactactcagcaatacaatataatggactactatacacaaacaatatctccaaatattaagctgagaaaaagaatccagatggaaagagtacacactccttatttcatttatatgaaactctagaacaagaagaaacttgtggtgatagaagatcactatttttttctggggccaggagtgagtagatgtgggatgactatgaagcctctctctcagcttctggtgattttctgccagtctttggttttccttggctgtggctgtatcatccttacctttgctttcatattcacatggtattcttcctat

SEQ ID NO: 41008 - DNA, 1049 bp, Homo sapiens
gcaaagcattcaagaggtgacttgggtgctgttaaaggcattcagttttataagggaagcagagcataaaaggttggaaaatttgcagcctgataatgtgatagaaaagaaaatcctattttctgaggagaaatttaagctggctgcaaaaatttggataagtaatgaggagctgaatattaatccccaagacaatggggaaaatgtctgcagggcatgtcagaggtcttcacagcagctcctcctgtcacagacctggaggcctagaaggaaaaaatggtttcatggtctgggcccaaggcccccttgctctgtgcagcctaaggacttggtgccttgcgtcccagccactccagccatggctaaaaggggccaaggtacagtttgagccattgcttcagagagtgcaagccccaaggcttggcagcttccatgtggtgctgagcctgcaggtgcacagaagttgagaattgaggtttggaacctctgcctagatttcagaggatgtacggaaatgcctggatatgcccaggcagaagaagtttgctgcagggacaaaggcctcatggagaacctctgccagggcagtgcagaagggaaatgtggggtcagagcccccacacagagtccctaccgaagcactgcctagtggagctgtgagaagagggtcaccgtcctccagaccccagaatggtgaatccactgacagcttgcactgtgcacctggaaaagccgtagacaatgccagcccatgaaagcagccaggagaggggctattccctgcaaagccacatgggtggagctgcccaagaccatgggaacccacttcttgcattggcatgacctggatgtgagtcatggagtcaaaggagatcattttggaactttaagacttgactgccccaatgattttggacttgcatgggcctttagccctttgttttggtcagtttctcccatttgcaatgagtgtgtttatccaatgtctgtgcccccatttcatctagaaagtaattaacttgcttttgattttactggttcataggtgg

SEQ ID NO: 41009 - DNA, 1022 bp, Homo sapiens
tgggtttagtagagtccaaaggagtgatgcatattgtgttggaaacttgagctggagatttaggcagacctaagcaaatccaagctacaccattttccttctgtgataccctacttttgctcagcttctatttggcactactcagtaggaactggaaggcattacagatatctttgattgaaggtttttttatttttgaacacttataatatgaaacttttacattttctaaagtggaaacaattgtgataaactttacatttagttgcacagcattcaaactctggttactttattcgtagcacctttaggttttcttgcattcattgcactgatttttcagaatactacatccacttggtttccctgaggccttgaccgataaatgatcacacaaattgtttcacgatttttttttccaaaagggaatttctgatggcagaaagtttctactgcttgtgtttgtgtgtatttttgttttccatatgattttgtatcttttcttccctttgggatgggacagtcttagtatggcctctttttatctttgcctactagtattgacatatggagtgaaatttttggggggattctataatcattcctgcagaaaatctcacctactcttcaaatttaactcgccatcatttatatagattactcacacatctgtatcctagccatttgctccactgaactcccaaccactatatacaagcatctactggacatttccacttgattatcctatagctttctcaaactcaacatatccaacctactccagtcctccccctcttagtctgagaaagtggcaccatcatcaccaagtttcctaaaccaggaatttaggagttatgttggctgctttttctcccccctttatttttattcagataatcatgaagtcctgaaacctctcaggtttgcttttctgtttccactgccatttcccaagttcagtcccaactgtagttgtctcctggactacaacaacagcttccttctaactgggttcctac

SEQ ID NO: 41010 - DNA, 1050 bp, Homo sapiens
tgcttaacatgtgtttgagcaccattgactttttatggccaatacaatgaagtaattttgattcagtttgattgatgccagatctgtaaggtatttttatgtggaatatgtagttttctgtgaaatgaagaatctcatttgtccatttcattattttcttatattataattcttcgtatatttaatacaaatgagtctctaattgaggcagaattttgaatgtagggaacataagaatgaatgagactgagatgattctgactttcatggagcttatagctttcctgtggaaatagatattatacagaatgatgacttacttagagttgtcactagtattaccaaggaaaaagacagtatgtaatgagtacacacaatatgggatccattaccttgtctttggagtatgtggaaaagtaacaggtaagccaagacttagggttgaggcagcaggggcgtgtggggaggaaaagggatgtgtgtctgtgtctgtgtgttagaggtagaggcagacattaggaacagcctggaggcagcaggttattttgaatacattagatgactcttatattttaaaatcatgctaatttgcacttctttatatttacttacctccttatgtattttaatgaattttttaaaaatgcttttttgagggcaatatatttatgcctttaatgacaagatctcatttcattatatgggaaaatgccatgtcttagaactattttaatgaattgcttgtcagccacagagtatgagttggcaaagaacttctctcagagaaaattgaaagaattgaaaacatttgatgatttactaatattttctggtccagcgaaacttttccaacaatttaaattcaaatataaattattagagatgttagttgttttctactgtgcctactgtgtcactgttaactgataaataagagattgatgtttttaaacctgttttacaggatttacaagcaattgcaaaatactttataaaggcatgtttaatttgatagtagtggtcttgattaggaagaggatgaatctagga

SEQ ID NO: 41011 - DNA, 1031 bp, Homo sapiens
aagggcgcacccatttcctccaaaaatgagctaaagggaaagcagtgccccagagtcaagggatcggggctgctgctccttcgactagcggcgcgaacaagtcatgctacttgggcctgtttcctcaactgtaaaatgaggggtctaggattccctctgggaatgtacgattctaaaatcgaacagggtttggtagcaccgccggggcggagccttacggggcgccgcgggaatccaacgacaggactcgccacagtgggagctctctccagaccctactctagccacgacgctgcggggtcagagggcggcgtgcgcgtccccgccgggactgcgtgcgcgtccccgcccagctgtcggcagaagccgggccgggtgggcggggcgcagcggggcggggcgcgcgaggagggtggctgcctctggagcaggccgggagaagagaaaaggcggcggcccggctggggaagaggggcggaggaggcggttcggacggctgtgtggggtacggagcgtcgccgggacagagcggagcagctgggcacggcgtccagggcagctagggcctgggccgcggttcggccgcgccggccggtgagtgacgggaggcccgcaggggaggccggcgccgtccgcgctgcggcggggacgaaggcagcggccgggcagtttgaggccgcggccgggaccgaggcgctggcgctggcggccgtggggttgacgggcccggcctggagcagaggaaaggcggctgaccccggtccatgcgcgtcccgggtcggccgtccgggcgccctgagagggcgtccgccgcgctcgtgtcctcgccgggccgcatgccgggccagccgttgaggtcagcaaatggcgacttaagcctcgagggcaccgacctccgtgtcccccccagtttgtgtgtctttgtattgggaagggacgaaggaggagttaaacttagggaaccctaagcttctcgttccgtctggtttttagaaacttgggttatttggggacaaatggcttaaagtaag

SEQ ID NO: 41012 - DNA, 1035 bp, Homo sapiens
ttcccctatgttttcttctagtagtttcatagtttcaagcctttaatttaagtctttaattcattttaactgagttttgtatatggtgagaggtagggatttagtctcatttttctgcatgcgggagatgtgactttttaattttttttaacttttctttttctcaattttcctccacaccatttattgaagagattgtcctttctccagtgtggattcttggcacctttgttgaaaatcaattggctgttggctgtaggtttgttaatttatttctgagctttctattctgttccattggtcaatgtttctgtttttatgctgttttggttacattagctttgtagcatattttgaagtcacataatgtgatgtctaagccttccttcttttttatcagaattgctttagctatttagggtctttgtggttcatataaatttcaggattgtttttctaattctgtaaaaaatatcattgatatttaacaggcattgccttaaacctgtagatcactttgggttttatggccattttcagaatattaattcttccaatccacaaacataggttatcttcccatttatttgtgtccttctcaatttctttcatcaatgttttgtagtttttcggggtagagatctttcactttcttagttaagtttattcctaagtgtattagtctgttcttccattgctataaagaaatacctgagactgggtaatttataaagaaaagaagattcattgtctcatggctctgcagactgtacgggaagcatagtggcttctgcttctgtggaggcctcagagagcttccaagaatggtggaagacaaagagggagcagggctcttacacagcaggagcaggaccgagagagagggaggaggtgctacacatttttaaacaaccaaatctcttgagcacgcactcactattgtaacacagcatccaggggaacatccaggccccatatccaacattggggattacaactgaacgtagatttgggtggggacacagatccaaacca

SEQ ID NO: 41013 - DNA, 1035 bp, Homo sapiens
agctcctgaaatgaagcccgcttcagaacttactcaaatgcatgttgcttcttattgcagctggactagtagcttgaactgtgatggaaattaaacgtctgcttctaaatcctgacaggaatctcctaaacagggtcaaaggccacctgtcttagtcagctcaggctgccataacaaaataccatagactcagtggaaacaatagattttattcgttcattcatttattcatccattttcacacagttctggaggctggcagtccaagatcaggatgtcacatggttgggttctggtgagaactctttttagcaaccatcttttcatctacttctatgtcctcacatgggaaagagaaagtgaaagctctctggtatctctttataatggcactaatctcaccatgagggctccaccttcataatctcatctaaatctaatatctcccaaaggccccatctctaaacgtcataacattaggggttaggacttcaatagttgaatttgcatggggaaataattccatctatagcaatgccaatatgtgaactaactaacaggcttaagccaggtacctgagatggtcacaattatgggcaagaagatgttcaatccaaataatgaaattatagcagtttacaaaaatgttacaatttatgtttctgaatgttccatactagaaataaatagaaaggcaccacggtctcaaagtgtgtgtgtgtgtgtgtgtgtgtgtgtgtgtgtgagtgtgtgtgtttataaattttatttgatagtttcaaattactaggctgaagaaagaagaacattagcaaaaaatgatagtggcattaatacatttgctcactactaatgacctaaaacgtggcaattcaaaaggaacaaataattatttcagtgtagactgtcacagaatctagggcatcatcaaactttgatccctttgggctttttacttggaaagaatgcagtttctctttttttttaaccttagctttattctccaaacattttaaaatttaattcatgggctat

SEQ ID NO: 41014 - DNA, 1040 bp, Homo sapiens
ttgatacacacctactggaatggccaaaatctaaaacactgacaataataaacgctggtgaggatgtaaagcattcattgttagtgggaatgcaaaatggtacagccactttggaagacagtctagcagtttcttatgaaactaaacatactcatatctcatgaaataaatatgagaggcattattatttaagaataataaagcaaacaattataattcaatatttttaactttttcctaaaaataacaaatagttcattgtagatgtttacatttgtcccaaaaatgacatttcaagaaatcagctatcagaatgattgtttcacagtagacttctttgttatattgcaacaattgacggctgaggctgtacatccttcttcagcttcagattgaatatactaagcaaaagactagagggatgaagtataaaaaacagtactcttctaagaaagctagattatcttctcttgattctttaattttcattgactgtcttcctgtgtcgtaccttaacactgataacctcatcttagccggactgaaaacaagtgacctattaaaacttcctaataaaaaataacattcaacaaaagttaattctacccccaaatacatttttttagaactcagagcaacttgggtttaaatccaagcttcacaacttatcagctgtgtgatattaagcagagttgtgggctttggtcattcctcatgtgtagaaacagagatgatgttacttggcattatgggatgaattgtatctccacttcaaaaaagttgtacgttgaggtcctaacccccagggccttagaatatgactgtgttttgagacaatgcctttaaagaggtaatttaggtataatgaggtcatattggtggaccctaatccaattggactgccactcttacaagaagaggagctttggacacagacaggtacagagggaaaactatgtcagaacacaggaagaaggcaccatctataagctaaggaaagaggcctcagaagaaatcaacccaaaataaatcaacttgac

SEQ ID NO: 41015 - DNA, 1035 bp, Homo sapiens
ttgaaacatttttaaagtagcacaaaagcttattttaaaaaatatcatttggcatgcaaaacttcggcagagccaattgtagatgaaaatgagacagatggccttcaaaatatgaagcacacattgtaaagaatgttgtactccaggcctgtgaatctcactgatatctggcagccacagttaaaatgttgtagcatctggaattgcgggctgtaattgaaactcaactgaagagctttctgtggagctggaatgaccagccaatgcataaagttgttaaacatgaaacaaagataactattatcttttaaaaacctctcattaaccctcatgacgttcttgggtgaaggtctaatctggcacacttgctaacttctaataaagaatcaaatggtcttccaactcacataatgactaattctaaagcatgcaacctcaaagtactacattctccctgttctagaaatacaaccctagagggccagtcttccttcagcattcaaatattgagtagaacaactgaactgtaaggttcaactaaaggaatgcaactgtgacttgagctgtggaacggctatggcctaagtcaagaattctcaacctcagcactagtgattgacattttgggccaggcaattctttcttctggggcctgtcctatgcattataagattgagcagcatccctggcctctacccattagatgccagaaacatactccacccccaagctttgacaaccaaaaatgtttccagaaatttccaatatctcctggggcttaaatcaagaaccactggcataagccaaggaagaactaaccatttaccatggtacaggatgagtatcccatatcttgggaccagaagtgttttggatttcagattttttaatatttgcattatgtgcttactggttgagcatctgaaatccaaaatgcatttcccttgagacttatatcagtgctcaaaaggtttcagttttgaagcatttcaaatttgggattttgggatttgggatgctaatctgcaataacat

SEQ ID NO: 41016 - DNA, 1072 bp, Homo sapiens
ttatatattttagagaggcataaaacatcaatcaaatacatttaagaaatacattggtttggttcagaaaggtgagacaactcaaagtggggccttccaggctataggtaaatttaaacattttcgggtggacagttggttgaatttgtctaaagacttgggatcaatagaaaggaatgttcaggttaagataaaggattgtggagaaccagttttattgttcagaagaatctctcagatggcagacttcagagagagggtaggttgtaaaatgtttcttatcaaatctaaaaggatgcctagctcttagttgattatccactggatctgcaaagaaaggaaagaaaataaaaggggaaggagattttctatggaatgtggatttttcccacaagagactttgcagggcaatttcgaggcatggcaaggaaatatattatggggctaaatattatttccttgtctcataatgtcacgccagagtcagattgaaaagcaagtcacaatatacatggtcaaataaaagccatctgatgaggatccatggtttgtaggacatgactccccagacctcttaggtaggaatttgggcaagataaaaatcagagcttagtccctgaactatagtcaaaagatagacaataacaagttttgttaaggatacagaaaattggaaccctcaaacattgctggtaggaatgtaaaatggtacagctgctttggaaaaccatttatccgtgtcttaaatagttaaatgtacacctagcagctatgccactcctatgtacttaagagaaaataaaacatatattcatacaaaaactcatatgaacagtctggcaggtacctggagtgttaaatggagttaccacatgacccaacatttctactcctaggtatttacctgtaatagtctgctagagctgccataacaaaataccacagactgagtaaattaaacaacagaaatttatttattacagttttggagcctggcagttgaagattacagtgctggcaggtctgttttcttctaagatctctctcctttcttgcagatggttgttttctg

SEQ ID NO: 41017 - DNA, 2093 bp, Homo sapiens
aacataccaccaagtggcatttaaaatgcagtcatgtcttacttgttttttgttggttttcttctgtgtttttaaatattgattttttgtcctaccaatgttcttttaaagcataggctggactagtctcatatttaaaaccacgagtccaaaaggccattcagcattacccaacaatcttactatgcctcgcaagtcaatatgtttttttctactttctgaggagtctgtcttaagtgtgtcttcttcctccccatggcgatcttgcctcatacaggggaaacatatacaatcagattagaagtacctcatctttccatcatcaacttgaacagtctgcctgcatcagtactcacatactttttggtagatttttattgagtatcttctgtgtgccaggcactgttttaggaacatgagatgtcctcatggagtgcgattctagctgtaatggggttggtagacagaaaggtggtaaacaataaactaagtacaatctggactatgttaggagctggaaaagtagagcagggtgaggaagtaaaagtgcaatgtttgggcaggaaggcatgcaaggccttattgagaaagtctgagcaaggacttgaaagaaatgggaaaatgggaaagttagtcatgcagctatcttgtgaaagaatgttcaagtaaacagtgctttcggtgcaaaggccctaaatcaggagtgtggtatgttagaagaatagcaaggagctacagttgctaaaagggagagaagcaggagttgaagtgaatgggctcagtggggagagggattacattgggcccaggaagccactgtgaggatggtgcttttgccctgtgtgaaatcgggagccattggaaggctttgaacagaggcttggcatatctcacttaagttttaaaagaatcattctgagtgctgtgatagggtgggagtgaaggggagcaaggaagagtagaagcagggagagtcttggaggctattgcagtcatcctggtgagagctgaaggtgacctgaccatggcagtagcagtgcacatgatgaggagtggtcaggttctggatatattttgaagatagaactgatagtacttttggacagactagacatggggtatgagagggtcaaggataacaccatgggttttggcttggacaactagaaggatgaagtaaccttcaactgagctggagaagtctacagggtagagcagatttggtaagggaagaacagacatccaaatggagatttctattctgtaactagatgtacaagtccattaagtcacgagactgaatgagattacctaggagtgagtttagatagagacagagtttagatagaggaccatggactgaactccagggcaccaaagttcagctgttctaggagaggagaaggaagcagcaaaggtaacaaataaagatcaaacagtgagttaggaagaaaaccagaagacaggagtgtcctaggaaccaagtgaaaaatgtacctcaaagaagaggttatggtcacctgtttcaagtgctatgaaaaatgtcaaggaagataaggattgagaattgatcattagatttagcaacatggagatcaaaaccaggttaagtggtagaggtgacagcctgactttagttttggagaaaatgggattttgtgtatttcttatttaacaaatatttgtataacaaagagaggttaggtaacttgcccatagtcaggcagctagtagaagcagtggcagatttcaggcacagccattctgccttcacagtacaagctttaaccacagtgcactgctgcttctgtgtggctggtaaggccagtattttgaggagttttgctgcagagaaaaggaagagaatgagatcaagagaggtttttgttttcctttcaaatgggagaattagtaagaaaatgattcattagagacaacaaaaactagtgaaggagaacagggagaatgcttgacaatgtccttgagtaggcaagaggatatgggatcaaacactgaagtggaggaaggggttggtagtaggcagaagcatggatatgtcatccagtaataagcaggaaagtacctcatatgcc

SEQ ID NO: 41018 - DNA, 1124 bp, Homo sapiens
atgttttcatcagagacactggcctgtaattgttttcttatagtgttcttgtctgattttgatatcagagtacttctggtcttgtaaaatgaattaagaatattttctcttcagttttttataaaagttcaagaaagattggtattagttcttctttaaatgattgtttaactttaccagtgaaaccactagttcctatgcttttctttgaggggagactttttattactgactcaatcttgttactacatactggtcttttcagattttctgtttctttgtgattcagtcttggtagattgtatgtttctgggaatttatccatttcttctagattttctgatttcttggcgtatagttgttcataagtctcatgattctctgtatttctgtggtatcagttttaatgtctctactttcatttataattttttaaattttactcttattttttcttagtctacctaaagggttgtccattgtgtttatgttttcaaataaccaactaagaatttcattagtcttttctgtaattttttttctgatctctattttatttatttctgctctgatttttattatatctttccttctgctgactttcggcttactttgctcttctttttccagttccttgtggtgcaacattagttgtttatttagaacatttctctttttttatgtagttgtttatttctataagcttcattattagaactgcttttgctgaattcccataccttttgttatgttgtatttccattttcatttgtctcaagatatttttaatttttccttttaattgcttcattgacccaatgaatgttcaagagcatgttatttaatttctatatttttgttaattccaaaattcctcctattatgggtttctagtttcattccattgtcagagaagatacttgatgtaatttcagtcttgatttcggacttgttttgtatcctaacatattctgctaggaaagtaggaagtaactagattgggacaaaatggttcagaactgtagtggttggaagggatcattgagcactaccactgaactggccagtctttgataaaagcaaatgctctgttcttttcctacgtagagttagcactacggtac

SEQ ID NO: 41019 - DNA, 1064 bp, Homo sapiens
ccttttcctagacctgttacctatttgtatgtcttcttttgagtaatatcttttcaggtcctttgcccattttttactcaggttgttttcttgctgttgagttgtttgagtttctggtatattttggataataactccttatcacatgtgtggtttgcagatattttctcctttgctgtagattgtctttgttgattatttcctttgctgtgcagaagcttgttaactttaatgcgatcctatttatctttttgcttttcttgcctgagttttttgggtcatatccaaaaagtctttaccaagatcattgtcaagtagtttgtagttttgggtcttatatttaagtctttaatccattttgagatgatttttgtatatgcggtgagataagggtccagttttattcttttgcatgtggataactagttttttcagcacagtttattgaagagactgttttttccccattgtgtgatcttcttatctttgttaaagattggttgactgtgtatgtgtgggtttatttctgggctctctcctgttccattggtctgtatgtctgtttttatttcagtagcgtactatttttattactgtagttttaaaatgtgttttagaatcagggagtgtggtatctctagctttttgctcaagattgctttggttatccaaggtcttttgtggttccatatgagttttagaattgtttttcctatttttctttgtctgttttatgttgccgtaacagaatatttgaggctgggtaatttataaataaaaggagttacggccagatgcagtgactcatgcctataatctcagtgccttgggaggccaaggcaggaggatcactcgaggccaggagttcaagaccagcctgggcaacataataagactctgtctttaccaaaaaaaatttaaaagtagccaggtgtggtggtgcacacctgtagtcccagctactcgggagactgaggtgggaggatcacttgcgcccaggagttcagggttgcagtgagctgtaattacaccactgcactccaactagggcgacagcacaagac

SEQ ID NO: 41020 - DNA, 1032 bp, Homo sapiens
gaaaggatgggagtaaggaaagggacagtaatgtcagaagaggacagaggtgcttatagttaagtacaactttatcaacctaatatattaagagattatctagcagttgtatgggatttctgttcccatgtacagtcttccctaatgcataacattccagcttaactttgcatctgtttactgctgtagctaaataatgagtttgccagaggctaccagtttacctgtcttgagaatgttcatactgtgttaacagcttgcacaggaatagattggtatccacatttccttttgttacttttttgcttttttgcaagcagccttgcctatatgtaacccattccctttttcctgttttaatcttatctttttttaacaatgtgaatatttgctttctatagcagtaactacattgaatagtcttctcagaagctggcagatttgaacccaagtttatttacatatttaagatagaagaaacatgaaaaagagcagtagaatgtgtgtagtgctcattaaggcggtataaaacattcatttcaattgccaaaccagcagataaaccatccttttatgtttttctccatattctgcaacacgcgttagagtgttatgtatttggagacaagggagtgtattttttcatctttgtatatccagttcctcatatggttctttgttaactgtcaaatgaaatattgtatatatttatggtagtatacaacatgatgttttaatatatgtagatattatggaaggattgaatcaagctaattaacatacccatcacttcacatacttaaccaatttttgtgataagaaaatttaaaatctgccctcttagcagttttcaagtatagttggccccccacatttgcagattctgcatcagcagattcagttaaccacggataaaaaatactcaagaaaaacccagcaacaataaaaaatcacaatacagcatatttaaaaaacacaaatttttaaaagacactataataatttacgtaagatttacattgtattcagtat

SEQ ID NO: 41021 - DNA, 1040 bp, Homo sapiens
tgtggagctggagatacaaaattcggagtcactaatagaaaagtttgcttcagattgagtcctatgaagtccataactttaaaagattgaatcaagttgggagggctggaaaatgagaaggagcaactagggacaggcaatccaggcaggtacgctggcaacaaagaccacagggaagctctgcttcggtgaggagacagtagtgctgaaggtggatcaactacaatgtggactaatttgtctaatgaggtcactgatgactttagaaggagctcttttaatacaaatgtagaggcagaaagcagattgggagggattgcgggatgagcaggaagtcaacaagtagaaaaaatgcccaactgtttcataaacttaactgtgagatagaatcagaattgtaaccagaacctatgaaaacagaaagacatcacttttttgttgttgttctgtttaagacaaaagattcttgagcatgtttagtctccagtgaaaaaaggatagactgaagatataggagaaaggataatttgtaatacaagtttcttgaaaagaaggagaatgttgatgtatagaaagtagagtttcattgaagtcaaataacaggtataaattgggctattgagcacaaaagatataagcataggtgttcttatctgagaatgggagatcatagtcattccagagaggacaggcctgccagatgtgactgtagaagtaggtgactcaagtgaggtggagaagaaaagatgctagaagatgaaacagtgagacctgaattttggatgagctgtccaagcagacagtatgtaatatctagagttgaggtatagagtaaattaggcaccaaagttctttagtgaatgtagggtagggttcaataaattatagcaaagggtagagttgggataactgggcttcagggggctcaaaaaatggaagttgttacacaaatgagaactaatgctctgaaacctgcatttgtggaccagcactcaaatgcaacagtcaaatccttcactcaaaagggctgctgagagacc

SEQ ID NO: 41022 - DNA, 1060 bp, Homo sapiens
aaattacacaggtgctattttctgccaacaattaggcacagattttttaaatgattacacaccccagtggtgaaaaaggacagggaatggatacattttatgcattaccaatggaaatataaatttatataagcttttcttaaaagcactttaacaatatctgtcaacaattttatgtaggttgaacatctcaaatccaaaactggaaatgctccagtgagcatttcctgtgagcattgcatcagcactcaaaaagtttatgattttagagcgttttagattacagatttttggatttggaatgctcaacctgtatgtgaaagaaaggaaaaggaaaactggacaacataagatgaactggaatctatacagtaggattaaatgaacattatagaactgcagaaatacagtatctgaaatcaaaaactcattggagaccagacacagaaaaagatgggattcatgaactcaagtacagtacaaatgaaaatacccaatttgaagtggcatagatagaaaaagaacaaaatagggcaaaagagatttgagacacagttgtttgatctagcatacttgtaatttcatagatctagcatacttgtaattgaagttcaagaagaaaagagaataggacagaagcttgaagagataatagctgagaattttctaaaactcataaaattatgacaaatatcttaaagattcaagaagttcagaaacactaagcagaataagtaaagaaaaaaacaaaatactgcctagatacatcatagtcaaactgctggaaaccaaaaataatgaaaaatagaaataaaaaaagttgagagataaaacatttaatacttacaaaggaacactaataaaactggtggctacatagagatgtttttcttttcacctttaaagatgtttcggtattttccatagtttctctatgtaaccagttgacattggaacatcttcaaaatgctaaaagaaaaaaacagccaacctagagttctatacttaaagaaaatttcctttttttaaaaaaagtgaaataaggatattttcagacaaa

SEQ ID NO: 41023 - DNA, 1057 bp, Homo sapiens
agaatagtggttgccccatggttgggtactgaaggaggaatatgtgaggaaagagtgatacagttgagaaagaacacacagagcctttccaaggaattcatattattctttcttcaattaaatgatgagtacttgattgtatattttagtattcttgttgccatttatacatagttgaatatgtgaaatatgttataataaaactatttttaaaaaataaaacaagagattctgtcagcctaaaactggactttataaagatttttggtcttagcaagaaatctttatattctgttactgagaatctaaagaggcagtgtcctatagagatttttttcattcacatttcatcctaaaaatgaccccaggaactacttgtacgttagacacatagcgaaaaagtgtaagatctcattgaagacttttgcttaaggcacatcttggtggttttaaccagttttaattacatgctttaccactgtgtttgtcttttctattccttcagttgcttcatgaatattggatggctctgaggaatcgtgtgtctgctgttgatgaacttgcaatggctacagaacgactaagagtgcgtgatcctagggagccaaagcctaatccgcctgttcttcatatcattgaaccacatgaggtaattggcaagtaaatcacagaaaagggaacagcaagcagatgtcacagatatctaagacccatagaaaaggcagaatcagggcactgagctctactgtaagtgtgtatttaatctccatttttaatttgacccatagaaaattgtctttatagaccaaaaatggtcaaagatgagcaatttcatatctattacatgcttagtgttcactattttggggcatcttgtttctctccaggttgcgcattcatctgtttttgagtttaaaaccttgtatgtgcttaagaccaatagatattctcagtcactttttagacatttttgtcacctcagttttatcagaactagaaaaatcttccttaaaaacaactgaaaccttttcttttgcagtgtttcttttgctaatga

SEQ ID NO: 41024 - DNA, 1038 bp, Homo sapiens
cttttacggtagacagcccaatattatactttgaatacattctgaaggaaaactcactcaaatgttgctgttaaaaaaaaaaaaaacagcaaacagtttctttaacactttgtttggcaaccattctctgaatttgaggaaattgacctattattcttttctttgtattgtgtgtggtgctggtgtgggaatcaggttccgtgattgcagaggtcttcagttcttacttacaacacaaatggaagagctaaataaatgccagaagctagtaagagaggctgtaaaaaacctggagggacctccatctcgtaatgttattgagtctgcaacagtctgtcacctccgaccagccagacttcctctcaactggtaggtaatagaagaaatcatacaatgaaatggtaccatttctttaagctagatttcttagagaagaaacaattgactcatatagtaaaggttttttcattttaattgagacagaagtagaaagagatgtattaatctaatttaaagaaaaataaagtctcaaggacaaggtatgaaaaaccatgtgatttgttttttctaaaatggcatatctagtggaaagaaaaatgaagtcaaaatattaagcttctccttaaaattaccagattgctggttatgtttgtgaatatttctgttaatctcttttttttcagctgtgtcttttgtaaagctgatgaattgttcacagagtatgaatcaaagctattttccaacacgtaagttctctatttgattattacccatcaagaaaatgaaacattttgcaagactcagttatgtgatataagactatgttttcccccacagtaacctttattatattgtttctttaattaaattgattagtacacctttggtatttgattgtttaatatgcccagttttacctatccagaagttatcccctaaatgttcatagtgtagtaatatataattaattgagatgcagttttgtggagtggtaaaatcccagactctagaatccagtggatttgaattatacagatt

SEQ ID NO: 41025 - DNA, 1059 bp, Homo sapiens
ccttaaattcttacagagggtgacaagtacacacacaccctcccacacacacacacagaacgtatatgtgtaaagttatagtgttatatattatgcacaaaattaaagcaggttagaaagagcatcttatatttacatggaagagtattagtggcttctccatctctcacggatcactttttttgcattaggtctaatatcttacaaactgtcattttgtatattttgcctgttattgtagtttttgcagggaagagtaaatccattgtctgttactctatcttggctggaagcaaagttatataactggcacttttaataagcaccatatagacacacctttccatataaatatgagaaacattaaaactgtattccatagattcaagagtgaagatgaaacatgttaagtagaaaccttgaaaacatgcaatcaaacttctggaaatcaaaatttcaatgtctaatatagaaaattcacttaataaatagaagattagacaccgcctaagaaaaaaatcaataaagtcaaagtatagaatagcaatagaaactctccaacatgaaaaacgaagaagactgaaaattttgaaaagagcctcagtgaggttgtggacaacttcacatggcctaatataaatgtattggagtccccaaaggaaaaaaaaaaaaaagaaatatattgtgggttttatatcatgtaaatgtacaatgtgtaaaagcaatgatacaaagtctgtgtggggagacgtggatgtataatattgtaagattattatcctatatatgaagaggtataatattatatgaaggtagactgtgtgtgacaaggcaaagaatgtgcaccctacagccaccacttcaacatacaacaaggagttagaggtaataatccaaaagaatagataaaaagaaaaaataaaaaatcaggccaggcacggtggcttgtgcctgtaatcccagtactttgggaagccgaggcaggcagatcacaaggttaggagatggagaccatcctggccaacatggtgaaaccccgtctctactagctgggtgtgg

SEQ ID NO: 41026 - DNA, 2394 bp, Homo sapiens
gactgaaataatgtcatctacttgggatgtcaaatatggaagaatgcttcctaactccttccacccgccacaccctatgtctacataatgtattcatttgtataatatagaaagcattggctttggggaatataaaaactggggtttacatccggacttattagttgtatgtccataaacaaattccttaaacatttaagtccttatttttcttatctataaaataaggtgttttaaagatgaattatgatgaagtatacaaaggatttagcacagtacctaacaaatattaaatattcaatgaatgatagctgcctctacttctccttttgttgtttttattttccatttatgtagtcatttatttattttaatgtcttcgaaagtattgactttaacaagtactttgtgatgcatttattatttcatttgttattatttatgtatttgatttatttctttgtgaggtaggatagaatctcagtcagatttttgctgttaggataccacagactggataactacaaagaagggaagtctgtttaactcgcaattctagaggctggcgcatctaagagcatgacactggcaactggcgaggatcatctcatggtggaaggtggaagggagtacatgagatagagagaagcaccaggggctggactcgctttgtaacaaccaacccttgagataactaacccgctcctgcaataatgacaattaatccactcatgagggttccaccctcatgactgagtcacatataattaggccccacctcctaatattattcactggagtttaagcttctaacacgtgaacttttgggggatacattcaaaccatagcagatgatgagcaaaagtacatacgatcccttatctattgagcttacagcttagaggagaacatacatttcttaaaatgtttcttaaatacttagataaatattaaattgcaattgagataactttcacaaatgaaaaaaaggaaaattctaactataacaggtttcattaaaaaaatagtttgttctataacatcatacaattgggatgctgacaactgagctgtgatctgaaacattaacatgagctaggtaaagaggaaaaggaaaaatcctctattgtagaggaaacagaaaatattaatgtaaatagatcatgtggcagaaatagcgtggctagaatgtaaagagctagggagatgatggtggatagagagactaggtaggtagagatgggaccatggaggatgttatttgccttgttaaagaattttattttttttcttaagagtagtaggagctattgaaacgatttaaacacagtggttgggggtcattttgtggttagatttgtatttcaaaagatcactctagttgcagtgtggagagtggcttagaagagggtaagagtggatgttaggatattaattgattgtctataagaagtaatctaggcaagtggtgctggcacttttgatttggactaggtttgtcctaaagataacagaaaaaagtggataaggcaaaattaacaagcctcagtgacagatcaggagataccaagatttctgacttgcataaatccatgaatggtgactggtttccccagtgaatactaccagaaaagaagcatgggccagtggctcacacttctaatcccagcactttgggaggctgaggcgggtggatcatctgaggtcaggagtttgagaccagcctggccaacatgatgaagcctcgtctctactaaaaatacaaaaattagctggacatggtggcagacgcctgtaatcccagctagtcgggaggctgaggcaggagaatcgcttgaacctgggaggcagaagttgcagtgagctgagattgcaccgttgccctccagcctgggcgacagagcaagactctgtctcaaaaaaaaaaaaaaaaaaaaaaagatgaagcatgtgtgcaaaaagattatgaatttgagatttcggcaagttgagtttgagacggctttgggacctcaaaaaagaggtaacatatagcaattgaattgatttgagctaaaaatataaatctgtggacctttgcatagcagtgatgcattggttctttcagatgttgctaactcccagcaaccatcaaggtaacttaattcaatctaaatatttgttgatcatcttcagaataagtgttgtaggtgtgggaaggatatttttattattattttatggcttctgaagagaatatatgcccattgtgaaaaaatttgaactgtacataaaagtataaagaaaattacaacccggacatggtggctcacacctgtaatcccagcactttgggaggctgaggtgggaggatcacttgagcccaggagttcaagatcagcctgggcaacatag

SEQ ID NO: 41027 - DNA, 1045 bp, Homo sapiens
ttgtacctgcctaaacagcatagatataggtctgaattaaaattagagttccaaagtcataggtagaaaacaaagaatctaacccaaaaagaaacaaagggtggggggggtggggagaggcagaaaaagagagaaagggaattaatttcaattaactgtgtctatgaaaatggagactataatttttattgtgtgaacccaggaatactagggccataattttagtaattatataagttattagtagtcttataatgtcacactatatgtatataccgttattgtttctaccattcctttacttgagcatttagattgtgtctagttttttcctcctctccacacgtgcattgaaatgatccttctaccttaatcttattcaatatcacagtagaacggacactgcatttctaaaacctttattcaagttgtgaatatctaaaatgaaaagtttaaatcttgttttatgtatttccctaaaagttgttattaaagtgtagttaaattacaaaatttaaacatacttggagttctgtagtaaatactcatcttcaaaacttatctttctgaaaatccaagttttcgtatgttttcagcagcataactcactctgctaaaacaaaaatctcagtatccattactttgacctttaaaagcagtgttttccaatgattatttttaggaggaaaaggttttctagtaatattttctagtatatatttaaatatttgcatcacttaaatgttacatttagatacatatttatagaataatattacgttcagtaaaggaccacatttagtggtctcctttcatgtttggaaactgtcgaaattgtaaatgtttaggcgttaataaggtctgagatcttacccagctcaaaagttagctgagagggtacagaaaagagtacatgactatcagagttactttttctcattttaatgttgagagagtatgagcaataatttcttagttcctgggtcggtttttttggagatacaagatgttggcaagtgttttgagcacctgtcaccattcaaca

SEQ ID NO: 41028 - DNA, 1090 bp, Homo sapiens
ggcagaacaggatatagttatcattacctatgatgtactgcgttcagaattaaattatgtcgatatcccacatagcaatagtgaggatgggcgtcgcctacggaaccagaagcgctatatggctatcccgagccccctggtagctgtggagtggtggaggatctgccttgatgaagctcagatggttgagtgtcccacagtaaaagtgagagtttctgcaaaatcttttgagggctggggaagaagggtgaaaaggaattaggggaccttgagtagtttaatagtttaagcatagttaacctgtagtactgatattggtcaaaagtttgttattaaacactacttgtgcttttctcttgtgctttgaactacataaccctttgaaattagttctgtactctgtgactcattgctctatatgaaatatatatttttcagtaagatgtctgtttatatatgatgcagatcaaagtaaactgtgtttaggaacttctgtaagcatttctgctaactgggagctcatcgtgtagcctctgatagctttgaaccaaagttgactttgacagtcttttaaatcagaggccaaatggtaacagaaaatactactttagaggacagaattttgattcagcctttgaatgtcatatgtctttattctgttgtctttggccagtctgtaacctgaactgaatgtatgaatcatgtctgttagtatatctggaggatagagtgatgcagggcatggatcagttattcagggggctttttcattttgtacgtatttgaactacccctctgttttaggggactgcgtggcagcctcccactaatgagaaccactgtactggaagatggtccattgaatatgacattcaacattgagtgtgataactgttaaataaaagtaggtacatctcaccagaagtgtagcttttaatgggctgtttttcatgagtatgcctgacttctgtgttctttctgtggttttctggatttcatttttatttcatttttccctctcatcaggctgcagaaatggcccagcgtttgagtgggattaatcgatggtgtatcagtggcactccagtac

SEQ ID NO: 41029 - DNA, 1032 bp, Homo sapiens
aaacttatggccttttaaaaatattacaatttgttcattttaaagcctggtatctaaggaaaacttcaaatttagctattaatcttagattatataattatagtaaaagtctaaaacaactgagcataaagctgtacattaattgtgaagttttggaaattttacatggcatatttattggaaaaaaataagttgtgaattttttggtgtcatcttttagttttagaagttatgaggtatgtcctataaaagtatataggcctctttcaaagcaattcagaaataaatgatatactttttcaccttgaaagaattatgtttttaataaagaaccattagctgaaaggagtttgtaaatatgttcaaggtttttattacttttttcatgttatagtaagtataaatcttcttccacagaacaattgtgcccaccaagtgaacttagtgtttttacaaatttgcattaataacataatcacttgtcttccagttggctgctactgctaccaaatgcctatccttttctagcataagaaataaaatgagaacccatttcttattgggcatagaacagttatgtctccatatggattttgtatgttaaaattacaaaagtaaagtaagttgttcctatataaacttcaaacagtattcacattgagttcctcaaatgtttataaaacatccacaatagacaatacacgtgtcagctacgtgtcagcttctctgaggggctacaaaaatgaaaaactttgcctttgttaccctggggaaaggaccagtggacataaatgtttgcagtaccagatagattacaatgtaataatactgtatccacagaggagaacataattccagccagggaaaacaaaagaaaatgccatggaaaaagtatcagttaaactttcttgaagaatggatgagtagatttttgattaatgaagaattaaagatagggcctttcagtgacaaaacacactgagcaaggccccagagttgggcaagttcattgtatgctcttagaataagaat

SEQ ID NO: 41030 - DNA, 1046 bp, Homo sapiens
atcaaacattccctctctttactgattttgccaaaattgtggctcagtgataacaagtatgtaacaatttatgactcacatatctgtgttctatctacgttccctacagaccaagtgttaatctattctgtttttcctgatcctgaattttacaaatatttaaacatttattgctgctgtagtaagacatcaccaagcgagccaagacagaatactagcagtaatgaaatacactctttgtcattcatttctgtgtaaggctggtggattcctgttctgtagtgaaagaatatgagattctcagtgattagggagtcaggtacaacatagtcaacatgaagtaaagggaattaacatttattgagtgtctaccattagaaacttttatagttatattatttaagatggacttctctccattttgtaaatgagaacacttaggtcaaaatcaataggttatttttctcaaattcatttagcttccaaatatcaatgccagtattcaaaatcaagtctttcaactgtaaaacttcataccacattgcttcactagggtcaaaatattaacattaatcaaggtctgtttttttacacgttttagtgtttgattcagtaatgaggatgcccaaacctaactgtgcagaagattcctagcatgtatgtcataatcttctggggaaatcggcatttttaacaaacttgactgattaattcatcagttttgggaatcattgcattggtagatagaactaggtgttcttatcacattctcccaggttcgatttcagttaggggaatatttttttccagcaactcgaattgtacattgtaggcacttacatttataatttgttagtgaaaatgaaacacgtgggggaaatttggtaggcatgtatttattgtttgtgtcacacatgctatgaatacctttaaaagtagtgatgctaattttttcttgcttatgtcctcataaagaatggtatatttcaaatgaaactacttttattttgattaattgtttttaggttggaatttatcttttggaa

SEQ ID NO: 41031 - DNA, 1028 bp, Homo sapiens
taagtattgtccaagctgttctgatctgtatgggacccttgaaaggggtcatagggcccatggtgaatgaagatcaagctatagggaattggaaggaaaggaaattgaaaattttcctcaaggactcatgtcagtcaaagtagttcttacttaatcaacaaggaaatgcaaactcagaaaagccacatagcaaggacctgagctccatctgggtctgcagtcccccacactcagtgcgccatctgctagcactcatgactcctcagaagcggtagcatctcatgtggaactaaataacacagactgtgaaaatattaggttcacgcccagggcaacaacccccaaaaatcccaatttattttgaatgagttgtaatgagtaggtggcaaatttatgacaccaagcatgtgctgttctatcacttggtattccctaggcagcattcatttcatgcctcctaagccatgacatggaagcctggccttctgtttttgtctggtcaagacctagagctctgtgggaacagtttttgtttttgttttttttaaacatttacatggcccttttctgctctttggggaaatgggagagattagagctgctgccacccagagggtggaataagtcaatggaatggatgagttagcagggaatgagcctatacctacaggtaggaagcgaggttttcatgaatctctaaatgccatttatctactttcagagataaacaaacaaatagatctaagccttttctgtgagagtcaagtaggttattcccgagcccagacgaccttctagtgtagactcagtgcagtgtacagtgtgacctaggaacatcagcatcgctggggaacttggtagagttgcaagttaggctctacaccagcccaccgagccagaaattctggcgggtggggcccaataacctgtattttaacaagccctcctggcgactctggtgcagactaaagtttaagaattactgctagtatttagttatcaagaaataggcaattctaaaaacttca

SEQ ID NO: 41032 - DNA, 1059 bp, Homo sapiens
acttcaactgctttctcccactaactccacatttttagttgtttgtattgctattgttgaataagttaaatattgctaaattatttaaatttggcatttcctttataatcctattttgcacacatctatttactgctcatcgctaatcccttggcatggactctccagtcatctcttacctggttatcaagcagcatccttttttgcaagaagcacttgtaggtcctctctcctctaagttctcaacagtttgacagtctccatctaaggatactgtagttgttgagagtgtagtgttggtagagagctgcttaggtttgaatctagctttgccactcactatgtgaccttgagcaagtaactttgcttgaatttctttattcttaaaacagggaagtctatatgtgctcttgtttgttggcccagtctatttcagccccagattcactctcagccctgccctaccccattctataccccagagggaaggctgacctctgctcttggcatcatctggactggttgacccactggcttccaactgggtttgcccaatgggaagcacctgcagcgaatcagagggtgggaggagagaagtgggcattatttccctgatttctccccacttcaggtgcctgtcttggggagtaactgtaccccttgtgaggatggttcttggaggtgaccactccttcaaggatccagtgctccttgaatgctgataacacgttaatggtattccactgctcctcttccctggataccccaccaggccttcttccttgaaccctgactaactttctaagcattgcctttattaaagtttcttcatttgaagtatttgggtcgaactgtgttacctgtcagaatccttattgacacagtactcagggtcaggaatgaccttaaaaatagaattctgataaaccctgatttctcaaggttgcttaataccctaggcaaattcatggatgacctctattcttgagaacacacaacacttagcagtaggtatgtgatgtggcatcattgtctcttgaatggtcatcctagtggtgt

SEQ ID NO: 41033 - DNA, 1076 bp, Homo sapiens
tttttgtgtatggtgtaagaataatgggtctaatttcgttattttgtttgtggatatccagtgaggtaaacatcatttattgaagagtctatcatcttcctattgtacattgtcatttgtaaccaataaagaaggaaatgttttcaggtaaatattttctgaattgctaaatgttacactaacagcaaagtcagtcatcaaaagtgttcatggagtcagccacaggattatctgctttctgcttcaatgaattctacataaaggaattcttgctcagtagaatgatgatgcaattttcaattttggtcacaatgagcaacagggaattatctttaatttctgtttaaacatcataaacatttggagttagccctgacttaaaatgccagctgtgttctgaactagccgtgtgacttcaggcaagtcactttatccctctgagcttcagttttcttacctgcaaaatgggaataatagtacccactttcctgcttgtattgttgtgaggattacatcatctagataatttacgtgaagtctttagcatggtgtctggctcatggcggatactcagtaaatatttttaaattgttgtttgcacttttattgctgtaattattaactcgacctgtgagtttttcatagaagggattatgtcttaggcatcttgtacctaatgtccaacatgttgttgtaaccccaacacctagctcaagcatgtttacagaattgagctaagatcctcttgagaatgctaaatgagaagaacaaaggggctgtgtaataaagaagttcagcctttgtaattattcagccatgtgcttctaattcaggttaaaaaaatttgaaggccaaagaatctttttaaacatatcttacaaaggaaggtagatttaactatttaaatggagtcactggcaaacatgttctaggaaaataataatgaactagtgcgatcaaaaggtgatctttactattgctttgttaaaaatagtcttctcatctaaaactgtttttatatatgcaactttgtgagatctttttataattcttgtaatggaaaagctagaatgata

SEQ ID NO: 41034 - DNA, 1064 bp, Homo sapiens
ttgtggttcattcatacaatgaaatattactcagcaataaagagaaacaaactgccaataccacagcatggatgaatctcagatgcatattgctaaatgagagaaaccaatctggaaaagctataatatggtgtggttccaatgatgtgaaacttctggaaagggcaaatcagatctatagctgccaggagctggaggtggagggaggggattgactacaaagggccacaaggggaactttcggggtgataaaaatagtttatatttttattgtggtagtgattataggactatatacatttgtcaaactttattgaatgtacacctaagaagagtgaattacactattggaaattatatctcaataagccttacttgaaataaagaatataatgggaggaaaatggttactgcatagagtgataggtgcagtctagggagcagtacaggctcataaagattcacaggatctttaccatgagaaccatgctttgatcatctttaatcttatatttgaacaagctcagaagctcctgtgaaatctgattttcatttaaacctaaccatagtaacttaatgtacacagcaacttccatacctgaaaataccctgaaatgtatagtcggctgacacctgtctcctcgtccattccaggaagggaaatagttgaaagtctgtgtgacaggaaacatcttgaaaacaaaagcacattctatgtccctaaaacaaaacaaaactgcaaatagttacctctatgcactcacttagattagttaaaatttagaagactggcaggactaactggggctaatgtgaagcaactgacgcttgcagacattgctggtgaggatgcaaatggaaacaacaatggttctgcatgcttccatctacatgaaattcctttatagggaaatctaatcaatgacagagagcaggtcagtgattgcctggggctgagtgtagagagggcgtctaactgcaagggggcacaaggaaacttttggggtgctgaaatgttcttcattgtagtggtggttacaggggtgactatatttgtcaaaatt

SEQ ID NO: 41035 - DNA, 1023 bp, Homo sapiens
aggagaatcgcttgatcccagagttcaagaccagcctgggcaacataggaggccctgtctctataaaaattttaaataaaagaaaaaagtagtagtagttaatattttttggtccttacaatgtaaggtgggttcttttatccccctttcacacaacaaagtgagaacaaaaattgttacttgcccatagttttacacagctagtaagtagtggaaccacagtttagtttcatagttgaaactaactactcttaacttgaaacatactcctaactacttttgctcgtcttcttacctggggtatattctcatcagttttctttcctaaactctaatgttattttaataaaatttgtcccatagtataatattccaatgtgatctaataggaacacatctcctccttcttaaatgtctgtactctattactttagtctgaggtcgcatcagtcttctttactggtggctgtatcacattcctgtgaatgtttagcatgttttccactaaaaactctgaattctttccccctccatgtgctgcttttagctccagcttttcatcctgcacttgtacatggaaccgtccatgaatttaagcctgagataaataaacattggtgtgtttgagataatcagaggtctaaaaaatttcagactggttgtgttttttttgtgtgagtctttctgattctgctgtttgattacttgaaaccttacagtagcaaatatccttctcattttgcatggagtaaaagcatcaagattttgggggaatgctattagtatttttaaaaagattttaaggcaattttaagttgaaattttaaggcaatattaactataaaattattaaattctgaataatgatctcctaacttctccccttaaagtatattaaattttaaaaagttttgtactttgatttaatgatatagctacattaattttctcttcttcctaataaaactcagcatcagtatttaagattttaatggccccccgattttttattattttgttttt

SEQ ID NO: 41036 - DNA, 1051 bp, Homo sapiens
gaagataatgtaaataaagataatgaattgcagagaagtggtgtcttacctaggacctcccactacagtcaagaacctcttacattaatctggtgccctttctgttatacggtaactgcttcatccatagtgagacttttaatggcaggcagatggcaaataatttttcaatgataaatgatggctgtttgttaccattaccagttattttaactcttgcagtagactgtttcacatttatgggaaacattgctggccacttttgtttctggagtctctggaattgccaaatagattgatcttgtcttttttgcttaccctatgggtccccctttaaaaccctgacaatcaaggtacacataggattctcagtcaaaacctctgtctgtacctccagtttgttttacttctacatttaatctaggacccttctgtaggaagcctttctacaaacagcatttcctagtggtgtggttgagggataggaaaggcagggcagtcaacaggtctgggacatggatgcgaattgaattctcatctggtaggagacttgaaaattgaattctcatctgataggagactagagttgagagtagagaggctgcattgaatgctcttcctttctagccctaccaagctagttaggatgtagcagtaggtcctattttcctgaggggatttttggcacttgggaggaatgaagttgcccctaagttagaatttcaaagtagagacagtttgtctttggtgctattacccaccctctcctctcacagctgtttggtgatcttctgcacatcctgccctcttctatttgcctgatgctctgttgccatttagcagagtatctcttgttaaatcttttttttttgaaacggagtttcgcactgtcgctcaggctggagtgcagtggcacgatctcggctcactgcaacctctgcctcccaggttcacgcgatcctcctgcctcagcctcccgagtagatgggattacaggcacacactatctcgttagatctttaaaaggtctcttaaagtctcacttctctca

SEQ ID NO: 41037 - DNA, 1143 bp, Homo sapiens
aattggtcagtactgagttgaaatatgtaactgtcagtgtcagaaacagggatttagaattgtgaagttactgacaggaaggattcttgtgtagcacagagcttggtattacagtctcacagttcattatctaaaacccttgagaataactaggcttcctaattcagaatttttcagaattcagaaaggtaatactgtatatatgcatacacacatacacattacatctgtgattatgtaatacctttctgggtcagcattccataatctgtcacaaaagtatttctgcagtgaaacaaatgaatattcatactaagtggataaaaaaaggtcataacctaccattaggtttggtgttactgccaaattaattttaacaacaaacttaggaacacaactttcactttccaggatgtttttgaattttgagtaaaaaggattgtgaacctgtataatacagtcagtaagtgtatatttatctgttcactgcagttggactgtctctctaaaatcctggctctgacccttgccaacaacttctatacttctctaaacttctgttttctcattaagaaaatggatagtacctcatggggttgttaccagaggtatttgaggtaatagatacaaagcatttaacagcatcgggtgtgtaataagtattcaaacattaatttttgtaacaacaaactttttgtattttcagtattctagctacagaaatcttttccataaagatttatgcttgagtttttataattattatcaggaagaagattgtgagaaagcattcttcaaaatggacaatgtgcttatagatgacagaagaatacatgtggattttagccagtcggttgcaaaggttaaatggaaaggaaaaggtatgatggtttatcttttgtttttgttctgctttttttttttttttgagatggagtctcgctctgttgcccaggctggagtgcagtggcacgatcttggttcactgcaacctgtgtctcccaggttcaagccattctcatgcctcagcctcccaagcagctgggattacaagcatgtgccaccatgcccagctaatttttgtatttttagtagagatggggtttcaccacgttggccaggctggtctcgaactcctgacct

SEQ ID NO: 41038 - DNA, 1032 bp, Homo sapiens
gatttgtatggatttatctttttcatctgttaaagttaattttttccgaattattatcttgcttaattatattcaacaagtttggagttctttttcttttccacagaggtactcatttttctagctgtcttctcatttctctaatttcctttcttcagtttcttttctactgagacaacctcagctctagaagcttacatgaacaccttgggaaagtgtttttcttgtcatcaaattaaactgttatcttgtgaggtaacttttcaactggggacactctggagccaggctagaacccagaaatttctgtgaaacagcgcagactgttcccccacatattttaaggtttatgtggcttcctgaaagctgaatttgtctttatggttgggattggtgcttaattgtcagatcatttctcttcattcagcagttagaattggataataaatagtgtccatataaatatttatttatttttttgagatggagtctcactttgttgcctaggctggagtgcgtggtgggatctcggctcattgtggcctctgccttcctcattcaagcaattctcgtgcctcagcctcttgagttgctgggattgtaggtgcatgccaccacgcccagctaatttttgtatttttagtagagacagggtttcactgtgttggccaggctggtctcgaactcctgacctcaagtgatccacctgcgtgttctcccaaagtgctgggattacaggcacgagccaccatgcctggcctattttgattttaacagaagcccactttggctaatattttagaattaatataaatcaattcttggaggtttataagtttgtctcagttgctgtccaattaattattaaaaatttttttttagagacaagatctcactgtgtcacccagctggagtgcagtggtgtgattgtagctcactgcaaccttgatcagttactgttttagcatgtttgatataactaagaataaagtatgtcttctatgtttctcagatttttttattctttaaata

SEQ ID NO: 41039 - DNA, 1029 bp, Homo sapiens
atgacgcaaaaggggtcgcgccgagggtgacgcgtggcgtagacgacgccgtcggcctgcgcctgtcacccccctcctcccggggtttgtagcggaggaggagcgggcgccatggcggttctactggagaccactttaggcgacgtcgtcatcgacttgtacaccgaagaacggccgcgtggtgaggcttgagccccactcacctgtcgccggggcccccgagcttgtctccctactttcccttctctgcgcagtccagggcagagattggctagagctcgagcttctgggctgctggtgcccgcgactgggctattttattaaccggccttggctagaaaagtttttgtgacgggaattcgtttgagccttggcagcccttctcccgtattttgtgttggccagtccggtggacggtgcttgcggtcattaattgcctttgggagtgtgtgtgtggggcgtgtgtgtgtgtgattcgagctgcacatacaatacccatagcttttgtgcctttattgtgtttactcgtgagaggaacataggaactattgcttggtgtgtaatcggttaaatcttgatgaaggcagttagggtgtgcttggcgcagcgagtgtgggcataccgcttaggtggaggaggaagaggttgtctggagtgtggactgagccttcgaggcactgggctaagtcctgggcttggcttcttgcccccgagggtctgatttttccactgggggaagtagacacaggaacccattttagttttctatgtgttatggtagaagaatgtgtaagttgccacggaaaccagaagagggcggcttctttggtggggggtgggaagaagcaaagctagcgaatactatatagaacacttgaactagttctttcaaagatgaatgggaatgagggttttcttagcttggactttctttgtttggaattttctggaaacggcaagtagtttggtgtggctggaaggactggtgtgagtcgtggaatggtagactcgagtgtggtcagatacgcc

SEQ ID NO: 41040 - DNA, 1033 bp, Homo sapiens
tggtgttagcaggtgctggtaagatatctggtatctttcatgtcagtgaagagtctacagttcatttgaaagctacaagttcaagaagctaatgttaggataaattgtgtaaaatagaaaatcagtaattgtcttggattaaataaattgttggtgcctttgttcactatattataaaatacgaaatgactgtgaaatatattgacttggcatatgcacagaatacagtctcattctcagtgaacttatcctaaatgtgacagaatagcagtaaaaagaaaaaaagaatgtctttaatccagctggttcaagtaggttttgtcctaatctaagtattagtagagacacttaattaaccaggggcttgactgcgctcgtttcctcctttctaaagtgagcataccacacagggttctgaggattaaagctaaagtgtatacatcaaacagctctattgctatccctttgcataaatggtggctgctattaaggataaaacttggtaaaaggcaagagctgtttgaatctgaagttttgttttttttttttaacacaaatgagaaaaggagaaaccctgaacttacctagcttttcctctacatggagaaaatatttaattttcttgttaacagtttctcttctcttctgactctgtgatgcttattcttcattttattgaatagttataatgaaattcaaattgctagctttaaccccacttttactttttctgggattttatattcagtattaattatttaaattagcatcctttttcattacagaagatttaactgcttaaaaatcaatcacaacaggctttgtattccaataagtttctatacaatactacatatatatgtaatataattagagaatgctacaacagatcaattgaaaatttttctattaacaggttttcatttaaccaaagtaacattgtgtgtgttgttgttgtttttaacttaaaacctagggatgcgtccttgatggcaatgagaaggcgcattgaaggtttgactccagaggaaat

SEQ ID NO: 41041 - DNA, 1087 bp, Homo sapiens
ggtttcttcctttaggctcgattttattctccagccaccatatttattgatgagatagactccatctgtagtcgccgagggacttctgaagaacatgaagcaagcagaagggtgaaagcggagctgctggttcagatggatggtatctgtgtttagcttgagttgaacagggacgggaggttgttaggtgtggtgtctccagttccagtgggtcaaactttactcatagtgctaacccaagcttttaataggtattcttaacttcagatggactagagggggtggcaagaagttcctgatagtgatagtaatagatttggtacactgacagtggtgacaagtcagaattaatggccacacacagggcacccttttggtatatacaactatcttactttagctatgaaattgaaataaaaataaatgcagataaattggccttagagtttatgtacgctttgaaaaagatttaaaattgttatgtatttgagatctggcttttcgattaaatctattttgagtcatatatttgcatactacagaactcattttctttggattacaaattcacataggtaccagttaacctaagtcttaaggaggcattaagactgtgcttccttgtattgttgtactaaatagttgttgatctttaaatagctgagcttcatttggtataatccaacttaatatctttttcactctccccttacccttattttaggtgttggaggtacttctgaaaatgatgacccttccaaaatggttatggttctggcagctactaattttccctgggatatagatgaggctttaagacgacgccttgagaaacgaatctatattcctttgccgtcaggtatcttcctttcaatcttgtcagaaagcctgttaactttcatgtagttttgtttagagaatttaaaatttgttattaactaactttctggaagagatacatgaggagtatcttcctttacagtactagtttggctatatgccttaatactaaatagtaaggaattaaaaagtaaagaatggctctttacttaattatctcttcttagagatccaattcttactggaa

SEQ ID NO: 41042 - DNA, 1035 bp, Homo sapiens
cacccacctcggcctcccaaaatgctgggattacaggcctgagccaccatgcctggccgagacaggatcttattttattgcccaagctggttcttgaagtcttgagctcaagcagtcttgccaccttggcctcccaaagtgctaagattataggcgtgggccaccacacctggcctgagtttttttcttgaaaaaatactttttttttttccttaaaaaatactatgctacttcctctggcttgcttttctgagaagaaatctgctttcatctgaattgtttttccctataagcaaggtgttgatattctttcattgctttcaattttttctgtgtctttggttttcagaaattaaagtataatgtgtgttggcatggagtctttggggtgttctatttgtttctgaggctatttttcttcataatctttcaagtacattcataattattgaagcatgtaaaaggctttaaaatctgtcaggaaactaacatcactgtcattttggtcttggcatctgttcattgtctctttacatttaatttgagattttcatggttcttggtatgaggaattttctgttgaaacctggacattttcatattatatcatgagactctagatcttatttaaaccttctgtttagctgatttttcctaacattgctctggcagagagattggggtgccaccgctgccaggtggggatggaagttcaggttccccagccagcctctgtcggcacctgcctaggggcagaggccttctcattactgctgagctgcggtggaagttctccacacgctctccagggacactgtggttggggagtggaagtctaggttccctctatgatgtccagtgactgtggcggggaggggtgggggagagaacatgcaggggctcttgttcatttcatttttgggaatgaaagtttcagcttcttatttagcctctgattctaccctggtgggggtttgaggtaactcactgtaggcttccagaagtagaaagtcctaggccttccaccctgccttt

SEQ ID NO: 41043 - DNA, 1044 bp, Homo sapiens
ggaaggaacccttgtggcataatcccctctcaaaggcccaacttttaatactagcacattagctactgagtttcaacaccttgcttttggagggacacattaaaaccatagcagtagctgggctgaaattaaccagaattaaccataatttgtcatttactatccaggtttccccctggaagttgcagtcctcccaatagactccagagttcctaaatagttgcatcaaacagattctgcaggtgcagtttttgtttaggtggaaatacagattcttgatgcttcctactctgtcagtcttccacgatcctgtcccaataattgatttttatatgtttatcttctatcttgtcagcttaatactatgctagaattgttcattctaggagaatttttgtagattccttagtattttctgtgtggacaattatgttatctgcaaatatttctgtatttttggatttctatgccttttatttcctcttcttaccttattgcattggctagaacttccagtactatgtcaaatatttaagagtgacaaagtagatgtccttgctgtgttcctgttcctgattttaggaggaaagaattcaatgtttcatcacagagagtataatgttagctgtaggtgaggtgtttttgtagatgttcttttttttttttttttttttttttttttttttttttttgagacagagtctcgctctgttgcccaggctggagtgcagtggcgtgatccccactcactgcaagctccgcctcccgggttcacgccattctcctgcctcagcctcccgagtagctgggactacaggcgcccgccaccacacccagctaattttttgtatttttagtagagatgaggtttcaccgtgttagccaggatggttttgtggatactctttatcaggttgaggatattccctttaaattctatttttctgagagcttctgtcctggataggtattcagttttagcacatgcttttctgcgtttgttgcatgatcacatgggtctttttctttagtctcttaatatag

SEQ ID NO: 41044 - DNA, 1115 bp, Homo sapiens
attcatttacccattttttaattggattatttgtggggggttttttgctcttgtttgagttctttgtatattctggatattaatcccttgtcagatgaatagtttgcaaatattttctcccattctacaggttgcctctttattcttttaattgttgcctttactgtgcagaagcattttagttttatataatcacatttgtttagttttgcttttgttgcctgtgcttttgaggtcttcctaaaatcttggcccagaccaatgtcctgaagcatttctcctacatcatcttctaataatttcatagtttcaggtgtaaacgtttatatctttaatttattttgagttggttttatatatggtgagagttagggggtctagctccttatttctgcaaatggatatctagttttctcagcaccacttattaaaaacactgcacttgctccagtgtatgttcttggtgcttttgttgaaaatcagttgactgtaaatacatggatttccggattctctattctgttccattggtctgtatgtctgtttttatgccagtaccatgctgttttggttactagagcattgcagtttagggtcaagtagtgtgatgtctccaactttgttccttttgctcaggatctctttggagtcttttgtggttctccttttctatttcttttttttattttttttttgagacgaagtctcgctctatcacccagtctggagtgcagtggcaggatctcggctcactgcaacctccacctcccggattcaagcaattgtctctgctcagcctcctgagtagctggagttataggtgcccactaccatgcccggctaatttttctatttttagtagagacggggtttcaccatgttggccaggctggtcttgaactcctgacctcaggtgatccgcccgtctcaacctcccaaagtgctgggattacaggagtgagccactgtgcccaaccaattttttttctttctttctttttccttttttttttttttctgagatggagtcttgctctgtcaccaggctggagtgcagtggtgcgatctcagctcactgcaacctccgcctcccaggttcaagcgatcctcctgcc

SEQ ID NO: 41045 - DNA, 1453 bp, Homo sapiens
tcctgtatagtaactattttgattatatcatcaatgttacctgtttcctctttcagaacagtgctgcatatacagattgttattggcaaaggaaaatctggctatctggcaatattttacctaagcgcagattaattggtgaaaaaattaactcttaagatggccattaataattaggaaagtttacagagtggtcttagtagaaaattcaagtcctcctaatttatttaaggttcaataatgcgttcaacatgcctgttatgtataacgcttaggttctaaggaagattaaggtttcataccaaaatacatgtagcttatcttttaggaaggggaaaaaggctccattttgaccatagtaaaatttgtgttgtgttttatttccttttcttaagctccactgataagggattgtttttatcaaaagttactatttgtagattggaggcataattttagtgattttcatacttttagctttcttcgcataaaagctaattgaaaccgtatatgtagtaaaattaaaggcagagctgttgcagttgaattggagagttagggcaaagaacacttattagcccacacttcccacctttctacaggtggtcctttcagagctcagcctgaaaacccactactgtgttatcgtgcgtcttttggggttagtggttcttttgagaatctgaaggaagctgtggactcttcctagaaaaaaaaaccacacatacacatacaatgttgcatgcagtttcaagggattttggacatattgaaacctatcacaggctgtaggttatggacctctgtgccatgagaaaattgatacattaaactaagaactttgtttttaacttaccaatcactactcagcacatcttatataagctgataatttgtgatggaaaaggtctgtagcatgtgatataaggtgaccttatgaatgcctctcttgctggtacattaagttgttttaatatatcatttggaggggactgaaatgttaggctcattacaagcttgatacagaaatatttctgaaggatttctaatcagaattgtaaaacaatgtgctatcatgaaatcgcagtcttcacctcatggttcatggaacatttggttagtcccataaaatcctatgcaaaacaaagtagttcaagaatttttaggtgggtagtcacatttataaggtattcctcttactctttgggctttttcagtctgatttatttaaattttcatttagttgttttacttttggactaaggtgcaatacagtagaagataactttgttacatttatgttgtaggaaaactaaggtgctgtctcctcccccttcccttcccacaaaatctgtattccccctattgctgaaatgtaacagacactacaaattttgtattctttttttgttttttgttttgagacagggtctcactctgtcacccaggctgg

SEQ ID NO: 41046 - DNA, 1663 bp, Homo sapiens
tgtcacccaggctggagtgcagtggcacaatcttggctcactgcaacctctgccacctgggttcaagtgattctcctgcctcagcctcccggagtagctgggattacaggtatgcaccaccacaccccactaatttttgtattttaatagagacggggcttcaccattttggccaagctggtctcgaactcctgacctcaagtgatccacccgcctcggcctcccaaagtgctgggattacaggcgtgatgagccactgcacccagccccatgctttgttattttatttacaattggagaggaaggtttggctgtcagttttaggtgcatactggctcttattgccacctccgttgctaccaggaaactccttttctactccctgagcctgaactagagggaattctcctagagctctctgtgctcagcttcttccaagttttgggctaccttgagtccagcctgcagactactagagacaaaaaaatggagctgggtgtgctggcagaggcctgtagtcccagttactcgggaggctgaggtgggaggattgcttgaggctaggagttcaagaccagcgtggacaacatagtgagaattaattttttaaaaaaataattttttttaaatggtcaccaggtttaatggtacttcaaatttacatcttctcccctaatctacctgttattatttacttttcaggatcttgaagtagctgcttcctgcatcctgaccaggttttatagctgccttctgtgggagggagacaggagagtatatgtagtacatcttcctcaaaactgggacctctctggttgcttttagggttttcttctctttaactttggttttcttcagtttgaccatggtgtgcctatgtgtagttttctttgtatttttcttggttgagattcactcagtttcttgaaatgtacattaatgactttcatcgatttggggaaattctctgtcattatcccttcaaagatttattttgctttcttaccttttgagactctaatgattatacatgtgctattcctttgatactgtcctccatttctcttatgctttattctttcttttattctacatgttttctctctgtgcttcagtttatataattttattcatccatctttgaattatctgaatcttttgctgtgctcttttttttttttttgccttaaactgaaaaatcctaaatataccttaaaataaaaaatattaaacttggccaggcacagtgactcacgcctgtaattatagcactttaggaggccaaggtggacagatcacttgaggtcaggagtttgaaaccagccaggccaacatggtgaaaccccgtctctactaaaaatacaaaaaaattagctgtgcgaggtggcgggcacctgtaatcccagctactcaggaggctgaggcaggagaatcgcttgaaaccaggaggcagaggttgcaatgagccgagatcacgccactgcactccatcctgggcgacagagcaagactgtttcaaaaaaaaaaaaaaattgttcatctcattgtgtatattttttatttctcctgtttgaaataagtgatgaaactggaagcataaataactattattaactgtatcattttttttttccaaaaagggtttttaaaatattctattatt

SEQ ID NO: 41047 - DNA, 1054 bp, Homo sapiens
aactgagtcacatatatatagataaagcttaaagctatagtacttttagaagaaaacataggagaaaatctctgtgggctggagttaggtaaagagttcctagaaatgaccccagaatcatgacccatagaaaaaaaaattcatcaaaactaagaactttccctctaccacagataacagtcaagagaaaagacaagctacaggctgggagaaaatatttacaaatcacatagctaagaaaggttttttaaaactataatatataaagaaccctcaaaactcaacagtaaggaaacaaataacccaagccagtgacctgacatgtttctttaaatgtctgggtcaaaaaaagaaatggatctctgtctctttaaatctgccagagcaggtcaaagaaaggcaggcatctgtgctagtccctcagggaatcactaacaccaaccaagatagacaacctcaaatttttggagggcagagttcttactgcccaccttggcactaacgagctgctccaggaaggcaagctgtggttttcatgactgctgcaggactgaggaatggtagatgtagtgggttcacacacgctgctgcctgaaccaaattttagcagcctctcccttcatgaagcactctcctggctgctgtaagtatctgatcaggttccaaagttccaaaatagtttatcctgatagtctttttccagtttaattatttttagggaagggtggacctctgatgcttcctactctgctattttctgtgatgtctccttctactgtggtttttactattatctctttgtatggtttttgtttgtggttgctctagtgactacaaaatatatattaagttttcttttcttttcttttcttttcttttcttttttttttttttttttttttgagatgcaatttcactctgttgcccaggctggcgtgtagtggtacaacctcatctcactgcaacctccacctcccaggttcaagcgattctcctgcctcagcctcctgagtagctgggattacaggtgccctccccaacacctggctaattt

SEQ ID NO: 41048 - DNA, 1050 bp, Homo sapiens
aaatgtttatatccccacttgaaaatacctctggcacttaaatgagaagttacccacaattttgaccatacactgtctgatttaatactctttagtgattgtccgtgggttaaagttgaaatttgccctctgttcataccgttccctctgtctggaatgtcctacttccatctctctcttctataacccttcctcctttctgaagtctaattaactcttggtcattctctctttttttttttttttttgatacagagtcttgctctgtcatcaggctagagtgcagtggcgtgatctcagttcactacaacttctgcctcctgggttcaagcaattctcgtgcctcagcctcccgagtagctgggattacaggcatgcgccatcatacccagctagtttttgtatttttagtagagacgaggtttcaccgtgttggccaggatggtctcaatctcctgaacttgtgatctgcccgcctcggcctcctgatcattcttaattattctttgagggccagacatgatggctcatgtctgtaatcccagcactttatttattttgagataaggtcaaaacatttcacctagggtgtaatgcagtggcgtgatctcctctcatgcaacctctgtctcctggctcaaatgacctatctcagcctcctgggtagatgggaccgcaggtgcatttttttttgtattttttgtagatacagggttttgccatgttgcccaggctggtctcaaactcctgggctcaagtgatccacccacctcagcctcccaaagtgctgggatgggtgcagtggttcacacctgtaatcccaacactttgcaaggtcgtggcagacagatcacttgagcccaggagtttgagaccagcctgggcaacatggtgaaaccccctctgtacaaaaaatacaaaaaacttagccaggcatggtaatgcatatttgtggtcctagctacctgggaggctaaggttggagggtcactggagcctaggagacgttgcagtgagccatatttgtgccactgcactccagcctaggtg

SEQ ID NO: 41049 - DNA, 1030 bp, Homo sapiens
tttttttttttttttttttttttttttttggatttttagtagagaccaggtttcaccgtgttagccaggacggtctcaatcttctgacctcatgatttgcctgcctctgcctcccaaagtggctgggattacaggcgtgagcgaccacgcccagcctgtttgtttttttttttttgagacggagttttggtctgttgccaggctggagtgcagtggcgcgatctcggcccactgcaacctccatctcctgggctcaagcgattctcctgcttcagcctcccaagtagctggaattacaagtgtgctccaccacacccagctaatttttgtatttttagtagagatggggtttcaccatgttggccaggatggtctcaatctcttgacctcatgatccaccctccctggcctcccaaagggaaatcatattttaatcaaacatcccagataaatattacagttaggttaatttcttatattctaggtgacttcatgccatctatatgtcaatgaattccaaatctctctctccagaaatggcctttctctgaaattcgtaatttctctatccagctgcttcctggctatcttcacatggatttcaaataggcctttcaaacttcacatgacccataaagaacttttttttttaagcataaatcagatactgttatcttcttgcttcgaactctgcaatatcttctcactttacttgaggtaaaaggcagaccatttctattgcttgcaaaacccacatgtattcctgccgcatttcttacagttcttgccccatttcctacagttctcccctttatcagctgtgctggtcttctctctgttgctgttatttctgtgtggaatacctaatcctgatttataaatggttgagtccttcttgtttttttacggtttagctgaagtcaccttcttaactggtcttccctagccattcagtcttatgtagctatccagtcacatttgttacatcaccctgtgttgattctctgtgtagggtatgtcactgttcctt

SEQ ID NO: 41050 - DNA, 3075 bp, Homo sapiens
atccttcttaaaagattttgcatgcaaatgtgaatcctaacagaagcatgtggttgttctattttagtcttgtatttctagaattagaccccacttttccaactggatttcttttctatttaaaccctttaattaattctttattaattagccaaaatgtttctcccttctaaatccaggcattccatatctataatacttagaagttagtttttgtttttaatctattttttgatattttcatgagtcacactgaagtattcctaagtatccaaaggatatcttgtaaacaaccaggttgttcttttcgaagtaggagaaaccctttgcaatttgtgttagtggtagactgtgagtcgcacctttactctgatgccctgaaaaatagaaaaggaaagattattaatgactgttgtatatttattgagaatagggaaaggattggtgggttagaaaaggcattgttttgttgttctttggtacattaattttttagaataaatgagcctggagtggaagaattttttttcatgaaagacaaaataggaagaatatttgaggcctaggcattccaccaagagaagcatatacagagagataaatgaatatgcatgttaacatgttaacagatgtttgttgcacattgagaacctttttttttttttttttcggagtgcattagagaagagtagaaagcttactcatctggtaccctcttcttgcactccacagctgaatttgcataggtactcactttgaatatccttttaactaccccttaggctgcacttttgatcattaatttcctttgaaatgttttctagatttctaacatgctttattaaaaattatgcatttaacctttaaatatatgcctgaatttttcccaagctatttcttaatattcaatattgaagaagataattcttatttaacatctagtttatttgcctaggttggattatctcaagatgcccaggatcaaatgagaaagatgctttgccaaaaagaatctaattacatccgtcttaaaagggctaaaatggacaagtctatgtttgtgaagataaagacactaggaataggagcatttggtgaagtctgtctagcaagaaaagtagatactaaggctttgtatgcaacaaaaactcttcgaaagaaagatgttcttcttcgaaatcaagtcgctcatgttaaggctgagagagatatcctggctgaagctgacaatgaatgggtagttcgtctatattattcattccaagataaggacaatttatactttgtaatggactacattcctgggggtgatatgatgagcctattaattagaatgggcatctttccagaaagtctggcacgattctacatagcagaacttacctgtgcagttgaaagtgttcataaaatgggttttattcatagagatattaaacctgataatattttgattgatcgtgatggtcatattaaattgactgactttggcctctgcactggcttcagatggacacacgattctaagtactatcagagtggtaagtaaactcataaaatttattttagtttgttcataataatgtaatttattgatgtagtaaaatataagatggtatcatcactggatgagagccagaagatgtgggtcaggtcttgattctgttggataaacttgggtgactccattaggcacttagacttatgaaatgaaagaatgtgctagacttgattgtttagacttatgaaatgaaagaatgtgctagacttgattgtttctaaatattattaacatttttgagtcacaccttttacattttatttgaaaatatgccagacaaacaatttttttttttttttttttttgatggagtctcgctctgtcgcccaggctggagtgcagtggcaccatcttggctcactgcaatatccccctcctgggttcaagtgattctcctgcctcagcctcccgagtagctgggattataagcacctgccagtacgcccggctaatttttgtatttttaatagagatggggtttcaccatgttggccaggctgatctcgaactcctgacctcaggtgatccacctgtctcagccacccaaagtgctgagattataggtgtgagccccctgcgcctggccaaaaacatttttaaaataattttttaatgaatcctcatatccaacattcagttaaagaactagattatcagtactttagaagcccttaaacaatcacttccccttttctcctccacaaagataattattatttcagaactttataatcggttctttacttttatcgatccttttatcacaaatgtgtatatctttaaataatatattatttcattttgcctactctttaacctttatttaaatataatctatatatattctttgtgttgacttgtttgaggttcctccatgttattgcttgtaacatttattttcactactatttaggatttcattacatgactgttacacaacttatataaccctaaacactttatgatccttgatcctattttatcctcacaatgtcactgtgaggcaggatgaagaaactgagacctagttagatgaagtaacttgcccaaggtcagacagaaatcaagtgtaagggctaggctttgaacccaggtttgtctgatttcagggcccatgttatttctactacaccacactgcctcaccaagatccctccaagcgctaatggaagtgtaagtcaatctaacatttgttaaatactatgtactaggtgcttaaccatatattctaatatgctcgcaacaattctctgaggtaagtattattagcctcctgtgcttctgtgaacacaagtagattgacattaaaatgggtagaactgagacaattgaacctactttaatgttcgacatagtggaatttagtgtcttcccagattcgactgaattattacctggaaagcttcttaaaaatatgattcctaggctctattcccatcttttgatcaaaaatcttcactggggcatagaaatctttttgttgttttttgtttgtttgtttgtttgtttttgagacg

SEQ ID NO: 41051 - DNA, 1050 bp, Homo sapiens
caaagcccttctgctttacaaacagggggatctgctgctccttcgtcatatacaaatggaagtattcctcagtctatgatggtgccaaacagaaatagtcataacatggaactatataacattagtgtacctggactgcaaacaaattggcctcagtcatcttctgctccagcccagtcatccccgagcagtgggcatgaaatccctacatggcaacctaacataccagtgaggtcaaattcttttaataacccattaggaaatagagcaagtcactctgctaattctcagccttctgctacaacagtcactgcaattacaccagctcctattcaacagcctgtgaaaagtatgcgtgtattaaaaccagagctacagactgctttagcacctacacacccttcttggataccacagccaattcaaactgttcaacccagtccttttcctgagggaaccgcttcaaatgtgactgtgatgccacctgttgctgaagctccaaactatcaaggaccaccaccaccctacccaaaacatctgctgcaccaaaacccatctgttcctccatacgagtcaatcagtaagcctagcaaagaggatcagccaagcttgcccaaggaagatgagagtgaaaagagttatgaaaatgttgatagtggggataaagaaaagaaacagattacaacttcacctattactgttaggaaaaacaagaaagatgaagagcgaagggaatctcgtattcaaagttattctcctcaagcatttaaattctttatggagcaacatgtagaaaatgtactcaaatctcatcagcagcgtctacatcgtaaaaaacaattagagaatgaaatgatgcgggtaaaaccttttaaaatgtccatttttatacttaatcatctgtttgcttggtgtttattttaaaatattgtgtccagtatttttctttctttttatagctaaataaaatatattatcagttatggaatttaaaagtgaataaatattaaagtacttttgattgtagcattttattttagtatttcaata

SEQ ID NO: 41052 - DNA, 1080 bp, Homo sapiens
taagagagaatggaattgggtgggaaagatcataaatctggctatagttttccaagtgaagatgtcaagtagggaggtggggatgtatgtatgagccatacatatgaaataggtcacctaagggatgttacatagacaaaataataagatggcctgcaaccaagcttattatttaatagctagtaggaaggggtaaacctgcaaaggggacagagaagaaataggtgaaaaggaagaaaaccaataaggttttcagtgttttggaagccacagtaagagagtgtttcaagaaggggagggaatggtcaaaatgccaaatactgctaagaaagagatactgaccaagatgagagctaaaaaataatcttgttgactttagtgacatggtgtattagtttgctagggctgccataacaaaataacacagactgggtggcttaaacaatgaagatttatttgagtgctggagactagaagtccaagattagttactggcaggtctagtttcttctgaggccattctccttggcttgcagatggcggccgccttgctgtgtcctcatatgtttgtccctctgcatgtgcatgtgtctggggtctccatctccatgtccaaattttctcttacagggatacaggtcatactgcattaggacccaccctaatgacctaatttaatcttaattaccaaatacagtcacatcttgtggtactggtggttaggacttcagcatatggattgggggttcagcaaatgaggtaacttgtcatgtcctgggagcataattcagattggagtgggttgaggactaaataggatatgtagtagtaaaaaaaaacaaggtataccttcaagaagtgtttctggaggagagagtgaggatgttagcaagagtagtgcttctcaaaccatctatggtgatttttcaaatttccagttcatcatgacttcaattcataattttataacatacaataaattattagaaaatgaaaatttaagtgccacacatggtagctcacgcttgtgatcacagcactttgggagactgaggcaggaggatcacttgagctcagaag

SEQ ID NO: 41053 - DNA, 1050 bp, Homo sapiens
ataggaggatcatctgtcagtagcctgttcacccattagtcttactaagccatttctcatttaaaaatgtcgtttgaaatactgaatcctctaggacaagtaagtagttgcctccctcttgaaaaatgcatgtcaacatactttctgcatgatagtgagtgatttatgtttatataaaacataaagtacaaggagtggaagagagcagccaacattttagctccaggcactgtgcttggtagtttacatgttttcttatttaatcctcacatcaaccctatgagcctattacaggcaaagacactgagcctctgaaatgtgaaataatttgccaggtgtcactctactttacagagctgctggaactcaaactcacatctgtctgattccaaatcctctgtttttttcatcgtactatatagcctcctaaagtctttatcacataatcatatatagtctaagtatcttcttttgtcttatatttgtattcctgtaatatagttctctgaaaacgtaatctctaagaggataagagccagaactactatgcacaatggcaatgtgcttaataaaataccaagatactcatataaaaaagtagttctttttttttttttttttttttttttttaagacggagttttactcttgttgcccaggctggagtgtagtgacgtgatctgtactcactgcaacctccacctcctgggttctcctgcctcagcctcccaaacagctgggattatagacacgtaccactacacccagacaattttatatttttagtagagatggggttttaccatgttggtcaggctggtctggagctcctgacctcaggtgatctatccgcctcggcctcccagagtgctgggattacaggtgtgagccaccgcactcagcccaaaagagttgtttctgatattttgattgctacctttttaacaatctgatagtctctgattgtttatataagaattaggaagctgggagcagtggctcacacctgtaatcccagcactttgggaggccgaggtgggtggatcacct

SEQ ID NO: 41054 - DNA, 1055 bp, Homo sapiens
gaagaaagctctggatctatcaaataaagaagtccttcgtgtgggctacatatatagatgttttcatgaagaggagtgaaaagccagaaggatatagacaaatgaggcctaagacctttcctgccagtaactatactgtcagtagccggcaaatgttacaagaaattcgggaatcccttaggaatttatctaaaccatctgatgctgctaaggctgagcataacatgagtaaaatgtcaaccgaagatcctcgacaagtcagaaatccacccaaatttgggacgcatcataaagccttgcaggaaattcgaaactctctgcttccatttgcaaatgaaacaaattcttctcggagtacttcagaagttaatccacaaatgcttcaagacttgcaagctgctggatttgatgaggtaagaatgtttaaagacaaaagaaaggattcttcttaccttatgctacataacactttttgggtgataacatgccaaaatgtttcctttgggagaatttaaccctgtatacacatttatgtattctatcagcaaagaatgttacgtttataattccattaattactattaaaaataatatttctttagtttcttctgtgatatgtatcactaaattctggagtttctggaatttaaaaggccagatcatgaagtcataatggaagtgcagttgaagaaagccataggtgagggtaggggaaggacatctgtttgtgtgaaatacaagcttggtgaactaagtggctgttggggaaatgatagttccaaggatatgaaatttaactttatagtagggagaaagaattatagttaagagtttgtgtaagcagttgtgttctcaggcccaaatcttaaattcacaaaaactaacaaaatttcacttcaggctaactgccaagtctttaatatttctcttcagaattcattttgaagttttttcataacccatatatttaatcatttcatttaggttattaatagaattttcttcttatgataacataccttgtaagcatgaatattttaggtgtcaggagtcat

SEQ ID NO: 41055 - DNA, 1030 bp, Homo sapiens
tttggttattttagatgttttatttacatcaatgggagattgttatacatcacaaaagttatttagtcattgaataacattttcgctaagtaggaacagcaatcatttttcagcatgaagatacagcgttgctttcacttttgatctgacaattattagaaagtgaactgaagaaaatgtcagtatgcagtttcctttaaagatgggaactcgctatgttgcctgcgctggattccaactcctggactcgagcaatcctcccaccacagcctctcaagtagctgggactacaggtgcactactgcacccagccagggtacctttctgataaacttaattcaacccaaattaacactttgaaatcttatgtaatggtatcattttttttttcctaagttggacaaactaatcaatgatacttgtttgttgatgtttgtatttttgatgagggtctgaactttaaaaaaaaaaaaatggcgatctgtcatacccaggcagtttgattccagagctcttactttaaccatgagattaaagtcattgaaagttatggggtaggtaggtgacatgatcagaattgtttattaagacgaatctggccccatcgtagtgtgggttaaaaaggtaagcagttttgctttgaagaattattttaaaaattctttttgcctagtaataatttgaattttcacatgtcatagcagcaaagattgttgagatttagtaatgccagtattaaccataccttgttgtggggattataaaattagtataactttctagaaggcattctgacaataagtatcagaattttaaatatgtattctctttgatccagcaattccacttctgggaatttattttaagaaaaatgctcagcaatgtgtgcacaagaatttttattgcagcaatttttttattaactaatttcgttatgtgcaaggaatatgctatatgtatattatacatatgttcattttattaaactatgaggcataataaaatgaacatccatgaacttaccacctga

SEQ ID NO: 41056 - DNA, 1035 bp, Homo sapiens
tttttttttttttttgaggcagagtcttgctctgctggagtgcggtggtgcaatctcggctcactgcaacctccacctcccaggttcaagcaattctcctgcctcagtctcctgagtagctggaactacaggtgtgcgccaccacgcccagctaatttttgtaattttagtagagacagagtttcaccatgttggccaggatggtctcgatctcttgacctcatgatccacccgcctcgacctcccaaagtgctgtgattacaggtgtgagccactgcacccggcctgaaatttttttaaggtgaaaatgttttgacaagttcctttttcagaataggtttttgagcagaactctttcagcttgttagacccaactttgcttttgtttagcttcacagcatagctgaaagttgccaaactggacattgtgcaataaagtagaattctatattgataagcaaactatttccaaactaaaaatgtgatagataaaagtgtgattaatcaaatgatatgatcagagtaaagaattttgccattttgatccttttactttgttttagccacctatagtgttaccaaccatctttatccttgtctgcagggataataatgaactaatgtagtgttttaagataatttaatgatactatctttccaaactttgttagattttaaatgtattattgacctgagaccttaatgacaaatcactgctattagacaattgaagtgttcatttactttgtaattccaataatcatagttatggaattatggtaaggttttgcttttctgtcctaataaatatatatattttttgagatggagttttgctcttgttgctgaggctggagtgaaatggcatgatctcagctcactgcaacctccgtctcttaggttcaagcaattctcctgcctcagcctcccgagtagctgggattacaggtgctcaccaccacacccagctaatttttgtatttttagtagagatggggtttcactgtgttggccaggctggtcttgaactgacct

SEQ ID NO: 41057 - DNA, 1025 bp, Homo sapiens
aaagtcagttgaaatcacctgcttttcctgaagacttcgagtttggtatccatattatcccatggaaatttgaatatttaatatcactgaataagcctttggtccaaagtggtgatgtataataatggaattattagcctattattctgagaattaaacacattgatatcatcacctttctaaatatcagtagaagtttgaatgtttactaatataaaaatcatcttgaaagatttcttccttttctttttttctcccaggaggaagaagcagtacttttttgtctcatagcattagtaaccaagctaatgttcaccagtctgtcattagctcctggctcagcactgatcctgcaaaagaccgaattgaaatcacaagcttacttcccagtaggtctctgtctgtgaacactttggatgttttaggtccttgtcttgtttgtggaaccgatgcagaagcaatttatgttactagacatcttttttcgtagaagtactataattataagatttcagatagaacatgcaattagccttttgaaatccaacttctgtgcaaaattttagtatcagaaaatacgagatttgcaggggaaacatcagtaaactaccattaatgtcaatgcccagttttgacttttgttagcctgacactcccaaacagttgtagaatccgatagatgactgatggcaaaagattgtgaacatgtggaagaaaatcagtgggattctggtgctgatgaataggttgccttcagagtattattgacagacagcttgtggaactaattctttatttttgatgttgtgggaattaacacatcaatggtggttatgggaactaccaatgggttcctacaatttttatcagtagtatgtggcatatacaccttcctagtggcagttgccaatgttaatgattattctttttattgcaagtatttcctatgatccttccacactttatttccttaataataataaactttttcagaaagaattgagtagagcaaaaatgacaaagat

SEQ ID NO: 41058 - DNA, 1030 bp, Homo sapiens
gggtactggttaaatggcctgatctcaggccgggtgtggtggctcatgcctgtaatcccagcactttgggaggccaaggcaggtggatcacctgagtttgggagttcgagaccagcctgaccaacatggagaaaccccgtctctactaaaaatacaaaattagccgggtgtggtggctcatgcctgtaatcctagctattcaggaggctgaggcaggagaattgcttttacccaggagacagaggtttcagcgagccgagattgcaccattgcactccagcctggatagcaaaagcgaaactccgtctcaaaaaaaaaaaaaaagggcgtgctttcctcattacagtcagttgtaggttatggtcagccaaagaccatgcacttgtaatcggggtttatgtgtttttgcattttccaagtttcctgtttttgagggtttgtctgtggctccaaagttcttttgcttattcatttattcagaaatatttactgaatgcctaccatgtggtaggcattcttctaggtgttaggacgtgtaacagtgagcagaacgaaatgtcgaaacgcatagagcaaatattctaatagttaaaaaaatagataatgtatcagtaagagtccaattagaatgtcagaaactaccttagatgtagaaggaattggtctcacatgtgttagaagggctgggaaaacaaaaggtaataggaggggtgctgggagaacaaataggaagaaaagggaaaacccagaaatagtaattgttagtacccctgctacttgactgttgaaaatgctgtaaaagtttgttctgaattaggagaaaaggcgctccctcaaccaggctgaaactaccaccagtgttgttgccagaaacctggagcaggaaggagctgcttctcccttccgccttccagtcacccaccattaatacctgctattggcaaggcccatctggatggcagatggcaaagcagcctggaaagtggagtttaccaacttctacctcctacagtatatagtggagcacagc

SEQ ID NO: 41059 - DNA, 1147 bp, Homo sapiens
aattctcacacctcagcctttcaagtagctgggattacaggcgcgtgccaccacacctagcaaatttttgtatttttagtagagacgggattttgccatattggccaggctggtctcgaacccctgatctcagatgatctgcctgccttggcctcccaaagtgctaggattacaggcatgagcgacagccgtgggccagatatgtatattttagatgtaggttaattcccataagaatacaaagagttgcctttgaacatccaactgcttgatccctaaaagtcattactgtagtttgagataaatgtggggcattattaaacaatattccttttgtatctaattcagtgtatatagaactttgatggcagtagtttctagatttcattattctaaaggaaaaaggagagatttattcttgtagaagggtgtgagtcagaatttaaagatactcttgttgggaagaagtgctaattccttagtactttgctttaatagtatcctcatttctgatgcctagactctgtcagtcaaccagcagtggactacagctcactaccacacaggccctggcagtccttcctatagcagtgcaccatgtacaggtgttgtgtgcaacaacccagaaatcgttacagttggagaggatggtcgaataaatctcttcagagctgatcacaaggaagctgtaagaaccataggtaagaaaaatcccagcctggccaacatggcgaaacctagtctcttctaaaaatacaaaagttaggctgggtgtggtggctcaccccggcaattgcagcactttgggaggccgaggcaggtggatcacctgaggtcgggagtccgagaccagcctgaccaacatggagaaacaccgtctctactaaaactacagaatttgctgggcatggtggcacatgcctgtaatcccagctacttgggaggctgaggcaggagaatcgcttgaacctgggaggcggaggttgcagtgagcagagatcgcaccattgcactccagccagggcaacaaaagtgaaactctgtttaaaaaaaaaaaaagaaaagttagccaggcgtggtggcgcatgcctgtaatcccagctactcaggaggctgaggcaggagaatcgcttgaacctgagaggtg

SEQ ID NO: 41060 - DNA, 1066 bp, Homo sapiens
atgttttttaatgctataaaatgttagaatgtgccatcagctaatgccaggcttacgtatttctagaccataaagcagtttttcacaaattcatctttacagaaaaccagcatctagcttagcatctttccccttttaatttgtaggcttttaaaggcaaatcattcccaccatcacttaacgccgggattatacacattctagaaatgattctgagaggagtgtatagtatggtgcctatctacactcacatgatattcttattcacgttttttttaaccataagtggcaaatattttaaaatatttgaaaaacactccagaatctagtacgctttatttttagactgaacctaaagtaggttgttcttttaacaaagggtttaattcgggtggggaatataacatatcaaaatacatgaacaaatggaaagttacttctagaaaagcaaagaaattgggtatcatttttgtttcttgggaagctaattttgttgaatgtttagaattgagcaaagatgtaaatttttgaagggcagtttagaaaaattaactttgtgaatgaacttaagatgtctgtactctatatgtgatgctgtgcagtttgtttttatatggaaagatgtcaactatagccataaccaataaaataaaaactgatgaggcatgcagctttcagcacatcttttatacatgaagaaattaattttgtgttgctatggtgttgaaatatccaagatgttctgtatctatgtaaacatgattcctttaataaattgtattttattattaagcctttttttccttttaatataatcataagttgctattattgactgagctgttactgcattatttggattcaatcataccaaccctattttacaacgggggaaattgagtattagagaaagtgacatgcccagggccacataaagcatactcgagggaaggagaatcaaggtctacaaaatatttatatcaggtagactgaatgtgacttttaaaagtgatcttcttacctgtagattatctgattgaaggagttctgcatctaagacaatgga

SEQ ID NO: 41061 - DNA, 1036 bp, Homo sapiens
cacctgtaatcccagctactcgggaggctgaggcaggggaatcgcttgaacccaggaggtagaggttgcagtgagccgagattgagccattacactccagcctgggcaacagagcaagactccatctcaaaaaaaaaaaaaaaaaaaagtctaggtttgggacctgaacctacaacttacagcctcctaggcaaataagcaaattacttaaccttggtacaccttagttaatctgcaaaatagtgataatactaataacaatttgtttggattaaataaaatagtgcatgcaaagcgcgtatcatatagtgaccagtagctgtcactgtgactaatcactggcttgccctcttcatgtctaaccttctcaaaggtgcagtgctacccctggcgctgggtttggctatcactgctctgctgcttctcatggttgcatgccgactacgactggtgaaacagaaactgaaaaaagctcgtcccattacatctgaggaatcggactacctcataaatgggatgtatctatagtaatgtaatttcaataccttggggcagggacatgttttgtttataatttatacatctattaagttctggatatttacagcttcttttgtttttaattgggccagaagattctgcaaatcccaaatctttctttattatttattgtaaaaaaagtttccttagaagtcataaaatattttgaaatttagagaggaattcatgattaaagattcctaaaaatataattctgatttatgtaagctgtccctgaaaatagaaatgtgtacttagctgagagaaaattcagcatctcaggaggtggtattaggatgactgtgttaacccattaccttttagaagccaactgttggccccttaccatgctggactgctataggcccagcttccccttgttctgtggcccttttcttcctccttgaagctcccagtattctttttcttttcccctctaaacctgtttctgagagtggatctcaagcaagttcatgccttcaatcagatgttactt

SEQ ID NO: 41062 - DNA, 1068 bp, Homo sapiens
gatctggctaaagcccctgatttcctcaggttcatttctcatcatctcctagctctcccgtgtttttcatctctgtttctttactggctcattctcctgactgtgatcatgttcagatttcttaatgtgtaaagaaacaaagtagcatcctccatcttctgtactcccataaatgaattaccaattgctaaatccagggggctctccaggcttcacctcacttgacatttccttagcatttgattcagctgaggactttcttcttggacgtctctttcctcagcttccaaaagcccactccctactatagcggttgtcctcctatttctctgactggtcttcttctgtttttttttggtcctctgcttttgtctgccctctaaatgctggtgtttcccaggacctcgttcctggctcacctttcttcttcctttctctctggctgtcctaacccctattgtgactgcagctaccacctttatgctaaaggctcccacatatttaggcccagctaatccaaaagcctaagagaaaattccacctgatcgctgataggcatctcaatctgaaaatgtcaaaaaataaacttacctccttcagccacccaacagtctctatcatacatcaaaatcactcaggcaaaaatcctacagaccaggtagatggaccacctattttattaatacaactatgcttcatctataattctatcatagtaagtataacactttgttgcattttttcccatttaaatgtctgtctacccagacttactcgttcaaaaactgtctcatttacattttgtagaagtagagtaccatagtggatagaaccacaggctctggggctgtcctgtctggggttatttgctagctctaccacttaacaatcttagacaagtcacttcagtcttttttttttttttttttaagacaggatcttactttgccacccaagctggagtacagtttaagagctcactgaagcctctacctcccagactcaagtgatccttctgctttagcctccctaagtattgggattataggcatgagccactgtgcccag

SEQ ID NO: 41063 - DNA, 1032 bp, Homo sapiens
gaaacagagttgggcagaccaggcatctttggcaggactgccgaaggggtgaagagtttatggagagatctgtgttatcagaggccaggatggatgaattcctaccacattactgtggtggagagaaccacgtgagcatgaacaaattagctgaaagtagagtcgagaccaaagcccaggtcttggctctacctttagaaccttgaataagtcacttcatatctctggacctcagttgcctcatctgttaataagggacttcaaccagatgtcctccaaggtgctgtccagcactgaggaatgataaataggctgacattcatactttaccccatcagcccttacccatgctaggtgtcactcattggtcccagcactgtcccatggggaatgtggacttagctcagaatccttttgaaaatagtgctccaggctagaagccattattctcagcaaactaacgcaggaacagaaaaccaaatactgcatgtcctcacgttagaaatggaagccgaatgatgagaacacatgaacatatggagggaaacaacacacactggggcctgtcagagggtgggaggtagggggagggggagcatcaggcagaacagctaatggatgctgggcttaatacctagggatgggatgatctgtgcagcaaaccaccatgacacgtttacctgtgtgacaaacctgcacatcctacacatgtaccccggaacttagaagttggagggaaaaaaaagaaaataatgctccaggctgccacctgcggctgatgggagtcagcacccaatttccaatctatttatgatctctccttttgctttttgataatcagcctttggatttggttatgaagatgtaaagagtggtctttcacagatgcagagagattagatgtacagttattatattagggctttttctaattattaaaataatatggatttactgtagaaaatatagaaaaatacaaagaaagttaaaagcatctagcaaaactcaccattaaaattttgtcgcattttc

SEQ ID NO: 41064 - DNA, 1065 bp, Homo sapiens
ctccccagtagctgggactgcaggcatgtaccaccatgcccagctaatttttgttaattttttgtagagatggggttttgccttgttgcccaggctggtcacgaactcgtgggctcaagtgattgcctacttctgcctcccaaggtgctaggattacaggcatgagccaccgtgctgggccccgtccatttctttatgtgtaacatttggaaagctgactattggaagaagaaagaacagattacccatttgaaaacgtgagaatagatttttatggtcctctgacatgtcttagatgagtgggctgttacatccaaatatccgtgattttaaatcagctgcagatgtagtgtttttagtattaaagctcagaaaagaaatccagcaactaacagtagctcttccacacttcagtgggcctggaccgcaagatggtaacccacacggcagctagtcctgccctgccaagaaccacagggccgagtgaagatgcagggggtgactccttggtggaaaagtctcagaaagccactgccccaaacaagccacctgcattatcaaacacagagaagaggaatcattccgccttttggggaccagagagtcaaatcattcctgtgatgccaggtaaggattcacggtgggttctcaatgaagaaccttgttttctgtagccaaacttggctcacaattaagtttatgtttgaagagtgttaaggaagtatcttgaaataagagttaaaattaagaatttggccagaaaggcggggggaaatcttgacatttgcactaatttgtagtaagggacacttactaaatacactcatgtacctactccagagacactaatacatttatttgtaaatacattaacacttagcttacgtaaaccaatacccaaagtgttaaattttaggttgttttgagatgaaacagcataaccattatgtatttgtgtaaatcctcttcacccaagcaagtgaacatttaaacaagttgtcttgaaagagatgcatgtgctagtaattcaacgttatgcctccaatttaactaaatctatcacta

SEQ ID NO: 41065 - DNA, 1031 bp, Homo sapiens
ctaattttgtatttttagtagagacagggtttcaccatgttggccaacctggtctcgaattcctgacctcaggtgatccacccgcctcagcctcccgaagcacttagactacaggcgtgaaccaccgcgcccagcccaacgtctacatgtctaagaaagattaggtcatcaaattttttaaaatatccattgcatggaacttagcgacactaaagatattgtagtattgtagagggaacccctcaccacacacacaattcacttctggagaggtgctaaggtcttgtacatttaaatatcctgttactcggtcatcgtgtattttcttagtgtatgcagtgtgcagggtccttgccaggcactggggatagagtggtgcactggtggtccctgactctggtaaacttgcagtaagtctgtgacatttttgaattctcagtattcaatactcaggatccagatggtaattaagccagcagagtgcagaatgaggataaaagagttggaacaggactgtgatttacttgtactatattggatctagccttctatcaaaaactgaggttagtatgcatactggaaatgaaattttctaaggagttagagattttaggatcctaaggacttgtcaactttgataattttcataggcggcattaaaaatttgtttggctgatgacaacctgtccagccaggggttaagcttactgtaaggaagcagggtaaccattcacagacaggacaggcaccaaactccagcccgtgccagcactgtgaggtcaccagtgatagcgagtaaacagtctgtccagctcagcccggattccatcagccctgctaattcattgcagctggacaggagagccagccagctactcaaaacattgttgagtccctttgctgggcagctactcaaaacatcattggtcccttggccaccaggaccagtggagacatgacattgtctccagcagggatggctcacttctgtagatctgggcgccctctagagggctttccccctgggtacc

SEQ ID NO: 41066 - DNA, 1031 bp, Homo sapiens
tgtatgtttattgtggcactattcacaatagcaaagacttggaaccaacccagatgtccattaataatagactggattaagaaaatgtggcacatatactccatggactactgtgcagccataaaaaaaggatgagttcatgtcctttgcagggacatgggtgaagctggaaaccattctcagcaaactatcacaaggacagaaaaccaaacaccgcatattctcactcataagtgggagttgaacaatgagaacacacggacacggaggagaacatcacacaccagggcctgtcggggtgggggtcaagggaagggatagcattaggacaaatacctaatgtaaatgacgagttgaagggggcagcaaaccaacatggcacatgtatacctatgtaacaaacctgcacgttgtgcacatgtaccttagaacttttaagtataataataaaaaaataattaaaaagaagtatctgatctgacaaatttatcgcctgtgtgatgtaacttagccctctgagcctagtttctgcatcagtattatgcagatgataatacctacctcagagattcgttgtgaaagttaagttctttctataacttcacctggcctggtacctggtacaaggaaattgtaaccgcccaatgggttctccttgcccactgcctacacagagctgatttatcaagacaggggaattgcaatagagaaagagtttaattcacaaggaactggttgtgcggataaaacacaagaccagatgagccagtttatcaacctaggtactgccaacggggtgctgccaaccatcgaggacagggtctataaaatatctcaagcactgaacttaggttttataatagtgatgcctaagccataatttctaatcttgtggcttatttgttagttttgcaaaggcagtccagtcctcaggcaagaaaggggcttatttggggaaagggctgttaccatctttgtttctttttacttttttttttttttttgacacagggactcactttgttatgcag

SEQ ID NO: 41067 - DNA, 1030 bp, Homo sapiens
acccactcctttttcttgacgtggctctcctgactttgcctgcggtggctttcatcatacaaaaatgggaggaaaacttctggtcccttttataaaaagtgaaaagaggggacttgattttcgttgaaaataagaaactttaaggccgggcgtggtggcttatgcctgtaatcccagcactttgggaggccgaggagggcggatcacctgaggtcaggagtttgagacctgcctgaccaatgtgatgaaaccccatctctactaaaaatacaaaaattagccagagctggtggcatgcgcctgtaatcccagctattcgggaggctgaggcaggagaatcgcttgaacctaggaggcggaggttgcagtgagccgagatcgcgccattgcactccagcctgggcaacaagagcgaaactccatcttaaaaaaaaaaaaaaaaaaaggaaaagaaaataggaaactttaaagcgtgtttcttaaggactaaaaatgatgctgattcgacggtttgactttttgtagatgctctgaatgagagaatcaggacacatacaggaggcacaaaaatggtagtggttggacatgaatgtcacggagggaataagagaccttgattgtgcccacgtgtggtcaggctccgtgtgtttaatcatgccctgttgctgtttgatttataatagcacgaatgatatcagcaagatgggggcggagctcagcccctttggaagtgtggattctccaaaacctgtggatccattgaaagagtctggaaatctgtgtccatcacatcctgcctccctccccacctctaccttagatgaggctcagaatccttgtcaggggagcagatatcaaagggtcaccctgcgactgcttggccttgaggcaaacactgggaaggactccatagctttccttctgaagtggaggcaggcagcactttcacttggaccccccatcagcatctctgaggcccaccacggctgttgcacacacatcctctctgcccaaacacagaccaaaatat

SEQ ID NO: 41068 - DNA, 1498 bp, Homo sapiens
cttaacaccttctgccactttctctcggtgctaatggatggaattcctgcacaagttttaactgaacaagaaatcccagcaaaaggcattttctttctacttctttgattgtggaaaagcagacatttctctgaagcatgaccttattcttcgaaacggtattgctagtaaaatagcatgcaggacttcagacctcagggatcctttccatgcactgaccaagaattgtattaatcctttttatcattatagtttttttacattttctcattctgtcaaccatattggagtgaagtggcatagtcatcactcactgtaatctccaactcctgggctcaagtgatcctctagactcagcctctagagtagctgggactacaggcgcatgccaccatgcctggcaaattgttttatatttaggtagagattgggtcttcctatgttgcgcaggtaataaaactgtgaaaatcctggaatataagctaagaaataccaatgtggacatagggcctggcaaagatttcatgaagaagacactaaaaacaattgtaacaaaaacaaaaattgacaaatgggacctcattaaactaaagagcttctgcacagaaaaagaaactagcaacacggtaaacagacagcgtgtagaatggggaaactatttgcaaactctgcatctgacaaaggtccaatatccagaatctacaaagtacttaaacaattagacaagcaagaaaaaaaaacccaattaaaaaatgtgcaaagacatgaacagacacttttcaaaagaagacatacaagtggccaacaaacgtgaaaaaatgctcaatatcactaatcatcagataagtgcaaatcaaaactgcaatgagttaccatctcttaccagtcacaaagttggagatggtggtgaggctgcagaggaaaagaaacagacactgttggtgggaaagcaaacttgttcagccgctatggaaagcagtttggagatttctccaagaacttaaaatagaactaccattcaagcctgcaatcccactactcgggatatatccacaggaaaagaattcattttatccaaaagacacctgcaccaatatgttcattacagtgctattcttactagcaaggacacagaatcaacctaagtgcccagcaacactgaattgaatgaaaaaaatgtggtacataaacaccatggaaatctatgcagccaccaaacacagcaaaatcatgtccttttcagcaacatggatggaactagaggctattatcctaagcaacctaatgcaagaacagaaaactacatactgcatgttcccattggaaagtggcagctacacattgaattcacatgaaccagaggcactggagattactagacaggtgagacaggaggggcacctgggctgaaaaaccacctgttgggtaccatgcttactgtttgagtgatgagatcattgggacaccaagcctcagccttccaaaatctacccatgta

SEQ ID NO: 41069 - DNA, 1048 bp, Homo sapiens
ctcccttccctgaattcagaactgtagttctccatggcatgatacaaacaggtccttgttctcttctcctcttccccttttccacatcccagccccacctctgtaaaggctttgtgcattataaacctggaatgtatcgactttctttcaggggatattggaaagataatggtcattatacttataaactcaaattttgagaggttttagattattcagaagcatacttggaactaatgaagggtatataataaaacaactggaatccaatttggtaagctaaaattatgactttccctgggtaaaaagtcttctcagaaaaacaatgtcagaaaataacagcgtgctgcttagaaatacggctgggctctgtactatgcaaaatctagaaagtgtggggaaactttaaacccaagaaaacgttcttagtattcatcctccaggtgtcttacttcagaatgcatcctttgagattatgtccacttaagagaaatcatcagttaagaaatctactttaacaaaacaaaaaggagaaaaagtaataatgtgatggcaatcttaatttttgggtacaacatgacaagctgtgagtttgtgtgtttgtaagagaaaaatgtgtgggtacttgctaataaacaggtgaattaatgcacatccttatctcattgctggcttctttccaagttgagcaacaacaaaatgctgtatttgagtttctgacaaatttgttttaaaaatcaaatttgaatgtactattctataaattgcctttctgaatagaacatgacatgccattttctagcagctgccagtgataatttgttttacactaacttttaaatcagtgtgtgtactgcagggaaaaggatataggaatactcatcttacaggggaatttgtgaccagaagatgtagtaacttcaatgactgaaagtcaatgctgatagtttactggcaacattaattgaagcatcaaaaataaatggcaaagagaaatcaggacaaaaaatctaattgctgtttgggaaaaaacttgattttgatgttt

SEQ ID NO: 41070 - DNA, 1065 bp, Homo sapiens
aagaattgacaaactctgatgcatcattagaatttccatttggaatcttaaactaaaagactccatttgcatttggaattttaaactaaaagactcgatggtccaagatatttgctgtctgtctccaggacgtgatgcttaaaggcagaccacctgagttcatttcctggcttctccattaccatctgtgtgagcttgggcaaatcacataactccctaatttactttaaatggcatcatctggttttttttttttttttttttttttttttttttttaaaggcataatgacataactacttcagaggactgttaggaagactaaatgagttaatctgtgtaacgtttttagcagtgcctgacacgttagctatgatgacatgttagctatgatcatgactgttggtgactataaaggacacattcttatttgtgaatcaccttcttaaaaataaaattgtttgctttgcagattttttaaaaaatggatttggccaaccatggacttattctactgcaacagttaaacgctcagcgagagtttggtttcctgtgtgactgcacggttgcaatcggcgatgtatacttcaaggcacacaaatcagttcttgcttcattctccaattactttaagatgttgtttgtccatcagaccaggtaactaaagtggttgctaataacctaatgactgtagacttcttaacctccatgtccctggccctcatcaagaccatgggtctctctacgtctcctagctcctaggtgacctgctcccttgtggcctcactcgcccccactacccttcttgttacaggtgctttcagtagcacttgagaatcactggacctgccagctctatgcagcccttccacctccagatgccctcgctgggtgtcacctgcatggtcaggatctgcaaaatcaggtccatttttttttttttttttttttttttttttttttttttgagacggagtctctctctgtcgcctaggctggagtgcagtggtgcaatctcggctcactgcaagctccgcctcccgggttcacgccattctcctgctt

SEQ ID NO: 41071 - DNA, 1050 bp, Homo sapiens
tgacagagtgagactgtctcaaaaaataaaaagaaaaaagaaacaccacttactatttaagtttttgtgggtcaggaatcagtgcagcttagctgggtcctctgattctgtgtttctcacaaggctgcagtcatctcagagattcacttcctagttcactcgtggttattggctggatttggttcctctcaggctattagattgaggcctcagttcctcataagctgatgtccagaagcttctccatagagcatctcacaacatggcagtgtgcttcatcagatgaacaagtaggggagtgatatggtttagatctgtatccctgcccaaatcttgtgtcgaatggtaatgcccgtgttggaggtgggtcctggtgggggggtgactggatcatcagggtagatttctcatgagtggtttggcaccatccccttggtgctgttcttgtgacagtgagttctcgtgaggttgtttaaaagtgtgtagcacctgcatctccccttgttcgctcttcttcgcttctgccatgtaaggtacctgctctcccttcaccttccactatgattgtaagtttctggaggcttccccagaagccaagcacatgccagcatcatgcttcctgtagaacagtgcagaaccatgagccaattaggcctcttttctttataaattaccccgtctcaggtatttctttatagcagtgagagactggactaatacagagagcaagagagactgtcaggaagagaatgctagtaaaacagaagtcacagtcttttgcaacctaatcacagaagtgatttttgctgtgctctctttgttaaaaacaagttagggccaggcacagtggctcatgcttataatcctagccctttgggaggctgagatgggagggtcacttgaggccaggagttcaagaccagcctggtcaacatagtgatacccccgcccatctctttaaaaaaaaaaaaaaattaaaaagcaagttatggccagtcgtggtggctcacacctgtaatcccagcacttcgggaggccgaggtgagtgga

SEQ ID NO: 41072 - DNA, 1044 bp, Homo sapiens
aaaaaaaacaaaacaaaaagacacaaaactgttttatcacttttcctcatgctaccctgtatagtcacactgccctccccctacccggactgtccctaacccctggcagtgagtaatctcttctccatctccataattttgtcattttgaggatgttatatagatagtcatacagtatgtgactttttttttttttttttttttgagacggagtcttgctctgttgcccaggctggagtgcagtggctcaatcttggctcattgcaagctctgcctcccgggttcacgccattctcctgcctcagcctcctgagtaggtgggactacaggcacccgccaccaagcccagctaatttttttttgtatttttagtagagatggggtttcactgtgtttagccaggatggtctcgatctgtatgtgactttttaactggcttttttcacagagcataatgccctcaacttggatccatccaaattgttgcttgtatcaaagttcctgtcttcctgtggttactgaaacaattttttggtatttcattttgatgttactttttaatatatctcgttgcatagatatttagtagttgctctggttattacatcttacgtatataacttattacaatctactgatttcaacatcttgcagattaaatgaagtatagaatctttatttccctaatggatgattggatgcagaaaaaaaaaaagaattcttatttcttttatattcctttacccttccgtatttataattttcttaactattcttctgcagacatagaaaacttcatcagataatgttataatttttgcttcaaccatcaaacataatttagaaaactaagaaaagcaaagtctgttgtatgtgcccatgtttttattctttctgttcttttctccttctgatcttctaagatttcttttactgtttttttttttcaagaactttatttagccattcttttaaggtaagtctagtgagacaaattctcttagtttgtcttcatctgagagtgtattaattttctcttcattc

SEQ ID NO: 41073 - DNA, 1056 bp, Homo sapiens
tcctatgtaggatgtagtaattaacaatttagaaaaaaaaaaaaaatcacagttttggtctgtgtctgaattgcccatcacccagcctttaccagaaatttctgaagctttgaggatcctaattttatgttaattccgttaagacatacaaccttttgcaaattaatagtatattttttaattgatatattaacattggttgtaatttatattatggaatatatgcttatgataaatatcactatactaatatataaagcaacttcttatgatgaatattggtatattagtatatgttttaacaatacttaggccaggccccgtggctcatgcttgtaatgcactttgggaggccaaggcaggcagatggcttgagctgaggagttcacgaccagcctgggcaacatagtgagacctcatctctacaaaacataaacaaaaacttagccaggtgcggtggcacatgcctgtagtctaagctacttgggaggctgaggtgggtggggcgggggggggtcccttgagttcaggaggttgaggctgcattgagctgagatcatggcactgcgcttcagcctgggagacagagcaagaccctgtctcaaaaaaaacaaacaaacaaaaaaaaaactttttttttaaatagttgcaggtggctgcagtggtagcccctgtagtgattaaccttgaaatcacatatgttttgaagtggtcagtatctttatttctgtgtattttctattgccctactttttatactttaaaattcagcaggagtagtagtttgggaatgttaaaattgcattattaatgaaatggtatttataggaagagaatatattaatacttcttcaaattttatttttaattttgtagaaagaagtttaattcttgacacttagttgtatggaacctaagactttattaattatctggactagtgattattgaatcaaaatgggcatgaatgagctctaatattaatatcacaggttgttgaatgttttataaaagtaattgctgatctttttttggtggtcgtatttgcatttttat

SEQ ID NO: 41074 - DNA, 1024 bp, Homo sapiens
agaacagcgtgcatctggagttggctgaatgaggtttcagtcaccctgtctgttggaattaaatctttacctggtctcattttcagagatcataatctgagatactcaacccacatccctttggcttacaattcctaaaagcaatagtggatccagtggcttatgcctataatttcagtgctttgggaggctgacacagaaagaccacttgaggccaggagttgaagaccagcctggcaacatagcaagactcccatttctaaaagacttggaaaaaaaaaaaaaaaaaagccgggcttgctggtgcgcagctgtagtcctagctactcaagaggctgaggtgggaggatcgcttgagctccagggttccaggctgcagtgagtcgtgactgcacctcgctccgtccagcctgggcgacagagtgaggccctgtcactaaacaaacaagaaaacaataatagcagtgcttcttgttaatgtccagtctttgaagagaacagcagaggatgggaacggcaggtctgagtggcatggagcccgacaccagggagaatgttttcaggctaatagcactgtgttacagaatcactggtggactgttaaccatttttttgaaaaatgaaatagaatagaaaataacagaatacattgctcatgataaacgtaaatactggtttgtgaagcttttgtggcaattggtgtgtaagcatatatgtgtatatgtactatgtttaatgatttataggttgtagtcagaaaaacttacaggataaagcgtgatcttggtaacgtaaaatgtatctgtgtttttatagctttaatctccaatcagtatgttacaggagaaaaggcatttttccttagtatgatctatctactcacagtacttctgacatcaaatatatggggacctcttcctcctcctaccagccagttctccaattctccagacactaacaaggtgtcctgcaattcagttcaattccagcactagccagagttagtgcagacgccagttagtta

SEQ ID NO: 41075 - DNA, 1035 bp, Homo sapiens
aggagtgaacaggtcaatgggcagcccttgttttgatcttgatctttgacctaattgcacaaagaatttaacagttgacaaacaggagctattcagctctgtcagattgtactatcaattatatatgtaaatcttcccatcactaaagttcttaaatgtctcctaatgaaaattagtcaggtatttaataactaggaattgtgggagctctcttcagtcactctgttataactcatctagctacaggtgttgagtgttggttgccagggcatattttaaagtcaggggaaggatgttttgaagaaaatttgatccaaagtttgtgggtagctatcctatccttcttaagacactttaaggcaaaccattgaatcattgcaaatgagaaaactgaaggccagagagactaatttacttgcccatggtcatgtaactgcctcaaaacaaaatgtccccacgtccacacacggatttgatgatctgcaggatactgtgaggccttatgaccagaggctttagacacgaggaaaccacttgtttccaaatattttaggatgcaagttcaggattctcttctttgcttctacatgtgagatacctgtgaaatgaatacgacctgaattaccattaccattattcctatcaccaaccagcaaaacatttcacagcagagagtgcggtgggcagggattttggaagcctgagtccctgctaggcctcttcctttaactgtagaatctgaagcaagtcattcagcctgtctagagtctccaggttctggtagttaaaatcacagggttgaaatcttctgccactggctgtgtgagcttgagccagttatttcacttccctgagctttctttcacatcatctgtaaaatgaagttaataagtacacaccgcagaggactgctgtggggattaaatgacagaacccaacataaatgctcagagtgctgcctagcaattagaagagtaaacatgaactgtccttagctactcccctacaaaattaggagatgaactggatgctctc

SEQ ID NO: 41076 - DNA, 1020 bp, Homo sapiens
tattttttttagggtagggtggaagagaggaaggacaaatttgtctatataatttcttaacccttaaattgtcgttactaaggatcacgaaaacttcttctgaggatagtaaatttaaaagcacatcttataactttgaggaggttagaaatgctttttaatttaatatatgttatgtttaatacttgcaagagctgtcttaagacatgaaaggattaagggtcttttccttgactgttttcatttgagggtaatcagatattggtgttaaacagtactcgatttttgtagcctacttcacctgtggagttttatgaagaactgagtctgtcacctcagcactatttccagagaaacaactttctttcagttcccttactggtccttggtagcagactatttagataggcttggtagaagatgccaaacctgtctgataaatattctttgctttaagcaatcttgacatatacagtgcattattattaattatagtctccattctgtacggtggatcactaaagcttatccctcctgtgtagctgaaactatgttccttttgatcaacatctttcttttccccatctaatcccttatcccatgccctggtaactaccattctactctctacttctatgagttcaactttgctagacaaaaatggataagtatgtgaggtaatgatatgttaattatcttaatttattcattccacaatgtaaacatatatcaaaacatcatatagtaccctacaaatacatacaattattatttgtcaattgaaaatcatttttttaagttaaaaataattcttggcaaggaagaacacccagagataaagcttggcaaagctgtgccttcttagagtcttcatcttcgggagtttgtggtagaagcactgcgggtatgtaacaaaatagagacctggctttggctttgagtgtcaaagagatccacagtttggcagatagcacgttacataacaccattgccatggctttgttagaaacaagagcttgg

SEQ ID NO: 41077 - DNA, 1037 bp, Homo sapiens
aaggaacttgagccaacctctctcaatcagaccatagtaactggtgtagaagagcgtgttgggctcagggctcggagaattttccaagggagtcttcaggccgggctctgaaaaacaaatttttgctgaagagaaaagcagagaggaagtggcctggatcccacaaaagcaagtcagcaggtcatggccagggccactactttggcagctggagcagctctgatggggacaactttcagtctcgtccactgatttcttgaggccattttctatgggttccttttgaactgctgtttcaactttgcttggaagaaccaggatcttttagagcttattcttagaaggtggtggagtcttagatgagagagaatctgttttcatgcagaaaatcatgggttccagttctgggagaatgcccatccacccaaacttcccatctctaggaaaatcactgcttatctttgagaaattccgcagaaggtggagaatttagtgtcactagtcacccattctgaaggtcttgcaaaatgcaactagcatatattagaccattgcacccccgttgttctacctaaactgcaatctctggctggatcatctgaaaggaaaggaagtacctctgagctcgggtgggctcagaatctgggagaaagttttatatactattacctacaggtttttactgttcatttagcttcaagcaccgacaccgccttgcaaagataaagataaagtctattagacaatttaatcatgagattctaatgaaaaaaagaagaaacagaaaggtaaacagatcccatctatttccctaaaatggtgagtataaaactctgaaaataggagagcgagagaagggtctctgtgggcagttaggttggatgagctggaatggctgggtcccatgttgtgctcagacattgcaaagaacaaccaggggcaggcgagcagcagctccagaaatagatggcaggaggctcctccgtggaagcaacctgtaaaatatccttcctctgccccatggtacgccagccctg

SEQ ID NO: 41078 - DNA, 1053 bp, Homo sapiens
atgtgctaatttgtctatcactaaaccagctgaactatggattaaatagcaccccatccccctcaaaaagctagaaggatttaaattgtatagaataagatgccatcttggctgcagtcaaacatttgtgctaataacaagagcccagaacaaggatgtctttattccttaattccaaagttagttatgtttcagtttcaattacgaatatggggaaatcctaagaggctgaattcagactaggccctccaaagattcaagggtgggcctcggatgctatcagttgggccccaaagatgtttaagggctttgcctttcgtctcaacaaaaacctaaggtagagggtccctcctgtcaactcccaggcaatcactgatctttgtcactgcagacttttcaaggattttctataaatggagtcagtttgctttcactgaaggctattttgacactcatctgtgcgtgtgcatcagtagttaatgctcttttcttacaaggcagtatgctgttggatataccagttcaccagttgatggatgtttggctctttactccatttcctgctgttacaagtaaggtgctgtcagtgcaatcaaattagaactcaggattaagaaactcactcagaaccgcacaaccacatggaaactgaaaaatctgctccagaatgactactgggtgaataacgaaattgaggcagaaataaaaatgctccttgaaaccaatgagaacaaagacacaacataccagattctctggtatcattctctggacacatttaaagcaatgtatagagggaaatttatagcactaaatgcacacaggagaaagcagaaagatctaaaattgatacctaatatcacacctaaaataactagaggagcaagaacaaacaaattcaaaagctagcagaagacaagaaagaactaagcaaaactgaaggagatagagacacgaaaaacccttcaaaaaatcagtgaatccaagagctaatgttttcagaagatcaacaaaatagaccgctagccagactaatgaagaaaagagaagaat

SEQ ID NO: 41079 - DNA, 1037 bp, Homo sapiens
ggatttgcatcattattagctctaattttaaggaactgtccatattcaaagaacagtgttgaatgaaagaggttctataggacaaccccccagtaactgttctaaagacagcagaaagagaatgactttgaattcctgaagtattttcaggcctttttggtttaggcagctaaacaaagcagagtgtgcccttcataagtggcttctgcttttttatcctgtcatgtaaattgtggtcatatataaatcaaacctaattctttagttgatttgaggcaaaaatagaggcaatctcttggcattttttacttttcctctgaataaaactaaaccactcagaatcatttgttctaggtttagggttaattagggagctagaatttgtatattctttgctttttatgcagctgaacccttaattttaggtttagtaggatcctggagcacatactatgtgtctttcactgtattaacattgggaatttacaagcagtttctctctacaagttactttctatgaaggtatccatttctactttgagttaaaaagttttgctctatgtaaaaaatggttaagttttatatgaacgcattaccaatatttagtgcagactaaacatactgatgctgtatacatttacttacaggataaattgttagctatatatgattggcttgtgtggggatggtagatggggcacattttaacctggcatttaagattcaggctttcttagctcatgtccccattgtttgcctactcttactctctgccttcaacaatgctaaacagttttctgaacccatctaccatattccttcccagcattgtgccgttgctcaaattgtgaatgcccttcccaggccactgttgtctgacaaaatcctaatcattttttagagttgtggttctcaactgaagaatagaggaaattttgcatctggcctttttccctgcccagtatttggcaataactggtaactggagacattgcatcttgggagtgggggctgccactggtgtctaatgggtaaag

SEQ ID NO: 41080 - DNA, 1075 bp, Homo sapiens
gaaatactacctcagccaagtaatcaaggctaacaacagttcaaatcatagcaccttacctctggtctaaaaacccacagccccagactaaggctgagaaaaacttgacaaatcctaattgtggaacaggctacaaaataaccagtatttctcagagttgtcaaggtaattataaacaaggaaattgtcatagtcaagaggagcctaaggagatatgatgactaaatgtaatgtatcctggataagacccgggaacagaaaaaagattttaggtagaaactacagcagtccacataaaatagggattttagttaataatgcaacaatattggttaatttgttgtgacatgcattactgttagtaatataagttaagcaatgggtgtacaggaattctgcactatccttgcagcttttctgtgaattcaaataagtttattaaaattcttttaaaatactaaacctttttttttcttttttctttttttttaagacagggtttccctctgtcttccaggctggaatgcagtggtatgatcacaactccctgcagcctcaacctcccgggctcaagcaattctcccgcctcagcctccctagtagttggtaccaaaggcacatgccaccatgcccagctagtttctttttttaattgttgtagagatggagtctctttatgttgcccagactggtctgaactcctgagctcaagcagtcccccaacctcagcctcccaaagtgttgggattataggcatgagccactgcaccttacctaaatactaaatctaattatccatgtgaaaatactgttgttgcaagaggaacgtggtagtcattttaactccttaagtgctaatttcgtgaggaagagtacagattctaatgttggtattagctaacaaaaaaaaatgggaaacacatttttatatcatatgtcttcattgtgtcaggcactgccatttgcttggattttgtcataagcagtaacagttatgtctggcctttaaggaaattaaagtactttttaaaatttcaatttggtagtgctttagagtagagtttgatgaggtctg

SEQ ID NO: 41081 - DNA, 1158 bp, Homo sapiens
tttccccagtttacaggtttgaggagatgaaattaaaaatacatatatgttacttccaagtagttttcaaaggaggcttttgtaaaattttctcttaaagattactttatggtcacaagcattgggcctcttaaattcttaaggaatagccatgcctaacgttgaccacatggtcgttatctgtaggtattagagactggaacttaattatttaacagaagagttacaaagatttttaaggactgcagccttatttatgatatttgatatggaggatcaggtctatattgaaaagttaaatgtaagatcaaacattgtaaaatttacttttctctatatgactgggctgggagttggtaaatgagaagtttaaacaatgccatgtatgagtcttattagtgtctgcacttgggggaaaaataggaataggacattccaagttcacaaagctagtcaaaaggctaagcaaggattttcattcaaacttggatctgattcttaaatctatacattctaatggaaaagtatgtgttactctgaaatatatacttctttgtgaaatgtgttttactactttcaaatgttaatgattgtcaatgtaaggaatatgaagggatttggcttatgtgattaaaaatagattgtattgactagacccttgtgatagggactttgccttgcatttagtcctgtttcattgtcttactcccattttatggatgaggaaagtgaggttttaagagttaacttcttcagttttccatactcagtaaatagcactgtataccttcgatactcaagacttaaaccccagggtgtttttttactctccttttcttcatatccagatctagtagattagcagcaagttgactttacccttctaaataacagaccttgaatttatgcagttattttcatttccactacaatccttctagtctgggtttcccacactctacttctgtcataaacacttctaactattctctctgcttctacttaccttcctgcaattcattctccacaattgccaatgatcttttaaaaatgtaaaccaaatttctccacttttgacccagcctaccccacaaatctgcagatcattctacttcttcaactataattttcaataacctcccccaactcagccctaca

SEQ ID NO: 41082 - DNA, 1033 bp, Homo sapiens
ctaaaccgggagcagatgatggtccctgccttgccaagtctttcgtaaaagtgtgcttccaaagaagagcttaaagagtggattttagttttcttcccaaactgagatatccatatagaaagcagactaccagtcagtcagtaaataatctgtctctgataccaaccatggactgttgtatataccaaaaaatcctttttaaaatattagcccaattaatgatgagagcgaagattgctgacaacatccaatttacaaaaactaagaaggaatttctaataaaccgtatcctgtttataacatctatatacctggcaactatgaaggcagccttttcccccatcaattacggaattaaagaaacattttttaattccatctgctccacagttgtatcaacatggtaattaaagagttccagcgatttccaacatccattctgctttaacagggagttttgtagtgaggaagctgctggaaatgaagagtgttcttagtaactttttatgtgactggttaaagttaagaatgcagacccaaactaaatgaagaggatgcattaagagaaagattactcatgttgaattgattttgcctacctgttaaaaccctgaaacactaacttgcaatcaacagagcaagcactgctggctgtgctgattgtgtataaatgaacagccagaagtaaattcagtgttatacaaacaagccacagaaaacacgatcagttttggaaatgtaaaaaaattgtgtaagtttgtctcataagtaggggtagctcttttctggaggatgttggggttcatttcctcatcaagaatgttttaaacgctgaaaacaatcttgtttttatatatcgagtgacatgaaatacttgtcttaatagtgctaaaatgcaacggaattgttacacaacttgaggtagatctgagtttcatttccttcttattttaggtctggatattacacttagcaacatacagtaagcttgaaatctctctcattatattttatcatcaagcaatcagtacac

SEQ ID NO: 41083 - DNA, 1048 bp, Homo sapiens
cttgagattctgcaaacacatagtcacaaaatacacaaagtaggatgtgttccagggaaaatcattaggtgagcaatttcaaatagttgaaatattactcgtttctttttcccttacaataatctgcggacagctgcagtgtttaccctaggccaaagtactgaatctagctaaaaatacatggtactatctcagggaggtctaatctgaaatatgaatggataaactattttggatatacccccaaaataagctacctgcacagttacttccagtatgccacactctgcaccccacagtcaccaaaagcatctgcacttgggcaaataaggaatctctcatgccaggaagagtacaaggaagaccaccagtaccatgaaagagatgccaacaagctgaagaactgacacctgagaaaacaaaataaaagactctaacataagaataatgatttcctcagtttataagatccaaatatctcgcttataaaataaacatgtaaaaaggaaacaattagacatattgggaataaaaaagcaatttaagaaaaatgtgctttatttaaatttaggcatttatttgtaaacttatgaataattggccaagttcaatgcatatgaaatctttaatcagagtaacaaaataagggttcagtcttatatcaaactcaacatctgtattagttatttactgttatataacaaattgccccaaaatttaggagcaaaaccaataaatactatctcacagttcctatgggtcaggaattgaggcacagtttacctgagtgcttctggcttagaacatctcacaaagctgtaattaaggtgttcgctgtgggcaacagtaatctcaaggctcaactagggaaaaattcacttccaaactcacttacgtggatgttagcaggagacccctagtccaccctgattgttggtcctctagcaaggactgtatcagttccttgctacctgtgccctggcatgaaatgacaaagtgaggaatggaagggagagggagcccaaaacagaagccatgatcttttaat

SEQ ID NO: 41084 - DNA, 1049 bp, Homo sapiens
ttgaacagttgaccacctttggccaaaacttggagattggcacaagagtaggttacggtctgtttacaccttcatttaggttatagttcatgatgtctggggaaagctttaagccaaatttaaaatatttaaggggctgctttaggctaaacttgatttaacgacttctaaaatggagagaacatttacctggtagacattcctctaggaacgttcctataagaagtaagttagataaaaggaagacttctagcaataattcttagatatattggcatttaaactatttcctttttttctttcctttccttttttttctttttctttttaggtgatgggtaataattttacatacatataggatatagagtgatagtttgataatatgtgtatacaatgtataatgatcaaattgggataattagccttttgctgtatgaattctaattccagttctaacatttgattctagtcaaaggttgatacggagaattatgtcaggatataaacaagtatctgggagaaataacaagtttctggaagaaagaacagataaactatgtgatgaataggagtttattattgcctcttacaaaaaatatatgatgtagacaagaaaaacgtggcagtatgtgcacataaataaaattaatttggtctttaactacataaattgcctgatattagcctcatataaaatttggattaatcagaatgcccagggtatgtagtctttagataaatggtctgccaggttaattaaggcttctttatttattaagtcttctttaatttcttaggaaaaattattgccaaattgaaagtgtattaatttccctttctgccctatcaaggagaatgtactaaatatagcccttgatttgggaactagtagcatcttgaaaatatcgttattaaaagctgttctcatataacaagctatagattgaaacagaaactggaagtagagtcgctatgtgacatttgagggactgggtgccaggtgctgtgataagccctttcatacatattttcttatttaatcttca

SEQ ID NO: 41085 - DNA, 1034 bp, Homo sapiens
tgatttgatttttctaaactatctaccatattttaagtgtagcagctttgactttgcaataacgtggcaagtatctgatttctcctttgaggcagaggtttaagtgtaggcctgttacacttgtttgatacctttttcatgacagtctcagtatagatcagttggtacagaaatacatgaacacattttgatagggcttatttcacacaaagaagtttatggttatttgtgtggggtggtgttgttatatattattgtctttaagggaaaagaagctataagattcgctgacagccaaagtatcatttagaaaagtgaagcaacaagatttaggttgatgaaagatacatgagtttgcattttgacctgttcagtgtctgtcttccagcacggtgtgtacacttcttcaaaattgtacacagtttgctaattagaaatatcttggaaagcctcatggtcactaattttcaactagcatcaggtattttgaaaacgtgtgtctggatattaactcttgtttaaactgaatgtatgatattttgttagaatggaaaagtactatcttgttaatttaagtattttaaatatagttgtatatttttcttactcttagtcacctgtaattgaaatatttctgttttgcgtcatacacgaagctagtgaaaaagaaagtgcaaggcattttcagatgagcaagtgactatcgtggctgttgccagcagggcagtattgttaaaaaaaatcaaaataaaccctcccaagcattttgggattttatggattagaaatggaagaacaggagaagcatatgcaaagtgaaattgcacgaggggaattttctgaggtatcttcctaggcagagccgaaatctcctactccaaaatgccctttctcataccaccggaattgttgagtttgctgaactgcctggaattcagcccatgaaaatcactggagttaggaaacatcttccctttaaaatgcttctggtgtggttaaaggaactagcaaccactcatgtataattactgtga

SEQ ID NO: 41086 - DNA, 1050 bp, Homo sapiens
tctagatgggctccagagcttctaccagaagaaatgagtagctcagactctgtggagctgagggtgggagataaagttggactggttgcctgagactatattggcaggtatggagtgccaggctggggagcatgggctttcttccacaggtgacaagttgacagctgcttttacattaatacctctattactcagctaggcctgccatacggggtggtagaagttcaaagtcaaggagtcagtggagatggcttcattctgaggaccctctccttggtgtgcaaatggtggtcttcttcctctgttctcgtgtggtcttccctccatatatgtctgtgtcttaatcttatgggacaccagtcatgtcagattgagcccaccctaatgacttccattttaacttaaccacctctttagagaccctatctcctaatacagtcacattctgggtactgggggtgagaatttgaacacaggaattttaggggacacagttcagcccataataacatctaaacataagaaccaccaaaagggaggctgctgtataagggtagctacagggcgatgtggtcctgggcaaggctggtgatgggtgattcagtgaaagaaagactaagaatgctggaggccactgggaagcacatcagaaggcctcaggaagcagcacagcctagtggttatgaatgtggcctctgagttgaaccacttcagttcagatcccagctctgccacttactagctgttgtgggacccttagtcaaggtatgtaatctttccaagccatgctcttctctttaatagtgttgactattcgaaaatgttttggggtaagggtgagaaaggccagcaaggctagggagaagcaagtgtccaatgtgacagggaacctgcgtggtgacaaaaattggaaagtcagaaaagaggccatttggaaggaagagatgttaggtattttgagcataattgagtttgaggcaatagaggaaaactcacatggttatgttcagaacatgagtgaaaataatttttaagttcaggctagcgttg

SEQ ID NO: 41087 - DNA, 1028 bp, Homo sapiens
aaatatactgcccttattctctggtatttttttgttttaaatttgaacagttttgaaggagtaagactgatatgtaaatatatatcaggatatcattttctgaacttagattgaaaaatatgtttcttgacaagtgctcttgacaagcgcatgttctgtagtaattgaagaacatagctgggagaggtggctcacgcctataatccctgaactttgggaggccagggcgggtagatcacctgaggtcaggagttcgagactagtctggcaaacatggcgaaaccccatctgtactaaaaatacaaaaatcacccagggcatggtggcggacacctatatatcccagctacttgggaggctaaggcaggagaatcacttgaacctgggaggcggaggttgcagtcagccaagatcgcgccacttcactccagcgtgggtgaaagactgaaactccatctcaaaaaaaaaaaaaaaaaaaaagaacataggtgctttgccaaatggtgatatttgtgcatctgtgcgctcagatacatacaaattagaaattacaaacttgataaatgagttgagtgtggcttaccccatgtgcgttgtgatggtagcaatgagattgaacgtgccaggggacttcacattctcttgcagctgcttgacagaagatctgttgactctttgggaagacatctgtctttgccatttattccttttaactggggaattggaggaataaaagttgtatctctttccagtgacaaagaacatgttctgtctgagcctttattcttggtgtccttgtctgtgaagagacatttgcttgtcccatctctcttctacatcttgccgtccccccttcttcttcttgtggtgacatccttccttccatccatctctgcatccttccttccaataataatttatgagtcctctaatttgaaggatacatattgctgcttcttttctcctgcaaggaaactgcacatttcttttaagaaatttcttcatttcttaacattttttcagctgta

SEQ ID NO: 41088 - DNA, 1686 bp, Homo sapiens
cccacaagcgttatctggccccaaatgtcagtagggctgaggttgagaaaccttgttctagattaagtggtcagggaagccttgcaggggaggggacatttgggccagcacctgagtgataagaatgagccgtcggccaggcgcggtggctcacgcctgtaatcccagtactttgagaggccgaggggggcattgtgcctgagctcacaagttcgagaccagcctgggcaacacggtgaaaccccgtctctactaaaaatacaaaaattagcccggcatggtggtgcgcgcctgtaatcccagctattcaggaggctgaggcaggagattcacttgaacctgtgaacctaggaagaagaggttgcagtgagctgagatggcaccactgtactccagcctgggcgacacagtgagactccgtctcaaaaaataaaataaaaaaaataaaaaaataatgagctgtctacgacaatatttgtaggaggcgcatttggggaagaggaactatcaagaacaaagtccctgaggcccgggtggctgtggaaggagcagagagaaggctgatatgggtggggtgagtgaagtgggctggggatagatcacatagggttttgtggttgttgtaaggtttttttcaagtgactaactgggcttttgagttatcagagagtttgaatattggtgtttgtttattgttttgtttttattttgaaacagagtctccctctgttgcccaggctggagtgcagtggcgccatctcggctcactgcaagctctgcctcccgggttcacgccattctcctgcctcagcctcccgagtagctgggactacaggcgcccgccaccacgcccggctaattttttgtgtttttagtagagacggggtttcaccgtgttagccaggatggcctcgatctcctgacctcgtgatccgcccacttcagcctcccaaagtgctaggattacaggcgtgagccaccgcgccctgtcgaatattgtgcattgttttgaatttttctctttgattttattttccacagaattatggcctcgaaactgataacatgaagaacttggttctgaaactgagagcatcttcccacaatttacagaattacataagtagccgacggaaaagtcccgcttacgatggcaacacctcccgcaaggcccccaatgagttcctgacctcggtggtggagctcatcggcgccgccaaggccctgctggcgtggctggaccggtaagttggagatgtgccttttactgccctgcaagagtagatagagtccaagctgcatggaagctgtactttgtcttaggaaaaggaaccattgttcttttcatatcatttttaccggctcttaaggagtcctcgatcagtggtagattttaggattcctttgccagttaacttaaaaggttaatagcaggaacaaattaacctcagcttagagaagagtgaaactgtgctaaaggttgtgttttactgagattaaacattaatggttgaggatttgattggtatgaaagctgttagttgacttcagaagggatgttaactgtcaatttttgttttgttttgtttttaatctattccttctctctttctattcagattgctattttatgtgtcacttgagagaaaacagttaaataaaaactaatttaatacaaaatttagc

SEQ ID NO: 41089 - DNA, 1072 bp, Homo sapiens
tcaagtaaaatctatttaaaattagaattgttttgttaaagttaaagccttttgttgttgtttttaacttaccattgttcatcttgcaaaaaaaaaaaagtttcttacctacttccgagtatatttatgctttatgtatcttgattttgacacgtgacttgcctctctctggcccacatagccaaagccagctgaaagaagtttctccacagccgggtgcagtggttcatgcctgtaatcccagcactttgggaggccaaggtgggcggatcatgaggtcaggagattgagaccaccctggccaacatggtgaaaccccgtctctactaaaaaattcaaaaattaactgagcatggtggcacttgcctgtaatcccagctacttgggaggctgaggcaggagaattgcttgaaccagggagtcagaggttgcagtgagccgagatcacaccactgcactccagcctggtgacagagtgaaactccgtttcaaaaaaaaaaaaaaaaaaagtttctccacttcagaggggatgtgtagaattttgagaagctgaatagctattcagcttgtgctggatccaggatcactggacagttttccttattcttgtctaatgtccatcttgtcatctgtcttatcatgtggcgcttttttgggcaggttgtatggaaggggacatacacagcagagtaatcaaaagcttgtgccctagatgcagattgccttggtcaaaagctcagcactaccgctgatgagctttgtaactttggagaatttatttactgttatcatgccagtttccttaccggcaaattagagataaaaacatttctaccttcacgggctgttttcctgagataatacatgtcaaacactgagtccagttcctggcataaagtgttcaataatgttaagtattctgttagtttcagtttttaaatggtaccagattcttgccttgggatgctattgagatggcataatgtatctcaagaaatatcgtcatgtttttttaaaaatgatgaaacaatttaggacatacagaggcaactgaatacagaaatttataccc

SEQ ID NO: 41090 - DNA, 1030 bp, Homo sapiens
ctggaggagctgggggtcacacggattggacaccaggagcttgtgttggaggctgtggaccttctctgtgcactggttagttcaggaaaagacggtctgtaccgtgatgacgttctttagagccttgctctcttaagccgtcattgtttgtgatttagcatatcactctttccttaatgctccatcaaaataaaacatgagctgaagatactataggaaggggaaaaataagttattttctacattaaaggttggcaaactatggcctgcgagttaaatctggcccactatctatttttgtaaataaagttttataggaacacaaccatgtccattcacttacgtgtttgtgactgctttcttgcgacagtgacagaattgagtggttgtaacgggaccacatggttcccccaaagcctaaaatatttattaacttgtcctttacagaaagagtttgtctttttcagaaaatctctgtattagtctaattttcttttataaggaaaaaatgatggaaatactcctgaatgaaaatgtcaccttctggcgaggcgcagtggctcatgcctataatcccagcactctgggaggccgaggcgggtggattgcttgagtccaggagtttgagaccagcctgggcaacgtagcaaaaccctgtctctattagaaataccaaaagttagccaggtgtggctagcacgcacctatagtcgcagatattcaggaggctgaggtcagagaatcacctgagcctgggaggtggaggctgcagtgagcagagatcgcaccactgcactctagcctgggtgacagagtgagaacctgtctcaaaaaagaaaagaaaatgtcatcttctaaattgaagtgagaaataggttctgattttcatgtctgattttgttactataaaaagcggttgagtttcacagatatttgtgatatttaaataactgatatttgcacttgacatgacctataaaatgggaaaaaaatgtggccttcattacattttgtagatgatgggttttgg

SEQ ID NO: 41091 - DNA, 1048 bp, Homo sapiens
gacatttcccagtgttcacaaaattgtctatagcttttttttttttgacgtagaccaaacaaaacatatctatggaccagtttgcaatttcctctgtggacagccatggtcaggtgttaattgtccagtgagaagcgcacctgtaagatgtgaataaaattggctgcatagtaattaatcagctattcagtaaacttttttaatgtataatttgtttttcctatttacctaattccgttattcctaaaattgcaacatgtaattccatgcaggtattatttagccagaaacactcatgccctgatgtattcagcaaaccactgaatagttactcttcagggtaaaaacaggaattcggcttctcttggttgagtttacctccccatagtggctatataatattggcctctgatgggagctgtttgtgtttgcacagaaagttttcacatatcacctaaaatagggagtgtgcccccatctctgtgctggttagtggggtcctacgtaaattagtaagttatctgttgactcaaggttctttccatcttcaaggtgctctgcatcgggaaatgaagcaaacaagaaacaccagcttcagttcttaatccagaatggcactcaccccaaaacacaattcacaaaacttcttaaacacaggagaatattgtagtctttcagtttgcgttgtaagtatacaggctatagagatacataagtgtatatacacacatatacagataaacataccatacatatttattgtgaatgacattttgataaaccttcattagatttttatttcaaccattagctccctttctaaaagctaaaaccaaaaaagtacaaatttccttttttgtaccaattactctgctttatgctagggacagccaggtgagttaggtgtaaatgaaatccgtgtccggaagctggcaatttagtagggaggcagcagtgagcagctgacatgtatagcatttctctctctctctctctttctctcgtttttgagacagggtcttcctctgtcacccaggctggagtgcag

SEQ ID NO: 41092 - DNA, 1058 bp, Homo sapiens
aagccttaaccccttgctcacacccagctgtgagtcccccaaaaggagacagtctgtcagctccatcagaggaaaacccctacgtgctttctatcagaaaaggcggcgattatgataatctgaatcatgctttcctgaggataaccttttagtgaaaggaagcattctatttcctattttcagagatttgtggaaaggggaaattcagtgctttgggattgggagtggatgtgtgtgtgtgtgtgtgtgtgtgtgtgtgtgtttctaattttacttacatatgcattaattgaacaattttgcatgttctcacagtaattttatattacattgtcttcaggagaatcaagtcaaaatactagttggaatatgatctttgaaatagaggaaaactagcttaatatgtagggtggatcagacttcatgtaacacctgttaaagttgtcagcaccatcttaacagagataccaactggagtcttaaactaaccatgagcagatgacacaactgtgggtggcatttaggaaacgactctgtacactaaagccttaaattgttactaataagtatttaaaaaaacataaatactctttgctattaagatgcctggagacacatggtttgaagtggtttgattctaagcaccccaggccaatttgaagaattttacataaagctgattaaagaaaaacccttcctggagctggagaaattcttcattcttacttggatcaaatcagagatggacaggccgggcatagtggctcacgcctatgatcccagcacttcgggaggctgagacaggaggatggcttgagcccaggagttcgagatcaacttgggcaacatagtgagaccctgtgtctaccaaaagaaccccccacattaaaaaaacccggtagagattggcaccgtggaatagagaaacttaatgagtgtttaaaccaagcttttcaagagaccgtttcccaggcacatacatgcggggcgtctcaacatcctgtcaccattgttcttgaactcacttcttcaacaccagcctcacctgggaacataga

SEQ ID NO: 41093 - DNA, 1030 bp, Homo sapiens
gaactatcgacttacaaaagctcgtctgcttataggactatttttagtgctctttgctaatctctttacccaacctttattttataaatacatgctactgataagcagctcttcatgtagactttgctactcttggtattgcatgaatctgggtagggcgattatgagaaccatagaaggccttagatttaaaactgtctaaacctggccacagtcgacagctggatctcacctccttgttatttgacagatgtgtgccttaggaaagaagttcttgtctacagaatgaattaacctgtctggcttttattattaatgtttagctacactgtcaccaattttaccgtaatgttagtggatcctcagtaattattaagcagtgtgtcaggcacatgtctaagcattgtacaaatatcagctcatttaataggcaccaccacctttgaggtaggaacagttatttccattttgcagttgaggaaaccgagtcacacacagattgaccgatgtcacccagcagagcaggtggtttggcttcactccactccattttctcaggagtttcttcccaaggccacatctagaccacaccgacaatctttacatttatgaatagaacttcaggattcggtctgaatagcatatggtagcggaggagtctcatccagtatatgtctgtgttattctctatctttagttcatgtcagaaagttatttgtaagtcaaattaattcctagttcatggcgccttgccagtcagttcagtaaaggcctttgcaaagcaaatgatcttttacaacgtgtagggttagccgcacataacagaaaacccagtgggttaaccaaattggggttccatggcgctgccatcttgttcagccattcgtagcacatggcgtagggtatggcctggcacatggtgttcattttcatacttaatgcttcagtgcaaggtggcggctcctgcatgattgtcttcctattccaggcagaagggagtctcatggaagacagaagacaggtagcagcc

SEQ ID NO: 41094 - DNA, 1033 bp, Homo sapiens
ggtgcccggcgacccgggggcccgagtgcagaggcacaaggtgcctttgtgtgggtgactcccgcgggacctcgtccatgccgcctgcccagagccgtccgcaggcgtgacagggctgtcggacaggtagagggagactccggcgggtccgccgagcctgtctgtttttgttggagaaggcgagagggccgcgcaaaagccaacaccatagcatttgcgccagggagaaacctcgagccaggactccccgggaggcagtgacttttgctccgggaggcgccagtatccccggtggcgctgcattttcaggccacatgtaagcactgggaaggagaaatataattgtttggaaccactgtcttgattcatacaatatttgggatgaggaaggcagtggggctggggcggtgggggggtggtggggggaatgagcagaggtagaagcttgtcctcctagctggctcgcttacttttcaatgtctcctacgatttcgagggaaaggtactagagtttactcaacccttttctgtactttcaagagaacaaagtccaccaagaacaatctgtattttcatggtttccccccacccccaacgacatctctgtttcaagttactatttgtttttctatctgctcttccaggtgaggaatggtgttctttctcagtaataactagaattgtgtagcgctttacagtttgctaagagctctctctgttattgtccttggtcatcacagtaagcctgtgaggtaggtaatactggtaagaccaggtcgtctttcaaaccgtcccacccatggctgcagcataatgaaaactgatcaccgctacatctcatttctcacgcctgtgacttacacatagaccacgtggaataggatgtccgaggtgtgtggggtgtgtcagtgggtatgtctgaccatttcctgctcctctgggagaactccttgagaacgggtttgtcaagtgagcagaatttcctggactcctatataaaatgaagctaaaaacaacacatgtttctgccttg

SEQ ID NO: 41095 - DNA, 1035 bp, Homo sapiens
tctttccctgatgaccacagacctctccaagctgggcactgttctatggtgcgttttgttaaagtctaagggaagtcctgtaggaagaggtagttgttactaaacttgaggaaacatgaaacaacatatagcacacaattcaaaaaacttactaaaatttattaagagcatttgacatcttagttaagtcactgttcataactactgttccaccatagaatcttcacaagaacagcctgctggacttcacaagaaggctgatggatgttgggggtgggcatttggggtgtggaaaggccgcttggcacattctcagcatgcgccagcccacaccgccccttaccaccaaagccttctatttcccattccatccagtaggagcagctgtagctgacctgaaaccttcggggacaggctcattgattgtttaaatagggaggtgcaagctctcaggggtccggggccttgatgacacagctcaggcaccacaggcacctcccacaagcgcgtcaggctgtgtgaggctgagcacagcttattttcactttcttgtccataaagtctcacatcatattcagttgttttccttctaccctaaaagaaacacaaccagaaaagccagtctcccattttcatctgtttaaggaattatgtagccacaaggatctttagaagcaagtcctcttaggagaaaatgacaacctctatgggatttcaacaatggagttccttttgaaaagcagtggtgcagcccacacctcctaaattgccgtactttcttcgccttttgttgagtctgtatgagatcctcattaacaagtttaacaattcctggagactgaggcttttgtcaattatgacgagacttcccatttcctagaccatggtctccgttagcatttttgtgtgtgtagttactgttttgaatccatttccctctgtctttaaatgtttttcctttggtatttgaatttgtccttgtgaatcaccatgagtccatttttggaacaaatcagggtataaatctcttataag

SEQ ID NO: 41096 - DNA, 1034 bp, Homo sapiens
tatccctaagttctagttaatacctgtttgcaaaatcctgactgaggttagtacttgttttacttcaggtgcctggtactcaaaacaattaagccactgttttttgtatataagaacatgaggtcctttctaattgggaccagaatcatttcctggcccaaatgaagccggctattctgaacaattcagaagtagtgatggcagatctcaaaaatacataccagaaataaccacatcattagttgtatgtgaaaggataccagaaataaattaaccctttattttctttgtttatttttaagaggaaggaaaagaccacctactttgtggcttggctgtgttttaagaaacaaaaaggctttcgattccatctttctattcctgttcccctatctagcccatctggcactgcttactgccttatttgagaaaaatgtaatggtttctgaaatactgcagtactgactttctttgtcattctgagttaattttgaatggtatgctaaagtggctctgtcgtgattcatatgtattttacaaaaggtgatacaggctcttgagtcaaagacacttgggccagttcttagctttatacctctctgtgcctcagtatcctcttctggaaaatggggaggattgaaatacttcgttcatagggttaaataagttaatacattttaagggcttagaccaatatttaagccacagaaagtcctcagtaatttaaaattgacatcattattagtatttttatttcttatgtattgtgacaattgatgtttaaaattatttggatcttttccctttttctcttccttccttgggctgatttattttcatagaatcttggagctgaaagaaacctcagacagacaatctcaagcatccttgttttttcagatcagaatgttcagataggatatcaccccatgtcatacagtcttcagcagccaacctgcagcgtccagatctctctccacccctcctacctcacagggtcatcccgcatcctttccccttttaccacaacactt

SEQ ID NO: 41097 - DNA, 1051 bp, Homo sapiens
gctaaaaatctcaaaagtcaagtaagttagtatttgctaaagtcatgtagctgacaatatagtgatgaaagacatatgagaaaacattgtccacatccaaaactgaacttctgtctaactaccctagtgggcctgccctccctgcacctcttattcactatgctgactaatggcatcatccacccaggtcatccaagcctaaaccttggaggtcatcttaagcaccacctccccagacctttacaactgctgaccctcagaactagtcagtcgttaaccagcttctgacattacctaaatttctcccaaacccatcccaattttgtacccaattcttctgacttaatttaagtctatcatttttgtcagaattactagatgaattcttcagtcatatgtatagatatacacgtgctccacaggttaaaaaaaaaaaaagtatgatatttttggtcttttgggttttgttttggtaactttttatcaaagaagaatgaataagtatattcgataaattagactatgatttctcaaactcagaactgttgacatttggggccagataattctttgttgccagagtctgtcctgtgcattgtaagatacataaaggcatccctggcctcttcctactagattccagtagcactacctcagttaagataaccaaaaaagtgtcccagcattgccgaatgtcccctgcaggctaaactcaccccagggagagccactggattagactaagaaccattgagtaacactagtcatatgctttctgtgcaccaactgctttctgtgtatcatctcatttaatccccacgagaactctgagggtagatgccattcttaagcaaaccaagaccttagttaagtaatgcatgctgtgtaaccatgcacccacaccagggcttgcacccgggtagtttgactccagaacctggttccctcaggttggaaccatctccccacttactagctgtgtgaacttgggcaagttagggaacttatgtcacctctgtcgccctcagtgtcctgtaagatcctgagaata

SEQ ID NO: 41098 - DNA, 1084 bp, Homo sapiens
ctggctaacatggtgaaaccccgtctctactaaaaatacaaaaaattagccgggcatggtggtgggcgcctcaagtcccagctactcaggaggctgaggcaggagaatggcatgaacccgggaggcggagcttgcagcgaggcgagatggcaccactgcactccagcctgggtgacagagcgagactccatctcaaaaaaaaaaaaaattcattttctcaaataagaaagaggaagagtttttacagagatgataaactaattcaaggctagtactctaactaaaccttctgcatacaagaagagaaagtcctagacgcacataattgcaacacaaggtaagataagctaagcgctaaaaatagaggttgggcagattcctgggtggttgagagagggagattaatgctcagaagaaatttactaacattcattacttattctcaatcaaaactctaagaatcagatatagagaatttcttttgtgatacaatgaggggcttacttacaaccactttcgggattttttcctgtgagagtctgctgtcccttctgtttctcaatcttttaactaactcaatcaagctttaatggcagaactttcactaccattgaactattacaatcctgttctgactagttgaactgaattactgctgaactttactcttattaagctctctagtgtagttcccaaaatttgaacccaaaatactttgtgtctgcaaaacagacaacctctgaggttcttaaaattagactaattaattggtctactttagtgtctcttaaactattagagtctgtagtatgtagcttttaagttagaatttttttaattttgtgttttcatttcactgttaatgaaattatttacatttacaagacaatgtcttttgcaatgcaaattcagaactaaaattgttttcatgacagaatacaacctgtttcttaagtttctcaagctagcttttctctattagcctctgtagatccctgagaatccacatatttctggggttccacgcttaatcttttttttcagctactctgcacatttctcaagtttgggaaatactgagcta

SEQ ID NO: 41099 - DNA, 1050 bp, Homo sapiens
gcctcccacagcgaagaaccacccaacattaatcagcccaagatgtcagtcatgccaaggttggaaaactttcctttagatgatttggccataaaatctttctctcaggagtcttggaacttcccatcataaaaacgtaggaccgttgcatgtttgttaggaaccctgagatgatatcaccacttttcttaaggtctttgtcatttcctcttcatgaacctgctaattctcttgggttggtttgaattgggcccatgctgagttttctttgttgtttttctcaacctttggatatgttggttctgacagaaaccattcttgtttcctctgcacttatacaacttctgacaccagatgtgtgggttttttccacaccaagcaatctccaattctccgaacaccagctgggtatcctgcagtttcattcaattctgacactgtccacatgtttttagtgttagatcccacaagttaagggccaagtcccacaagactgcgcctcacttcagatgacagtcacaaatctgggcctctaggagttctgagcgaccagctataaaataaatcagagggttccatgtccccctcctcagattgaatcatttttcagaatggctcaaaaactcagggaaacaccttacctacacttgagtaatgggtaatcaattggtctcagtgaccagccccatcttgagctacctagaggcctcatcctaagttatctcattactgtaaactctgggggacttgtgaatttaaagcaagacatgccgattactcaggaaatttcaagggctttaggagccagcgacaaagtccaaatatatttcttattaaaccacatctgtggatttatttttctcagccgacatgattattttggtatttctgctcttgaataacacaatagagatacaaaatactatgtactctatttgtgtggggggaaacacaaagaaacagaggcttaagaagaggtggagtaatattttcggtgactcagcatgtcagttgtggttattaataatagtgttgcttcgacttcaccat

SEQ ID NO: 41100 - DNA, 1033 bp, Homo sapiens
ttagctcttgtgttttacatatatgcttcccctcttcatggtttgattttcggtttcttcttttatagccttatgtaatgatgccttttactctaaactggcatacatctcattttggaagaatatagaattgaacactaaaataaaaatgaaagaagagtttgagagtgtctgtaaaaatactcatttggctgtaatctggtgcctgcatttgtgattggctgtgcctttaagcacattctgtgaaaacacctccagggttttgaagtgtaatgctccattgttattctcgaatgcatataatagtgattttcccaccccctccaccataccccatgtatcattatggtagtgaaaacatttctgctactggttggctagaaggtcttcatgtgttattgcctaatatcatttgaagtgtttaaaagggtactgtctataatcataatatcaatttagtctgtctagcactgtttccccataattgctttaaggacttcacataaatctgttaacatgagcgttcattccttctgcagtggggagttgcaaagtagatcaagctacaaattgtcaagaaggaggtgtaccttttaaagtgtggggaggatttggtttgtcattgactgagattgaaaagtgaatgggaatccaaaagaaatgtagttttaaacctaggaaaggagctgggtatggtggctcacacctgtaatcccagcactttgggaggccaaggcgggcagatcacttgaggtcaggtgttagagaccagcctgggcaacatggtgaaacctcgtctctactaaaaatacaaaaattagccaggtgtggtagtgcacacctgtaatcccagctcttagggaagctgaggcaagagaattgcctgaatcccaggagcagaggttgcagtgagccaagattgcaccactgcactccagcctgggcaacagagcgagactccatctcaaaaaacaaacaaaaaacaaaaacaaaaaagaaaacccaggaaaggaaggtaaatttatttatatta

SEQ ID NO: 41101 - DNA, 1057 bp, Homo sapiens
ggattcatgctcagcatgttataaaggtaagaaaaacatgtctagtatgtttagtatagtatagttttgtggtaaagacgcagacttcagcatcagactgcctgggtttaacttcagattctactactagttgggtgactttgggtaggtaattttgtcctctgtgcctcagtttgctcttaggactcatatgaggattcagtgtatgcctgatacttagaaagcactgaataatatcttagttataagtaatcagttaaattattatccccatgccttgattacctctggtgattaatgactgatcaggagactgctgatctggaaagaggtataggaggaagtcgtgttattccattggagcactagaaaattctccagtgctatggaaacattggggtgttttccaactcatcaaacttgcattggacacctagggtttcttttcttgatgttgtcacattctgattgtgcatttctaggtttttaagtttttcgttgtttcttgttacatttttatgactgactggattctctgtgctgtggagaggagtgaggagatttcctgaatctcaaggagcttgaggccttgataggtttttcctctttctgaactggaaataacttagatttcctgacatctcagggaatttgaagctttgataggttcttctccatttgtgaactggagataaattcgtaaatcactcgtaccctttcagagaagtagtacagatttcctctcattttttttttttttctgtttattttagagcaaacctgtgcaacacacggcccacgggctgcctgcggcccaacacaaattcttaaactttcttaaaacattatgaaatttgttttgcattttttttaagctcatctgctatcgttagtgtattttatgtgtggcccaggacagttcttcttccagtgtggccgagggaagccaaaagattgcaattgcacagcactgttttaaaggcttcatatattaaaaataataatagctaatatttatggagagtttatcacagtaaatactttgtgatatggtttg

SEQ ID NO: 41102 - DNA, 1040 bp, Homo sapiens
aaacgctggcaaacagtgaaatagattgtatcagggatcttgtaaagggatttcctcataggggaacacttaatgtcttaaaggcctttgattcctccataattctaaaattttaaaagagtcctgaacctttggctcagatgagaagcaatttatcatgtgactataatagaataatgtagttatctacgttattacttccatacaaaaggacaaattgattttaaacgagtatattctcatactaacttgtatatatattaatggaaaaatgttaatttctgtcagaacggtttgagaagttgtttttgaaaacctagaactttgtgtgcatgtatctgatttttttaagaaacctagcagtttttccctaatcttgctttatctagtttttatgctttaaaaaattacataatatttccttttatctagttttaccagtctatactaacagaattggtttcagatactaaactttatgttgagatagtcacatggcacatattccttgatcaaatgtggaatttaatagtgatttttgttttgaactgtgttcttattttaagaattatatataagttggaggtggacgtgggaatattattatttttggtgagatcatgagattataaaaagaaactaaataactgtataatccccttcgggcttattcgtgtagccctttttggacatagggaatactcacctgacttttttgctcttaaaaagacttcttgtccctcatatctcaccattcgttgggtttattctttcttattaggccagggggtgaaccagatttccattcattcccacatattcccctctttgatatgaacaaaagatctttgaaggcagattgttgaaaagagcgactgccacccttctcttctcagtttcccccaaacccataagtcactgcgttcctaattccagccttgttttatctcattcgatttatcatcatctgacatactgtatatatgttcttcccatttgtttgttaattgactcacctgtctggaatgtaagtaccatga

SEQ ID NO: 41103 - DNA, 1063 bp, Homo sapiens
gaaactttacaagcctaggcgtttctcggcttttaaaaaatgctgtgagttggttttcccagcaaggaaggttgatgagcatgcacttggctccaagaagcagctattacacaaatagaatccaagtgcctggctaagccgcccagcctcggtgcgtcgggtaacagccaatggcggcggcctgccagcctcgccccgcccacctcccgccggccccgcccctccacctcgcccccttccgcggccccgccccgcctccccgccctgttcttggcggcctgggctccgcggccctgctggcgtccttcgtctgtagttcctggcttttccaccgtcagccactcgttttaattacgcgaacgggttccaactcatccagcctttaagtttgggtggtggttttgagagggggaaagagatgcaccaaaggaagtaggggaaaaataaaaccttaagcgctgggcgcgccacgcgggacgcagaggttaggggcgcgcggcgaggtagcggggcggcggcgcgagacggcgcaggggaaacactcggtgcctgcgtgagtctggccgcgccggctcatgtgtacgcgaagctgtgtcagcagaaactttagaaaacacgctgtgcgagcggccgccgcctcccgcctccaggaggagcctgcgggcgcgcggggcggacggtgcctgcaggcggcggccgcgcttgcccggaaaggaatgtggctgcggccggcgcctccttccgcggggtcccacaaaggctcatctgtgcgcggcgcggcgccgtcggaggagtccgagcctgttcagtcaggctgaggacgcggttgttttcgtccccctgtccccgcccccacgagcctacgtgcggggtagggagggcggcaccggaacccccgcccgggtcgggccgaaaggagcgagcggggcctgccggcagaggccgccgggctgctgtgtgactcggtcccctccgcgctcgccgccctcatcctcgcccagcgcctccgcggcagggttaattccgcccgctgcctggtggtcccactcccgggggattccgg

SEQ ID NO: 41104 - DNA, 1058 bp, Homo sapiens
agcgaacactggggcactatgatgacgccagatgactgcacactggggtactatgatgagtctaggtgagtgcacactggggcactatgatgaggccaggtgagcgcagactggggcactatgatgaggccaggtgagcgcacactggacactgtaataaggcccggtgagcgtacactgaggcactatgatgaggccaggtgagcgcacactggggcactatgatgaggccaggtgagcgcacactgggacactatgatgatgccggatgagcgcacactgggacactatgatgaggccaggtgagcacactctgcgacactatgatgaggccaggtgagggcacactgaggcactatgatgaggccgggtgagcgcacagtgggacactatgatgaggccaggtgagcgcacactgggacactatgatgaggccgggtgagcacacactgggacactttgatgaggccaggtgagtgcatactgggaccctatgatgaggccaggtgagtgcacactgggacactatgatgaggctaggtgagcggacactgggacactatgatgaggctaggtgagcgcacactgaggcactatgatgaggccgggtgagcgcacactggggcactatgatgatgccgggtgagcgcacagtgggacactatgatgaggctaggtgagtgcacactgggacactatgatgaggccaggtgagtgcacactgtggcactatgatgaggctagttgagttcacactggggcattatgatgaagctaggtgagcgcacactgtgacagtaagatgaggccaggtgagcgcacactgggacagtaagatgaggccaggtgagcgcacactgggacactatgatgaggctaggtgagtgcaccctggggcactatgatgaggccgggtgagtgcacactgcgacactatggtgaggctaggtgagtgcacactgcggcactatgatgaggccgggtgagcgtacactggggcactatgatgaggctagctgagtgcacactggggcggtatgatgaggctcggtgagtgc

SEQ ID NO: 41105 - DNA, 1034 bp, Homo sapiens
tgtcttgttagaccaaggcaggtaagtttgcccagcattgacaatggggagaaatcagtgccagttcagtatctaccctgctccccggcccaccctggccaacaagcacggcttgactgttcagtttgtgttcatcgattactttcaactatggtattttattatttgattataattaagatagcaccaattttatcacaataacttaattctggaaaaaaagatgaacatttactttgggtttgtagtctcctaaatcagctgtgtacatgatcatgggaatgcatgctgggacactatgatgaggccaggtgagtgcacactgggacactatgatgaggccaggtgagtgcacactgcgacactatgatgaggccaggtgagcgcacactgggacactatgatgaggccaggtgagtgcacactggggcactatgatgaggccaggtgagcgcacactgggacactatgatgaggccgggtgagcgcacacagggacactatgatgaggccgggtgagcgcacactgggacacaatgatgaggccgggtgagcgcacactggggctctatgatgaggccgggtgagcgcacactgcggcactatgacgaggccgggtgagtgcacactgagacactatgaggctaggtgagcgcacactggggcactatgatgaggccaggtgagcggacactgggacactgtgatgaggccaggtgagcgcacactgggacactgtgatgaggccaggtgagcgcacactggggcactgtgatgaggctaggggagtgcacactggggcactgtgatgaggctaggtgagcgcacactggggcgctctgatgaggccacgtgagcgcacactgggacactatgattaggccaggtgagcgcacagtgggtcactgtgatgaggccgggtgagcacacacggggacactatgatgaggccaggtgagcgcacattgggacactatgatggggctaggtgaatgcacactgggacactgtgatgtggctaggtgagagcacac

SEQ ID NO: 41106 - DNA, 1031 bp, Homo sapiens
acgaggtcttgctctgtcgcccaggctggagagcagcggctactcgtgggtacagtcatagcatgccgcaggcttgaactcctgggctcaagggatccttctgctttagcctcccgaatagctgagactacgtgccttgctactgtgccagcaaaatttttttttttaactttttaaatgtttttgttaaaaatgaaacacaaacccattagcctaggcctacacagggtcaggatcatccatatcactgtctccacctccgcatcttgtcccactgtgaggtcttcaggggcagtgacatgcatggagctgtcatctcctgtgataacaacactttcttctggatgcctcctgatggacctgccctaggcattttacaggtaggtagaaggagtacactctgaaatagcaataaaagtatactatagtgaatacataaatcagtaacatttattattatcaagtattatgtactatacgtaattgtatgagctagacttttataggacgggcagcacagtagatttgtttacacagcatcaccacaaacgtgagtaatgtgttacgatggctactcagtcactaggagacaggaattttttagctccattataatcttatgagaccactatcgtatatgaggtctgtccttgaacaaaaagtcagtatgtgatacatgactgtataaatgttatatgcatattactgtatacatgttatgtttcccaacaaaaaagaagtttactatgacaagcttaatagagaagagtagctcttgtgttacattttgattgtctatttatgatgcattttttcttttctctttaagaggttctttatttcttacatatgaagttctggccctgaagaaggctgtgacattagatactcaagtggtagaacgagaaaaaatgaagtcatatatatatgtgcacacagtttctttagacaaaggagaaaatcatggtaagtttattgtaaagtaatcctctgtgaaaaatggaagctagttattgcatttaaaaatgcgt

SEQ ID NO: 41107 - DNA, 1060 bp, Homo sapiens
tttgaatgcaatgcatgtttatcaccttttaaaacatttaataatagacttgccaaggttctttgtgtagcatagagatgggtacttgaatgttggccttattgtgagtaaaacgtcgtcccccagctttccctgccgtaaatgctgctctcttccctcccgcagggagctgcactgtgcgatgggagaataagaccatgtactgcatcgtcagtgccttcggactgtctatttgacctgcagtccagcctatggcctttctccttttgtctctagttcatcctctaaccaccagccatgaattcagtgaactcttttctcattctctttgttttgtggcactttcacaatgtagaggaaaaaaccaaatgaccgcactgtgatgtgaatggcaccgaagtcagatgagtatccctgtaggtcacctgcagcctgcgttgccacttgtcttaactctgaatatttcatttcaaaggtgctaaaatctgaaatctgctagtgtgaaacttgctctactctctgaaatgattcaaatacactaattttccatactttatacttttgttagaataaattattcaaatctaaagtctgttgtgttcttcatagtctgcatagtatcataaacgatttcttcatagtgagtggctacagaatctatacaaccagaccaggcgcagtggctcacacctgtaatcccaccactttgggaggctgaggcaggcggatcatgaggtcaggagatcaagaccatcctgtctaacacggtgaaaccccgtctctactaaaaataccaaaaattagccaggtgtggtggcgggcgcctgtagtcccagctactcgggaggctgaggcaggagagtggcatgaacccaggaggcagaggttgtagtgagccaagatcgtgagccaagttcccgccactgcactccagcctgggtgacaagagcaagagtccgcctcaaaaaaaaaaaaaaaaaaaaaaaaaaaaaatatatatatatatatatacaaccaaaaaaaaaaaagttctgctgtggtcctctccatgatgtactca

SEQ ID NO: 41108 - DNA, 1023 bp, Homo sapiens
cgtggtggcgcatgcctgtaatcccagctattcgggaggccgaggcaggagaatcccttgaacctgggaggcagaggttgccgtgagccaagatcgcgccattgcactccagcctgggcaacaagagcgaaactccgtctcaaaaaccaaaaaaaaagaaaaaaatttcgtttaaggaggaatgttttcagggaaaataaaactaaaacttaaggactgattctagagtttcagttttgatctgatttcctaactagcacacacttcctgtgacagtggcataatcagtgtttgaatgctgatggcaaccaagtgaataatgacgagaagagctggttcaggagcagttggcaaagaaaaaagcctttccccttaaactgttactaatataatattggaaaatgtcttgtattacagtaatatcgagtaaaacttctaaaaaagaaatcgctttgtaaaggaaagcgcttaatactgcagtccgattctgactcccacaaataaggtggctaagtggcttcattattcgagatctcaatcgcatatgtgtaaaatgaaggggctggacagagtgatgagtgttctacctgggatggaggccctgggaggtggagaccatggctgtcttgtagtaggcatgtcttaggtatttactgaatggcccgttctggtcctcccaccagcctcttagcagccttttctgcatctcttctaacttcgtgtagatgcctgggcctttgtaactattctctcaactcaccattcatctttcttggagacgttaaaactatccactggattcaatacaactctgctttccactaaaaattctttaaaatgtccctcaacctttttcgtactgtaaccatatgggaggtgatacagtgcctttcctttgtgattaaggtcacggtagtcacttggaaggatcctttaagcttccagaaatgacttaatctctaagatattgcaaattgttcttcactcagtgagttggttttgtttccaagtccgacttctgag

SEQ ID NO: 41109 - DNA, 1043 bp, Homo sapiens
gggaacagattaaggttgcagatgccttgcagccaaccacttggcttaacctaggacaggtgggaactatttgataatagcatataacacattgtgcctcttgggttagcttcatattattttaattgaactaataagaattgatttgcgaatctctcttagccaatccaagaacatatgtatacatctaaccatccacttcttctttttaacctcaggttaaccccaaagattggctttccttggagtgaaatcaggaacatctctttcaatgacaaaaagtttgtcattaaacccatcgacaagaaggcacctgtaagttccaaaggattctattcaggggctactgtttttcattcttatacttgtcagggtaacggacaagttatactgtgacgagtagccagtgatagtccaaactcctcatgaggttacattgagggccagagatcctgtgggccaggcaattgctgcaggggagaccacttaacttttcaaatgattctcattccttatgaagaaaagggcagttctgagccattggccaaatgataagcatttcccaaaatgctgtgtttttggtgtggagagccagcctgtccccttgaccacctgggtgcagggactctccccggcacctgacggacagtgggacctgcgagtctcaagggccagatttgcctttcagagctgtcctggaacttacccaagatagggacagtcagacttgcacccaagcattgctggtgcccaaggtttcatcggggcttcacccacttctgttgtcagaggtgtgcatcctcacacaggtgacactggcaggcagtcattttgggaggacatggtaagaaggcgacactttatgtcctgaaatctgatagtattgattgtaatagctgcaaagaccagtgcattatgtaaatttggttttatttattctgctgacatttaaacttttgttaactcagaatatttgagacatacgcacataactgtagcattgtagaatgggtaaggattttgttatctaatcagaaatctag

SEQ ID NO: 41110 - DNA, 1030 bp, Homo sapiens
tccttgggctttaattttccaactttggtcaagaattaaaagttctttaactcaaaagtgagtcataattttcatgtttaacctttttgttttgatactgcagttatgcttatgagtggctatgaattgttatatgaggtttcaaagtcctaagaggaaaaactttctaggcacaccagagagccggaggcctaaattttctaaggtcagaacctgttttgagagtcctgtgtagagacaggagccggagaggggatcccagccccttgaagtttcaggatgcggcacgctggctcacagtgctatgtgctgtgggcggagcctccggagcttggatcctagcttctctgttggtgccagcaggctgctcttgtgttttgggagaaagtgctccagaagcaacacatgcctacctggtgccactttcacagcctttcaatgtaaggaggacataggctgaagtcagtagcagggcaaggtggtatctggagttcccctttaatgctctgaaacctgtaaagaaaattacatctcgaagataaaagaacaaactcattgcatgtctgtttgaatgccaggtgtgtttttttttaatggggattggtgattctagagcatagcactgtaaaagaaaggatgtatacaaaagctttgacatttagaaccatggtctggccagtgtcctgccatcattcctgcaggcacaccatgactgactgcgctaattccccagaagggccatgtcaggcttacatgtttgccctcagcctacagagtccaccccactgccttgatctagttgatgtgatcataacgaaacctgtattgctcatcagtattgaagctgttggtaggccatagattgcttgaccttcctgctacttctaaaatgaaggtttttgtgggatgttggaaaggactgctttggagggcagcattgttggatggtggttttgaggatttgtcgttatttccagaatggcattatccctggtaaaatgtgttggaagaatagggtgggaagtgtcag

SEQ ID NO: 41111 - DNA, 1336 bp, Homo sapiens
aaatgacctgcatgagtccatctccatttgcaaccacgcggattcctgccagaccccagggcacagatctatttcacttgggcaagtcagggacctgtgccagctgtgcccaacctcctctcacctccggggcccacgtggtgatactgcacagggagggaggcaggcgctgtcacaggagctcctcagagaacctggaaatgagatattgaggactctcggttcgctcctactccaagtgtgctggatgcagcattggtaaagaagcacggaaaagccaggcacagcggctcacacctggaatcccagcactctgggaggccgaggcaggcgaatcccttgagctcaggagtcttgcccagcctggggaacatggcgaaaccccgtctctaccaaaatttaaaaaattagctggctatggtggtgcacgcctgtggtctcagtcaggtggctgaggtgggaggatcacttgagcctgggaggcagaggttgtagtaagccaagattgcgccactgcactctagcctgggtgacagagcgagaccgtgtctcaaaaaaaattttaaagaagtggggaaagtgggtacttggaaccaggacaccatctttccgggagaccctagagctgaagccgtggctattaagacagccatgccaaggagcagtgcacaaagtcctcgtgggaacgtatgtgggaaactgcctctgccttggaaatctcttcaatgaccagattttgtaacgtggccaggccagggctgtccaaacaggtttttcaacctgcaggaaaacagccatgggcaggaacttgctgatgtcagcttgtaactgccccagcccacgtaagtgtccatttcttccaagtaaaaacgtgagctgtgtgccctatttagtgctgtttttgcgctctgctccccctcccccaccattgagcgatgaacgtggcaactctctcagatggttctttccccacagagcatgctggggtgttgggcaggctcactttctgcctctcttctccccattcctgaaggcacacccctctcttcatgaaaaaagcatttatgtagatattcagtcatttaataggcccaaattctttcccttttgaacaaatattgacaacttggtagcagcataagcaggagactgtcctgaagtctgaggagtgctgagaactcgccagctgttgcgctgttacctctctcggtagaactaggagaattagatatgcctgaaacattgttcaggtgagaaagctgatctattgaatatggaaattgagctctaagagatttatactctgcaagtaaagtctctattaaaacacctgttt

SEQ ID NO: 41112 - DNA, 1048 bp, Homo sapiens
gaaatgaagatttagagaaataattcactttttaaaattggaagatttttttaaatcaagtatttattagtgatattactacttacttattaaatacttttttccccaataacagctgcttcaaatacagcgttgttttttttttttttctttgagactgaatctcactctgttgccccggctggagtgcaatggtgcaatctcagctcactgcaacctctgtctcacaggttcaagcaattctcctgcatcagctccccgaatagttgggattacaggcacatgctaccacgccctgctaatttttgtatttttaatagagacagggtttcgccatgtttgccaggctagtctcgaactcctgaactcaagtgatccacccgtcttggcctcccaaagtgctgggattacaagtgtgagccaccacgctcagcttgcagccttcccccatcccttttgggtgagtgggaagagggggaagaacaggtcagtcctgggcatttaataaacagacttctagagctttagggagcctctggcctccctgcacccttcagatgaagaaacaggcccagatcaggagttaatttggaattttaggatttactttaagcaaatgctctgtatacctgagttgtcatttctaatgtattcaaccctctttggcattaaatatgatagaagccatgtatttgaaggatggtagcattttttaaagtttaacattatatatcatgggattttaaattagacatctatgtatatgtaaatagtcgaacttgtctgggactcggtttagatgatgttcaacaaatgtccacagcaagttcgactatcactgcttttctgtttacaagacagtcgtgagactaagcagctcaggactcctgtaatgcacaacagaggcttgaaaatgtgaaatctttgctgtgacctagggtcgggattctacctttgctgtatcagaatgtcccatttctggaggtctataagatgcaggttcctctgggcacccctgtgcattgacacccttccgtcccagaagtct

SEQ ID NO: 41113 - DNA, 1029 bp, Homo sapiens
ccgcacacctggataatcttttctatttttagtagagatggggtttcatcgtgttagccaggatgatctccatctcctgacctcgtgatctgccctcctcggcctcccaaagtgctgggattacgtgagccactgtgcccagccaatttttaagttcactttctacacgctactgggttgttaaaaccaacctcagtaaaagtatccgttttacaagttacttgctttttcaggccaggcacagtcaggagtttgagaccagcctggccaacatggtgaaaccctgtctctactaaaattacaaaatttagctgggtgtagtggctggcatctgtaatcccagctgcttgggaggccgaggcaggagaatcgtttgaacccaggaggcagaggttgcagtgctgagatgatgccactgcactccaacctgggcgacagaggagactccatctcaaaaaaagaaaacaagttaattgctttttaaaagggttgtgtgaactttcagtcagatatgaaactgtttcagaaccaaaaataagttattctaaattcctgctagtcagtttgcaaaatgcttaatatctttttaatgttaattattagctttggtttcaggagatgtcattttcacactgtcttcaaacttagaagagactcaggtttagaatttggagtctgggccgggcgcggtggctcacgcctgtaatcccagcactttgggaggccgaggcaggcagatgacaagatcaggagattgagaccatcctggctaacacggtgaaaccctgtctctactaaaaatacaaaaaattagctgggtgttgtggcgggcacctgtagtcccagctactcgggaggctaaggcaggagaatggcaggaacctgggaggcggagcttgcagtgagccaagatcacaccactgcactccagcctgggcgacagagaaagactctgtctcaaaaaaaaaaaaaaaaaaaatggagtctgaaatctcgtgtgcatggactctggtcatttgtctttgtcct

SEQ ID NO: 41114 - DNA, 1040 bp, Homo sapiens
tctagctacagctacttggttttccatagagttaagttggctccttagatgctgaagtctgtagttatgaccttgctttcattagtaattagcacctgggcaggtactaaccaatgaatgccctttacacctggcaagaaggaatgggtggggaggccagattgtttcaatctaaagggcactacgttgtggtgggttacgttttttggtagacagacactgcctacaggcaactaagtcattccattaactgtcattatcaatccatgtgtggccaagcttgaattgtcctgctggtttagcttcctgatggggaacaacagctgtcgcaacgcacagtgtctgcagctccatcatgggccccaggacgtcccacagcagctaacactggtctgtactcggaactctgccacctggccagtgacttttgtgcgtcatgttcctgggaatagtatgactgtccatgattcctaggaaagctagaggaataactgaggatgaggagctagcactttgacccctgtggggagtgctggttatagtggttatcagggttgtgacaagtggactcttgtgagttccaacactggatgattttattattcctattactcaggcagtaaaagactagtacatatcctggtgttatataattatatgaaaacttatcagaatgagttttataactagcgtacccatgtttttgttattgtgctgcagataaaatggcgcactgaaatgttactgaattatgtgacaatttttgttacaattctgtgcactttttacaagatttgtggagcttagatagatggctggcctttggcatctgaacattttcctgagcccgatagacaagcagattttttttgtttgtttttggagacagggttctcatgcctgtaatcccagcaccctgcctagttcaagaccagcctggctggcaacatggtgaaaccccgtctctaccaaaaatacaaaagttagctgggcatggtgatgcacgcctgtaatcccagatactctggagactgaggcag

SEQ ID NO: 41115 - DNA, 1044 bp, Homo sapiens
gcccggctaatttttgtatttttagtagagatggtttcaccatgttggccaggatggtcttggtcgcctgacctcgtgatccacccacctcagcctcattgtttcctagactcaccttctcactcccaagatcagaaattggaaatcatcattctcagtaaactatcgcaagaacaaaaaaccaaacaccgcatattctcactcataggtgggaattgaacaatgagatcacatggacacaggaaggggaatatcacactctggggactgttgtggggtggggggaggggggagggatagcatcgggagatatacctaatgctagatgacgagttagtgggtgcagcgcaccagcatggcacatgtatacatatgtaactaacctgcacaatgtgcacatgtaccctaaaacttaaagtataataaaaaaaaataagaaaaaaagaaaggaaaaactcttcacaggcttctaaatttgcagagacaaccatgcattccaggtgaatagtgatgtttaatctataggcctttagttccctatcttttctgagcctacaattaaaaccgactctagcatataataagccatcttggccttgtcccttacttttgtttatgtgtgtagttactaagtttactaagtagttactaaacttaagtttctgtgtataattacctgcacatttcagtgaagcatgttggtgatgaagtatttatgatatacctagtgaaactgaaatcacatggtatacaatcaagacttagacttcaggagtttattagataaattcttgttcaaggtccctttctctttattttgcctgccctgaggtaaggagatgagaaggatgtagattgtgtttctagaaagaatagtttcttttgctgaatgtaacatcctttgattatttcttttccctttcttaggggaaagtggtgtctaagaattccagtttacttccctgttagataacacacaatgtatgttatttccagtgtagaagaagttggttcttaattagagacactcaccaaaaagggcct

SEQ ID NO: 41116 - DNA, 1065 bp, Homo sapiens
ctccccctaacagcctccacctggcagccttaaagtgcttgtgggctgggggttcagatgttccccatagataaggaattgatttcagggttggccactaggattccttagctcggaactccacacacgcattcttcttaagttattgatgttaggtacacctgtacaaccaccctgcataaagttcattcattcaacaaatagagcacctactttgtgccaggttttcaggtactggggagacattggtgaacaaaaagaggcttttaaaggattatcacctgcttggttgacagtcacatccagtgaatggtggaacccatttcctgctaatgtgtatttgagcctgaaatgcacattgtcccacctttcctcaatggcaaaatgctctggaaaggagatgctggtctgactaaataaaatgggctttctgtttggagttgtaaagggagccgtgccttcctcagcccctcctgaaagaaagacctgctttcaagaagcttatattgcagggggaaagacacatgtctaatacatcgtcagggggtggtgagcgtgctactgtaaattttcacctaggctttggcaagagctagaattaactttcattctttactgactctttgaagcgttaaaaccactgggcagagtgacttaggagtgggcccactgtgatgtgtttttgttggttttctggtaaatcacttttgggttggacagtgaaccatgatggtctttcttcaagaacttgtttttgcaagggtttggtgataagtccatcatttccaaacccacttactcttccatcctttctcaggtgctgtggttcagggaaatgattgttttgatagtattttacctattgcaccattacttcatctgtaaatttcttataaaatatgtcttgggatccagccttgtcttttttgtttgttttttttttttttttttgagacggagtctctgtctgtcgcccaggctggagtgcagtggtgtgatctggactcaccgcaagctccacctcccgggttcacgccattctcctgcctcagcctcccgagtagc

SEQ ID NO: 41117 - DNA, 1035 bp, Homo sapiens
agaattaatatgccagtagattcagaagccaatataatttttgcctaagttacatcaagatgattcatttgtgatgcagagtattttctatacaaaatttttctttttaattcaaacttaaaagtgacacgtgacatcgaggcttgacagtgcatgtggtatgaaactgacctaagtacaaccccttactcaggcagagctgagtgcaacggtatgcggaggagtggtcaagaagattacccttctgggtgtggttttctttatttcactaaaagaagaggtgcagagctcagctaagatagcactcaggaaaaagttaacctgttctccgtcactacttttctttctcatttctcataatgaatggtaatttatttttatggtttcttttttgtattttggtaaaatatacagtttatcctcttacttttaggtttacatttcaaggtattaagtacatttacattgttacatagccatcaccaaggtccatctccagaactttatcttcccagattgaaactctgtacctattaaactctccctccccatccccaccaccagcccttggcaaccaccattctactttctgtctctatgaattcgacaactttagatacctcatgcaggtggaatcgtgatagcatttgtccttttgtgacagtctcatttcctgtagcataatgtcttcaaggttcatccatgttgcaatgtcagaactcccttctctctcttatttcttatggcaggtatgttttcatttcattttgttttagaggtcttttatgatagatcagaacttaaaagatgtttctgacatttgataaagtgaagatagttgtgaaactgttaaggaaagacagtagccatcaccttgtgtattagagccagagttactctttgaaagactgtattctgtataatatctacaattaaaatttttaaactttttttgaggccaggcgaggtggcctgattacaggcacgagcctgtaatcccagcactttgggaggctgaggcaggcagatcacatg

SEQ ID NO: 41118 - DNA, 1046 bp, Homo sapiens
atcatcaaaaaagctgggttcccctatggctgtgactgtggcgttccttccctgttgtcctgatgctgctggcgttgacaatgtgattctgccactgttgaatttgtgttctataatataaatttgactatcagccgggcacagtggctcacgcttgtaattccaacactttggaaggccaaggcgggaggatcacttgagcccaggagttcgagaccagcttggacaacgtaatgagaccttgtctctacaaaaacttttaaaaattagccaggcacggtggcgtgcacctgtggtcccagctatatgggaggctgaggtgggaggatcacctgagcctgggaggtctaggctacacaggtctagctgtgatcatgccactgcactccagcctgggcgacagagcaagaccctgtctgaaaaaaataaagtaaaataaaattgactattatatactgaggtatagttctcttgttctcttgtttagggttctccaagcttcctgtatctgtagactgatgtttatcattaaatttgagggatcaaggctattatttctttcaacaatttttctgccattctctttcttttcatttactgggattctaattacatatgatttagacaacttgaaattgccctataagtcactacacctctgctcgttttttcttctcattcttcaaatctgatcatttctattgctttatttcagattcatcagccctttcttctgcagtctgttgctaagcagtgaaacttttattttacagattgtaatttttcgttttagcatttccattggtccttttttatcaacccatttctctgctgagactcctcattgatcttattaggacgatgcttttctttaagtctttggatatttttagattagttgttcagagtctttctctgctgagttcaacatttagaccaattggatctagatgttactgatagctttttcttcttgatcatgggtcacatttttctgcttctttgcacgtctactaatttgttatcgtgtggtggacattgtgaat

SEQ ID NO: 41119 - DNA, 1047 bp, Homo sapiens
ctggccagaacttccaacactatgttgaataggagtggtgagagagggcatccttgtcttgtgctggttttcaaagggactgcttccaggttttgcccattcagtatgatattggctgcgtgtttgtcataaatagctcttattattttgagatacgttccatcagtacctggtttattgagcgtttttagcatgaaagggtgttgaattttatcgaaggctttttctgcatctattgagataattttctactttaatatatttttaaaattcatgtggcaaagcaaaggtatgtggtatgtcatgaatagatggagctgttcatgtcatttgtacaaaaattcacgctgcatgtttgttccatcctgggcactactgctctagaccctgggctgacagcattgatcacaacagacctgagccttgcccacatgaagctcacactctagtacagaacaatgcaggaatagcccttgagggcctccctgcttaggagtagagcccgtgggagactgaagaatatcgatgcttgtcataggaacagggaagagagaggagcagccagttagcaggttgggagtgtggcgactgtgatctggaatctggtcagctccagccgtggagaatcagcttctggggtgtagatataagctgtcggggtggcaaagaagagtcagggcctgagaaactggatgggttttgggacatcatctgagaactgaacactgaaaaatgaatgagacctcagaaattgaaagagtagagaaattctcaggtcaatgagaatgcagttgaaggagaaggaaggaagaggagacattggaggaaacagatgacatggtcaaaaaaattgtaggaaaactgaagaaatagatggtagaatagaagggaggatttacttttttaaaaaatcactgtaggggcaggcacagtggctcacgcctgtaatcccagcactttgggaggccaaggcaggaaggaggatcacttgagcccaggagttcaaggccagcctaggcaagatggtaagaccctggctttgaaaaa

SEQ ID NO: 41120 - DNA, 1079 bp, Homo sapiens
agttggattttaccttctttaataacacatcttttatgctaaaagataaatagtaggaattttcacctcacctccagtaatgacagaacaagacccaactggaggagtcccaacagaaaatatctataaacactggacataataccaaagcaactacatcagtgaattggagagtggacagagcagacgaaatcgggtggaggagacaagctcagagaaaaagaggatgggagctgtacaaattctctgtttttatggcttctgttctggggctaaatatagtctacttggagtgtgtggtcttggaggagacactaattgaaaacagcagtctttttgaccagggaaatttaaaaaaaaaaaaaaaaaaaaaaaaaaaaaccgagctagggaatcatggacactgaaaaaagtggaagaatcttggaagcaaaagagcaagagaaggtttcagcaaacatgtctgcccacatttccgagtgacccttgaaccacgtatgtatggaccaaattcaaagcagctcatctagagaaaaaatatctgaactgagactgaagctgccaccccaaaaaatagagattgcaactcaaacacagatgattgcctacttaaacaaaagaaatcataatcatgagagaaaattaactgaatccagaatttctacaacttaatattgataaggtccagtatacaataagaaaaactacctatcatataaagaaccaagaaaatgaaacatattctcaaaatcaactgagtccgatgccaagatgtgccagatactggaattagcagccaatgatttttaaacagctattagaactctcctcaatgaagtaaaacaaaatatgctttcaatgagttgaaaaatatgaattctcaagagagaggtgattaaagaaagaaatcatttctcaagagagaaatgattaatgaaagaaccaaatgatatctgatatacccacctgctgttcccatcccctccacctccacaacacacacaaaccatttgcctacctagcaaatttctcgtccttaagtactcagcttaggagtccccactttaagaagcctttct

SEQ ID NO: 41121 - DNA, 1761 bp, Homo sapiens
gggcacttaaggaaatctctaatcatcagctgactgctaagctaactaagcagagacttcagtggccacacacaacaaagaatacaaattttacaaaatttttccagagaagtcattaaacaaagaataacaaacagcaacagaaaacccaggttggacgggtggtacaagaatataactttcaaagttactacattataattatttaaagtgtttaattttcagcaaaaaaaaagaaaaaagtacaaggcaggcaaaaaataggaacatatggcagtcagaaaaagcagtcaatagaaactgttcccaaggaagtccagatttttaacttactagacaaagactttaattggctattatatattcaaagaactaaagaaaaccatgtctaaagaattaaagtaagtatgagaaagatgtctcaccaaatgtgaatatcagttaagagagaaaaaacattttttaagaaccaaatagaaattctggcattgaaaagtgcaataattgaaatgataaattttcttcagggccttaatagcaaatttgatctggcagaagaaaatatccatgaaattgaagttaagtccattgagataatccactctgaggaacagaaaaatgaatgaagaaaaatgagcaaagcctcagagacctgtgggacaccatcaagcatatcaacgtacacatccccagaaggagaggagagaagagagaaaggggcagaatatctgaagagatcatggcttgaaaacttactaaatttgatgaaaaatgttgatcttcacattcaagacgttcagtgaactccatataggagaaattcaagagatccacaattagacatatgctactcaaactgtcaagagacagagacaaatagaatcttgaaagtagcaagacaaaaattacttttcatgtacatgggctcctcaataacattaacagctgacttctcatcccacatcatgaaggccaaaaggcaatgggatcatatattcaaagtgctaaaagaaaaaactgccattcaagaattctgtatccagcaaaactatcctttaaaatgaggagaaattaagacattcccatataatcaaaaactgagagaacttgtcattagcacacctaccctacaagaaatactaaagggagtccttcatactgaaatgaaaggatactagacagcaattcaaatccacattaagaaataaggagcaccaataaagactgtatatatgtatataattgatagtataaatttacttttctttgtaattcttctgtcatttaaaagacagttacatcataaagcaatcattataaaactgtattaatgggcttctaatgtataaagatgtaatttgtagggtggatcacaaggtcatgagattgagaccatcctggccaacatggtgaaaccctgtctctactaaagtacaaaaattagctgggtgtggtggcgcacacctgtagtcccagctactcgggaggctaaggcaggagaattgcttgaatccaagagatggaggttgcagtaagccgagatcacaccactgcactccagcctagtgacaaagcaagactctgtttcacagtaaataaataaataaataataatactactacaaaggaaggagaaggaacagaataatactagagaaaactttttgtatactcttgaaattagattactattaatctgaagtagattgtcttaaattaagatgttaattgtaatccccagagcagctactaagaaagtat

SEQ ID NO: 41122 - DNA, 1152 bp, Homo sapiens
cttgctcgacttattggcagcccttggcatagttgctcactccctctgtggcctttcccgttcccctcctacagcacacagattccttttctgtctctttgtgggatccttctgattttctggacttcaaccatggaaataccagtgggccagtcctcagacctctcttctctgttcacattctctctcttggggggtctcatcctatctcttggctttaaatgccatttatatgctgatgtctcccaaatctagaccttctacttggacctcactaccaaactccagactcacaaatccgccttacaaatccacagattcaacttgcctatgaaatgtctaattggtgtcttaaacttaacacatcagaactgagctcttgatttcttctctgctccaagcctgctcttcctccagatgtccccattgcagtaaatggcaaccccgttattttgttttctccaccctcaaatcttgaagggatcctcgactcttctctttccctgacatttcccaagcaccagcaaatcttcgaattatatccagattccaacagctccttgccacgctggttcaaagcgctgccacgtctcacctggagacttgccgcagcctccggacttgcctctaggatcccacttgccccctccagtcttgcccacttcaggagcgagcatggtaaaacctcccgaaaaccctccgtgctgctcacctggctcaggttaaaagccagagtccttgcagtagcctgggagtcccttctggcctcagaccctgcttctctgacatcagcccctccttcttcccttcacctccttcaagcagcatgacactcttggcattcctcagacccccaagcctgcctggaagtccccgctcaggcctttgcactgccttcccccagctgaggctgcctcccaggcactctcggttctcgtggctcactcctcacttccttcttgtgtctgctcaaagtgtgcaaaccagtccagtgaagatagcaccctcctcacccatcgccctctgtccacttgctttgctttctcctctttactgtacttatctagttataatctaatcatatttcatttgtgatttgattacatgtcaaaatgataatattttggatactttgggtttaatgaaacaaat

SEQ ID NO: 41123 - DNA, 1033 bp, Homo sapiens
atttggatgttgagactgatgatgccacacacatacaaagatactgtaaaaaggtttattacacacactatcaggcttttggggagagcaaggaaagcttcccaggttggtctgaaaatgtcttgtgaaagcagggaaaggagactggcttgaggtttttattatggccatgggtggggctggggtgagggttccagtgcatgggaaggggcttgcacgacttgcgtgtcctgctggtgccaaagagggaacacccaggcttcctatcagcctgctcagatgtgggagctggagagggatgggtgaggcttaaaagccccaccaatccacggagccagactctttattacagcttattttagatttataaatatttgttcaaaacatgaaaaaaattggtgccagacaagatatacctatccttgacagataaccaaatccaggagttcagaagttcttgagtaacaaagccagcaacacagggttcaatcactttttcaaatacacaacataaaccaaggcatctactcaccttaaaaaatattctggcctcatgatattctcttttcgcttggaagtttaaagtaatgactttcttgggaaacatatgagatgatgaaaatagtttttatcatttgttttaatattattgccttattcaaaatctcaacggtctcatgatggaattcaaatcaaaatgaagatctgcatgttactaatttccaaatttacattttcagtccagaccctcacctgaggtctagacattactcccaagcatattcttcatagttctgtttgggtgtttagaagggatctcaaatttaacatgtcccaaatagagctgttgatttgccctctaagcctgacctaccccctactctcccatctccgtaagtggcatcaccatcttcccagttgcattatctgaaattctagaagtcactctcaattgtcctctttccttcaccctccacaagtcttgtgggtagagttatgaaacatagtcaagatttaatgtgtttagaatctc

SEQ ID NO: 41124 - DNA, 1027 bp, Homo sapiens
ggttggtgggatttggaggtgcggagtggaggtgggtctcgtgttgggaagtgtaggccagccccagtgcggcttggaattcttacaatcgatgtgatcttgttggcacccatagacgggcgaagctttgaggagcctctagttgtacccacactctagataagcctgcccactgcacgccttgtcagtgtgtctagatgcgcttctcagtcctgccaggtgactggccctgcctcttgtgctgctgcagacacaagcgcgcggcttctgattcgatgggctttccatcagtttccacaatacccgccaagtctgatttccttcctagctttataaagattccttcacgccctccccccatcccaactcctatactccgcccaggcaactgccctggcctttttgggctgtgagggggcatgccactcaacattgcacacgtgctatttcagtcacatgccacaggcagttctcctttatcagagggagccagcccctaacaacattgtcaagcatagatcctcgtggacaaaactttgcagatgacatatttactaaaggttagccctgcttatcttttttttttttttttttttttttgagacagaatcttgctctgtcacccaggctggagtgcaatggcaggatctcggctcactgcaacctccgcctcctgggtttaagcaattttcctgcctcagcctcccgaatagctgggactacagatgcgtaccaccacgcctggctaatttttgtatttttagtagagataagggtccgccatgttggccaggctggtcttgaactcctgacctcgtgatccaccagccttggtctcccaaagtgcagggattacagatgtgagccaccacgcctggccaactctgcttatctttaaatatgattggataaatcaaagtcagtttgccaaaatgtcttaagttttcaatttcagtcaatgcagtaaatgttttggggagtctgcagtgtatcgggcactggctcaagcactatcattttaccaatg

SEQ ID NO: 41125 - DNA, 1029 bp, Homo sapiens
tccactgcaaccttgaactcctaggatcaagggatcctccctcctcagcctcctgagtaacttgggtctataggcatgcagcaccacacccagttaattttgtttgtttgttttttgtagagacagagtcttgctatgtttcccaggctggtcttgaactcatggccagccacgagtatcaagtgatactcctgccttggcctcccaaaatgctggggttacaggcatgcgtcattgctcctcatctttactgataattttaacctcttctttccacatttgagtatttgatcaacctggtatttattttggaagtatgcatctactttaacttttcaataagaaaagccagctgccttaataccactacttgaatgattcatcagttctccactgtcggtaataccatctttctcctataccaagtttctaaatatacatatatgtatatttatatataacatatacattatatatttatatttatacatatacagatcaatttatgggctcactgttctgattcactgatctttttttaatcaacacttgcacagacaccaagctgttttttcaaacaagtttcattgaggtataatttgtcagttacacattgcacatattgtataattgttaattatacaatacattgcacatatttagtttacagtttcataagttttgatttatatacccatgaaaccatccccacaatcacaaccgcatcatcacccctgaaagtttcttcatgcccctggcaatcccttccttctgcctctcccaactccagatcccagcaactgatgatttgctttcatagtggtggagggacctttccttccattctctaaaggttcaataatttaagtctctggaatcaactgacagtagacaaacaggagaaaaggcatacaagtttattatgtgcacatgtgcacagcaaccacacagaatattagactcaaaaatgggccagatggttgaagcttaaatagcattttgagatacagaaagaaatggggcttggag

SEQ ID NO: 41126 - DNA, 1525 bp, Homo sapiens
gtgaaggaaactcaagattctcctttatttctgtgcttgtgggaatccccctggcacaccccaaagaggggtccctgctccgtctcacagggatctttttgtatatttggcttagcatcatacatttgccatgttgtttcatcatctgcctaatttactgtttttgaatatttcatttgtttctaattgttactacagataatgctggggtgagcaactctgtgtacataggtttatctcctattggaatattttctttatataggcgttttttttttttctttttttttggagacagagtcttgctctgttgcccaggctggagtgcagtggcgcgaccggagctcactgcaacctccacttcccgggttcaagtgattgtcccacctcagcctcctgaatagctgggattacaggtgcatgctaccatgcctggctactttttgtatttttagcagagacagggtttcaccatgttggccagggtggtctcgaactcctgacctcaagtgatccgtctggctcagcctcccaaagtgctgggattacaggtgtgagccactgcacctggcctatataggcttttttcttaaacctatttagtaatgttttcccaagtttattttttatttttaattttttccccaagtttatttttctatttttttttcatggaaaaatggggtaacttagcagtttcaatattgaagactgaagtttaaaaaaaatttaaattcaaggtacttttaaaattcagttagaaaagtaggctttaaaaattattagagacaagagtaccaaagcggtgtgtgtatgtgtgtgtgtgtatgcatgcttgtggattggaaaaactttggagactgattacttttcattatatatgtgtcacagtgaaacagcttttatgtgtcatgtaagattactgcttgcctctctaaggaaggtcgtgactgtttaaatagacgggcaaggtggaaccttttgaaagatgagcttttgaatataagttgtctgctagatcatggtttgtattgaactaacaaggtttgcagatctgctgacttatataaagctttttgattcctactaagctttaagatttaaaaaatgttcaatgttgaaatttctgtggggctctatttttgctttggctttctggtgagagagtgaggaagcattctttccttcactaagtttgtctttcttgtcttctggatagattgattttaagagactaagggaatttacaaactaaagattttagtcatctggtggaaaaggagactttaagattgtttagggctgggcggggtgactcacatctgtaatcccagcactttgggaggccaaggcaggcagaacacttgaaggagttcaagaccagcgtggccaacgtggtgaaaccctgtctctactaaaaatacaaaaattgtttagctctgtttttcataatagaaatagaaaaggtaaaattgcttttcttctgaaaagaacaagtattgttcatccaagaagggtttttgtg

SEQ ID NO: 41127 - DNA, 1009 bp, Homo sapiens
ttcctgctgctcctaagaccaccatgaggaaggctgggaattggctcttgaattaatttgttggtatttttaagaatagctattaaagtactgttgttaattttcccaagtctattttattgttagtatttgtcacattttctttgtaaacagtgaattaaaaatattttataggaatattcattcttatctagatttcctacttatataaaaaaacaagtgaatgagattgttacaaagggtaattttgtgtgagtagaataataaaagttgaaattgagaagatgcaatgttttagactgaaactgatggttggtttgttttccccttctttctaacaggccttattccactgctggggattgatgtgtgggagcacgcttactaccttcagtataaaaatgtcaggcctgattatctaaaagctatttggaatgtaatcaactgggagaatgtaactgaaagatacatggcttgcaaaaagtaaaccacgatcgttatgctgagtatgttaagctctttatgactgtttttgtagtggtatagagtactgcagaatacagtaagctgctctattgtagcatttcttgatgttgcttagtcacttatttcataaacaacttaatgttctgaataatttcttactaaacattttgttattgggcaagtgattgaaaatagtaaatgctttgtgtgattgaatctgattggacattttcttcagagagctaaattacaattgtcatttataaaaccatcaaaaatattccatccatatactttggggacttgtagggatgcctttctagtcctattctattgcagttatagaaaatctagtcttttgccccagttacttaaaaataaaatattaacactttcccaagggaaacactcggctttctatagaaaattgcactttttgtcgagtaatcctctgcagtgatacttctggtagatgtcacccagtggtttttgttaggtcaaatgttcctgtatagtttttgca

SEQ ID NO: 41128 - DNA, 1044 bp, Homo sapiens
ggtatctgcctgcctcggcctcctgaagtgctgggattacaggcatgagccaccatgcccagccaaatgttttacttattaaccctgcttcattctacagagaattaatatcagcttagataattatatgtactaaaataaaaaaaaaattagctatagaacaagagtgaggaaaagaaatacaagcagagactgatttcagagcttgtactgttacctcctctgctgagcatttgaggttaaactgggactagatctcaggtttccagaccttctgcctttctggggctctttggtagagtatatgaaaatattcggcttggaagtgccaggctgggctcaccaaatactttgctgttgagcctaattggatttaaaaaatgtcactgaagagtatgggaaatagagccatgagttgtctggcagagggttgggactttgaacttaaagtgataccttcacatcaacaacagtcattctctgccccttcttctacccctgacattggaatactcttgatctgtggctcacttcacaggatagacccagattttggcagaatctgaacagctcttttgggacagtgacatggcataacaatttgtaaaagccacaaaaaatttgtaagcaccgatctgtagagtcaggttatttgtagagctgcatgaccagaaaggctgatatttgtaagtgagtcccagctacactccttcctctccctgtggaaagcacattagaaggaaaatgagggaatgtcatggccttttgtttataaaaatcattaataaattttgctacttgaaattattaataataaattactagtgacctccctcacaactgatcaagacatactggttaagaattgtttttgtagagagagctataatttattttgagtgtttttgtgtgtgcgtgatggagtctcactctgttgcccaggctggagtgcagtggcgcaatcttggctcactacaacttccgcctcccaggttcaagcaattctcctgcgtcagcttcctgagtagctgggattacaggcgc

SEQ ID NO: 41129 - DNA, 1049 bp, Homo sapiens
ccattatctaatagcttacaaagaaaaaaatataatgtatacagtggttgaaaaagtaggagttacaaaaaaatgtgtttgcattttaacttttcaggagatgttacagcccagatagctcttcagcctgcactgaagttcaatggtggtggtcatatcaatcatagcattttctggacaaacctcagccctaacggtggtggagaacccaaaggttggtatatattggtgcacccttatctacattttgtgcacagtaggaatcgattgttgatttactgaagttaccttatacttgttttttgttttttttgttgttgtttttttgagacaagagttttgctcttgttgcccaggctggagtacagtggcgcagtcttggctcactgcaacctccgcttcctgggttcaagtgattctcctgcctcagcctcccaagtagctgggattacaggcgcccgccaccacgcctggctaatttttgcatttttagtagagatgaggtttcattcaccatgttggccaggctggtcttgaactcctgacctcatgatctgcccaccttggcctcccaaagtgctgggattacaggcatgagccaccgtgcctggcctaagttaccttattcttaccagaggtatcatagtggcatatttttcataacaacgagtatgataaaagttgtaactttcaaaaggacacaagtaggaatggagaatgctttcatggggttatgtcataagattttatgttcacgccaacatagaatatcacatcaactccaccttctggtttctggatggtacttcatattagggaaagactgagagacttcattttatgaactttttttttttgagacggagtcttacagtcgcccaggctggagcgcagtggtgcaatgtcggctcattgcaacctccgcctttcaggttcatgcaattcttgtgtctcagccacccaagtagctgggattacaggcatgtggcatcactcccggctaatttttatatttttggtagagacagggtttcaccatgttggcgggg

SEQ ID NO: 41130 - DNA, 1051 bp, Homo sapiens
gtgtcttgtagtaaggtgatttattaggataagattaaagtacattccagatggtcgtagtatatttccagtgaatcagatcggtctggagaaaatctttgcaactcgtatcacaagagctctcaaaaattgaaaacaaaaagtgcaaaagccaaaggagaaaatggggaaggacatgaacagatgattctcagaaaaaataccgtaatggtctttaaacatagaaagtcgctccacctcacttacaatggaaatacacgttgaaattacctttcctggtgggagtggaaaaatggttcaagttccacggagtacaaaattacttgtgtttattcttataccttgcagttatacttctaaccctaaccttattctgaaggtgcagctccacacatggaaacaataggtatacaaggttattgcagtgctatttgtcatagcaaaagttagggataacccaaatatccgttaatagggaactgattgggaatggtgcatccatacagtagaacacaatgcaaccattaaaaagattcaggaaataatcgtgtgttgctttggaatgagtctcaggttgtattaagtattcacttaaatatttaagtgtagtaagtattcactgtattcaaaagcaaaaataagcatatatgcttttatgtatttacttaaatacataaaaatatatatttatatttaatatgaatatttatgtgtatatgcttattttcggggaggaattggaaggatatcctggaaacttaacatttttagttgcctataaagagtggggggtggagacaagatttctctgtctttgaacttttagttttacatagccaaaaaagtaaataaaaaaggaaacaaagtaaatcctaaggttgaaagcaaattgaaacaaatgaacttaactgttaactaatataactaagatacacagaaaaaataattattctttgggtttttttttttttttttgagacagtctcactgtgttgcccaggctggagtgcagtggtgcaatctcagctcactgcaacctctgtctcctggg

SEQ ID NO: 41131 - DNA, 1671 bp, Homo sapiens
ataatgactaattattagcactggtgtgtcttcgttaactgtgattgctaatctctccctgcttcttttggtagaaagactacctacaagatctctagtctgatttaaaaatcaaccttaatacttgaatgaaatgctggagttaataggccacctaatgaaattgtaagcggccgttaaataattctttcttaattgcaggattggtcttgatttgagcaatggtaaacctcgagacaacaaacaagcaggggtgtttgaaccaaccatagttaaagttaagagtttgaaatttgcaacagaagctgcaatcaccattcttcgaattgatgatcttattaaattacatccagaaagtaaagatgataaacatggaagttatgaagatgctgttcactctggagcccttaatgattgatctgatgttccttttatttataacaatgttaaatgcaattgtcttgtaccttgagttgagtattacacattaaagtaaagtacaagctgtaaacttgggtttttgtgatgtaggaaatggtttccatctgtactttggtcctctgatttcacatattgcaacctagtactttattagtttaaaaagaaattgaggttgttcaaagtttaagcaattcattctctctgaacacacattgctattcccatcccacccccaatgcacagggctgcaacaccacgacttctgcccattctctccagtgtgtgtaacagggtcacaagaattcgacagccagatgctccaagagggtggcccaaggctatagcccctccttcaatattgacctaacgggggagaaaagatttagattgtttattcttctgtggacacagtttaaaatcttaaacttgtctttttcctcttaatgtatcagcatgctaccctttcaaactcaaattttcattttaactgcttaggaataaatttacacctttgtgaaaattcatccctgcctatcttacctcgttccttttatgccaagtaagccaatgtctttttttttttttttttttttttttaaaccttgggaagtaatgaactcagtcctagtaactagtatttctttaactattacccacatggccaacacctagaagatactatcttaaaattggattgtgaaattcactggtaagctctcagggttacttgtgcatctttaccttctctgggtttaatccaagttctttaactattgcagcagagacagctgcaaaggcttcattgatttcaaatatgtcaacatcttccagtgaccaacctgcttttgtaacctagaggaaagattcatagaaaagaggtctaaacttgggtggaaaggctaaagttaaaccattctttgtcaacataaatatatgctgcatgatactggtaactgctactttggtttgttcttaggttaatacagtgacattctcacacatttttgccttagtgacatccattccatccaaaaggttaagggtgtgatctaaaagatcccttagaaattctaaattgtcttaaaattttgaaccagtagcatctgttatgtgtacctaaggctaatgtaacagaatcagttcccctagaaagcatgtgatccaaatgctctcagtggctgggggtagtggctcacacctgaaatctcaacacttggggagcctaaggca

SEQ ID NO: 41132 - DNA, 1790 bp, Homo sapiens
cagcctcccaaagtgctgggattacaggcgtgagccactgcacttggcctggactcatcttcattgtccacctcctaggctaaatttatgtcttttatgtgcttgtaatctctgcataccactttagtgacacttgccctggagtgtgattggtaatccctctccccactagatccttgaaggcaggacctgtgttccctgtttaaccatagttctcaattagtaattcaaatttgggttggggagagctaagtggtaatttttaattccttcaaattttccatgaattggactaatttaaattctggtcagagataacaaaggataatacaatttgatctatgattatcttgtgataaatacttaatggaagttaaattatttttaaaaatcacagaaggtaactcaggttacaaaaatactttgcagagaatcagatatcaccaaggagagaattcagaagatcctggcaactggtgccaatgttattctaaccactggtggaattgatgatatgtgtctgaagtattttgtggaggctggtgctatggcagttagaagagttttaaaaagggaccttaaacgcattgccaaagcttctggaggtatgtcttgtgctggctgtcacataaaatacttttattatccctgatcctatcaaaggtctttttacattggaatattgacagaaaacagctcaaaaacatttatattctcttaatgctttgtgctaccaacacatttatagagccatttttcatgtaactggagaaattttgttggaaatttgtgaactgaatttgttcatttctaaaatgacagttccatcttaggataaaaggagttaccgtgtgctgcctaactaaattctaaacttgtaatatagcacttttaccacaaatgctactgagtccaaggatattaaaatcatgaaagagcaatattcacagatcctttgtaactctcttattagcaactattctgtcaaccctggccaatttggaaggtgaagaaacttttgaagctgcaatgttgggacaggcagaagaagtggtacaggagagaatttgtgatgatgagctgatcttaatcaaaaagtaagagccactttctaaaattgtaaagttataccgattttgttaagtaaaagtaggttttcttcccatttatttgctgcttgtagtctcacagtgatacgagcagttatacgcatgggataaaataacattgggccactgtaaattgagatgaagtaaccattttcatctcttctgcagggactagacattgtttctgtatagtatatctaaatatcctgtgtaggcaggacttaagggaactttatgtagacttattttattaaaatgccattttttttgagaaattgatggtcttggcaaaaaaaaatttttaaaaatgctattacaagaattgtacttttgttttgaacagtactaaggctcgtacgtctgcatcgattatcttacgtggggcaaatgatttcatgtgtgatgagatggagcgctctttacatgatgcactttgtgtagtgaagagagttttggagtcaaaatctgtggttcccggtgggggtgctgtagaagcagccctttccatataccttgaaaactatgcaaccagcatggtaagaacagtcatttcttgtcttagaggcctgagagcagtagctgtggacttcaattttttttttcccttttgtgaagtcacctaattttcttcttttcctaggggtctcgggaacagcttgcgattgcagagtttgcaagatc

SEQ ID NO: 41133 - DNA, 1111 bp, Homo sapiens
gttattattgcagcagaactcctaaaaaatgcagatgaattagtcaaacagaaaattcatcccacatcagttattagtggctatcgacttgcttgcaagtaagattgtttgcattcagagaaattttttttgatgtaatagttgtaaactgtgttgtcttaacgttttgattaataactaaattttaatttgaaaaccttcaatttaaatgttttagcatttaagtagtaatatttgaagttaaaaacttggaccagtatcttttttctcatttgactaccacattttctcctaataatagattttagtggctatgcttatgggatagattaaacttgccatgatctgaagagggagggttttttcatgtcctcctcctatatgaaatggctgaacggatattattacttacgacattttggctctgtgttaagcatgatgaatgcaaagagtttgagtagtgactttataagcgtttttctcccccacacttttaaacagggaagcagtgcgttatatcaatgaaaacctaattgttaacacagatgaactgggaagagattgcctgattaatgctgctaagacatccatgtcttccaaaatcattggaatgtatccttgtggttgtcagataaaatttagactttttaaagcataagactttgagatgggcatggtggtatgtgcctgtagtcccagctactaaggaggctgaggtaggagtattaattgaacccaggagtgccagtccaatgtgggcaacatagcaagaccctgtctcgggagtgggtgcgtgtgtgcgcatgtgttgcgcgcacgcgtgcgtagtagcagcagtatcaattttgtgcaataaaattttgaataaccaattttatgcaaattgatatcaatagagaggagtaatgctgtattgaaattacctgttgccttccctgcttttttagggtgaaaaggtaataaaaagcatgtctaaaagtgatatgaattgcagatagtgataatgttgtaacattttggtgacaagtaatgcttgctgctttaatagattagattactaaaaggaagtcccttgaaattacccttgatttttcacgtgtgtaccctttgt

SEQ ID NO: 41134 - DNA, 1049 bp, Homo sapiens
cgaagtggcagagcatgaaattggtggttattactttttttttttttccccgccatcagattccaccccgcatcaaagctgtgccaaataggctcgctttgtttagggacagggtcccacctgtcgcccagacgagagtgccatcatagctcactgcattctccaagcacaggtccgcgccgccgcatccggctttgtttttattttttgtagaaatgggtttcgctatgttgcccaaaggggtctcaaactcctggcatcaagcgatcctcctgcctcggcctcgcagtgttgggattacacctgtgagccacagtgtctggccccatttacactcttagtaggtggtttttaaataattaacacagatttgtagatttgggaaatacgggggctgttggatgtcatttacctttaggctgaaattactgtctttcagagttgtggcttatcctcatttcttttttatttttaattgattgtctacagttatggctgcagcttcgattgccaatattgtaaaaagttctcttggtccagttggcttggataaaatgttggtggatgatattggtgtaagtacacataactgttgtgttagtttccttaaagtaaaactatcttcagtgttttgctatgttctttctttgactttatcagaatccacgtactggaaggtgatattaaaggtgaacgtgtattataatggggctgtgttgatttctataagtggttcatattttttcctgcgaatttcttaggatgtaaccattactaacgatggtgcaaccatcctgaagttactggaggtagaacatcctgcagctaaagttctttgtgagctggctgatctgcaagacaaagaagttggagatggaactacttcagtggtaggtagactggctaaagaatgatcatttttctaaaaacgaccgactttcagaaagttgaagccataagtgggtcatttgtgctgtgtcagaaataagttacatattctgaatgcccagaagattgagcaagaagaaaaaacaaaagaagttacacat

SEQ ID NO: 41135 - DNA, 1051 bp, Homo sapiens
taacttggagaagggcccgcccctccagttacaccccagctccaagctccacccttcttacaaccttttctagaaggcactagaatggcccactgcgtctgcgcaacatcgtttgaggcgaaggttcaacctcttcccagcggtccaacatccgacttccgttctccgctttcgcgcccttcccatcggctatctaattggacaaaaatgccgaccccgccccttccccggagcctcacttccgtcacagtcctgtttctctccctgttgtccctgcctctttttccttcccgccgtgccccgcggccgggccggggcagccgggaagcgggtggggtggtgtgttacccagtagctcctgggacatcgctcgggtacgctccacgccgtcgcagccactgctgtggtcgccggtcggccgaggggccgcgatactggttgcccgcggtgtaagcagaattcgacgtgtatcgctgccgtcaagatggaggggcctttgtccgtgttcggtgaccgcagcactggggaaacgatccgctcccaaaacggtaagggcgggccgggcctgggtcgggtttgcggccggggagggccgagtcccaccgcgaccggaccccggctgccctcgtttctctcctttacctccgcagaaagggcctcggggccccgcagccggacccagcccacccgccgttctctggggcagggcgctgtggccccacttttcccacagcgaggaggagccccgccgcgcgcggcagggttttgagaccggcaacgcgtggatgtggtgtccggggcggcgttggaaacgcgccctccgcgggaaagcgggcctcccgggctcgcacgtgcgggccacgcctcgcacccccttttgtttcagggcgaccccctgagtgtccatgttaaacgccaggttttattttaggaccatttaccagaaaaagagtaggtccatccgcgcgccctcggatgagcccggtgccctgtccgcccgcagctgcagtcgaggtcgggcgtccggcgtccagccgtatccgggttgaca

SEQ ID NO: 41136 - DNA, 1049 bp, Homo sapiens
agcgcagccttccacaggctcgaatttttaagacttgacataaagtctccggaattccagattattaaagtgaccccctcatttcaacccggcaaaacttctcaccccagtgtcataagattcgatagcgatctcccagaaacttggactggaatgctcctacactgaggggatggggggaagaagaaatgctaaagattatttcagagttacagaaatcctgttgaaattccaatgcatcgtttactcttagcgctggggcttcacagtttttttttaagttggaaatatttacaaaatttcccatagggtgaaatccagagttaatccaaaaccagaatcttttaaaattaagtacattcaaatgtgcagatttcttaaacctcatttagttgagctttgataggtgaaacgcacgttttgaacaactctggtaacaaagaaaaacattaaattgattataggtatgttatatttaaagaccagttgtgaaattagctatattgtgctcaaagtatgttactgacatttctccgtcgttaaaaggaactgctccattctagttttttataatagtctgtattatgtatatagcctgatagtgctgaatttctgaattgaccttcatcttatttactcaataatattcatttgacaaatacttattaagtgcatatatgtgtcaggaactgtactagatgctgaggatatagcagtaagcgcaacagaccaagctaacagcttagtaaagggtgaggtaaaacaaaacaaaaaagtattcaaaaaaataaactaatttttatcttaatttaaaaaattacaaatttttaaaaatcacaaattggtatccatgtataattcatttccgtgcattttcttgtgtgaagaaagctcagtaaaagtatttcttaggtttctgtaattctagttctctactcgattttcttctgcaattttctgagccagaacccttcttagaaggcatattagagactttaaaagttaaataataaaataaatctcttctttaaacagcattgtactacgta

SEQ ID NO: 41137 - DNA, 1022 bp, Homo sapiens
tcccctggaccagcccagagcccggtagctccggtgggtggctagatccagaagagaaaaatcactgcggttcaactctcaggaagccccatccctaggggaaaggggagaccaccacatcaagggagcaccccgtgggacaaaggaatctgaatagcagcccttgagtccaagatctctctgacatagtctattcaattgagagggaactagaaaaacaattctggtgatatgacaaaacaaggttctttaacaccctcaaaagatcacacaagctcactagcaatgaatccaaatcaagacaaaatctctgaattgccagaaaaaaattcagaaggtcgactgttaaatcgaggaggaaccagagaaaggtgaagtccaacttaaagaaataaaattatgtaggatatgaatggaaaaatctccactgaaacagcctaaataaaaaacaatcacaacttctggaaataaaggacacacttggagaattgcaaaatgcactggaaagtctcaacaacagaatcaaacaagtagaagaaagaacatcagagcttgaagacaaggctttcaaattaacccagtctgacaaagaaaaaaataattaaaaacaatgcctccaagaagtttgggattatgttaaacgatcaaacctaagaataactggtgttcctaaagaagaaatctaaaagtttgaaaaacatatttgagggaataatcaaggaaaacttcctgagccttgctagagatctagacatccaaataaagaagctcaaagaacgcctgggaaatttatcacaagaagatcactgcctaggaacacagtcatctgtttaatgtcaagatgaaggaaagactcttaagagctgtaaggcaaaagcattaggtaacctataaaggaaaacctatcagattaacagcagatttctcagcagaaaccctacaagctggatgggactagggtcttatctttaccctcttaaacaaaacaattatcagccaagaattttgtatccaggaaaact

SEQ ID NO: 41138 - DNA, 1019 bp, Homo sapiens
ctatgttcacatttaaatgatagtgttcaacttggtagggttctcaaagtgatcatctactccaaagctcttacactactgatgaggaaattcaggtccgaaagatgaagtgatttacccagttttccagctcactgatcaaagccaggtgctggagtccaggccctttctctctccgtgcagggctggggcgacaccgagttctctaagcagtatgtgtctgtgagcaggcctgggaggctggccctttgcccttccgagaagatcgctgagcagcaagtggaagtggtgcatggtttctccaagcagagtggtgaatagacatcaagggacaattcctttctgtatcagcctattttgctaggagcctagatctaaagctttacgtgccccaaatctgggtgcccgacccagtttgtcaaagtgggatttcattttaatgatcaaccttgcagtcagaagtgtggtgtatgtcaaaagacagttctgttgattttgaccttgggattttagggcagtagttctctgacttttcaatttcatggacaagtaaagtttctgcaaaatgggaggggaatggcaggcagccaacagaggtgtgccaacattctggtctttccaagcatggacataaataaagagaaactcgccatctaccactgacacagttatactctttaatatgggaaaggcaccatctctgaaaacagggccatcctttgagtggacctagtttagctttatgaaaaatgcacagtatttcttgctcgtcagcatttgggactcgtgttgttggaaggctttgagaaaccattcatgcccttgtgtgatcttctgtggacaaaagcagttcccaggtaaactcgctctgaggctgaacctacaacctcagaacccccttttttccagggaggtcacgatagccatcacggtttcttaattgtatggggtgaacagattctaacttttcatttctaacttaaagtacttcttcaggttgtaatttgacatttgcagaa

SEQ ID NO: 41139 - DNA, 1033 bp, Homo sapiens
cagatttgtatgttaggtaagtcgaactgtttcctttccagaaaagacagtgcccatttcaaagtaaacacatcacaaatgacctagagactttcttccagggatccctgggtcacactgacttctttgcagtctgttttgcattgaatttgacacatcctactattggaatgatctgctgaagtctccttccgtcccagctccttccggatcctctgtaaccagctttttcgtatcaaagagcttaggttgaacaaatggaaggctgtattttataattattttggtgttggtgtgaagagaatatgttattgacccttttcgtgggcgatgggtctgctgtatggaatacacacagatgtgtatttatataaggcggtctagacacaaatgcagaactcttgcagtgtctcacttatgtgttatgttccaggctattaatgattttattgaagacacttccagaacatattagtcaaactagttctctctgcctgcttatagaatgggctgaacacctccagaatgtcaccaaaatcagtgggaaacagaattggaaggtgctgcagatagtaaacacaatggcagttcatgcattaaaacccagtgtgacgggtcagggaccgtattggtttgttgtgctgtggatcatcttctctgaatgctaatcaagagaatctgaaatgcccactaatggagaactaatccaggggcgtataaccttctgattcaagaccttacagaagccacattacaacacagcaccctgaaaatccaggggccctacattcccaccaggccacaccaaacgtccaggctttcctgggagatattttggtggactggcggccaaagttaagtagcttctgatctaaaaatgactctggctttcccatgaaaataggacagcatcgtcatcatcactgacttcttgtctgatggtgcaggcaacagtctgccctgtgactcagttctgtggcatatgaaggcaggagaatcacccacctgcccgaaggagacctttagaccttct

SEQ ID NO: 41140 - DNA, 1024 bp, Homo sapiens
gctctaaatttagtggctctaaatgtcatctggaatgggccagagaatgaatattttaggttttgtggaccacagcgtgtctgtcaaaaaacactcctgtgtgtagcgtgaaggcagctgcagacaataggcacatggacaagaggctgtgtggccacaggacgtcacttacaaaagcaggcagaggagcaggcttgtcccgagggcagtagcttgctgactcctctctagtgttatacaagatctggtacacaccataacccacgtgacatgtctaccgtgggatatctaaacatttttggtgatctaagagggatggagatagagactcccatcccaggtgaccatctacgggtctagataagccgcatcactgtcaaagttgtcgtttccatttagcagcaggtcatcagaggccaaccactaggacccactaggatcttgcaagatagaattgtgaacgggaaatatccctgagagtgcttttccccagcagaagccatgattggctgcatgggacctctcaccttcccagggccaacagctgctgctttagtctgtggccccttcctggctgcagaaccaatcatcatttatagctccttcaaatgactgcatgtttggaatgagttcaggtaaatataattttaaaaaataccatgggcacagcacacggtaagccctcacacccgcaccagtgggttcacccacccacggggatgttcccggagtcccctggagatagggcctccgatttcatggctaagttttcttggagagaatctgcatgttggatttgtgtgaaaaacaaactccatcagaaaatggagatgctaaacctagaaggtatctgccttttctatcccatgtgagggaagaagtttcttgtttttttaaagtagggtagcaattggctgtttagacctttttctgttctgccagtaggttgggggacacggcttactgaccctgtgctgagctggagctgcggagaggcatgggtgtaacggggaggagaggagag

SEQ ID NO: 41141 - DNA, 1032 bp, Homo sapiens
ctcccaaaggcttccgaatccatgatcactttacaactctgagcataagggcgggagcgctgatggcgggaaagcaagtcaacagcacgcccatcccacctgcagcatagggaccgcacctccccttgatttcatcggtgatattctatttataggacttcactcattactgtgaacacccaaacaactaatgctgtgtgtaagggggtctgcgccctgccactgatggtggagactgtgcttaggattagagtcttcgggggctccacttacaggtgaaataggcaggtctgggagcctggggccagggcgatgcctcttctcttctcactggaagtttgggagccttgctcagtgggggccttgggttttctggattcttgctaaagtgcttccttaagccctgagtcctctcttctccaaacaccacagaaacagccagtgccattgttatgcacattctcacaaagcaaggagctagagagagcaggtgccaggagaggactgagtggggcaggcacatggcaggcactggctggggcggatgggagctgccagcctgtaccctcccagggaaccccctccccatgtcacagggaacagctttgccatctactggagagctgtggcccatgacggtgggtgagatggctggtgctcatctctgccaccctggaagggggtaaagaacggcattgccttatattcattgttcagcaacatcttttgtctttaatgaccttcagaaaaaaaaaacaacctcattcatctctctgttttttcttaaataacacatgatgttgggatccttctggagtctgtggaatttgctttttaaagaggaaaggaacagaagaaggttcctgaccaggcatttttcatcctcacctatcacagtccaagaggaaatgagtttaaattgaagtcaatgaaatttgcagaaattcacgaaggtggcatttttaaatgtaaaattggtctttttggggaaagtaatggaattgtctttttaacaaagaggctttcaacctt

SEQ ID NO: 41142 - DNA, 1018 bp, Homo sapiens
ggatatatacgaagccaagaaaatctgattgtcagcattccagtagtgtcaacacagacgtcaaagcccagagtctgccttggagtctaacagggattcttcctccataaaactggaactgtgaaaggctgtaacctcaatgtaaagatgaaccaaaaggaaggttgatcaccccacaggtctagtggccaactcggaagtttgtattggtctgagttgagctgaggataataaaagtctctgaaaagtggtgaccacagagcggcctgcttgcaaatttgcagcgtgtattcagatcccccggatgctctggaaatctccaaccatgatgttagcttcagatagtcttggactgagcatgtggcacatgtcagaaacaataaactgtaaaaattaacctaggaggttttaaaatgaatcaaaagaacctgtagaaataagaaactactggattgaaaagctcaccgtatgggtttcatgtcagcttaaacacagctggaaagactgttagtgaactggaagacacatcagaaggaaatatccagaatgcagcagagatacagacatgaaaaaatactttttaacaaacatgggaaagagattaagtatgtccttccagaagatggggatggagggaagaaagagacagtatttgaagagacaatggctcagaattttctagaactgacaaataatactaatccaaagattcaagaagcccagtgaaacccacggaaaataaaagaaaaatccagtcacacgtagatgcatcatagtgaaattgtggaacaccaaaatatacaagacattaaatgtcaccagaagagaaaagacaccttccaaagagtgacagaccaccttccaaagagcgacaccctaaagtctaacttcttcccagctgcagcagaagccagaagatgatgcaatcgtatctttaatgtgtgctgaaagaaaaagaagttctagtctagaactctacacttagcaaaaataacttccaagaataatggcaaaataa

SEQ ID NO: 41143 - DNA, 1048 bp, Homo sapiens
tgggagggacctaagaggaggtagttgaatcatgagggccagtttttctcgtgctagtctcgtgatagtaagtctcacgagatctgatgggtttatcaggggtctccgcttttgcttctttctcattttctcttgctgtcgctgcttaagaagagcctttcgcctcccaccatgattgtgagaactcctcagccatgtggaactgtaagtccaattaaaccttttaaaccttttttggtttcgtttcgggcatgtcttcagcagcagtgtgaaaacggacactggggaaaatcatctgaattaagagagtgctggggtggggcctggggcgtcggggctgatgctgccccagcattttggtttccacagtggagcccagggaggaagttgggaaagaatgaggaaagaacgattgcccggaagcgtttcactgtcctgaggagagtgagcctgaagattgtagaaggcagttgcagaggttgtctgtcatcctggacaagagacgcacttgttgcagacgtttgcttgaggacagaagagactggggctgctgttgcctattctgtttcatggctttactctgagagccctgaaagcattgaccctttgcttcagtcatccattgagttattcccacccaaccccaacgtgggttcagaaccctttcagagacatctccaacttgtatttgtgtctaagagtgttagtctcctttgtcagactatgaagaagccttgtcaaggcaggagggaaaagtgctcttggcagcctcacaaatctggctttagctgaaaggtattttttgtttgttttctttaatcctcgtcaactggacatggtgcggttaagagaggcaagtatgtgtgagcctggacagctttccagctctaggggcagaggaggtttgatagcccttcatggcagggtgcatgcgaagagttttgcttgccggcatagataaacttgactatgtctgctctactcaatttgatgtatagtttgaaaggtaatgctgtattacgaataaaataatgggtatatctaccta

SEQ ID NO: 41144 - DNA, 1196 bp, Homo sapiens
ccagcgtttgtgtcatctgtttaaatatgctgtctggggccgggtgcggtggctcatgcctgtaatccagcactttgggaggctgaggcgggtagatcacctgaggtcaggagttcaagaccagcctgaccaacatggtaaaccccgtctctactaaaaataaaaaaaattagccaggtgtggtggcacgcgcctgtaatcccagctactcgggagactgaggcaggagaattgcttgaacccgggaggcagaagttgcagtgagccgagattgcaccactgcactccagcctgggtgacagagtgagactctgtctcaaaaataaaaataaaataaaatatatctacgctgtccgagtcttcagaatggctttgcacaaccaatggggcagtctgcgtaggaaagatagaatgaaactgtccttcaaacatagagaaaggcagaagggcaataggagagggacacccgtcacaaatcaggtgggggcattgcctacccattttgcaatattcggttctgtcttactggcagcgtctttgtttggccaaaaagagggcaacaagtctttggttcctctacttgctctgcttgaggaactataaaatgaagtcatctcaccaaggccatccgttctgttgttccatatacttctagggtttttaatctgaagtatcgaggaagctgtctatctgcctctccagctcatttcagatgtaatgttttctcttcatagttactgttacactctggcccaattcctagtgaaatgattttatttagaattgggcttttacttggctaaacttttccatatgatgcttattccaaaatgaacccttcatgccaacacatttttgtttatttaggagaaagaaggaggtattaggaatgaggtctgatgatgacattagtgtgttattagctcaggtcatctggtgatagcgcaggctgtgtggctgacatacctggtgattggaagcacattaaatatccaaatgaatcagtctcatgaagctgattcaatggagagtgataagcaaggacactggagttctaagttttttaacaggaataatgtaactgtgatagcaagccttgtgtattttgagtaataatccatttattttttaaatgtatctatctgcctgcctgtctgtctgtctgtctgtctgcctgcctgcctgcctgcctgcct

SEQ ID NO: 41145 - DNA, 1094 bp, Homo sapiens
tcaacattggtctccaagtatgtacccttctacggtggtatagaaaaaggaaaaacttgtccaaacagggcagagacagtaggagatgatttggacaggaactgtagctgtttgaagagagataagtttgtgtaatcaagggaaaggagacagttgactgagatttaaaagatgtttataattttaaatgtctttttaccctctagcagttggtctctatttaagcagaatttaaatttaacaaagcaatactgattacgctttttcattgaaacctgcatttatgtgacttgcatacacctatggagattccaaaatctgttagtttgcagtgtgaaatcctgtatgtttctactgtcataacccctacccaaatttcaagtggatggttacgaattggatttctcatttggagttaagaaataagaaacaggatttggaatcagagtccacaagagtactatatttttttttgattgatggtaaagacttgctaagtttatggcaggattgtggagatatttttctcaggatgcattagtgtatttgtttctggtggaaattaagatgggcaacaaattcagaaagcaaggcagatttttatccatcacaaattaattaaattatttagaacaaactccaaatgaaactcaagaattaaccatctaagacaactggcatctcaatgccgggtgcaatgaagggtaggtagtctaatgtcactgaaggacctagaagcacctccatccaggtatacccagtgatgctctgtgccttcttccccagaggaagcacctccatccagatgcaccccagcaatgacctttgcctatgtccccggaggaaggcttcctagggctttgggccaagcgatagtggaagcatttttaaacaatccgaagcgggaagggaagattcctccctctagaggaggagtcctggctactggaaaaagagaatacagtagaaagggagggtgatgatcctgggtggctcgtgggcacctcatggtgataagccagtgcaaactatccccaggtttgagagaatcctcgccaggattctccgtttctggtatccccataggtgttagc

SEQ ID NO: 41146 - DNA, 1114 bp, Homo sapiens
tcttgttgcctaggctggagtgcaatggcgcgatcttgggtcactgcaacctccacctcctgggttcaagcatttctcctgcctcagcctcccaagtagctgggattacaggtgcctgccaccacgcccagctaaattttgtatttttagtagagatgggggtttcaccatgttggccaggctgtctcgaactcctgacctcatgatccacccacctcggcttcccaaagtgctgggattacaggtgtgagccgctgcacctggccgatgatgattattttttaattgaggactatgttacttagagctcgtcccaaagacagttaaatccagtctagaatactttctctcctgtttggttgtaggaattaggccaactgaactctaagggagccaaaactgaacccagccttgtctgccaggagtgagaacagagcacgttcctcagacctgtacaagttagttgccgccctggtggagactttggccacattcatccgacctgaaggagtgctggcaatctgaatgtagtgtgtgctggacaccagctccctcctttctcctgggactgtatccactcccctctcctctgtgggcaccgcagtacctggggattctgtgtcctggagaccgaaatattggttcagaaacaatctgccagctgtccccactttagctgtgctgctctctttgccagtccctgaagtttttattttcttttatttgtctggttaacctgggccacttgggaatcttctctgtagatgggagttggggaagagtggcagagctggatcgcttaatcactgttcaggaagagtgcagtggcatagaggaaaaagcttgccttgggagggcagccgtgtgtttgacttggaagggatcttggagtgcaccttgtcagtttcttcctaaggataaagatgctgaagctgtagtcttgaacccagcccaggcttccaggtggacagacttgtttaagtgtgtgtgtgtgtgtgtgtgtgtgtgtgtgtgtgtgtgtgtgtgtatacacaaagatatctgctgttagtgttttggtaaggctttcttttcttccggttttttttttagagttgtgattattttctccaca

SEQ ID NO: 41147 - DNA, 1050 bp, Homo sapiens
ccagacccctggtgagggaaccctctgtgtctgccgaccatgtctttgcagaacaattcaatctatcccgagaggcagcctcccagaggcagcaatggggaaatgccaggcttctcaacctccgtgtcagcattcttgatatttggggtgggataatcctttgtcagggggactgttctttgcattgtaggatgtttagcagagtctctggcctctgtctgctagacaccagtggcactctgtagtgtgacagtgaaaaatgtctccagacattgtcaactgagaacttctgacataatgggaagggtaaaaacttagggccaggccaggcgcagtgtctcacacctgtaatcccagcactttgggaggccgagacgggcggatcacgaggtcaggagatggagagcatcctggctaacacggtgaaaccccgtctctactaaaaataccaaaaaaaattagccgggcgtggtggtgggcgcctgtagtcccagctactcaggaggctgaggcaggagagtagcatgaacccgggaggtggagcttgcagtgagccgagatcgcgccactgcactccagcctgggcggcagagtgagactccgtcaaaaaaaaaaaacaaaaaacaaaacaaaacaaaaaacaaaaaaacctaggcccaaaatactgatgctcgaatctcagctctactgggacgaccttgaccaagtctatctgagctcatagtacctgccccacgagattgcttgcataattaaactcaatgatgtggtagctttcagtacatgtttattgaagccaaatctcttatcatctgttttcttaattaatggcaagaattacgttcagatgcgcagtaagcaataaaaaaaaatctagcttccttgtttcaccaaaggtacacttctagctctttggcacaaaccggtttagttcagtgtagatggaatcgctcggagatctggcttcatcacgggagagaggacatttcacttctggtggtatctctcttgtacccgttgagagctgctcccacgcagttaatggcgccc

SEQ ID NO: 41148 - DNA, 1023 bp, Homo sapiens
aaaaaaagaaaaagtcagttgttgtttttaataaaataagcttaaacaaatttttatcagttcttttattggtcagttttgttttgaaataacttactcgttttaaaatccagactgaaattcttctcagtatttggaaaaaaatccatctgccagtttatagacaagccagcatataggctttgacatatataagctgtcatgaataactttgttctattaaatgactagtcacaatttaatattttaccctaggattttttcccatctggctctagtattaggctgtattttaaaggataccggttctaagaagttgccgtaactataaataaagtgacagttactcgaacagataggctgtactcagccaatagcctggccatttagaaagctgaacagaaccactttaccctatgttgacagtgagaacaaattgaacatccttgacttaagtgccatttgtacacccctttcccgtaacaggaagaccctctatttcttttgctgtgctcatctctacccaatacatttaaaccgtgagagggagctgtgtctctatttttccctgaaaagtgctcgtctgttggcatttctggcggactcctcacagctggatatttggggttgctttacataacctggcatgtaagggacccaggtcacttctcctccataagctcctgacttccatgcattggagaagcttgcctcccagggagtgacttaccagaaatggggccagaattgataaatcaaaggggtttaggggcaagatcagtgtggaagcgggccccagagagaagctgcattagcggagctcccgggagcactgttttgacctcagggttctgttgattctggggccagctaggggcggagccaaagccaacccaagccactcccccatgtgcagcatcccagcctctctcccggcggctgctcctcgtggtccaccagccaccctctcaccacagggccggctgttgggagcttagagaatcataggaaagaaggaggcaa

SEQ ID NO: 41149 - DNA, 1033 bp, Homo sapiens
gtctcagcctcccgagtagctgggattacaggcacatgccaccaagcctggccaatttttttgtatttttagtagagacagagtttcaccatgttggccagactagtctcgaactcctgacctcaggcagtctgcccgccttggcctcccaaagtgctgggattacaggcatgagccaccgtgactggccagtgttgtattctttaaaaaagaggattgtccattccatttctactacccaaacatgacttcttgattctattccattcaatggaacactttttcattctctataaagtgcacagcaaggaagaagctataagaaaccttctctgtcttcagtgagtttactttgtcctggaggaaactagccagtaacaaacaactccagctccaaggtcaggcgtggttcctggtactgtagggatgtgtgcagtgtggggccatggaggcacgcccttgtggggaatggagaaagtttcctaaggagatggctgtggtttgctttgaatagggagtctgggctaagtgtgtttgaagtcaaaggaacaaaactagcaaagatacgaaggcagacattccagggtcctctcggagaatataattcctaactcactggagccctgtgtatggataggaagtagtttgaaagaagctggaaaatcttggcaacagactctggggatgtttaattcaaatctaaggagtatgaaatttattccgtagatcatggtaagccactgggtagattggacccataataacaaaacttaataatattttttctgtgatttatggtttttaatatttactaagtgtcaacaaagtgtgaagatttataagagcattatagtgtgtatgtaatttttacgcaaagggtttattggttgatctatgtagataagtaggatgtaaacatatgggaagaatgaggggaaagtcagatgttctgtatcatgccacccacaccatttaccctagccattgacatcacctggagagctatgaaagtattgctgaaatcccaccaagt

SEQ ID NO: 41150 - DNA, 1029 bp, Homo sapiens
ggactttgtttgccatactgcctatcctgaaagaaacataagcactttccctggtaggtcagctctctggatactggcaccctgggactatttctccccctgagtggggattctcaaaccaggctctgccatcttcaacattgtttgggtgaaaaagtttgtgctttcctaagtgtctcaggaaaagattctgtaacacactaaagaggctaaatgccatcatctggcaccacgacagttgcatttttgtttaaaataggaatttgaggatctaaagtatgtgagctagatatgaggaatattgtgaatgttagggatattgaatattcgtttacacaatatttgtcatctttgcacggaagtggtgagaccctaagggagagggaagaaaagggatgtgagttggcccccagcacctgcagggcctgtgacctgaccatgggagggctcagcccccatccctctgagaggccgcagggaccctccagtcttagctcccagttgtcttcaattccgctgtcttctctactctcacctgctgctaatcacgcaccgcagcctcccacaagcacccacctcatggccctcgtgtccccacccctcggacagcctccgccatggcccgtgcacttccctggatgccccgcgtgtttttgctgcaggaacttctccggaaccaggtcgtctctcaaggaaaccccttcctctgcttgcccctccctctccacatctcctaggccctcggagtcaagctggtgtcctctcagcccacacttttctctttgagatcagcacgttcctcctgagcatggcctgctgtgagcttcaggtcatttgtctcacccgcctactcttcctccttgtcatgcaacattgggtctgccaggccttccctgtaagctgttgaggctttctctcccctagaaatcctgcctccattccagtggccaatctgaaccccacatgaatgtccactttgcagagctggagataattacacaactgggctcacccattttactttaaatt

SEQ ID NO: 41151 - DNA, 1034 bp, Homo sapiens
ggtgcagacgtccacaaatagaacttttagaaaccttcacttttgcatttgtacattaatgggttttctgcaaggatgagcagaaatatactatttttgctatagtcatcatatgcctatgtgtgtataaatagatgcatgtattgtattttgtatttatcaagcttaacccaaaatggagcttatcaaaataaagctcatttttatgctatcattttccaagctaataatttatttttaattttcttttgttttaaaatttgtcttaaatatgatttttctactttttacatgaatttcattcatttctctaattccttgtattgaatttcagagcagtgacccaaggtcatccgtactgacatgttttggtatgaatcttcgtggtaatgataatagctacagtaatgagggctcctacctgctagattgccaggctttttaatttctgttagatggtttgcattttagccagggtcctctagagagcagagcttggggcaagagtgagagctgacactttctttggaaggtggaagcccgggatggctagggtgaaaaatagaggggaataaaggcaaggaaacatgagaagcaactcgaagcattcttgccggccgcagcttcaggggccctaaagagccacagttggtccttagcaggtgtgtttgtatgacacagaggactcttagtgaaaatttgcaaggaagaaaccacaacttggaccagccctctgaaggcaaggagaagggaaggaggcctttgtttacccagaatcctcctgtctcccattactatggatgaaggtgtgtcccggggggagcagacaccctcgcatttccagttcacatcacatttccttgcacttgcccaggaagcaaaaccccatgcccagaagatcaagagatttcattcaagcttgggagtagagcggaagctccatgctgaaaagtcccttgagtggggatgagggccgggtaaacccaggactaacttggttaaagttaaatctcttgagagtttgacaaggacac

SEQ ID NO: 41152 - DNA, 1089 bp, Homo sapiens
gagtgggatgccagtgaggggaggatcataggacatgagttcgaggtcaagatcctgtgtctcactttactaattatgtcaccacgggcacatttcctcagagcagttaggtgaatgctgacagtcatttccatgccattgtggccttggggtcccacgtgaaatactaaaagttcctcctgtgtcaaaacggacagagcctcttctaaatgttagtctctcatcagatccccattcaacaagagggagatttgtgaggactgccatgatacctcttattgccatagccgcagtgttgagcagagctcctagcccattttccatagtttcagcagttgacaggtgctgatgagaatatattcataaacaggccaggcacagtggctcacgcctgtaatcccagcactttgggaggccgaggcaggcagataacgtggggtcaggagttgtgaccagcctgcccaacatgatgaaaccccgtctctacaaaaaatacaaaaattagccaggtgtgatggctcgcacatgtaatcccagctactgggaggctgaggcatgagaataacttgaacccaggaggaggaggttgcagtcagcagagatcaagccactccactctagcctgggaaacagagtgagactctgtctcagaaaaaaatgtatacatatatacacacacacatatattttatattatatatgtattgtatatttttatatatattatatataatatatactttatatataatatatatactttatatataatatatcatatatactttatatataatgtatatactttatatataatatataatttattatattatatactttatatataatatataatatattatatataaagtatataatataataaattatatattatatataaagtacctataatatattatattatattttatattttatattttataatatatattatatattatatattatatattttatattttacattttatatatattttatatattttatatattatacattttatatattatacattttatatatcttatacattttatttattatacattttatat

SEQ ID NO: 41153 - DNA, 1033 bp, Homo sapiens
taaccaaggacccctatggacatacttgatttatcacaacggctgcagagtatacattccattgtactgtaatttatttagctttgctctattagtagacattgagatcgcttactttttttccttctccaaatgttgggattaacagcagtgtacatgtatctttacagccttgccagtatttctaaagaacagatttccaggagtagattttccaagccataaaaataactgaattctaagatcactctgaacagactagtatgttttttggtggatctcagaaggaaaggaaggcattcactgtgaggacaccccttcagcagattcagaataagtcattttctgaatgttttatcagtgtcaccatcaatactctgaaatgcatgcatttgaggattctatggattcaagacagggttagcgctgtctcttttgtattgagagagagagagagagagagagagagagagagagagtgtgtgtgtgtgtgtgtgtgtgtgtgtgatgtgcatgcaatttggtaaagaaccgtatttattttcatctttatttctcctaaagattctaagccaagttatcactttgcctaagagctcttctagggaaataaattaaaaacacatccagaggcataataaataagaaacttcatcttttccagctatttcaggcttccaaagtacgctatttattctaaaaaactgtcctttattgaaatactaagcatattctgctgtctctgagatagacaaaattcctacttgtagttttaggaaaaaattttctactcattctacggtttctactcatttagttaaaaaatatttattaagcatttactaaataaattctaaatactgtaagggataagtataataccaaaaactaggtgtttaccctaaggaagttctcatcaccctaaggaatttatagtaggaataatatatagaaatataaaaaatatttcttcgtccttggcaggacagtgggagatataaaaatagtaaaagaaggctcatccatttcggga

SEQ ID NO: 41154 - DNA, 1036 bp, Homo sapiens
cagtatggccattttcacgatattgattcttcctacccatgagcatggaatgttcttccatttgtttgtctcctcttttatttccttgagcagtgggcaaaccttttattttacttttcaggaatcacttttaacatcttctttaacaatctcccttttgctcttaaagttataaacatcaaattatggctgagtggcattacacctggaataaacttcaaggcacactgaagaacttacaatcaggcagagaaggggcggatgtgggttgttatattagccaacttttgttttaagttagacttcttgaagacatgtaccataaactgacagcctccttctcagcaaagttgtgacatggttttgctttgtgtggagtatattgattttctttctcctgataaactttgcacatcatctagaggctttattgacatcttgagagaaaacaaacttgtaattgaacatggtgatagactcattaactttttaggtctgatctgtttgactaggtgtaacttaattgtaaaactggcattgttaatttaacaaagtgtacatttattatatagtcctccagtttgcatagttactttgtatcagaactgataaattcagttactgggtttatgtaatacccagtaagtcgaacacttcagtatgaaggctaagacacaataaagaagtcacaagataaacaggctttgccatggctattttaaaggctttttttatgtattaggtagagaatgttgtggttatgctttatctggcattttttggtttgtttttgtggagtttctgtttgtttttaaagacagggtcttgctatgttgcccttgctggtctcaaattcctgggctcaagcgatcctcctgcctcagcctcccaaatagctgggacaatgggtgtgttccaccctacccagctgacatgttttaacttaaagaaaattaaaactttattattaagattaataatgaaacctctgcatggataggaagacttaaaactagtagttgtgtcttagaaaaga

SEQ ID NO: 41155 - DNA, 1050 bp, Homo sapiens
gaccagtgttgtaggtggtgctgggaatataatagatataaaaggcaataaacaaaaatcaccttctcccctggctcacttttcttttctgttcccttttgtttctcaaactatgttttaaaaagttacgtgattcaagcattttaatttggtccaagtcttcctgctctatgacctctgggacagcttgcctggagggagacttggaggctaacatcctaccaaggtgtataagacaacaaggtgtacaagatgtataagacagccagagttggtttctgctgcttgcaaatgtaaccgattaatcaactttcaggctcaagtgtaattaagtttgaattaaactttctgtgaagtcccccttgtctctttagtagagcctcacagggtggggaaagacacctcggtaggctgtgtaatttccaagttatctaaaaactctcagaatttctccagctgtagcacaatatggttctatatttaagatgatccaaaatattagaccagtaattatcctttgatttaacttcaagtgcatgcagttagtatttctgaactaggagggacacaatgactttctgttgggaagattcaatttgtaaaacaccaattggattaggatgtgtttcctatgaatgggactagttgtgtgttaaatgaacaagaacaaagcacaagggaatgaatacctgactagtggtgaaaaataagaaacatgccttgaacaaggatatagaattgattagaagtctggtgtgaagccaaaatagatagtgatttggataaatgattatataaattcttgctaacaacccaagatgtgtgatacctttaaaatactgtgtttcatatcattggaagaattgtattttaacttcagagttaagatatatagaaatagaaatatgcaggttaagtgaaatcaaacgtttcaatacaaattcctttggttctgtgtgcactcagaaccaaaaagaagatatttatgggtgcatgagtttgtgtggttgaggggacggcaaggacttgggattcagctgacttttattt

SEQ ID NO: 41156 - DNA, 1046 bp, Homo sapiens
tcttctgtatcacagaaatgcgtacgttgagagcctttgtcctttgcctagtattttagaattaagattttatttatcatatgttattcattgggatgatgtcagttaattaaagtctagagaaatgtgggtcaatgttggtaattcattgacttttcaatccagctatttattttcatccagcccacagtagtgctagcctttcattgcttctttaatagagatccctctgtaatgataactgttttttgtttgtttggtaatgattttactcactactctttaagaaaaagggagacagaaaaagaagtcggtcttgcagacgcaagttccccaagtgtacctttagaatgctcaaaagctcagcatcatgaggaccctggagagatgggaacataccagatgtcgctttgcattttgttgtgtagagtgtctcagtgtttttgttttgatacccagccatgcgcttgacccatgctgctagtttgaaattctcaaaattgtgggcaggaagttaaaagcatattactctgaaaaagtatgtgtatatattttaaaacatgttacttattgcattacttccaaagtacatggttttgttgtatgtatactataaggagtgactactattatagtgagaacctgcttctacaaaaaatagaaaaaaaaaaattagctgggcgtggtagcatgtgcctgtaggcccaacaacttgggagaccgaggcaggtggatccattgagcctggaaagtcaagggtgcagtgagccatgatcatgccaccacattccagcctgagtgacagagcgagaccttatctaaaaaaaaaaaaaaaaaaaaaaaaaaaaatccctataatttattgaatgcttaccataaatcatgagctaagctcagactttacctaaatatttaattgttatgatatttgtatagtgctttttctaatttcacatatgcatatcattatggcaatgaggtacaccaagccagtattacttactttttatgtaaaagatattaaaagttttacaaagtctgtcagt

SEQ ID NO: 41157 - DNA, 1098 bp, Homo sapiens
ctcctctggctttctcaacacaagacacaacctcatctaccccaatctgtgcctaagtcctgattgctttaggtggcatatatgacctatttataccaacttcctggtattcttggtaaaaatggcaataaaaatgaatattgaattccaagctaaattcttttcaggcattatctggtttaattatttcataagaacactctcagttaagcattattagtaaccctattttagatgtgaggataataaggcttaaagagattaaggcatttgcccaagaaaagaggaacttatgagtgtggacttggaggttgaacctggactgtctaatctaaacatttaactcctttagcttttcagctttttttttttttaacacacagatataattacgatagatgtcacatactcatatgtccacagtgatcactcaggtgatgagaagttaggttagatgtgggcagtagggggcggtgaggacagtagtggaagggtgaggtggaattcatgttgaaaagtcgcttctgccagttgctggcaagaggtgagagggaaactcagtatggctgtattgttttctttttaatcaaaagaaatcatcaatctggaattttacatgggatttctcatttaataatatgctttgtgtgggaaaaaaatagaaaaacagaaagaaaaccaacctgtagcattggcctaaacataacaagccaaaatagagtgttgtggggactaaatggtacattaatagtaggtacttaccagagcctgacatgtcgtaatcctcaggaacagtaaggcttggctgagaggtgatgacctgtgagcctaagaaatgctcacagcctcttgatgcagagcagtagaggtaggggtggttttacttctctgaaatcagttagccagagccagtctgccccattagaatcctgacttcctttgctcttacctatgccaacttggtaatatctattcaatggtacaatagtatctatttccttttgtgcagattagctcatttacgaagagtacttagaacagtagccagaacataaatatttagaaatgtaaaattctttattgttattctattaatat

SEQ ID NO: 41158 - DNA, 1047 bp, Homo sapiens
aattagttgctatgactgtattcatttgtagtgctttacataggttggacagagaaatattgcatggaataagtaaacgtgaatttcactttggctttgccaccagcttccatttttgtaagttcatttctccaagaaatctaagtagattcacctttctttctctcccacccctccaattaaagtaaccattatgctagtttaatgggataagtagtacttttttcatcttttgtttggtaataaaatgtaatttggggaaatgaagttgtttcctggatacctcaagccaataaaatagtgacacaaggacgaatatttatacaacatccttggtttttcagtccagtgtccttatcttttgccttagttagtgatgttaaaatgctatgcctttttttctatattaaaaaaaaatctctgaattcgaaagggtcaatgagatatatctccatgagaggcaacatccaaatcatctgccaggtgatcccaccttgtcacaaaggattgtgactgacagcagaaagaaagcaggcatgagaaaacgagatgcagtcaagagctgacgatcacatcaaaaaggaaagaaaggtgaaacatttcgactacagtgaaatttgctgttaagctttttctatggagagaaaagctttcttcatagagaaaaccatatttcaagaattaccactcaaaaagcgtaggtggccacttgatgatagagaggccatgtgtactcattcttgatgacaagtacagggtgacctaattgggggctttcactccagcaaactgccccgattccactgaccccatgacgaggatgcttatttttccaaatagccacaagtcttgaggcaggataccttcagggttggctaactcagctcctaggtctgccatccttagtgctatgcaaaatgtagacgggctttgtaggggaaaaggggttatttctgttattataaagaggggagttcacctaaacatcatcagctaccctgttgttggttcctatccgtggatgctaatttctgccagtgatctctg

SEQ ID NO: 41159 - DNA, 1044 bp, Homo sapiens
aaaattcttacagcctggcagcaggtttaattgaatttatcaaaatgcttccaaataaaatatacttactcagcaacttgtaaggaatatgaaaaggagaaggaaggaaatctagtgactttgcttccatcctacctccagaaacatagttttcttcttggcacagaccgaatagacttgatcagaataattaaccatccttaccacctcttagcaaaggacagacttcttgacagctaaagctgctctgctacgattatcttgaatgtcaccaggtagaggtggggtctgggggattcaaatggtgggaaaatatggaaagcacttaaatgaggatttaaaaaatatattatttaggaaaataggacagaatgtgcaaacaaatactcaccctcgacaattttgtcattgttatggcagtggtataaatggaaaccaagggccattagcacaaatgtccacaagtgccaggccggtattttaaagcatgatactggaggtcaaatattggaaagtagtggagccactgagaactggagatggcatgcctgatttaaagacatcacaatttttaaatgattaaaattcagtgcactaaacaacagaattcagcgttttgcagtctttcaaatggagagatgcctattaacgagtgttgctgagtattacctatgaagatctcccattagtcagaatagtctgaataatatattctaaaaatacatttctttatttaaatttgaggttgtcttaactttttttgagacagtctcactctgtcaccaggctggagtgcagtggcgcaatttgggctcactgcatcctctgcctcccgggttcaagcgattcccttgcctcagcctcccaagtagctgggactacagatgggtgtcaccaggtccagctaatttttgtatttttagtacagacgggtttcatcatgttggccaggatggtcatgatctgttgaccttgtgacctacccgcttcaccctcccaaagtgctgggattacaggtgtgagccatgagcctggccttcttaa

SEQ ID NO: 41160 - DNA, 1042 bp, Homo sapiens
gtgtttgtgagtgcacggacagcacatccttcagggactgtgaaatctgagacaccacaagggtacaaagtagaaggcaaattggaaataatttttctccaagttgatagtgaccagggggtgggaaagttattcctgcattgctgcccccaacatacttataactcctttgaaatttgaggcttgaagtgtttatttcacaagtagctcatgctgtcgggcaaagtgcggttttgcgtaaaaatagggactcaaaacaaagattgattcatcagccatgatgaactttgttttgttaaatttaaacaaactggtccaaactcatacttttttgtgggatagattttctatctttcctcagtgcaggcagttgaaaaatacagagttttaatattctgtactgaatccctttctaatgttttactttgtgcacttagaagataagtattcttctgtgaaacaagctaaatgtatgctgcttcagcttttcatatgtcgctttggaggagggccagcagaagaattctagaatataatgccatccttgattgtttcatagagattaactgaatttttgtgcattggagtaaatttgaactttgtttaaggtttataccagtacatagattattaggttgttctttaagacactgccttatttagagtaggtgacatttacaatttaggaaaaaggaagaggaaggaaggaaggaaggaagggtgagctccttctccctggacccctgctcctttctccctgtgccaaattgttaactcctactcatctttaaagtttcaggagtggtggcttatcctggatctccacagacagacccagaccccaggcttcaggaacacctttacccccttcttagtatcacctatcagagttctaatttcagtttgcatgattattaaatatttgtctttcctgctagagtgtaaactccatgagggcaggaccctttcattgcttgactatggattcctaatgcccaagagcctggcaggggctagtgtcaatcaccagcactatttgtcc

SEQ ID NO: 41161 - DNA, 1958 bp, Homo sapiens
gagcaaatgcatagctttaaatgactgtggtggtctgtgttttagtttctttcccttgaagctttagggtgtttttttttttttttggtagtaaacatttgggtaaaccgaggacactgtaagttcacatcagcagatggctcttccctccttgtcagtacccggtttcctgaggtatgagctcccactctctacagcaccccccctatatctatcccttgcttctaataagacctcccactcctcccaccctcccctgcctctttctttccggctgctcactttgccttatatgttactgcaatttaagaaggtgacaccaagagcactcactttcttgtcttccatttcttgagaaaaagcgtcctttctcctcttagatgcaaaggcctccacttgtgctggacacccacctctgcctcatcaaagaggttgttcctttggctggtcccctctctcctttattgtcttctctcatttccccaatgcacattgtgttgtaagagcgtctgcctcttaaagaacttacctggaccccactcacttcacttcttgccccattttcccttcccatttaatctttcctcccctgagacagcatcaccaacagctttgggcaatgccaagcccagttagatgctcctctcgtttgttcttacgcagcctctctccagcactgggcactgtggaccaccccctctggttgaaactctgctttcgtggcttctgagacctggtttttctcctacatctacgattctttctgcttagcgttttgagccttttctggcttgaacctgaacaacttctgaaggttgaaggtcctcagagcttggccccacgtcctctctatcttctccttgagttatattcccatggctttagaaaccatctatatgctaatgactcccaaatttatatctccagctcagctctcctctcagcactcccgtctcatttatccaaattacttacctgacaactccacgcggatgtttctcaaacatctgaaatgtaatatgttcaaaactaaactcttgctttttttcatggaaacttatttctccatgaatcttctccatctcagtgaatgacaactcattccacataattgccgaagtaaaaagacttgatggattttgattctgcacctcccacactcccacatccaatccatccacagaaatggttgatatacctccagagtacatcttccattgccaccgcgataacctgccggcaccttgctttgtctctcgccacccgctcatacagtgttcaaggtactcttattaaaacgtagatcggtcccttcactttcctgctaaaaccccgttttttccccctacattgcacttagcactttaagtcactctcctggccagtatagccatgactggcctggtctctgtctttgctgtccgactcacacctatggccaccaacgcctagtcacctgattttccatttgtgcaacaagccggatttgtgtactttgttcacagtgttccctttgtttggaatgtgttttccttctctcttctcatggctgtgttctttttattcaagtttctatctaaatctcatctctgatttatttctctaaccattttttctaggtaggatacctagttattcttgaccacagtatcagttttatttcctccctagcattttgtattttatagtgaacactttgtatatttgcttctgtattacctgtgtcttccactagactccaagtctcatcatcacacactgactgctgagcacatagtagggattaataattgttaatgaatgaataacttgatctgtcaatctccaaaacaaatgaaatattcaaggattgtggaggacaagagaagaaatggtctgtttcttcaagtagctcacaaatacatgttacaacgatgaggccggagcttctgtatgaacttactctgccctcaacagaa

SEQ ID NO: 41162 - DNA, 1023 bp, Homo sapiens
gaggggaggggaggggaggggaggggaggggagaggagaggagaggaaaagaaaagagaaagaaaagaaagaaacccagaaaggtatttgttgaattggtcttgaaaagttaatttgaagaactttgacaatatttctgaaaatccatttataggatatgcccacaattcattgtatggctggcttttttcccttaatttagagagctggaaaatcatgatatacaagcataaattaatgaattttttgcttgtgattcaccttctgactcctggatctaggagcaaggggaattattctgattattttttcctggctggactttgaaataccctgtctctaatcagtagcagctatgtttaaattctttttaggggcaaggcaggaattctaatttttctgaatgtacagagtgttcctctcagcaattgactttgtttattgactaatgacagattttccctcatgttggttaagaataactttaaaggtatatcagataatgttttgtgtacagtgttctatgttctctgtccaggcatatgtaaatatagtcagtgttttttttttttttgttttttgttttttgttttttgttttttttttttgagacggagtctcactctgtcgcccaggctggagtgcagtgacgcaatctcagcttactgcaagctccgcctcctgggttcacaccattctcctgcctcagcctccccagtagctgggaccacaggcatctgccaccacgcccggctaattttttgtatttttagtagagagggggtttcaccgtgttagccaggatggtcttgatctcctgaccttgtgatccgctcgcctcagcctcccaaagtgctgggattacaggcgtgagccaccgcgcccagctattttcagtcttagccagtaaactgcatttaaaactccaagtacttcagtaagacagcagagatttccaaaggtttcagaggatagtggtgggttatatttttgtatggcttttctgagggttgttttattttc

SEQ ID NO: 41163 - DNA, 1029 bp, Homo sapiens
tttgccaacctctggcttaggggaaaagctgaagagaaagcgagtatgtatttcctcaacttttttggtagttaaggcctgaggactatggctccagctgatgtcatttagtagcaaaatatgtaggaattcgcagactgttgttttttagttgttacctgccacttttagaggtatctctgcaaccttaataattcacaactgagaaatctgtcactcaacagtaatatactcagatagggaactcttccctgagttatacacaattcattcataagaaacaccccacgaaccaaaagaaaaaatcctttgttttgtgtgaaaactaaaagttggcataatagcaatgcatcctggagcttctggggtttgggagttggaccaaccctgtgcggtccttgtgatgggtaatgtcagccaagaaccccaggcggagaggatgtgacacacttagtatggttgccgtcctgcagcctcttactttctgcatcgccaagccaagaacaccaatttagctgcgaactttgttcccccattgctttctaaaaggccactctctgcttttgagacccattggtgctttgaggcttatattttaattttgaaaagagcttacctgattttcttatgattaaatacattttagtttgtttgcatgtgaaaatgttgtagaagacaggtaaaggaatagacatgggttttcactttctagcccacttctatgatagctcaggaccaacaacttctctaacccagatacctacaatggactcttaatgtgtctttgtgtctttttgttcctgctttgtcccacaccgctctgtgtccccactgcagtgagaatgatgattccaaatcacacatttgggctgccccaactcctcagtggctctttggagccttcacaacaaactcttaattctccaaaaccacatgcaagacacagtgttctggcttcacccacctctgtggcctcccctcattaccctcaccttcaatgctgctctccactcctactgacttgatgcc

SEQ ID NO: 41164 - DNA, 1030 bp, Homo sapiens
tcattttgcttgaggcactatttcaagagtctaaaagagtttcaccttcattttgaagtttgttttgtaaagttattatagtcatttatgtggcagtaaatcaatccttattggtatactaaaatctaggtattatagatgctagtgtcactatgcagagaatcctgtactttttaagaagttggagtcatccagctgttccttactctgatgccctgagagagtatggctctcttactgcgaatgcatttcggacacaatgtgttgctcgagtattggtttttctctacacatgtaatatccccaaagcctaaaacaagatgtttatctttttgatagacaagcaattaacttttgggggggagtttcaaggcagtaaagcccatctgttaggacactggaaataaataggaatttctgacagaagaacattatggcctttcatttgttatgctgtagctaaagctctgtcagcatttttattataaacctaggggattatcagtctgcagtaaaactctttttggactgaggcttatttagattcagagcgtactcacgaagaaaacctttactttcctgaacacgggatagatttgtttctgcttgcctttctaaaggagaaatgtgtctgggatttccatataattgtataaatttataaaatatttgatttattataaacagagtcattggtgatcacagtacattatttcctataaaggcagtgtagaaactggttggcagcatagttaccaagtagcgcttaaaatagttgtttatttctaagtcatacagtagtaggattttggcagttgccagatagctcaccattatccatgcattgataagattgaatacacacttcataagaccctttccttaaaatattgaaatttgagtggctgatcctgaatatcattcctattctgaaatgtgctccaaacagttttaaaaaatgacttcagtttcagacagaaagaggcatgtaatagtaatttatttttattcacatgaaagtataaagaca

SEQ ID NO: 41165 - DNA, 1050 bp, Homo sapiens
tctcttgttttcctgttctttcttttactgctatatcctatacagtggcatcttagactcttgacctggcctcaactacaacctgtcctgtgatgactcttgacatctctcctagtattcaaaactgcccactgatcatctctagttgctccattgttattggttaatatgcccaaacagttccttaagttataaattcttaaaagttattgcagattcttgtgtctctccacctatttgtttcgccacaccattgtgtatggtgataatttcttcacctgcgttcaccctgcctaactgccccattttacccttcatcatctctcacctcagtcattatagttgcttattaactaatctcttggtcaccagtctccctcgcctccaactccagttaccttccttaaataaagaaaaagaaattgatcctaccagtctcctgtttacaagccactgataactcctcattacctataaaataaactccaaagtaggcagcgtagagctcttcacaatctggggaaataatttctatacaaaatcatttcctatgacaaacattgagttgatagtaaatatttttgaataacctcttaaaacatcttccaggtcattgaatgccctctattctgggtgaagccatcacagactgtttcctgaatgtgctttcttttcacctctgcactattatgtatggtagattcttcataaggaaggaccttgcatccttcaagacagagcccaagtatcaagccctcttagaaattgtccatcattttcagggcatagttagttactccctccttgaagttcagtttgagatgataggattatgtggttgcatctcagtctccagcactgcattgaattctgtagaacagagactttgccttgtttatcctgatgttggattccctccaggacatactacgtttaaaacattggtaattatctgctatttgaagcttcttcagcttgttcaaaatttgaatggtcagttactttcaagttttcattttaaaatgaatattttattgaatataatgcagt

SEQ ID NO: 41166 - DNA, 1032 bp, Homo sapiens
ttaattcatttaggattatggcctctagcttcatccatgttgctgcaaaggacatgatttcattctttcttatggctatgtagtattccatggtgtatatgtaccacattttctttatccagtctactattgatggacacctgagtttattccatgtctttgctattgtgaatagtgtagcgatgaacaggtgagtgcatgtgtctttttggtagaatgatttgttttcctgtgagtatatacccagtaatgggattgttgggttaaatgatagctctgttttaagttctttgagaaatctccagactgctttccacagtggctggactaatttacattcccaccaacagtgtgtaagtgtataagcgtttccttttgtttgcagccttgccacatcttttttttttttttttactttttaataatagccattctgactggtataagatggtatcttattgtggttttgatttgcatttatctgttgattaactggctgtatgcagaagactgaacctggatgcctttcaccctatataaaaaaactaaaaatggaccaaagattaaatgtaaaacctcaaactatcataattctgaaagacaacttaggaaatactctagtcaacattggctctgggaaaaattttttggctaagtccccaaaagcaattgcaacaagaacaaaaataaacaagtgggactgaattaaactactgagcttgcacagcaaaagaaattatcaacagactaaagagacaacctacagaatggcagaggatatttacaaactatgcatttgacaaaggcctaatatccagaatttatagggaatctaacaaatcaagaagcaaaacacaataaaaaaaatttaaaaatgggcaaaggacatgaacaggcacttcacaaaagaatacatgcaagctaccaacaaacctatgaaaaaatgctcagcatcactaaaaatcaattcttaaagcacccttcttataaggaattccaggcagaacgcagagttagtattgcagtttttag

SEQ ID NO: 41167 - DNA, 1050 bp, Homo sapiens
ttgtgtcaagtgacagatctgcctgtgtacaattattggtggaatcatcagaggctgttaatcatcaccaaattgttttccttggaactgttttttatatgattaccactgagaatcaacaaactcttaaatcataatgacagttgaaagacctaaatgtcaaccaaattaagaaataatttcttagagtaatgaaaattaataatattattataataaaataagaaaacttaataacaagatgaaataatgttaacaaagctacgacataaggtctactcttggagaatatttgaatttcagggtaaaaatggcatcagaaacactaacagtctcatataaaatcaagcaaagtcaaatttgaaccttttgagtatgtgggatcctgccatataatcacattggtgatttcaccctaaaagccaaacatttcattgcactgatttgattttaaagacttctaattttctggtaaaatacccagaatgagaaagaggggaagggaacagagactaaagatagaggaaatttattattttggaaattgaatgcctagctcagaatgcagttgattacccttctcaagacccatgtctatgttcattttccacatgtgaaaaatatataaaaggctgttaccccgtgagctgttgtgtgtgaaacttgactcttgtgagcacccaggactgtcctgcatgaaaggaagaaatcaagtcaagtaaaaagatactttgttctttggtataggcagaattaagaattaaactcattatttaaatacttgaggtaagatacagtatttgaacttctcaaaagtgaaattagggaattttagagattaaaaggaacataaatgtttaatattacaggtgagaaaactggagtctaagaatgtttaattaaataaagatatgtctcccagcactttgggaggccggggccgatggatcatgaggtcaagagatcgagaccatgctggccaacatggtgaaaccccgtctctactaaaaatagaaaaattagctggccatggtggcgtgtgcctttagt

SEQ ID NO: 41168 - DNA, 1026 bp, Homo sapiens
aaagattagataggcatttctaaataattggcaagtccctactttggggctgacggttttaagatcaatgaacagaccatgtggacagcaatcactcatcccatctctttactttgttgaatgtcttaggtaccgaatcttgagggttactagtgatagaaggaccaatgagttctacctccaggagcctcctactcttgtaggaaggacaaacaagtagataaataattagaatgcaaattgaacactgtctcagaggtctgcataaatagctatggaatcatagggaaggaagcagttatccaagggggtcatagaagactctacgagaaaatagtgtgtgttttttattttgaaggatcagttcacattttctacatgggaaggggagaagatgcagaggaaattgcatacaaagacacagtgtgatggtgaaacagatttagtgggcagaactagagaacactgcataaggaaaggtgagaagtgagcctcttgcatgctttcataaggagctggactgaatcatttagcaagaaccagctaattgtgattgaaacaaggggtaaaatacttaggcttatttctgagaaagtagtaaagtagaggacatgctttgaagcttaaaaaaatgagggtgacttctttataataaaatgattatactatacatttaaaataatttttgaattttgagttatttttgttgaaggaagctattttgtattgtgtgtgagagaaatctgtgttctttcaacattctagtagtgagaacaggaaaataatggatgaaatggctaggataggaggattatcataaaatagagtgtattttgtatgcctggcataagtttcacagggtttttaatattgttcttgatgtttcataatgatatgacaaataaattttgtttagatgaaaatgttttctttgctgataaatatactctgtccaagcagtagcaatgcatttgggtgtcctcacttttatctaataaaactttcatggttctatcattttacgaa

SEQ ID NO: 41169 - DNA, 1029 bp, Homo sapiens
accatggcacacatatacctatgtaccagaacgtgtatacctgcatgttctgcacacatatccccccaccttttttttttagaggaaataaaatattcaaaaattcaaaaaataaaatgaaaaaaaaagtattgtggggcttcaccagtatagcaaataactgaattcagctacattctccccatccaaagtctgggcttttctttttagtttcatgtaacttgggagttgggggtaggtttcagatagaagttgtttttggttttgtttcaattctatcttctcttttttataagtgaggaaactgaagcccacttaatccccaatctaacttgttgctttactcctcttgtcgtctcttttcctggaagtacacacttattttctgtctacaaggaaccagtgcaagttctaatctaatcatagtaatttttaacacctgtcttaaaaaacattttaaaacaatatttaaaatgctcttcgttttgtgattgtttcctctggacatgcagcagtttcaagatggcttttactaaactttacagtgatgtctgcaactaacccaactcatagggaaatttcctttttttttttttcctgttcagtttcttcctgggtagcacaaaatctccccttacgtgctcatccccacatacagtggtcaggttatcacctccttgcttagaagagtgtcagtctctgtggccttgatattaactcttccctgccacacttttctgtgaaatgagatagtaatggtgcctgcctcacagggttattgtgagcattggaagaattaatccatgtgaactatttttgagcaatccctgatatataaaaggctttctgctaagaattagctgataaggaatgtaggaccatcggctggtgggttgtgcacaggcaatgggttgatgttttgtagggtggaggcatatttgggagcagctgggtgtcgggttctactctgctcccttgttctcccagtgcaagatgcttccccctgccttcatcttgtcaaggctcttg

SEQ ID NO: 41170 - DNA, 1053 bp, Homo sapiens
gatacagaggcaggacaaagacaggattgcagatgaccattgccaagcaacccagatgttcgttttctaggtttgcctgggcacaggcttatcctataaccttctctgtggtgcccaggcagctgtagttcaggcctactcaggctttttatgaccttcgttgtactacttagataaaacagaatacttgaaatcactagttacagagaacaagagtctataaactcattctgtaaaacaaaggaaaatttgtttttcttctccctgtgttgagggagtgctgagagagtctccagagcatattagataatattatcaagacttttcctgggtctaggctgtgcctgttgctgcttctggaacaagttagcctaaaacaggaaaacttatttctctttctttttaattttattgttctttaatttcccgcctcaaccttactgcgaataatattctgccactttatttaaatcctggcttagtttaaggagaaacgtaaagatgggtttcctggtagaataggagtaaacaggactgactgtgacctcactgctaatgacatgtaccttccttttactttctcaaaaccgaagattcccttattggcatgaggactgtttcaaaagtacttacatttcccacctgcattgtgattgatgtgttgaatgccctgacccaggcagctacagaaacataatttaattgaagtcggttaaaaattgtgcctttgtggaaagtgtggagaaggacttcaagatgatataaagcagaatagaaaagcttaaaagaattcaatttagaaaaatgtaatttttggtacctctattaaaaatatattttgacttttttaaaaatgagcaattctttgtgtttaaaatggaatgttagtggggatatttgtggtatgttctaaatgttctgtagaactggatttaggtatttgagtaacagcagatattagagtgcatggttatatatacaacaatgttgtcagtattgaaatacacattcagtgtcttagacttttaagaagatttttgattgacaaaaacc

SEQ ID NO: 41171 - DNA, 1028 bp, Homo sapiens
gggctctgccctcctacccctcccccacaaagatgtcccctccgggccattgttcccttgcacttgtcttccgtgttcctccctgatagctctgtgcctctagcgtacagcacgatgtgggtctctgttgttgaatttaaattggcccagtgaggcaatacagcacaatggggaaaagctgtgtctcgactgggtgccatcgggcaggcagcttgagctcagccgtcctcagtcttctcagctgcaaaatggggatgctaattgtgaaagggaaattaaaaatcgggaccacaattcactctgccaaaagaaaaattaagctgaaagctgagtcatgcaagatgcggcctttccttttgttcctaagcagagagctacagataaaagcttcaacatctccacaggtagcttctcagtgttcaccttatgttacataaattgccaatttactgagcacgatttactgagtagagaggaatacgtaacgacgattcccctacctgctccttttctcttttcccctttaaatattgaagccctcaaaatcaagattggagaaaggcacacaccacagattgtttctgtgattccatgtttatttcttctgggcatgtccttaaccttgggaaaataaacttctaaattgattgagacctgtctccaaaactttttggtttacataataatgcccattttatcatgctaccatgaggatgacattgggcaatgataacccccgacctatgcctggaatacagtgattgctcaataaaaactggttcttattataattcttattaatgtcttttttaaaaaatcaatctgctcactgatttttattctttcttaaaaaaatagactacctttagactgcctcctttcatcatgcacaatgtgaggcattgggggtacaacgggaagtaattgtctctgccttccaggaattctgcagagtggtaaagagggcaagtaccaaaaattacagagcaatgagctaggtcttgcaatgggactatccttggtctcct

SEQ ID NO: 41172 - DNA, 1028 bp, Homo sapiens
ggcggcgggcgggcgtggggggtccgggccacgcgggcgacgcgcctctagggaagcgatcttgttgcaccttcccgttattctgaaagcaaatcgtagccagacccgagcgcagcggcttagcaaataataaggggagcgtcagtcgtgctcgaaatgcttccttcgcgatggcgtcagtgttccgtgagggaatgaagccgcagtaggaaataaagaggctgtgcgcgtagtctgaaaagcagaagtcaacatttttacagatgaagaaagaatacggaggcaagaggtctttctctgcagtttggtggatttccaacatttagacttgtttggaagaatttcctcagctgcaccaatgaagtccttgatctatagaagtcggcagtccctaaatctacgtctgcattttgttgcaaatcctttataacattccattaaaataatgcagagttatttaatatccagttggccatcgtgagagtaattcgcggctgagattttgttaatcattctgtcttctgacttaacagtgaacgtaggtgattttttttgtaaaatgttgcttcacatgaattgtgagaatcacctctaagtttgaattgtactgaaggcactataagaatttcaaatgaacgctgagtagccagtagccttctggccttttcgtttaacaagcacagagttcgtttttaaaattaagttactttgacagaggaaatgtaatagccttggtagacaacattaaaaatgtaactgtcagatgttttaaagtctccaacagccgtatctgttttagagccatagaatatttacttactgaattgcctgtttaaagatgaactttctaaatgcagggaatagtaacttgcaaaaaagctatggtctctaagtaatgaaggctgtttcagtacctagaaaaatcaaaatcaaggttttgatgctgctagtgtaaaagatgcaatccccttcttaatggcctgcttatttattaagctcctaggcactatgctgaatgccctacatgc

SEQ ID NO: 41173 - DNA, 1025 bp, Homo sapiens
atttgaaaacactccaggccttgtttgcctagaaaacaccaagtttacattgaattaacatgttgtgtttgcttcacccattttctagcagacagcacaagacaacataaaatgttaaatgttatgattgactaactctaagtccattctgtagttttaaagattcagatactgtgtagggaacccgtggtgccgcagtgatggcttcaggttactgagccagcatccctgagtgccaacccgcaggcttccccgggagcttccgtggccctcggagtctttggggcaacaacgcaaatgcacactcactaaaagcacaccctcctgaaaagagaagtgctgggcaaaacacagtggtgcatgtgtgtttatgtgtacgtgttgggattctttctgctataggaaagaacacattcagggctaaaacctcacatactgtgtacacagtgataagtatactcatggtcttatctttaaaactctgggtaaagaaattatgtttttattttgactatctctgtttgccatcaaatgagtaggcaaatgataaatatgtaagaccaaaaagttaaattttatccctgatcctctctaaccttaaacatattagagttaaatgtgagaggcttaaacatatgagtgtccacagccttgtgaattagaaggaaaaggaattcttctccaataccaaactcttactaatggaatgccctccggatgcatagcactatacataatggtagacaggatttttgttaaatattcatttcctgtgaaatattcatttcctgtgctaaaaataaatttcatgagctaatatatccataaagttatttagttattcaagttgcagattggcactctgtaaagctgatctgaatttgaatcctcatcttaactgtgcatacctttgatttttccatcacctgtaatgcaacagtgttgagagtaaaacttctccatcacatgtatttcctaatgcaagaagaatcctcaaaagcaacacttaccaaacaaacatttat

SEQ ID NO: 41174 - DNA, 1033 bp, Homo sapiens
cccaaaacctttcattagtgtgccagatgtcattgactgactatatagtttcaaataactaaaaatgtcataagattagagcttgtgcttgttattggtggtttttatttgtattttttccctagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacataggtaaaaataatttttaaaagcttagaagcccagaaagtgttatctggaataaattgatacttaagaaatgtaatgtggcgtaagcttatatttgaaagaaggaatgtaaaaaatttacatgtttttcactttatgtacatcttgtttatatttactttagatgctttgttgtttgacaagattgctggcaatgtctagtgaggataatcaaaatacagattggaagttacactaatcacacagggattggcaactttcaaaggaaaggctggaatgatgtttctccaagaggtcccttcttgcattgatcagcattcagggtctggccattggcctcagaaactcaagagcaaatgaaaatggattctatttccagaatccagtcctattaagcaagctaatgtgattggtgtagaaactggactccccttttattgatctgtaattgtattaggcagtcacaagggtcagaatattggcatcccatggggtagaaagccaagtagcaatgaaaagtttatttggtgaacatggaattacaacaaggaggattagataaattagatatcctaatggaatcaggctaaattagtctgatgcccttttgtttttgaggatgggtgtcttgcctagtggattcagaaataggtcaggtatgttctttatgaacctgttcacccatctgtatattagatcaaagttcattggctaacctgccatctccccttgacaatt

SEQ ID NO: 41175 - DNA, 1067 bp, Homo sapiens
cattattgctggaatattaaatcaatttattctgtttactcataagatatgaatgattattttgaacattgaaactatactttttctttgccttttttaatagcccattttgactttaaaaatagtcaaaattttagaaaacagaccaattaggaatgattattctcattattgagaacattttcttaatgttccactaatcttaaattatctgttgcttttgaaatgtgatcatatttcagaaagttatctatttataccaacattttgggatcccgtgacttcttactactctttatagaagcactatttctgttacttagctagagagttcttccaattcgtctgcactagatacaatttgctgttgtatattacaattatagcaaaattattgtacttatattcaacactacctgtactggtaatctaaaatatatgacaaagtggctagtttaaatccgtccttttctacagctgtgttctgaatagaaaaggtatttggctatcaaattctcttttaggcatatatttgttttttcatctgtctttccttttttaactctgactgtggaagttgtactggtagattttatcatcatcatcatcatcatcaatcatcactattataatagtaatcgttttatcatgtattgggtacttacaatgaaccagaaacttaaatattttgtacatattttaatacagtttatttttattatatccccatgagataggtattaatttattttcattttacagatgagaataatatgcatcaaggaggttaagtaatctatttgtcacataactagtaagtggcagaatgacattaaaagatagaattatttggctccaaaatcggtgctcttaattacagtactataatgctccctaatatgtggtttcatgtactaggtaattaactttcaaaatcagtattctatgtattgtaaaggcattgccatcatgaatgtttgatgcgcttagttgcatcgttgacatttttttccaaaagcggtggttccctaatcccccagcagtggacagaatactaacagccttta

SEQ ID NO: 41176 - DNA, 1063 bp, Homo sapiens
taactggccataggcaagttgcgaagcagaaaagcttttgccacttggtgcagtttttctctgttgaataggccaggcctcctctaaatgccaggatttttttttctcccctcagtttcccaaaggcttctcttagtgcctcctcatttaactgtccacgtgattggtagtgctgcctgctcagtcctttttaaaacccagcaaaactgacctgtccaggtctcatgtcctcaggcctacgaaggtaaatgatgaacttactctattgtgggtgctcttcgaattatcttctgggtagaagtgaaaagtgtttcagatatggagctatttgagtcattttcaagccatccccagtaggtagctgatgttgagcttgctcatggttcagtttggtcgtgaaagcaacatgtagtcatcattcctatcatttgcttgacaccagctctttcctttttaaatgacatatgtttacatagatacatacataccggcataaaacaagcatacatagaaattttttttttgagacagagtctcgctgtgtcgcccaggctggagtgcagtggcgcgatctgggctcactgcacgccccgcctcctggattcacgccattctcctgcctcagcctcccaagtagctggaactacaggagcccaccaccatgcccggctaatttttttttttgtattttttttttttttagtagagctggggtttcattgtgttagccagaatggtctcaatctcctgaccttgtgatccgcccgcctcagcctcccaaagtgctgggattacaggcgtgagccaccgcgcctggctgcatacatagaaatttaagcaggataaaaggcttgtgtgtatatgtatgtgtacatatatttacacatatatgtaaaacatgcttttttgtaaatggatgaacattctaaaactttatgacagctaatgtctactttgacctcattcatcattggagactatttgtttgtttaagaagaataaacgccagaaacaacatcaggatgacttcacttaaaaataattaggagtcactgaattagca

SEQ ID NO: 41177 - DNA, 1050 bp, Homo sapiens
atggaccttcccttcacatccgggagcctcaagccacaccctgcgatgggtctgttatttctttagtcggctgcagcactgctctatgctatgaaataaacagcacagcatttcctttttattgatttataatagttgtacatattttgggagtatgtagaatagttggatacctgtgactgtggtaatcatatcggtgtgactgaggtatctgtcacctcagatatttatattttctttgttttgagaccattatgaatcttctagctattttgaaatacacaataaattattaagtgtaattttcctagtgtactatcaaacaatagaacatattccttttatccaactgtatttttgtaccccttaaccaacattatacacaatggaacattattcagccgtaaaaaggaatgaaatcgcgtaacttgcagcagcatggatgaaactgaaggtcgttaggttaaataaaattatccaggcacaaaaaggcaaatatcacacgtctgactcacttatgggagctaaaaagtagatctcatgacagtgtagagtagaagggtggttacaggtctcttattcagtgttccccgtatgtatgtggagtatgtatttgattttaggacttgcttagagaatcaatttaatttgactaatgatattatttaatgctattgacaaacatatagaaaatatgtagtttaataagtattttgtcaattcgattttaaatgtaaattaaataggggaaaagagtgcacaatttataatagtagaacaattattatatctcaagtgttcccaaagtcaaactacttgtatcttaaagaataccagttggtgtgcagtaaatgtttaacagcaacctctctaaaaacagaagggtcctgatttgtgtgtttccctgtttctctggcgtacattccctcaatatggacaatttcaagctacccatgcgccataatgaatgcagagttgggaagaaatgtgcataattggctcttgcaagccagttcggtgcaccactgccacaacagaaaagtagactct

SEQ ID NO: 41178 - DNA, 1060 bp, Homo sapiens
ctttgttaattaaggaagttttgaaatgagtgcctgtgtgatgatggtatagtaatgagaaaaatataagtatgaaaatatttttgcaaaggaaaaatactgatattagatataaaaaacagacaatccttgtattttgattattttaaaatttaacaaattaggtaaaaatactagaagttgtacattgcgttatttctgtatagtgcttgaattgcaaacaccataaaattcagttctgtataatatctcaagctcacgtgtaacctgtgagtttggttatatgtgtggtagaaagcacgatggtagagaccagcattctagtgttccttgtgccactgatattttatgaatgttggcaaattactgaacccatataggccttcgttcacacctcattgagaatccactaaaaaaatttatgttgaagcgtcttgtaaattataaggtgcttcgcaaatagaagggattattattgttcagagcaggaggatactagttgattgtttgatctcagtttgtgagttaatattttaaggttctcaggtgattactgtgtaatggttttctgctttatttttacgtacttcataaggtgatttagaatatgtaaacgtaaaagtaatacacgcatttaagtaaaacagtgcttttaattcaatattattaacaatggaatatttttgaattattctacagagtccatattttaattagcatgtccttctcttttacatatgcagattttcaattgagaaaggaattgctggccaagtagcaagaacaggggaagtcctgaacattccagatgcctatgcagacccacgctttaacaggtaagaaatagctgatgtcgacactccattgatttcttctgtgatgtcccactcagctgaaacctcttccgtggagcctgagttctccacgtcccaattcagttctttcttccttagttttcttctctgaaccaactctgctatcaatagtcagtatattcagatatttataaaatgatggattctaatccactaatgtatcatgatatctagatacaggagtt

SEQ ID NO: 41179 - DNA, 1042 bp, Homo sapiens
taagaatgcctttaagtggttttccgccctgggcgggccaggtattccttgccctcattccggtaaacccacaacctcccagtgtgggctttatggccatgaacatgtcacagtgctgctgcagagattttgtttatggccagttttggggccagtttatggccagatttttggggggggcttattcccaacatgtcccccttctttgatttgcaaatcgataaaagcaaaggcagctttgtgacggtcagctacttctcgcaggagtcaggatccacatctgcagactatacaaacaacacagatttatgaaagcacaatcatcattgaaattacaaagcttccaagtgtttttatccatattaatgggttactagctgctaatttgtctgcagctcctttaagcactccagttccttgcattaagctcaggcgtgcctgggatgctttaaatatttgttcttttaattttgctgtatccaaaaaccagtttgtagattgtccttctagaagcttttttattctttcccaaattttgatcttactaagagctattaatagtttccacaaatccttatgtttagctcctacaatgagccatatcatttgaggttgaggtgccactataccaccatggttccagataataggaacttttgctgtattttttgccatttctaccgtctgactgttttgttcagatcagctgaacgtagtgtggctgtggctcgcagactgagaggtgcaattcaagctaaacatccccttaggggaccaattagtaatgattccataggaatcgttgtgcagcacctctgcctgttctgcaatgcaatcttactaaacaagtatgttcattttttctaactgggtccaatcctgtttacaaaaaggtttttgagggtggtatgcctcaattatagtagcagatttattatggtaaatactgagatcagaaagcatgtgtaactgtgttatagagtgattgcatctaggcattattgccagccaagattgataaatatgcccaataagtataatt

SEQ ID NO: 41180 - DNA, 1025 bp, Homo sapiens
taatgaaaaagttttgaaatacagtgagaattacaaaatgtgacatagagacatgaagtgaacacaggctgttggaaaagtggcgctgatggaattttttgatgcagggttgccacgcaccttccatttgtaaaacatgcaatatctacaaagagcagtaaagcaaagcacaatcaaaatgacgtatgcctgtgctgacattcagaaatacatctgttgggtaaagtacttaaactacatcttttctttcccttaattttctcattattcagctgcccttgaatgcttaatccttttctactagcaatcttaaacttaaaaaatgtttgctgtatcagtcagtgatttaatactattttatctcaaggatcccttttcgctaaacttgttagtgtgaaaagcccttttcatcttgtgaacctttttgtcctaaatgagattcattaatttataaaaagccctttgaaaattataatgttcttttggaatattagtttttattatttctgttttattgaactgagctaatgatgtgttttcaaattagtgccttgttgatttgcagaatccctgcctgtgtgctttctacttcgacatgaattcattgtccagggacagtcctgataatcagccatgatcgttctgtcctcatgccctgcttgttcctctgctaccctctcttttagtacttcctcctgcagtttctgtcatctgtgctagcattctttaagatgcattctctaaacttcggaactatgctactcctaaatcatacctgatatggtttggctttgtgtccccacccaaatctcaccttgaattgtaataatccccatgtgtcaagcacttgaccagatggagataattgaatcatgggggcgatttccccctattctcatgatagtgagtgagttttcacaagatttgatggctttataaggggcttccccctttgctcaggactcattctctctcctgccgctctgtgacgtggtaccttccactatgattgtaagtttcctgag

SEQ ID NO: 41181 - DNA, 2072 bp, Homo sapiens
ttgtgatcataattatgctctacaactaatcagtcactgaatatagaatttagaattttcagagtttctgtatgaatctgttcattaccttaattgagtgaatgacttgaaaattaagagtacctgagccttgtggaaattgttaaaccactgaccagataattattatacaagcacatattattctgtgaatagaattttcttaaagtagattgcagtaatgttagagaagacactcccagtgtatggttgtaaaagccatcatttctttagtgattatttagttattttatttttttctattaaatatgagctttcttggctgtttggccacagtgttttcctttgcttcaaaatacaggcttgatgagatttctttacatggcaggtgttctacattttttttctctccacttaattgtcagctgtaaccttgcctccatcactcttaattatagtggcctctatatttttgagaagacggaggttatgtgatataagcccttgttgttattctgtatatcaaaatgtctttccatggactctcttcttatttctgtatttggggttgagtatcacactggaatttaccttctgaagacgacttccaacacctgggcttggatcctgttcctatcagctttgtctagagctacattaattcagttaaaatcatttctacttgcattttcaagagatcaggactatgtctctgagaagtattgaaaccagtctaatccagtcagttatatcagttgggaatgtttatttctagtgtcttcttcacatgcatatatttacttggtaataattacaatgcacatattattttgatttctgttttttactatgctataagcatttcatgattttatgcagtctaaaattatctttagtgactaaaaatgccccattgagtttctgtgtgataattttttactttttcattctattggtagatatttagattgttttaaaattttcatagactggttatatttatgtatatagcagttttattcttgtgaaatatttcctaaggaacaatgctaggatccagggttactaggtcaaaggacatgacttatttatgacacttaacacacactgttaagttggtttaactaaattactgttacagttgaaggtttcattgtagtcccattaaaataacaattatataacttttcacgtgtaaatggtatgacactcttttaatgtttttatttaaagcaaatacacatacttctgtatgttaactaattgtatttccttttaccagaatgcatctctatttcttctatgtgttatacattcagaagaacttctctggtataatgtaaatgacacttagatttgaattcctaatttgacattctaatctgaaagaccttttgaaaaacggctttttaaacccaaatgtaaaatggggataaagtctaccaaacctgagagatatagccagaataagattaaaatttatgtccttacaattatttattagaaaacccaaaacaaatttaaaaagcacaggggatgaattaatgaaatatgagaagaaattaatggagcaaaatttaaaatatagacttgattaataatacaaaagatagctctttaaatagatcaattccataaaatagattgtctttggcaatctatttcagaaaaaagaaaatataggcattaggaatgagaaagggaatattaatatggacaccagggagattattaataattaaagagagaatagcaaatactatatactaatgtaattgcaaatttatatgaaatggccaatgttgaggaaattacaaattatcaaaattgaagaagagttaagaaacctgaatatactgctatagtgaaaaaactgaaaaaattaggaaaagaccacctaaaatgacctgaggcccaaaagcttttgctgagtaattccaccaaacattaaagaggagaaaatttctacattatatgaagtgtgctaggaaaataactcatctcaagttatttaaagctaggaaaataactcatctcaaaagggagtattatttttgacacaaaaattagtg

SEQ ID NO: 41182 - DNA, 1063 bp, Homo sapiens
tggcaggtgagtactgaaagcatttagtatactggttatgctataaaattataagtgattaattacatttggaaaaaagtgtcttagttttttctgtattacacagataaagatcttaagtgtggatgaaatattgaaaataatcagtttgaatggaacttaatgcaaccttagagatcagtttttattgtaagacataaattgaaaaacttaatagaatcacatatgcagatatattcctttatttttgatcatctgaagaaagaaatctctaaaatgacctgggccagcgctgggggttgggggtgtggagataggggagggaagaattccttgtgtccatagcaatgtaggattctcttgaggtctctgtgagtctcagggtttcactgggtgccttcgctattaatgtcacatttgtggaactcacaattgaagagttccttggtctggacgcttaaaaggtaccaggaagtgacagaggggtggacctagaattttggcagctgctaggagcagcagaaaatgctgaaaagtgatgcttgaggataagatggggactctgaaaagtgaactttggcagagtcataaaatattacagtgttgatattggcaaagctgccatgtgttcagacagtgtcattgacaataccacatactgttttataaggccattagaaaaaatgatgaaactttatgtagtgatttttcttcgctattattcataagattctcttacattatgccaaatttggagaaaagcgcatctctgagaaatactaaaggtatgagctgataacctagaaatggtatcagttgccaagatctctataacgtttttttgaaaaaacgtaccccgtatcttgatcaatacttatttgactaatactcagagtttccttatgaaatagtatgccactattttcaataaagattcagatttagaaattcctcgggcaaccttttggtaggtggtgactggccagagggcttctgctctaacacatccctgacagaaggcatgctctttagttccactaaaggtgctggttacactctcagg

SEQ ID NO: 41183 - DNA, 1096 bp, Homo sapiens
cctaatttattcatcccactggtatgcaagtttattgaggtcagagataagttcctggcacacagtggttcctcagtaaatatttgttgaataaaaacacatgtttataaaaatcctatgctgcataaaaattaatgtcctctggaactttttttttttttttttttttttttgccaatttgttcctcatcagtgcctcaaaatttggtattcctggcaattttcttcttttccatgttcctctaactttttatttcaaagagagcttcattgctgatctgagtgaaatgctgttctggtacttcaccgctgagtgtgtgctgcaagtgtgcagggaaaagggaacattctacaccatgtgttcttaacctgaaattcctgtaagatctgcaaggaatcatgaactgcatcagtgggagggggcagtattctctctgtgttaccttgaaaatggtctttgtgctgggggagggacactctttttcagtaacaatttatattgttaacttatttcactttgaacttgtaaggtggcagaagttaggcaccttgcccaatgtaatatcactagtgactgcaggtttgggcttcaaaccttagtccatgctctaaaccagcggttcccaaccttttggcaccagggaccagttttgtggaagacagatgtttcacagactggtcggaggagtggtttcaggatgattcaagcatgttacatttattgtgttatttgtattattattatgttgtaatatataatgaaataatggtacaactcaccatgatgtagaattagtggaagccctgagcttttttccctgcaactagacagtcccgtctggggtgacgggagacagtgacacctgaagtgtgtcacttatgtccaggctactctgtaatctcattttagtcgctgtcactgcagaaaaccctgcttcacaaagacaggttgttggacacggaagcaggcttttcagtgcttttgtggcaacctcaggatattctacctggactttcatccagaacatatggagatttgaagttgtctcaaacatatttttaaagccactgtcatttgccatctcaagcagttgat

SEQ ID NO: 41184 - DNA, 1055 bp, Homo sapiens
aacatatttgagagtctagtgaaaccagccttatttgagtgaaaagagtcttatatattgtagattccagctggataaatagagtcaaaccagattagagcaaaggaatttattattttgtaagaatgagagttttctacaagattttattttaaataacaatgtattaatttaatgatgtaaaagtaatatccttgtaacactttgttgcatttaaaaaaatactcgagtgtttttagttttacctggtaaaattgacttaatagggaaattagctatcttgcatattaaaaaagtccctaagtaaggcaggtttcaaggttggctgattaatttggctagaaatgtctctgaagactcaatttctcatttctttcccttcctctttttctccttcctgtccctttctctctccctttcccctccaccccctctccttctctctctttcccctcctgtctcccctctgtcttccttgctgtgttgttgttgatttcaggttgatgcctcttgttattacagggtggctgccaccactggctaggtctgagaagctttcttgtttgtgattctctcaaaaccacgaaatttaagtcattttcttcagtctgattggagacatttattcggtgtctggcatgaagtagacttttggtaaatacttgtggatgaattgttaaaattgcataattgttagagatgctagaaatggctggtgggaggctgaatgtgctgcttcaactcctaagatacggatatatattaaaaagatgagtggtttatgaatgttcatagaaatacttatctcccataaagagaagatacgtgtgcttcacttagaaatattaaaataactacagcctgaaaggcaaattgagatggatagtgttgaaggatagaggtgcagtgaagtcagtcacaaagttctccatagtatcagtgtgtgacttaaatttcttttcccatcctgtggaatgagcacagaaagcaggctacttactcatggaagatttagtaaaaatgaccctatgttaaacctcaaggaaattatcagt

SEQ ID NO: 41185 - DNA, 1035 bp, Homo sapiens
ttttgcattaatttcatttcttttggatacttggtcttatagatacttagtcttaggtaaatatctaaaactaggatttcagaaaacgccaaactattttccagagttggttgatctaagagttcctgtctttaatggcttctttctaacttttcttcattccagtgaacaggtggatatattgggaaacttagggaacatcatagtagtgaagaaaaggagcctttggcttttcaatgttgatcctctgggttcttattgaatctcgtgccacgtttccaaggcctgttatttcttgatgggcagagacctgtggctgtccttgcccaacaggcctctgcatggactcttgttgttcctgctggccccttaagttttggttaaaactccctattgccagaataactcccatcattccctgtgcagattgctttggtttgcttgccatccagcccgctgcattcttccacgtggatgttgatactgtgcagaatgatttgaagcggttttaagggaaaggaataatatgagtcacgttgagaagttcttagtaaatgtggaggaataaccttgaagttgtttgtggctgtgaaaagaatggaggggatgagggacacgtgaacatctcccctgctgctgccctcagctggtgttgaagcgtggatccaggagtacaccctagacaagatgggatcttgaatgaaaacccaagccaagaatggaagaaagaaatggtggggcttgcgtcacatcgagttcaagcctatggagaagacacacttttcttgtttctttgtttaatcagctttattgaggtataatttacatacaataaatctgatcaagtttaactatatagtttaatgagttttcatgaatgtatattatcctgtaactaccaccccaatcaacgtttctgtcatctcagaaagtccctatatacctctctgcaggtaatgttccctcctacaccctccaccctcctctagttcctggcaacctctgatctgccttttgtcattatagttcatagaa

SEQ ID NO: 41186 - DNA, 1065 bp, Homo sapiens
gctagcaggagtagctatacttacatcagataaaacagactttaagtaaaaaaccataaagaaatacaaatgagatcatgtagaatgataaagagatcaattcttcaagaggatataataactctaaatatttgtgcatgcaacactggagcacccagattcataaagctaatattactagatctaaagagagagagacactccaatacaatgagagtggggaatttcaacatccgcctgtcagaagtcagcattagatcctctaggaagaaaatcaccaaataaacattgtgtttaaactggtgtttggatcagctggacctaaggtttacagagcattttatctgataattgtggaatacccattcttctcatcagcacatggaacagtcttcaggatataccacatgttaggccacaaaacaattctcaagatattttaaaaattttgaaatcaagtatcttctcagactacaataaaacttgaagtcaataaaagaaagaaactttagaaactagacaaatgcatggaaattaaacaagatactcccaaataaccattgggtcaatgaagaaattaatatgaaaatcaaaacatttattgaaacaaatgaaaacggaaatacaacataccaaaacctgtcgtatacagcaaaagcagtactaacagggaagaaaatagcaacaaacacctacatcagaaaagtaggagttcaaataaacaatctaatgatacactgcaaggaactagaaaagcaagaataaactaaatctagaagtagtagaacaaaagaaataaatattaccacagacctaagtgaaatactaaaaaattataagactaaaaataactaaaaggatcaatgaaacaaaatgttgggttttggaaaagttaaaaaaaaatgataaaccattagttagactaagagagaagacctaaagaaacaaaatcataaatgaaaatggagacattacaaccaactgataccacagaaatacaaaagatcatcataaactgttatgcacaactatacactaacaaactgcaaaacctagaggaaatgg

SEQ ID NO: 41187 - DNA, 1056 bp, Homo sapiens
gatagctgtatatattaaaaactcaacctgaatatattaaaaataattgactttgtatttttctcgtgtatagttctatgaattttaacacatatgtagattcccgtaaccaccactgacctcagcatgaagaatggcacttttttgtgccgtcctttataatcctgccctccattcaccccgtccttggcaatgacttctgtgttagtgatcactatagttctgtgttttcccaaatgtcgtgtgaatgacatcatgcagtgtcgagcctttttgagattcatccgagttgctgtctgtaccaattgtgtgttccttgttattgctgagtagtattttgttgtatggatgtaccacaatttatcggattactttctaaagcctatttggattatttccaatttgggggaaattatggataatattaatgctattttaaataatactttagaatgagagatttctcttcatgggaaatactgggtcctaattgctttaactggtgtttgtgttgaactatcttgtcttatgtttttgtctctgatgaaatttgaatgataaactaaatcttatttttgatagagactgtgagtcttttgagtctatttaagacttgtaagatgtatttgtgaaaaatgtcatctatttcatatttattttactagtttcaatttcatagacatgtagtttatttactagttttctaattaaattaaaaggaagaatcagttggtggcataacttgccaggcattcactaagtttctaatatcttatgtaatgttggacacaagaggtgtgtattaaatacccatttaatgaatcaagatagaatgattgaataattcagaagcactgtaatgtgtttaatgagattttttttgattcatggtaatgtgatgaatataaggttgtactttttagcacattatgttaaaaatatagttctttatagtaattggaagctgtattctttagagtaattatatattgcttatcacagtgaatcatttttagtattcaaggatacattgtctaaaagtaggttttattttac

SEQ ID NO: 41188 - DNA, 1050 bp, Homo sapiens
gttgaataattatttctagaaacatccacttgagagggttgtacctggaatgtgccagtactattcattttctggctagtcatttagtatgccaatgagcaagtatttattgagtatccactatgaatgtataattggagaacaagaaatatagtccacctctacgaaggaaggtggtcccataagactgtaatgccatatcttttctgtgccttttctgtgtttagacacacagatacttaccattgtattatagctacctacagtattcagtacagtcacatgctgtacaggtttggagcctgggagagatagactataccaccttatagcctaggtgaagtaggctataccatctaggtttgtgcaagtcactctatgatgttctcacaacagtgaattacaacaatgcgtttctcagactgtatctcaccattaagtgacatattactgtataaacttgcttctctcaagaacatcactttcatttaggggaagtcagataaacacaccatcaaagaataaggttattttaatatattttgtgactatatatttgaaaaaatccagtataatgtacttgctaagcaagtatgaattttaaaataaattaaatttgcttgagattgaagaatccacatggtttagttttagccattctgactgggctgagatactgagtccatgctctctgtctgctgtatcctgagtaatttgtgtcaccagagtagtatttcttgtgctactgaccttgagaaacttcttattttgtggtgaaagaatatatgaagcctttagagagcagtgactccggtgtgtaagcaagtgttaaatgggatggtgtagatttataaagacaagactgtgagacttgaagtcatgaagaggcatgaaaactggaaagtgttttcttggagtggttgaactaggccgctgatactagtgtgatccccagaccagtaacatgaacatcacctgggaactagttagaaatgtcatgggtcgggtctcaccccagacttgctaaatcagaacctctggtggaggagc

SEQ ID NO: 41189 - DNA, 1112 bp, Homo sapiens
cagcaacatggatggaactagaaaccattatcttaaatgaaataactcagaaatggaaatcacatattgtatgttctcacttataagtaggagttaaataatatgtacacatggacatagagagtggaataatagatcttgcatatgtggaagggtggaagattgggaggagagtaaggaattagaatttacttaatgggtacaggttacagtatttaggcgatggctacactaaaatcccagacctcaccactgtgcagtgtatctgtgtaacaaaactacacatgtatcatatatatatatatatattttaaaaggcagattcccggggtttcttttgtaggtattgtaaatgggattgctttctcgatttcatttttagattgtttgctttcgacatatagaaatgctacagattatcatatgttgattttgtatcctgcaactttactgaattcgtgtatcagttcaaatagcttgtttgctaaagtctttatgttttttgaaatacaagatcgtgtcatctgaaaaccaggacagcttgacttcttcctttccaattagatactctttatttctttctcttgtgtaattgctctggctgggacttccagtactatattgaataagttgtgaaagcaggcatctttgtcttgttagatcttacaggaaaggcttcagtttttccctgttcagtgtcatgctagctataggtttgttgtatatggcctttattgttttgaggtatgtttcttctatagccagtttgctgagcgtttttatcataaaggaatgttgaattttattgaatgctttttcagcatctattcaaatgatcatatgctttctgtctcattctattaatgtgatatatcatatttattgatttgcatatgttgaaaccatctttacatgtttagatatgaatcccgcttaattatgatgaatggatttttaatgtattacagaatttagttttttagtattttgttgaagattttttcatcatgttcattagtgatactggcctgtaattttctttttgctgttgtgtttttgtctggttttggaatcaggataatgctggcctcatagaatgagtttgaaagtat

SEQ ID NO: 41190 - DNA, 1044 bp, Homo sapiens
gatgggaagcaaaataattttttcctcaaactgaatgtatattaatatattggattgtttgatttgaatattgcataatttttattttgtttcaaatggatttatatttggctaaacttatttctgtgaatattgtttttattgtgacaattttatatgtgtttttgactgttcaactttttttaaattatactttaagctctgggatacatgtacagaactaggaggtttgttgtataacttttatattaaaaacacaaagatactatttgggggaaactttattagtgtaaaaaggtgttatcttaaagttctaaaatgtctaatagcaatgaataaaaatgtataattgttattaaaatgttatggtgttagaagtataggtaatttttctcactaatttttaaagtttctgaaattttgttttgcattttttatagtggtaatgttttttaaatgagggcttttgtgctgaaatatgaagtagtttttaaagtaagtgtatgtgaatgtgtttgtatgtgtatgcctgtaagtgtggattgagagggaggggagaagagaaataataaatcagaaacaggcattgtcttctcaatcttggcatttaatatcaagactaaccttaaagaaagcttgacatagcataatttagtttttataagcctcaaacatttgaaaacagtttaaatgtttgacactttcaaaagtgtggctgagctttgcttaagcacttgataaaaaaagatgcaaatttcagcttgctatataatgagggataatagtgtagtgtaagaatatatggtctttgtgggatatgaaattgagtacaggtcctagaacctattgtagtgctaccataaaaactaactcttgaattttcataaacattgtcagtgtgtcatttcctacctcccaaatctttgttttctatattaatcaaataatactttattgaacacatgtacagaagagttaaataattgttaagaccagcagtgtgtaactgaaactctactcagttattctcctcctcacttaact

SEQ ID NO: 41191 - DNA, 1059 bp, Homo sapiens
caacttgacaactgtcagcagttacagtttttgcttaactggttaagggtgacatagtttggaaaatacgtttctttttacttaactggattaataataaaagtaattcaatttttagaatttactttagaaaagtaaaggtttattagttttctgttgtctcataacaaattaccacaaatttagtgacttaaaccaacacccgtttactggctcacagttctgtagaccctgtgtaactatttgatttgctcagaatatcgcaagactgaaataaaggtgttggcgttacttagttctcttctggaggctctggggaaagctccactcccaaactgattcttgccattggcagaatttagtttcttgtagttgtaggactgaaggtccccttttcttactggctgtgagcttgaggtctctttagctcctaggtgttggttacatttcttagcatatggctctccatcttcaagccagcaatgagtcttcaaatctttcttgtgctttgaatcatgaactctgccaccaacagaaaaaaaatatctgctcttaaaggactcatttggttaggccaggcccagttggataatcttcctattttaggaccaacctgtagcataacatgtcctattgtggaagtaaaatacatcctcacagtgccggagatcatgcagagtgtgcatatcagggaaaagtcttggggactgtattaattcgttttcacactgctgataaagacatacctgagactgggaagaaaaagaggcttaatggactcacagtttcacatgtctggggaggcctcacaatcatagcagaaggtgaaaggcactttttacatggcggcggcaagagagaatgaaagagaagcgaaagcagaaatcccttataaaaccatcacatcttgtaagacatagtcactaccacgagaacagtactagggaaactggccccaagattcagttatctcccaccaggtccctcccgcaacacgtgggaattatgggagctacaattcaagatgagatgtgggtggggacacagagccaaaccata

SEQ ID NO: 41192 - DNA, 1694 bp, Homo sapiens
attttttcatatttcacttactagagttgagtttcctttttaaaaatatgattatgatcatgtcactgtcatgcctaagcaaagccctttagcagctgttggttgcctttagaacagagcaactcatgacttatcaggcactttgtgatttgtcctggctttgctctatctacacctttatctccagaatcttctccttggtatcatgttccgcagtgtaattgagttacttggagatttcctgtcctatgttttctggcgttcatttccagacattgacccacactgttacctttgccagagctgccgaactgtcttccagagtaccatttcacattcgcacaaacagtgaatgagatcctgttgttccacattcttgctggcatttggtgttgtcagtgttctggattttggccatttaaataggtatgtaatggtatctcactgttgtttgaatttgcatttccctcatgatatataatgtagagcatcttttcatttgctcatctgtatgtcttttttgatgacgtatgtgttaatgttttggacttttaataatcaggttgtttgttttcttattaatgagctttagagttctttgtctattctgggttaagtctttatctgatatgtgttttgcacatattttctcccaatctgtggcttgtctttttattctcttggcagtttcttttgcagagcagaaaatcttaattttactgaagtacaacttatcaattctttctttcatggatcttgtctttgtgttgcttctaaaaagtaaatgacatgcccaggttcatctatattttctcctatgttattttctaggggttttatcattttgtgttttacatttaagtctatgatccatttttatttaatttctgtgactggtttgaggtgtgtgtctatattcattttctatcatgaggctgtccggctgttcctgacactatttgttgaaaagagtattttttctctactgtattgcatttgctcctttgtcaaagatcagttttatatatttatttgggtctgtttataggctctctgttttattccattgatccacgtatccattatttccctaataaccacactgttttgattattgtagccttattgtatgtcttgaagttgggtattgtcagtcctcgaactttgttgttctcttacaatattgtgctggctattgtgagacttttgtctctcaatataaactttaatcagttttccagtaaccacaaaataacttcctgggatttctattttgattgcactgagtgtagaactaacatcttgacaatattgagtcttcctatccattaacatggaatatgtatccacttatttagttgtttgagtttttttcatcagagttttgtagcttttctcatatagagtttgtatctattttgttagatttatacccaagtatttcattttttgagtgctagtgcaaatgatattgtgcctttaatttcaaaatctacttgttcattcctggaatataggaaagatactgatttttgtgttttaactcatattctgaaaatctcatataatcacttattagttccaagaagcttttgttgatttttaaaaaaatttttctatatagacagtcatgtcatctgtgaacagttttatttcttccttcccaaactgtaaacctttagttctctattctt

SEQ ID NO: 41193 - DNA, 1067 bp, Homo sapiens
aatttttctaacttaatgtgctaaaaattatataatttaacaagtcaaaaattgaacttaccatcttctttctcactgggtaggagacttaccatcttctttctcattgggttggagacttaccatcttctttctcatcgggtaggagacttaccatcttctttctcttctcatcgggtaggagacttaccatcttctttctcgttgggtaggagacttaccgtcttctttctcattgggtgggagacttaccatcttctttctcattgggtaggagacttactatcttctttgtcttctcattgggtaggacacttaccatcttctttctcattacaccatatatatgtgagtttgaaaggtggtacttatctttattctcattcaccactctctccatattcagtccattaaataagtcctgctggttatgtttttaaaatatctctcaactacatcaccattaccttatatatgcacattactttttccttaaaactaattgtcctcactaacggctgatcgatgtttcagaaactcacagtaaacttacttgagctggaatataatcaggacctttcactaattgacaaaaaccagcctcatttctacctctttttctcttatttaagctctggcaacatcaaactgtttgtagtcccatgcccttcttgcatcactaccttctcatgctgtcatctctggaaattccagagcacttagttgctcacttaatttcttctcattaaggctcagctcaggtttcatttctagaagacatacccgacccattcctcctcatgactctctcctgaccccaagtattgggttcatttattcaaacattcattaatttaaatatgtattgagcacctgctattgagcaggcactgttctaagtgcttgtgatatatcagtgaacaaaacggaagagccctgtccttgtgaattcatatattctagtaaaataaatggacagcaaataaaagtaaattatgtaggatattcgaaagtttagagtgccacaggaaaaatgatgtagaacagagtgaggagggtcaggagtt

SEQ ID NO: 41194 - DNA, 2546 bp, Homo sapiens
caatgctgctaagtcacataaaacacggcatagtacacagcaggcactgaataaatgttagcaaattatgtgtaatataaaactgtaaaaaatgtaattgttatatttgggtagctagagaaaaaaatacttcagtcatatcatattagtccattttcacactgctgataaagacatacccgagactgggaagaaagagaggtttaattggactttcagttccacgtggctgaggaggcctcagaatcatggcaggaggtgaaagacacttcttacatggtggcagcaaaaggaaaaatgaggaagaagcaaaagtggaaacccctggtaacccatcagatttcatgagacttattctctatcatgagagtagcacgggaaagaccaactcccatgattcaattaccacccccctgggtcccacccacaaacttgggaattctgggagatacaattcaagttgagatttgggtggggacgtagccaaaccatgtaacatatttaaacctttgaccactggacttagctaatcttgcttccaacatcagatatgtttaaagaatttggtgcttatttgtgagtcaggaatggagggaagagtgcaggaacaatttttgaaaataccactgtctgacttgatacaatcatgtcagagtagttaaaaggagtttagcaggtccttcaggtcctgctgagggcaattactttgtgtccttgacaaagcagtctcaaggccgttatacaacacatactgtgggagtgaaaggctgatgaggaaagctgcaaatgtaaatctgccggtagggaagatcactgagacacagagagaaacatcaagtgaggaagtcaatgccggaaaggtgactagatgctgctggggttaaagggagagaggaagaggcttggctgtgcaacagtgaacctggaagaaatatatgctaccctggacgtgaaaggacacgtcagaacatttacatgtgtatgtgtatgtgcgtgcacagccacacacacacaatttggtttcttgaacagaaagaagcaagcgtcctcaaaagacaacccactttctcattgggttcagttggaactctgagcttcaaacctgactttacagagaactcattcactccattttcctggacaatcgtccttcagagccctgccctggctggccactctccctctcccgggtggtaagcatcttggaagggctgcaggctgttttggcagtgtgtccccagcatgcagccctgaaaaacgagtgcgtctttctgtggtttgtgggatcctcggaggaggagtgaaggtgattataatgtgtcagattctcatttggggtgggaagtgttgatttgacagagatgaaagcctttggctggggaggggtgtgtgaggtgcggtgtggcgaggattccccggtcggactgtgatgtcagtggccccggagggaacagcttgcactcagccttgagcagttggaatctgttgggagggcagttggccaatcctaggcctgagagttgggcaatgggagaccccatcagtgtgtcacctttgcctccgggtagaaagaaagcaatctaaggatgtgtgcaagactgcgttcctaggcgagtctgtgtaactgatgccaaaccggggaggaaggctgtggaggaggccgtggaggcccgctcaccagctctgtactgttggtcagagacgcactcctgctcctgcctgtgacccagcagttgacggttaactggtatggcaacattatatggtgaggagggtgcttgcttgctcacatgataataacaaaaatatttattaaattcttactgttacgaggtattctgttaagcctgtttaaagaccctgaggctgtctaagaagttttatgatactaaaatgtaattgaggcataccttatattttcctaattgtcctgggttaagtgatggcaacagtgactctaggggttcctttgacttttcattactccaagaagtcagaagagagactggtgagaaaatgaaaactaacactgaaatgtatcagaaggaagcttggaaagggtagtactgaagaagagaaaactatacgggcactctgcctttgtgcaacagagaaagagtcatacctattgcgagggagtgagttgaattgagcaaggactgtgcataaaggtttgtttgccttataaaggtgaaggcttacgttttgtgtctgcttctttgtgttctttgtgtttgcttgttttagtatgcttttgttttcagcaaagcatttactatttgccagaaatgctggcagtcacagtagtggaggagttggcatgcaattcattaggattatttcctttaaaattccttcacaaccgtcttagggcaattctgaaattacctttgggagatagattagaatatatgagaatgtctagcttacagttaaggctgatctggaagtactaatagtaggacagcttctcacctcttctgaaggactggagaggcagtctgcgtagggtagaaaagagaaaagagagcattccatagagagaa

SEQ ID NO: 41195 - DNA, 1029 bp, Homo sapiens
actcagaagccttttatatagctatttcctatgttttcactacagtgcctttcagctacaaaatgagttgttagaagtgtcatttttgctgttaaatattatttctgtgattctatgttttcactgtttcctgcttactaacatgtgtgttacagtggccttgaccttatatcactaaaggacagtgctaaaataacgataaagcaccagtgagattttaaggagttgctaggggatacaactgcagacgtctcttgcaggggttcctcaacatggctggatggcagaattgtatggaggagcttcatggcccctattgtacgtttactcatgcagagtctttggacaatatattttctaaaagatgcccgtggcttgccaaagttggtttcagatatatttgaaaaggaggtgcatcattagtaactacttttgctattttttaaaaaataaaatttatttttacttcttattttccctcttctaaaatttaacctaattttgctttcgtattgtggggaaaagaactctgatgttacatgaagaaaatgtaatacaaactaggttagattttatgtagtctgtctagcatagaacaataattattgccaacaggacagaatgggatgaaatgttgtggtggtagatgaggctcttcagtgataggactctttggttttaaggactttgagaggtggccgtcttcttataaactatcatcaagtaggtaggcatgaggtgtgagaccctcctgagcctcacacctgtacaaggtatgatttaggaccactggatttttgtgggacttgatctttttatcatatgggtgccctgtttatggaaaataatacaaaagtacctttttcaaatttcacaaaaatgtgataatgtgaactcatcaccgaggtcattcccaggaccttggaaggggcctgtacacatgctgggccctgaaacttcatggtatatctgcttcatggtatatagcttcatggtatatctgcctattctcctgcccagaaatgttgt

SEQ ID NO: 41196 - DNA, 1745 bp, Homo sapiens
aatcctgtgtgttttcagttactaagatcctgggatagtttattatctcagcaacacttagccctgacggactgacacatgcccctcttatgagcttctctttcctcagtgttattgtaattgttggtagcatttttgagaacttactgtgccctagactgtgtgcctggtgctttatttctgttttttttttttttttcgcttgttcgtaatgttaataatttgctcaaggtcagactgtgtgactcctaatgactgcgctctccccagctcccttgcctgcgttactcaacaaacatccccacgcacctgctgcgtgcccagctctgtactaggtctgaggatcaaaagatgaatcagaaataatccctgtccatgagaaaataaggatattatagggagaaacagaaattcaagccagtgcgtatgatgacatattaataaaggttgtacagcacagtgggtgctagaaagatttagaatcaaaacctgtctctttcattatgtggtcttggacaagtgtctctctccccactctccaacctttctgacttctattccaaaaatggggacatttgtaacttttataagatgtcgatggccacctacctgaaaacagtagtagcattgcatgcgccgaagcatttgaagccacaggcactcaacagcctgccacaaatgacagtttgtgtgtggtttccgtgttgcttcagtggaagattcaccgagagcacaaaggaaggagccagaaacttgcttgagggaaaaggagcagaaaagttatatggaggaggaggtggtgtttgacttgagttcttaaacagaagtaattttaactctgattggaggacaagggcaatacattccaggataagggaaatagcatgaacaaactgtgaaacattgggaactacaggaaacttatttttagaacagtgcagagcacagttggagaaatggtgggagaagtgctgtgcaggtgccacgggcagtcccagccccctgaatgcgactgcacaggccattcggaacgagtggaagggctcattctgagctgtgacttgttggttttttttgtttgtttgttttttgttttgttttttaatatgggttctggaaacacggaagcaatgtcaaggattgccaggagtcacagatgaaaggaaggaagccaactggtggaccgctgtagagagagatgatgaaggcttaaattcaggcagaggagatggaaagagaacaggtatgagcaaaatgaagcaatgaaatttgataaagacatattccggtggtaaaatgtaaagagtgaggcaaagaagggggttcaggagagctaccacacttctaatgtggtgactggagggttgtttgtaatagagcttgagagtagagaaagtttatttttttagtttttgttttttaactgtcaagttttctgtgtaggaattattcactttaaaaactcaaacaatgtggaaaatcttcaaagtaagctaagaaattccactacccacatatgaccctgttagcttttttcttctacactgaaatccacatgtatgtgtaatgatcatcttaaacagaatggtacctttagcagcttccttttgtatttagtaacatagcgcaagcagccctccagctttccactgaagtacctaagagatctgctttacgccttagtgtaaaaggataagtagtatcccattccatgtaggatgtttccggttatttctttatatcta

SEQ ID NO: 41197 - DNA, 1085 bp, Homo sapiens
gtgaggactgttttaaaagtgtatgggattaaggagcagagcattcctgatgtttgcttatattttgttgggttggggaagggaatgaaagaaaagatcctcccctagggttgccatagtttggagtaataggagaataacaaatgttttccatcaaaaacagactttctcttattctctgagcaatatatatctcatttggtctagataacatttatgaaagtcaatttagcatggatgggcttctgtagatacttgtcgttaataatgattgttcactatacagtgatgttttttaaaccctaagtgaaatttgagttgtcttttgcatgtgggtaacatatgtgtttcagcacaagggagatgaggatgtatgaagtgtgtaaaagaagcagggaaaggtagtgtccaatactggcaaccagtgaagttgtttgaggttattactgatgacagtatacttttcaaattgaatttggtaaattgcttcactggctgaataagagagttgattctgaacgaaggagatcaaacctgaacagtacattatcttcattatacttatggttgtatgcaataaacataacttttctaatccaaatattgtggcagactatcttacagaaaattgtatttgtgtatatgaaggattttcctatgtgttttgaaggaaatgaaaatgtgtaatggctacagcagtgatactgataggctagcaggcaattgattgctcagaggttaagttgagagagagagaattctctggaccatagtcattattccttattcacactccattcagctttccccgccccttctgggcacagcctcagatcttgtgccgttttggaaggcacacggtgtggccctggtacatgcttgtatccactcattgaggtctgggattccaccatggtaaggctcatcagagcccttcctcaggactggcaggaggacacccagagaagcagttctaacatttcactgtggttggtaagcaggggaggacatgttttcagtcctggttggaagtcagcttatcagtcaggacaggtgaggttctaattcagtaacaagtgctatga

SEQ ID NO: 41198 - DNA, 1083 bp, Homo sapiens
tcccaaagggttgggattacccagccttctctatcctttttgtctggagagacagacacaatttctctgctgttttaatctgctctagaaccaaaggtagagtccagaagagttctgggctcttccatgatccttgccaccaggtgaagcagtggcctgccttcctcttcctctgcctttggccaccccacagtgcacccatccatttacttattgatcgttttctctcttcccttagccttcagtggctctgcacaatgtttcaccatttcctcggctgtttctaaagaagggaacagctaggttttccacagtgacctgactgcagattccctggtatgctttgtagcctctctaagtgcaaggctggtgggaaattgctcaggttcgacatgtctcaagatattttactcagatacttacgagaagcatctctttggccatttctacccccccatcatcaccttctcatgcacagtgcagatactgcctggccagggtgggggtgggagagagacacaaaagaaaacaaaaaattgctttatttgatgttatcctcctgtgagcatatagactggttctgggtattgcaaaatgtatcgtggcccggaagtggagtggcttgtcaagtttttctttattagctaaaggacaggaattgacagggaaataatacaattaatggagaagagtgaagcatgtaagtagggaaagacagaaatgtggtctcagcttcttgaaacacagtcttctctgtagaaatctagattactgtaggttgagacttttaagtttactacagggtctctaagagtcagttattagaagttaacattgactgggtgccattaaatatctcatctcatctgatgtttatagctgcccgatcatgtagccattataaatggcagcaagtggaagcagcttgtccccggtgctctatgtgagtgagggcccggggttgtctgattcctgagatgacacaccaatcactacactagactatgctacactagtctacactacactagactacactgcactagactacactacactacactggactacactacactacac

SEQ ID NO: 41199 - DNA, 1077 bp, Homo sapiens
ataaagaaacacctgaggctgggtgtggtggctcacgcctgtaatcccagcactttgggaggacatggcaggcagatcacttgaggccaggggctcaagaccaggctggacgacatggcgaaaccctgtctctactaaaaatcagccgggcatggtggccggtgcctgtaatcccagctactcgggaggctgaggcaggagaatcacgtgaacccaggaggtggaggttgcagtgagctgagatcgtgccactccagcctgggtgaccctgtctcaaaaaataaataaacacctgagactgggtgatttataaataaaagaggtttaattggctcatgggtctgcagactgtacaggacacatgatgctggcatctgctcagcttctgggtgggcctcaggaagtttacactcatggcagaaggtgaagcgggagcaggtgcgtcacctgcaagagcaggagtaagggtggggggaggagccacacacttttaaatgaccagatctcactagaactcactatcatgaagacagcacaaagtcatgagggatcctctcccatggtccaaacacctcccacggggccccacctccagcattggggattacaattcagcatgagatttccaaactctgtcaaaggcagagcacaagacagtatcccttggcatctaaattgattataaaggaagtttctttctttacagggtttctttctagcatgaacttttacatagaacatgttttctgatggccccactttgtgtgtgtgtgtgcatgtctacatacacaatcacccactatataaggatgttttggtaaacaacagacccacatatatgatggtggtcacataagattataataccatatttttactgtagctttcctatgtttagatatgtttagatacacaaatccttagcattgtgttacagttgtctacagtattccgtacagtaccatgctgtacagtctgtggcctggaagcagtagtctatagcataaagccttggtatgtagtaggctggaccatatgggtttgtgtaagtccactctgtgatgttcacacaacaat

SEQ ID NO: 41200 - DNA, 1027 bp, Homo sapiens
aatcagaccaagatcaaaagctgtttcttttttttcttttttcttttcttttttttttttgacacggtgacttttctttcttctcagaagtatggtatgctatttccagaagttgtgaaggaatctcttccagcatattgagttgctgaaaaatacacaggtgatggtgatgctttaatcatgccccctccattgggagggacgccttgtgaatttcagctagaactgggatcccatcttggcaaatctgcgtaattcttgggtatacagctctaataggcaaaatgatctcccacagatgtcagtaggaaatgtcctgtagctggtgttccctgagaagttcatgtgcccaaaggaacactcattcccatacttgtgatgaaaggtattggattcgactggtctgttgtgatctggtttctccacggccgcttcacccctcatggttgtatcattggggcagaaattcgctgaccaagatttaccaatttgtggatcaaagtcatagtctctttttttgttagattattttgaactgcagggattgcagtaagtcctgttctcccagctgcttgttgcctggtaggattcagagcatagctctgctttttcaggcatctcatgctcaaaacagtgcatttcacaatgattccctgaagtctaagatgttggtagagattacagcctaaagaaacttctcagtggagagagaaggtctcactgtttgtcctcaggggttttctgtgtggctgttatttgatgtttgctgtcacagtctcatacctgagctttcttaacagcttgaagctcaaactagaatttaatttcctatgattcaagaccaagacggcttctgtggcttcctcctggtgaagggtggtgttcattccgtttcctgtaatctcagactcagtatcttttttttttttttttttttttgagatggactctccctcttatcactcaggctggagtgcagtggcgcaatcttggctcactgcaacctccgcctcctgggttcaagtga

SEQ ID NO: 41201 - DNA, 1052 bp, Homo sapiens
ggagtagtagtccaaccacttcccaggcaacatagagcgatggtcgctatataaatgcttaaatgaacacaggccagggacccatggagccacctggaccatgccatgtggaactagccagtgtgaagcatgggttctggggacatcagaatgagattgtgtctacagaaagtttgttaggaaagactgacacttggggcacgtgcacattgtcttagtaccaggagtaccgttctgtttttccagaacaagtggttactttctttctgtgggcactgagttttgtaaactacgagttcaaattttcaccttgtcagtttacagtcaaatttatggcttctccgtagcctgtgtgtcacttttgtggcgtgtgttttgtgttatctcctttcctgcttctgttttacttccctacctcttgtttgctttcttctttttcatttcagtttaatgcatgctatctttgtctcgctgtagtttgtgtatatttgaaaactttcttaaatgttctctggaacaaggtgaggtaagtaatcttcatttatttggtatcgaatacaatcctgagtgtgttacctttgttttacataaggggaaccagccacacagctaataaagttgcaggactcaggttcagcttgaggtttctcctagaaagcccaggctcactctcccagctgtgccctgttctctcaagaaaccaacagatacactccgcacactcctcaacaacccatgacgctccacacacacacacacgatcttcagtgggcaccgctgcagacacatgcattccacaaaccctgcagatccgctgatcggaggcattgattctcaaagcacatggcctgaaattatactaaaaacgcaaattcctgggccctaccccagacgcactgaaacagaagccgtgagggaggggcccgcagcttgtcagtcatcgcgaggtgattctgttgcactcttgactttcagaaccactcaggagattacacactttggaaaaaaaagaattgtttttctgataggactttcttaaatagcagacccta

SEQ ID NO: 41202 - DNA, 1044 bp, Homo sapiens
tggtaattgtgtgttctaggttcttaaagactctagttttcccttagtatagtagttaactttctattgttgtttgaataatctattttagattgctaggtaggcaactaaatacatagcttattatgcaatgtgggtgttgtgtgggcgacttaaccttgggatgacgaacttaacttttaccagttttggttagtatatattttaatgatgaagtttaagatttcatagtatatccttttttaaaattttattttctttgcatttatctgtgtagtgatgtggcaatataaaatataaagtttgaatgttctagctcaaaaaccagtgcaaattagatggtctgaagacaggaatgtgtattacatgcgtcctttcagaacacaacacaatggcaagaattggtataagaaaattaaatcatttttattttaaagctatatttgctttgatataaaacgactccttccaccctctctctctgtctcttgccttccttctcgtccttcctctttgttaactccatttgtagttggcttttatttgcgtttagttttgactcttactgtgctttaaaagttatctgaagtataaagtgaaaataaaaaggaaggtgaatgtgttgcatagtagaatcatcgccaaacagaaagggttaaaatactttttcttttcttttttggtggggggagggtggtgggaagtaagaggctttccaatgaggcatttcacaaaggcataatctttgaatctgattagataccatgttgagttggcctctttcacccagcacagagaatttctgacccatttaaaaagagatgttactgacaacatctgctaacggcaggcgagggctggctggaggaaaggaggagatgggaaatggaataaaaacctatgggagatgggattgtggtgaatgaaggctacaaagcgttttctcatttcaagagataaagacaaggcatattttgagaaattatcttttggctctggggaaaatcaagccagattttgccttctgctttggcgttctgccct

SEQ ID NO: 41203 - DNA, 1121 bp, Homo sapiens
aataacaggttattacataagagctcttcttaatttttatgttcattttctttgagccaaaatgttaactgttttctttcccattttggagttacctgagtaagcttatttaaattttgtaatcttgctgataaagtaacatgaaatttttacttttaaactttgcagaccaagaatatacttgtttaatatacctgtttgctgaataaataatgtattgtgataggtgatttgaaaatggtaaaaaaaattttaatatgtatctaataagtaaacagaaacagaaaggcaggcaatttttaaaaaatttttaaaacactggtaaatagaaaccattagaatctttatgttttgaaagcctttcagcagttaaaaatttcacattaattaagtctgcatttcctataccctaatgggaaagagttacatgcatgcaacttaaagacctttagtcgattcaaggttgtatagatttttttttttttttctggtgacagaatcttgctccatggcccaggcttgagtgcagtggtgcgatcacagctcactgcagcctcaacctcctgggctcaggtgatcatcctgcctgagcctcctgagtcgtcgggaccacaggtgtgcaccaccacacctggctcatttttaaaattctctatagaagacaaggtctccctatgttgcccagactggtcaagaactcctgggctcaagcagtcctccctccttggcctcccaaagtgttgggattacaggcgtgagccactccacctggccatagattgatttttatgtctctctctcttttttttttttttttttttgggacagagtcttgctctgttgcctaggctggagtgcaatggtgcaacctcggctccttgtaacctctaccactcatgttcaaggaattctcttgcttcagcctcccaagtagctgggattacaggcatccatcaccatgcctggctgattttttgtatttttagtagagatgggattttgccatgttggccaggctggtcttgaactcctgacctcaggtgatccacatgcctcagcctcccaaagtgctgggattacaggtgtgagccactgcatcctgccctctcttcattttttat

SEQ ID NO: 41204 - DNA, 1866 bp, Homo sapiens
ctgtgccccgggatggagacggaggtccctctgcgctcctgtggagctctcaggccctgcagctctctggcctttctgctctgtctctctccacttcctcagtgtgattcagcgcatggctggtgcttctgccctgtgtcatggtatcctcctgactgggagtctttcctcttggttgccaccagtgccctggaaccctttttccctgcatcttcctaggcttcgtcatggtccgctcatccgtgcttccatccttgctggtgcttacagttgtctgctttcgtgtttgtctcccattagccaaagtgttccttgcgggtaggaagcatgtttcattcattttcctaacctcagtgccgagcatgttgccaagcaaaataagttgaatgaatgaataaatagtgaaggtgcttaagtgagggaatatgactgaaatcgtcctttaaaatattaattttcctaaagggaaagaaataatgaaatacataatgtgattgtaaaatttcactggcatgacttgaaacttcatttttgtttcatttataatattttcatgtaatccaaatacactagttggcaccagtgacccagggcttctgagctactgtgaacacagcgtgtccatatgcccgagctggtggggcatggcttggcgtggagcagccaccctgagttgatgggaaggagggagataagtgtttagagcgttctggatgcctcagcttcatttcctggggcagtgataaaaagctttttactttgatgaaaacatttctacacagcaaagtgaaagtgttgcttatgaagggctgacgtgtttgaatatgatgaattatttacaaaaatacaagcgtatttggccctttaaaagttggtaagtactgtgtaagaagcggctttgcataaagagcagtttactctgttggaaaaaaagagactaacaggtaactgcagagttgcagtccagggatgggtggaggctggtgcagaatgggaaaaaacagcatggtaatatagaattcaagttgtagttattgtataggatgtaatttgtgtttctgtattatagttttagtagcttctgaaataaacatctaaagtgttatccaaaagggcttgaaggctgggcgaggtggctcttgccggtaatcctagcactttgggaggcttaggtgggagcactgcttgagcccgggagttctagatcagcctgggcaacatagtgagaccttgtttctaaaaaaaaaaaaaatagcccgggaggttgaggctgcagtgagccatgatcacaccattgcactgtagcctgggcaacagagggagaccctgcctcaaaagacaaaatgaacaacaacaaaaaagagcttagttactatggcttcttggatgtgctaattacatattgtattggtgtctcagggttatatacatttcaaattttcttggtgtcccaggaccagaagttgtctaatcagtcatcataactttttaggactatactctgcttctcagggttaaatatatctaatttttaaaggcagattaaagatctacttataaaacctcagtaatgaagacaagtggtactggcatgtggataggtagacaaattaatgcaacagaacagaaaagtgttaacaaacccagacacgtggcagaatctaaaggatgatataagtgtcatttcatttaggagaagcaaagatagactactgaatacatgatttgaggatactaggtagtcatctagaaaaaaataaaaatagattattccatgcagagcacctccaggatagattccaaatggattacatatgtacatatataggtatatttatgtgtatatttaaatgcaaaaaggaaatc

SEQ ID NO: 41205 - DNA, 1088 bp, Homo sapiens
ctccgcatgaaagcagaggctttggggaggttttgagcagtgggtgatccatggtttatgatctcagaagctcattctggctgcagtttggtgaatgaatgaagggagatgtcgtggatacagggagtccatggatgctactgtcatagtcaagacaagagcaatggtaacttggatcacggcgatgatggtagaagcaaaatgccgcggtggttcaggaggtgtttggaggtggcgtgtataagacctgcaggtgggttggatatggggacgtcaagggagagagaggaatcaagaatccatgcctgggtttttggctggaaagattgggtaaatggtggggctgttcactgggattgggatgggaagcctggaggaggagcacgtggggtgcgcaaggaatcaggcgtggcgtttggtggtgttcagcctgagatgcatatgctaggaaggcagttggataaacaaagcctgggaggatttgatccaaaggatcgttcaagactgcagcatagaaactgcagtcacagcatctaaaatcatgggattggatgccccaaggacagtatatagatgcctcagtgacattttgactctgagggaaatacagacggagttggttaatcaaccatagctgggtgcaatgtaagtgcctggctgaagtttgacacgcgaacggacggcccgctggaattctgtgctatgagccggagtagaaagagagatttggactctgcaacaccaaggtagtcgttgaagccacagtcgtgaatggagaccaggagtgaatagtgggagtgagcagaagtcggaggataggacagaagaaggcagagccatggagcaccctggagaggtgtgacccggcaagatcctgagatggaaggtagcacggcctggagttcagaagcggagcctcaagagggaagaagccagatgctccagagagcaggtgagttccagcagccaggaggtcgtccgtggcctcggtcgggagattgcggtggagtggcatggataatacctgatgccagtgtggtgaggatggcagacggggccttttgaatctcagctgtgggcaggtagat

SEQ ID NO: 41206 - DNA, 1599 bp, Homo sapiens
tttccttttaaaatgtaaattaggctcctccagctgatcatttctctaagtctgtctaaaggaaaactccacagtgacagaggaactcataatcttgcaaggaaatcagaaggtatccagtactcttgtgttctttgtagcactcaccacttgctgaaattatcttgctcacttactggcttatcagtttattgcctgctttccctctctggaaaggaagctccatgagagcctgagggcagtgtcttttttggttgtttccctgagactgttaacagtggctgacacacatagagaaggtactcaaatacttgtgttggaaattcaaagatgaaagccaaaataaatctaaacagaacaaaacatggtgcctgtcttcaagaaacctagaaatcgatgagcactctttgaaagcttcctttgtatgagcctctgttctgtggactcaggattccaaggtgtatgagacaaaatcagttatttcgaggagcacacagatcacagaagagatggacaagagttcacagacacgctcacccacagacaggctgtagggcgctctgcagacagtgagaaccagacggcctctgactgggaggtcctggaaaggtttcacaaggtgtgaagaggcagtgccttcgctttgcgagaagcctgggaaggaccttctgaggccaagggaaagggatcttctgaggttgcagggtggaaaacagcctggacaggtggtaggttggggacccgggtgataagacaggagagaggattacttaggctaagctaaggatactttacaatgacccctcagacgagtgtatagaaacagctatggaagacaggtagaaagaatcccctctgtgctggagctgggattctgtgtgactgcagggagagggctgatcttggtggcagagtcctcggcacacgagaagaggtaggagctggaccagagatggggccatgcacatgaatggtcgggagagatacaagcaggaggtagcagttaatagtcacacatccaggtggctggttggataaggcaggagacatctgactccttagtttctggattggaaaggtgtgtgtgtgtgtgtgtgtgtgtgtgtgtgtgtgtgtgagagagagagagagagagagagttggggttggaatgggagtagttccatgcccagagaaaagagatatcagaatgggaagtatgagaattgagcccctactatgtgttaagcagcctccttggtagtagggatcgtctctgcttgtatggtgcccacactctggtggtgcagacaagaaccagccagggaaacaaaaaataccaagagagctgcacagcgaatgcacacggagagtggcctgtgcagctgtgtggctccttgccttgttctgtgcaggtctctcttcacaggggcagtagaaatggcctctgagtgacaaggtgtcatcggccatgcagttatctggggaaaagcaccctaggcagagggggctcacaaggcagaggagcggggtgacggccgtgctggagctgagcccaccaggcagtggcaagtgaagtggcaaatgggccggatgaaggctttgtcagtcagaggaaaa

SEQ ID NO: 41207 - DNA, 1083 bp, Homo sapiens
gaaaaagcccgcggtcctgaaatgatggggcttctgttggtgctgctgaaactgctgttggctcgtgtgttcagggccctgctggatgttgtggaggggaagaaagatcgcagctctggatagagggtggagtcctctcgggattcgtagcaggctctccctttaggaacacaatacctggagaggagaagggtctactctgcagaaaggcccagctaggagaagctggtgcatcagagaaaccagactcatcagggaactttcaagaaaggccccctcgccccacaccttgccctgagcagtagctttggccttgaacaggagcaaaaggttagaacagtcttatttgggacatgactgaggtagtaaacaagaagatacttttaaacaaaattatcagacccacttcactcaagcttgggaaggggatagattattaaaagagagtagccaatttctgctctgacactctttactttttgggtctttgtttctgtctgttgctgcctgacaagccactggtctgaattgctaaagtactgaagtttgacagatttttctgatatgtatcgtttaaaaaatcagtcttttgaaaaagaatttctagattctttaaaaattttagaatggccaaatgcatacaaatgtgtctaattgttgagtgtcattccttttttttttctttcagtttgatcttctgttggtctgatatgcaagttgtcacgtaaaggctgttttgtccagttactgtttgtatgaatgctggttttatttttattaccatcgaaagcaaatcatgtgtagagggtatgatatgccagctccgcttctgtccattttagctctgcgttttggctcttcacactgaccggctggttcgctcactcatgcaccaaacaacacttagtaagagctaccgccaggacccaggacccaggccccagagacagaaagaaagaaagaagcctagtagaagctacgaagctgctgtgggagcttcccactctgccatccagtaatagagacagagtcccctagaagcacgtttgaagttaatgcccaggggtcagtggccaccatgcc

SEQ ID NO: 41208 - DNA, 1087 bp, Homo sapiens
agtaagtggcctgctccccgttccccggaggtggggcggctcctcatcccctgggggcaggtggggggcttggcctgctgggtgggaagcgggtgtcgagcgaggtgcccgtgcccgggcgtggagcgcccagggggcttctctggaggggcaggagccggtgcccctggcggagcgcgggagcgttcggccgcgcagggacgccggggtttcccaggctccgcgagcgctcgggggaagggcggctcgggagggcggcgggagcttggacgttgcgagcgggacctgccgcctccttctccgcccctcgtgccgtttctggccacacttgtccggcgcgtatttatactcaactttgtgaccacttaggttcctccctcttgagcctgtggccacttggctggagcagatgcgcttccttccacttgggggtccagcccaccgggtccctgtagccggggtgagggaggccagggcctcagaaccccgcgcttccaactgtgatggcaccgccgttctccaggactcggagtgggcgcccggcctcccaccccgcgcagtgaccggcatccagagcatggactggcggggtggaaacggttgcacctccacccaggggacgcacccccaccccgggccgcgtcctgttggtcccgggcttctctggggtccggggtggtagagaaaagggaaggacaataggtcgctagggtggaagagaaaggcgccgccgcctccgactcgcaggatgcgcccccgggcccactgtggcgtggccactcctcctcgccacccgcgggcgcggggccgagagcgcgctgaggcagaggtggcagaaaggcatgtcacgggggtgggggacaagattgagcagaaaagtcaaggcaggggttcgctagaaggaagcaggcaggcgggagacagtgaggaaagaggaggcgcccggtgcgcagaggaggggggcgtcgcggtcgcggatggagggggagcagggtgaggacgggaagaccgcggcggggccgggtaggagcacctccgggtgcaggaggtcgcgcccatgggcccccgcccgactccggcgccagtc

SEQ ID NO: 41209 - DNA, 1033 bp, Homo sapiens
gccacagacatcgtggacagccagtacgacgccgcagcccaaggccgcctcatagcctcatggacacctgtgtcgccaccttccatgtgaagcagcaaggcccaggtcccgaaagatgcagtgactttttgtcgtggcagccagtggtgactggattgacctactaggtacccagtggcagtctcaggttaagaaggaaatgcagcctcagtaacttccttttcaaagcagtggaggagcacacggcacctttccccagagccccagcatcccttgctcacacctgcagtagcggtgctgtcccaggtggcttacagatgaacccaactgtggagatgatgcagttggcccaacctcactgacggtgaaaaaatgtttgccagggtccagaaactttttttggtttatttctcatacagtgtattggcaactttggcacaccagaatttgtaaactccaccagtcctactttagtgagataaaaagcacactcttaatcttcttccttgttgctttcaagtagttagagttgagctgttaaggacagaataaaatcatagttgaggacagcaggttttagttgaattgaaaatttgactgctctgccccctagaatgtgtgtattttaagcatatgtagctaatctcttgtgttgttaaactataactgtttcatatttttcttttgacaaagtagccaaagacaatcagcagaaagcattttctgcaaaataaacgcaatatgcaaaatgtgattcgtccagttattagtgaagcccctccttttgtgagtatttactgtttattgtagctggtggtaaagaccttatccccaaaaagcattttaatctattaagaactttaatattgtatctaattagttgcaaaactggaagtgaaatttgcatagacttagtgctaattgccacagcaacttaaaagatgttaagtaatttttaagagatttactcaacattgaatcatggatgatgtggataaagacagaacctagaacatactgatgtcatcaagat

SEQ ID NO: 41210 - DNA, 1065 bp, Homo sapiens
aattccgtttacttcttgatctcctgattctacatcatatttttctattgtactcaacctatttcccaaatgggtttgaagcagttcttgaactatcaacaagaaaagtcccattttaaagaagaaagggtagatattttagaatgctatcagaaatattccagttttttttttattttgatgatgtaaggacaggactttagttatatgagattgatttacgtgtcatttcttaatgataaaagaatattcttaacttgcacctctctatagaaccttgatttttggttttggaattgcctgtttacttataaacagtagattgaagataaataagtaaaaaagcactgatggacaaggaattctgaaaatattttaaaacaaccatggaaactgtttatattattccagaagatcacaataaaatacaattttccttcaaaatatcactcaaggagcaaatgggaatgagtaaaataagtaaatttcacatggggcatacagatctcagtgggattttacatgtcgattctagataagttaacattgactttaaagacctaaccacctttaaaagtctaatgttttcagtctatgcacaattgtttcagtaacgtttatttaaagtcatatattttgcagtatttaaattaatggatatagttttagaaaggaaatgtattttttgggttttaaagtttcagatcaactgtatcttaaatttatcacactaaaatttaataaagataaatgaagccatcatctacatttttgaaagacaagaattaagtttgattgagaaagatgtttttaaaactttgaaactcataattgctctgtttttgctgttgttagtggcataagaagggactggctgtgttattctgcatattgcagttcttgtcaatgacctggtaagtctttccttaccctagtgaagtgttaaaattgcctgagacgtgacgagcattttgtttgggacctgtgaagccctagcatttcgtctggtgttttggagccagacaggccctgcagggtcagaggaggggaggtctgcgatgagtc

SEQ ID NO: 41211 - DNA, 2068 bp, Homo sapiens
tttactggtaagcacaaagttttgttatggctcatttatatatgctagtgcaaataggaagaagattcaagttagtgtataacattgaaaattaactattttttctgtgtaatcagactagactgtctacaagcagatttgtatttaaacatattacataatattggtattgtattactgcagtagcacgtttatattttaaccattaaaatcataaaattattttaaaataactataatatcttaacttagggaactggattgctgtggcttccgggcggcataaagctttttgcagtgttttataccctcggcaatcttgctgcgttagccaggtacgtttggcttctcaaaatatcttgtttgctcttgctaccaaatttacctttctaataagcactttcccagtaggatgtttatgtagttctgtacatactgtgaattcagccacaggatttacattcattaaataaatatgtattgactgctgctgtatgccgtctcccataacagacggtattagtgctaggaatagccagcctttgtggggcacttaatgtgtgtctgggactgttctaagtgttttgtatgtattatgacgagcttgtgaggtaggcagtattatcatccccgtttataactggagataatagcacagagcaggggagtcagtgctgcccatggcgatgaacctaaatcatggctgaggtgggaatcctgcaggcagtgggaatccggaggtgggatcccaccatggctgaggtgggaatccggagcccaggcttggagctgctgcactctaggctttgttcttgtggagcttacattttaatgaagaagatgttcacatgataagccagaaaaagatgggatggcattggtgctgtgcagagaattaaaacagggtgtggcagtagtgacagagggctactttatattgggagtatgagaatccctctttgagaatctttgtcgcatctttgggttgttgtttgtcttagccctttttatgctgcagtaacagaatactgtagactgggcgacttaggaagaatagaaatttttctcacagttggaggcctgaagtccaaggttaaggcacatccatcctgctgatagatgcatcccccaaggggaagatccctgtgtcctcccagggcagaagaggaaagagcaacccccaggcagcctctcctccaagggcctttgatccctttcaaagggaggagttctcacagcctagtccggtcttcatactaacacactgaagacacttacattttggagaagacaccttcacaccatagcatgtctattggtatagttgtaaagtttctttataaagttaaggaaaaaaaaaattttagtgagagattttaattaaataaagcaacagggcttcttttttaaaaaagtagtttatttttgcataaccagataaattagtagacctgtacctcagtcactttatttgtttcaaatagtacatgctttttaatgggacctgtgaagcaactgaagaaaatgtttgaagcaacaagattgcttgcaacaattgttatgcttgtaagtaaataatacatttttaaaacttttattgaagtattctttgcactgttattttacgaataattgcctgttatgtatgtatacttctttttttatttttatttttttttattattatactttaagtttcagggttgtatgtatacttcttgtgttgaatataataattatatccggccgggcacggtggctcacgtctgtaatcccagcactttggggggccaaggtgggcggatcacctgatggcaggagttcaagaccagcctgaccaatataatgaaaccccgtctctactaaaaatacaaaaattagcccggtgaggtggcatgcacctgtaatcccagctacttgggaggctgagacagaatcacttgaacctgggaggtggaggttgcagtgagccaagatcacaccattgcactccagactggccaacaagagtgaagctccatctaaaaaccaaaaaaaaaatatatcctatgtggttatagagttcaga

SEQ ID NO: 41212 - DNA, 1643 bp, Homo sapiens
acaggcgtgagccacagtgcctggcctatggtatttttggtgtagcagccagcacatagatttttaaccaggagctggatcccttacccagcacttagaacaggcacatagcagcactcagtatttattgagccagttagtggatggatggatggatggatgaatggatgtatgagtgtacagaggctggaaggtgaagtgaagtaagctttctgtttaagatggaagggacttcatgtttaaaagttgatggatgcattttcagagagtgagaacatgttcactagaggaaaaagcccaatagcatcaattccctgagcaggtaaggggttggctgtaaagcagggtggacaggtggatctcagctctgtgggaaccaggaaaggacaagagcatgggtgttcttagttggtgtgtttggtggtttggtggtttggtggcagcaggaaggtaagggagttcacactgatggctttgggtttctgtgtgtgaagtaggggaagttgtctgctaagaatggaagtgtggggcaggaagtggaggtttgaagtggtttagagtaaaatggacgttgagataaagcaagaagccttagattgccaggcagcaatgtgcaggccatggggggctgatgaggactggctcaggacccccctgccctgtgcctgactccacccagcagtgctcagctcagcacctcctggagcaggaggagggaaagctgcactccggtgggattttaccaggtggaggcagcggaaagggaatttgaatgtcctgttgaagccgctgaaaaaacggagaagggccggatgaggagttcaggaggccaaggagtcagcacggtggggccgaggaaccagcctgctgccagaagaaacgggtcggagagcggcagccggaattttggcgatggtgtaatttcgagcaggaagactgccctgggctgggtcactgagtggagtggaggggaaaggccagtggagatcaggggatgctgcacagaaaggccaggctgcccacgcacacgtggaacccgtgccgcatgctgcaaggatctggataggccccgcgatcaagagtcctgaatgagaaggagaaagtgtggaccccagcagcgggtgtggggagcgggcggttctgcctggaatgggcctgagggtctgcggatgtctgtttctttttctcacttgtctgcacaactttgactttttatacccactgctattttgaaaaaggagtgggaggaatactggattcagtgtcatcattagtggaaagccacaagtgtttcctatgtttagatggcagaagcccaggggcaaggctcaggtccttccagctgtgctgtctcctggcgatccgtggattagagctgttcctcagcttctccgtcacttaaaggggtgggtttcggctgtgctgtgggagccactcattcagccttcatgttgttgctgctaggactacattttcctctattatgtttctcacctgcttttgtaaaaaattaatgaatgaagttctagttgcaagcagtgctgtgcttactgtggcgggaataggggagcagcccctcctcaagggcctgtattctcttggcttcctcttcctctggtagcagataagtaaaatgatggatg

SEQ ID NO: 41213 - DNA, 1031 bp, Homo sapiens
ccatctggccttctgacttaggaatccgctaacgtctgccctcgctttcccaaataatccatcgctcccacgtactatttggttttctgagcctggtgcggggtctggcctcgggctgtgcagcgtaagtagctatgcagggcatttatcctgcaagctgcagtgagccgagaccctaaagcttgttgcatctgtttgtctttggaggtaaaggtggtgttatgtgtgtgtttgctggggggtggtcttttggaaatagggagactggaggaaaaataaacaggacattggtaagtgaaataatattgaattaaaatttttctgttaaggcagtgagccctggtaagagatttttttttttttcttaataaaagcccttgtgtctgcgccttaccagcgagacttgataagggttacttcctccagcaagaaggttaaaagtagcagtggagcaggaactgcggtgtaagtttttttgttattgcatgcgattatattgcacgttattgtgtgctgtcgcagaagttggacgtttaaaattgaattgtatttcataaggatcttctatttgtctctcctgacttccttgtcattatacttactcagcacttggtgtgggtagagttctgggctacagttttgggttcagagagtgtaagacaagtatctgttctcattgcactctgtaactctgtatattaccacagccacatgtggccaatgaattttttttttttttttttttagatggagtcttgctttgtcgctcaggcctggagtgcagtggcgtgatctcgactcgctgcaacctctgcctcccgggttcaagcaattctcctgcctcagcctcctgagtagctgggattacaggcacctgccaccatgccctgctaattattttgtgtttttagtagagatgggggtttcaccatgttggtcaggctggtctcgaactcctgacctcaagtgatccgcccaccttgacctcccaaagtgcttggatgacaggcttgagccactgcgcctggagc

SEQ ID NO: 41214 - DNA, 1046 bp, Homo sapiens
agaactgctgattcctacaggaacacttggacaatccaatacctaaatgttaaccatcaattaacccagtaaacctgcaagatggaaacgaagatttgttctcacgagtttcacgtgattatttaaagtaagggaaatttcagctgtttatagttctgtcttaactttttcctctcttcattcttttcctctcattttttgtagcacttctggggcccagtagccaactggggtcttcccattgctgccatcaatgatatgaaaaagtctccagagattatcagtgggcggatgacatttggtaagaatgcagatttggataattgggaggactttcaacatagtagagctcctgcttgcatttcaagattgtagcactagatgttacagtcactattagaaagtcacatacagaatgtgatggcatggaagagtgttacttctctatgtcagtaagaaacaagattaattagaaatatttatctaggaagtagtaacatcttatttgcctttcagatttagcacactgaactgaagactgtgtcatctgaatcattctaatagtcactttaatgatttatattgtgaacttttttgggggaaactgtcattaaactgacttgaaaccctgatatttgaacataaaactattgtggagggaataaataacaattctttcagataatgaatggattataagcaactccaggagacaaaaaaagtgtctagaacaaatttcagcctactcttgctcggaaatatgttccttaaatgtttaaataattaacaaaaatgcatagcagtacagtaaatttttttatgagcttcctattgatacaggcatttaagtaacaacttttatctgtcaaaggctttcgcagaagaggttcttttttgatcagggcaatggaactgttcatctctgtggtcctatcaaccctctcagttttctaagttattgattgtctttgctctgctatttttggcagccctctgttgctattctttgacattcatgagatttgcctacaaggtacagcctcgga

SEQ ID NO: 41215 - DNA, 1061 bp, Homo sapiens
ccttcccggccagagtggcagtggggacctggagggacgaaagcgacggcgctcctcaggacagggtgaccatggggacgcctctcccggcaggggtgacagtgggcgcccctcagggcagggtgacccggcaggggtgacagaggctcgttcctctcccatggttggcagtgggcacgtccctccgggccagttgacagtggctcgctcctccgggcgggagtggtttcctggccggtttctaccagatcctcggagtgggtcgccggtcacctgcggccgtccaggtgtgccagaggcggcgacctgggtgtggggtggggagacgccagcgggaggcgctgctgagagcgcggcgcggcgctgttggagcggagcttcgggtgcgcccagcgcgcttctgggacagcggaaataaaatgtgctggccttgggttcgcctttcggttttctcattctaaggactttaagcttgggaggaagtacaatttaagatgtttttatatacgaaattctgtcaaccaaagtaaagtgacgtgtctctaaggtcatactttttcttcttgttctattttctgttaactcctcctttccagttagaaacaaagagcattcgcggttggaaagcctgaaaatacactttctataatttatttgcacctctcatcttggggcgcttgcttttatttcaaaatattgaatataactttgaagcagttttaggttatttaggagtgtaattttagttagtttttcagtgtatgattttaaaacctaggtacgtgtacagctgcggttttttttcggtagttaatagtgtggtcaagaggtaaagagatgaaagctgaggaggaataaatcctgttataaccacacaaaagggatagtatgaaggcaacttgattttagcaataaaaaagttttaaatcctgaattttattgcaaatactgtttacttctacttttatagagcagtagggtaggaaaaataattcagtctgccatatggtaaacttgtaaacagaagcttcacttctgactttcaaaaaaagacatttcta

SEQ ID NO: 41216 - DNA, 1049 bp, Homo sapiens
acaggctcccacccaccagccaaaacttggctctcaactctcccactgcaaacctctccccggtctttcaacacaggctagtttcctattgtttaggaatgcaacacattaccccacatctagtggcttaaaacaacctgagcttattgtcttccagctctggatgtcagaattctgaaatctgtctcactgggctaaagtccagtgtccccaaggctggttccttccgcgggctctgggggctgagagtggatacacagcagatggtggccaggctgggtgcccgacagaagtctgacccacacctgcagccagcccctttatctacaatacatagctcgggaggccagcagctgtgtcaggcttgcaggaagccagattgctatctctagtgacagcccaggaagctgaactataaattctgtgacagtcagccccacatggccaggacttgatgaatgactgacagcttcctaagttctgtccctgcttccaagtcaggaccaaccagagaacacaaatatgcacccaaagcccacaggatgccctgattttagttccccgcctccatcttttgcagccagcagcccccctcacccacatcatcttccctatggcacgttccccctgcatgggttgttcactgtctgtgtgcacggccctgtgagggcagccactccagggcaacaaaggctttgcttttgctatagttccagcacctcaacaaagtcgggcacatggcaggagctcactcaatttcagcacacaatgaaggggctccttatcttcatttagcataaatatttggtagtgaaaggctaagtgttgattaaaagaaaaatatatggccgggcacggtggctcatgcctgtaatcccagcacattgaaaggccaaggcagttggatcacctgaggtcaggagttcgagaccagcctggccaacatggcgaagccccgtctctactaaaaatacaaaaattagccaggcatggtggcgcgtgcctgtaatccgaactactcaggaggctgaggcaggagaatcatctga

SEQ ID NO: 41217 - DNA, 1047 bp, Homo sapiens
aaacaccacatataagtcaaaaccaactggacttagttttgtgaggtttctggggggacagggggaggggagatttgatagtcttctgtttcttctattaaggcaacagatcataaaacctatctcataatataaaatatatatttaattttttttcttttttttctttttattttttaattttttattgttttttgagatggagtctcattctgtcaccaggctggagtgcagtgttgcaatctcagctcactgcaacctccgcctcctgggttcaagccattctcctgcctcagcctcccaagtagctgcgactacaggcacccgccacacccagctaattttttttgcattttagtagagacagggtttcatcgtgttgcccaggttggtcttgaacccccaagctcaggcagtctgccagcctcggcctccagaagtgctagggttgcaggcgtgagccaccacgcccagttcttctggtcttaatcactgcaaaccgaaaagacaaatggagaagctgaaagaaaaagaaataggagaacagaagagacagaagaggaatgatccaaagatggagacacgacgaggggccagaagaagaggaaatgagaccacgtcgggctcgccttgctccagcaaactccccccggtccccttccaccatcagccctaagacagaagcaccactcccagtggcctttgctgaccctggccgggttggtggctctggctggtggctctggcttcggtgtcttctcagcactcctggcttgccactgctctaacgtctgccatcttttattgtcgttgtctgtctctgtgagtgtctcctggcacgtggagtttcttaaacaccagtcaccttacccaagatgccccagcacagacaaaagtgcctgcacctggccaggcctccaagggacccatgagggagtgaagacaacagggtggaagcagagaggcactcacacccagacccagtgcccggcagccttcacccatcctggagtccccaccctccctgtccctggagtgtgaagaaga

SEQ ID NO: 41218 - DNA, 1035 bp, Homo sapiens
ggcccatctcaacctggattttattataacttcaaattttataataacatgacattttatcataatggcactcaaaaaaagctgaatgcagaaaatagaatacaactatagattgttttctaaacagcataaacggatacttgtctaagatcacaaacccctttggcagatacggccaggcggtggctcggggctgtcttgactgacacgccttctcattccggcttgtttttcatgatccactgatcctccgttttccatgctgctcgacatcagacttactgtttccttctaacctgggccttctcactaaatgtgaaatatagaatgcagaggctttttggtctctctgagtgcagttgagtcaaggtgggttttaaatgcagaatctcataaactgcgtttctaagctgtgacgttcctgtccctcacatatctctgcacagatcccatcaatatcctgggccaattgacacttttctctgtgtagaaaatgcacgaggcgcatggtggaagacctcggagctgagcccagacactctgattgagtaggcctgctccagcacagtgatcctggcacggtgactcctgtgagcagccctgctggtccagacactgctgtcacctgaggatcaggtttacaaaacctcgctctctagattggagcatgctggccaggattagtttttaagccatcatttgttaaagaaagagctgtgttattgtcatcagtagtatctgtgggatgcttgctttcttctgcattatttaacactgttaaacttcacagccctaaggccaaagcactcatctctgctttgcaaaagtgaacagcaaagtgccggagggctaaggtgcttgcccctggtcacccagctcctacataatgatgcccggacccaaatcccacctgttcacctccagcattgaggcctcttaactgctcctactatcccactacttcctagggccacccaattataagctcaaggacagtacatgtaggtgtgcagcagcaggacagcccccagtcca

SEQ ID NO: 41219 - DNA, 1048 bp, Homo sapiens
ttaagatcatttaacattagactggattctctccttagaaacatgaaatgtgtttgtttgactcacatcactgaggggctgagattcctaaggttactaatgcataaaaatatgtgtctgcctgtcagtggcaaaatagaaccagctgtgactgcagcaccttttgaaatttcagagaggaaaaagggcttccaatcacaagcatatctggggattgaagtcccagtggacagccgcagtctgtgcgggtggaggatacaaccgcttccctgggcagctttgctgtcgttgaacttggctttttgggaattatgaaatagcatcatagagctttagggtacaaaattgcattcaaagtttattcgttttggctgggcacggtggctcatgcctgtaatcccaacactttgggaggccgaggcaggcagatcacttgaggtcaggagttcgagaccagcgtggccagcatgacgaaacccagtctctactaaaatacaaaacattagccggacgtggtggtatgtgcctgtaatcccagctactcaggaggctgaaacatgaaaatcgcttgaacttgggaggtagaggttgcagtgagctgagatcctgccatcacactccagcctggatgacagaatgagactctgtctcaaaaaaaaacaaaaaaaaattattcatttcaacttctttgtttatttgggtgagaaaaccaagaccaagaactttggcttaggtcacagaaccagttaatttcaagactaatgttagaatcccagacccagtttccagatctccttccattatgttattttgcctcttttatctttttacttcttttgtttctttgcatctcagtaaatactggatggaaagaactttggtgttctgagaaccttatagcagaaaagcactatgaaagtgatagtttaggacagatctttgaaaaatctgtgtgtttgggctgggcgcagtggctcacgcctgtaatcccagcactttgggaggccgaggcgggcggatcacgaggtcaggagatcgagaccatcct

SEQ ID NO: 41220 - DNA, 1041 bp, Homo sapiens
gaggaaaactgggtatcttccatagacttccatgggtgtgccccagaaaggtgtcaggtctcagtgaccgcaagaccctcatccccaagagagctctgctttcagggcattgacagtattgcctaagaaccacgacacattgctgggcagagtaacctgcatctcattcaacagtccacttcatagatgaggaaaggggacactggcccatttgctaagctggagttaccgtcacctggctgggataggataccctctgagtgtctggcctatgagtcactgcacttatctacaaaatacgttacccatgccagttgcctaatgagctaaggtggctttgagagcaaggaaatgcaccaccctcaccgtcctaacttagcagaaccataggtccactgagctgaaaggaatcttctccccactcaacctttccacacgccagtagagcctcagaagatgggatgtggaacctccaaagcttagtttgtatttcttccaacagggaatgtacatttaaactaattaaaagtgagattattaactcaagacttccaccaacttgctaaaggtgtcaatatgcaaagtcatttcatttaggaagcagttattagtttggagttaccaaagccagagggttctctttggtgacctattatttgagctatttcagctgtaactggcatttctcctgaaagacagtagggagtgaatgaggaagacaaaatgcgagactctacctgggatattgctagtgatgaactgctgagtggaaggagaatttcgttttatttatctatttgctcaattgttcatacactcaaaagattttagcacatactgtgtgcattgtgctaagcaactgggacataaaaataggatccctgccctcagtgagcttaatgtctaacaatagaggcaaacaagtcaaaagaagcttgctatcagggtataagtgctgtgaaattattggcagctttggatttaaatggtctgattagatcaattgtcaatttatttctatttctggtggtcacagatcat

SEQ ID NO: 41221 - DNA, 1060 bp, Homo sapiens
tttcctgctttcttactatcatttgaaatttttttcttgttctatactttgacctctattagtttggcaattacacattggatttatattcctttaattgattgctttggaaactttagcatgtatgcttaaccaatctattgaatttttgtctaaaggtaatcaagcctctttatcttcagaaaaatatgaaaacattagaaggttttaactgatcactgtcccgtatatgctatttttaaatagcatatttaagacatcaattccaacttaagtccacaaattatacaatacacaaatgatttactttcatgcagctcgtgtgtgtctagctttacccacacaatttcactggaagtgagaattttcttcgattgtttacttggaaatgtctttgttttgtccttgtttgtgaaagattttttttttgtaggacagagaattcaaggttaaagttattttctcttagcacatcgcatatattattccactctctcagcttccaatattgctgttgagatggtagctgacagtaattaacattcatttgtagaaaagttgtcttttcttctggttgctctggagagattttttttttcggtttttggtatttcaaatatttaatatgatgtatttaggtatcattttcttttcattgaatcctcctggggattttgggggtctttataaatatgaagatcggtatattttatctactctgaaaaattctgcagtattgcctcacctctttgaatagtgcttttctgtttttctttgtttcttctgtctcattctaatagtcagaggcatgctggatttttctccttctatcttccatatttcctaacccccctttcatatttcctgtatttctgtctttctctcaattatcatcagatccaacgtctcttttaccaactctttgttggactttgcccaaactgctgttaattgatctattgaatttttttttttttttttttttttttttttttttttttttttttttgtgacagagtctcactcttttacccaggctggagtgcagtggtgtgatctc

SEQ ID NO: 41222 - DNA, 1173 bp, Homo sapiens
aatcggggctgcttcatatggtctttccatccatcttcgcatcccagagaccagggctggaggcggaggcagagtcacgggagcacctgccgggcccacctgccgaggccctgctggaggggaatggctgttcctcattcaggaggcacaggcctgtggggagatgcccctgtgtccgagccacaccactcaggcagggcaggggaggcccctggggtgaaccgagttccacccccgcccaacccttcacagaggaagacgcctttgggttggggcgaagagcatttcccagaccatcgtcctgcccactccctctcttgtttctctcctcccccttcttcttcttccctgcctctcccctccctccctttcatctcctctcagagaccgctaacgccagacccctctgtcaatgatttccttgttttctttatatctttacccatgtagcattttctaagcaataagctgtgttttacctgtttttgaggcttatgtaaataagaagctctcggtgagcttccaccgtgtctctcttcctttgttcacggttctaggcgtgagcttcccctgtgtttagaggtgtgtgctgtgcacactcaggcagcccatgctcactgttgtgtagtgttctgccacgtgtatctaccgcagggcgcctgttccttccaccattgctagagattgtggtgacttctggcgtgtggctatcctgcaaagacagctacaggtattcctgggcgtgtctccgagtgcacctgctggggctctgctccatgtagtcctgaggtggagtcgctgagccgtgggcctgcacatcttcaacctgatgagattgttgttttccaaactggtggcgcccgttcacactctcgccagcccagtgtgggagtcctggctgcttcatgtgtttccaaccttttatagtcagtaagatcttactagctatgagatattttgaattataacaagaaagacatatgcatcttggttctgatggagagttttaattttttatttggtaccttatgtgaagctagaacctttccagcctggtcttcagttacccgccctgctctgtctcagatccaccagccaggtgtgtagcctccagcccaggctgtggcagaatcctctgcagaccggcctgagttggcagccactggagataca

SEQ ID NO: 41223 - DNA, 1052 bp, Homo sapiens
gccctcatctctggatgccctggaaaggctgcagttctgaacctgcaagagggaggagcaaccctcaacccacagtggttgcccctggcaactcctccataggacttcccgggccccacgtgggttcctccttgctatcacacctgcaggagggtggctaccctcaaaccatagtaggtctccccataggccctggcctaccctggacctcggtaggaatcaccagtgaggaatgaggagggggtgaggcagggagcagccagaatcttgtctttcacccactgggatgaagcatcacaggcatgagctgataaaccaagagcaaacgcggtgggtcaggctggagagtgagctggcaggggatggggaggagcagggatcccagaggcagcaacagggctttggccacacccagaaggcagcgagacttggaagtgcaggctactagacagtcttgcagccaacggtgctgggccccgtgcaattccagcactcaagggagactctttggagccatcatgaaaacgcagtaggacctgacttggggcaggttctcaacccccaacagaggcgagggtgaggcagaatccaggaacatgaatttgggatcagacagtgtgttgactacatagctgtcctctctcagctccaaacccaccctctacacatggcctgggggagcagatgggctgggagcctcgtccatgttccatgtccactgccccatgcaccctgtgaatagagggtgccagagagacaggcagcccgggggaaggagcaggtgctgatcccccagctctgcctcatattcctgtcactgtccccattaagacctcctaatgctggccaggcacgggggctcatgcctgtaatcccagcactttgggaggctgaagtgggcggatcacttgaggccaggagctcaagaccagcctgggcaacatggtgaaaccccgtctcaaccaaaaaatacaaaaattagccagatatggtgaggcacacacctgtggtcccagcttcttgggaggctgaggtgggaggatcacttgagc

SEQ ID NO: 41224 - DNA, 1025 bp, Homo sapiens
cctggttacaagttctacatggagattaggtgagatctgatcatggctgacttcaaatcaagaggaatcttcccgtgtaatagggagccgagccgctagagggtgaggcgtggaatcacagggtggacttgcgcttccggagatcaaccggccacactttctaggggagaccggcctggggcagggccagcccttcaggagaagagaagtggataaggcagttgtgcaggctgcacctcccaggacattttttttttttttttttgagacagagtcttaagtctgttgcataggctggagtgcagtggcatgatcttggttcactgcaacctccgcctcctggtttcaagtgattctcctgcctcagcctcctgagtagctgggattacaggtgtatgccaccacggccagctaatttttgtgtttttggtagagacaaggtttcatcatgttggccaggctggtctccaacgcctgacctcaagtgatccatcccccctcggcctcccaaagtgctgggatgacaggtatgagccaccgcacccggcctcccaggacttttcattggcgagccagtgaatcccttacggcgaagcctgtttacactcaactttctgttatgacgattgacagcttccttacctgcccagagaaaagcaaacaaatggtgacctcagaagcagcatatagaactcagggaacagagacctttaaaaacctagagagactgtgaagatatgacacaatagccaaaaaacaaacaggatgaaacaaataaggaataactggaaaagtgaaagcattcctcccgatttaaaataggagtgctaaaacacaaaaacaaatattgggacagtgttgaggaattctagtgagtggaactggaaacaggcacaaaataggattgaaatgagaggaaactttactagatcttcatatttcctattggtgagttccttatgtcttaacccaccgagaaggaaggagcctgcatgttgtccatggctgtggaggggaccacccag

SEQ ID NO: 41225 - DNA, 1031 bp, Homo sapiens
tcccctgacctccgtccctgtgttagcagggtctcagtttggtccagtatctgaaccctgcctccagagtcaagtcccgtctcctacctcactggggaggttgggccctgttttctgatctctgtccccagctacatctagatgacaacacctccttatagactcctccagttatcttgggttcctacaagagcgtgtctgggatagggtccaagatgaactcctgcacggtagccccttgctgctgcctggtgagctctgggtcctgagaagggaaggggaggtgccgtggctgttgtaggcctgcctgggggctggaaccttagggaccacagctgccgaacaccccaaggacctctcgctagctgctctctcctgtatctccaggctgtcccagcctcacccaccatgtggtcggacgagattcagctaccagcgtatcagcggtggagtgaggccctggatgcgaaaagctccagatgtgtttcccttctgtgttctcagtctgatgtgctctgacatatttgcgcctacctagttatccagagacattgatttccttggcggggaagcacgttgggaaaaggaacatttactgattaatggaaggaaatatttgagtcacacattgtccttagatgaatcattgatttattcccagtaaaatctgacttatttaaatggccacacaagtaactaataaagtaatttaaaatcataatttaaactaatgagatactttaaaaacatatttctaggtctctagagtggaaggaatgtggtctgtagattataattgatcatggggagcaaacactttgcttcctgtttactcactgcttgcttggaaatacattggtacatttctggctcttgccaaaatgtaactctgagttaggagagcatcacttcatgtaattgataaagttaaaactttgtgcacttttggacatctgcaatatgcaatactctccaacacagaggcacacgtaggtatgagttgtcgtggaaatgcatgtgtttccatggtt

SEQ ID NO: 41226 - DNA, 1025 bp, Homo sapiens
ccgaaacaagagcaccagggctcagctctgagtcaaatgccttttctgtgtttctcatgagaacccaagcacaattcaagctgttgtctctgtgtgagaatgtgttctgtgtttcaaaccagtagcacagaaagaacactggcctgcacctcttcccatccccacagcgtgctgggggtaaccctgcctgataccctgtgggctgggattaggctcgaagtcacaggaaggaataattcatcactgatggctggccaggagatggacatggttggaacagggtgtggggaagcctaacccaactgggctgttggcataaacccatagggaaaggcgggatcagggaggccattgtggaagctgaggtatgaagcactgggacttggaactgggtgatggcagcagcgataggttaacgtgggtgacagggtgtggtgaccgctgactatgaggggcgcactaacaagcctgtcagcttcctccacgacggaacttcacaccatgaccccagtcgtctctgcagataacgtggccagtgctgaccccaggacatcacaggcagcactttcctcctctgcttccctccggatatttcacaaagcgcagttttgtgttttttacttgctagaataataaagctgaataaatggctgcattaggcaggaatggttttgcttccagaacacataaatcgtgcatctgtgtttgttcttcatgtgttttcagccagtcatggatatttctattctttattttctctccatatcatgcgtgaatgtttttgtatttctccccagggctgtgacccagatatctacgcactggtcctttaaaaggagaacagagaaaaaatcagtagctgtgtcctataatttttgtgcactgtctatctgcatagatatcccaccaactgttcacaacaatctgctctttcttctccctcacaattccttaaatttacttttctctcattttatttaatcaagcatgactttattaaaacaaaacaaaacaaaacaaaatga

SEQ ID NO: 41227 - DNA, 1026 bp, Homo sapiens
tgtaatcccagctacgtgggaggctgacgcaggagaatcgcctgaaccaggaggtggaggttacagttagctgagatcgtgccattgcactccagcctgggcaacaagagcaaaaactccgtctaaaaaaaaaaaagaaagaaaagaagaaaaaagaaaaatgacaaataataaaacaatcatcggcgaaaaatctataacaaatgggcttgcctcaagtacagttaattgtgagaggcacccctggtaaaatttctgggtcatttcagcatgctgacctgtgtttctggtgcactctggatcttagagagatatgcactaccactggaatctaaaactcgccctggatggaacgtgtgctgtgcaccccactcccttccaaccccacgctgctccaacttcacccgcgggatctgtcactgccagtggtctgctgagctcttccctgttaacatcccagtttccttggaaccccagctctcctcacctggctcccacttgcaaaattccctggccttcttcccattctcagggtggcagagcagagctgggagagactcctggtgccagtgtgtgcccagcgccagcctctttggcaaccattcctccaggctgtggctggtctttggttcctgttctcttccatctcctacagcgcacctgggccattctgcagctctctgttgcggggaatacacagcaatgatcccagatgttcactgtttttggtaacctctttgcaatgctctgctccttgttcccagcaatggcgatgcctccacccccttgcaaaacctgagcctcagacgaactcagactcctcttccttacctgctagttgcccacagacacactccacctccttccctctgttgcagaggtgagcgcgtggcctccactcgcagcctgtgtcctgatctccctcccacatgtgtcccagcagcccattctccatcctcactccctgctccttctggctccggatcctcctacacagccatgagcaaggtccttgttctcttcctc

SEQ ID NO: 41228 - DNA, 1028 bp, Homo sapiens
ataaatgtcatgtgcttgaatcatcctgaaactgtcccccaccctcatccatggaaaattatctgccacaaaaccagtccctggtgccaaaaagattggggactgctgccctaaatggagactagtccgccatgagagtattgtcaattcctactatagatgttcacgttgtttcagttttttgttttgttttgtgtcacgttgtttgcttttgcaaataattgctataaacatatttccttgttgatgggtgcagaagtttctctgcagcacagcctgaagcggagtggctgggcaggaggatgccccttccagctcttcttatcctgccaaagcttctccagcatggacacgcttagggccttctcagagttctccaagtttgatggaaacttaatccaagatggtctttttgtgaatgatataattcagaaattggatctaaattcagtggcagtgcaaggctatagacataaaggtttacagtttctaaactgagacttctttctgactgaataatgtttcactgattgccataacaagaggataggaactttcaaaatctgtgatattttctcattctgtatgtgaaaacactgtcatggtaaaggtgaggatgtttaacattttatgagacaaatttataaaatatttaagtacccccaaaggaggaagtgatttataaataaagcagggcactgcttagcaccagttccatggtcttaggtatgccagcctcagccacacacgctccctctcatgttgaataaggcacattgtcacagggaaaatcagcacgcccccagtgactcttgcagtgcttcaggccccacagacctgtgcttaaattcattgactttcttaacacccctaatgaacaatggctgagtgtcttaattgggacatgaaagaaatgattgccgggaacctcctaattacttcaccaatatcagccgctgcttgtgagcacagagtaattatataccattggatggtaagatggtgatggcttgctgatagcttacgtt

SEQ ID NO: 41229 - DNA, 1898 bp, Homo sapiens
tgctccggttataccagctggggactggggtgaaaccatgaacaagatagatggagccctacatctggcttaagtctggcaggacagccagcccctttgctctaggtaaaccacacacttcctacagaaacagggtcaccagcaaagaggagtttgtttttaatgccccataaagggagtggtatcttgtttctgccctctgcagtgactaaacccacagaataaattgcttatagtcggtaggaatgggccctgcgtttcacagcaaataaatccaggtgcagagttaggggacaaaaatatttacctactcagcagagtatacaaggcttaacacagtggttagggagtgggccaccattaccccaagagtatccatctacttgatgcagattttaccaagaaaccagcaacaacaagcacaaaactatggggagagtcagggggagaggctaacaaccacataaaatggtgtggggaccgcaggtgggagaaccaggttgtgatccgtgcttttccttgggagaaatcaattaactctgttagtctcagtctttctttcttttaaaatacaagggtttgagtaaatgatctctaacaccaagaatcatccttttctataataaccttaatcatcattatgggtctatcatctctgaattaaattaaatatttaataacccattaatgttcttagctaatgtcagcttttgaagtgactgtattcctatatttttactaattataaaataagattttgaaaaatctctctctgcctttctgtctcttaaggtttctctttccattcattctaaattgcctctctagacttcagtgtgtccgctcgctgttgaatgtgaagctgaggttggtaaaggatgtgtactctggtcttgctctgcggtgactgtggacgcgcttcacagccctacgtttcagaggctgttcactctgtgtgatgtcttcatcatactcacagaggacctgggttgtggctataccgcccattggctaggccggcccatctggaagatcacaggttattaatgactaaaatagttagaaacgatgtctttatttaaaataataagcattgattttatctaatttctaacaaatgcacatgagacattgaatacccaggtacaaatggacctggtgtcgcctttgaggtctcaggtactccttggctggcctgtgctggcccctttgtcttctggggcccctttctccaaggagtctggcttctgtgctccacggagtctggcctctgtgctccatggagtctggcctctgtgttccacagcgtctggcttctgtgctccacggagtctggcctctgtgctccatgctgtccttggtccacagggcctgaccttgaatcgtcatgaagacatgttctgctcattctgtagatttcctagagtctgtgccactgtttggctttgcatagaatccccaaatcggctgactattggacttcactaggatgcgaatggtgcaaagtttgatccaactggctgtggtggaaaatggaaacttgtggggcttcgagcagaaaatttgggaataccttgattccaagctcagacacttagacccctctttccacggctccagtggcggcccagccgttccagacacctaggccagcagagaagccaagcctcaagcccctgtcgccatctgttatctgccttgggctggccggcctgcacctcctccacgccctgcggtgcagctttgcctcccctgaggggttacaggctctgctcagctgcctcctgctgcagagcagaccacagcccagctggctgactcagggccaactcaggggaagccctcctgtgactgtgcgtttgacgggaccctggcagctgccgtccctggaactcatc

SEQ ID NO: 41230 - DNA, 1768 bp, Homo sapiens
tgttctgtatttggaattaaggtttattagacaagttcatttttaaagacatttttctgggctggctgagccaggctgccactcctgtgttcatatttagttctgctccatgatgattagcaaaataaaaggagactgttcaccacagaaggacttaaaatgtactgtgatatcagctttccatactgtaagtggattggaggagtcactgttcctaactcaattttctcaaataacaagaaacacccataaatgattgttgaaaaaggatatctgaattgtatggttttctggtcacatttgtcagaaccccttttttcttagatttttaaaaagaaaataaaaccaaatgttatttaattgattattatctgctatttttattattattttgttagatttcattattgaccttctagaacaaaaaggaagaaaggtaaaaaatctttttggcaataccttgtctttatactaacatgtcctaaaaacatatttgaatgacttaagtctcatataaataagatcgttgtagtaaaatcattgagtgctttatagaaacaagatgcctggaagcaaattgtggtgcttaagaatacgggcttggactcagctaagtctgacttcaaatgctggctctgcaactactagcttgtgactttggataaattatttaaccttgttcagtcttaggttcaacagctgaaaaacggtgttcatgttgctcagattctcgtaaggaccacgtgagtggagctctcgaaccaggagcaccatgcctggcgtggagcaaccttgaacttagtcgctatctttcaggtgttttctggtccattgtctatggaaagtaattacttaaaaaataataaaccctcaagtaagtagaagaaaggagcaacagctcccataaactgaaagagccaataatccctgccctatacacatcttttcaaacctggagccagcgacctagggaggagactgaggccggcagaactgggtgacctgccttggcagcctagtggggggtggcacatgaggggtgaagagaagaagcgccaagtccctcccctgctttccggggaatgtcccagacaggcagaggcttacatcaagaattcggaagattgtcttatttcagaatgagactgcctttacaagcaaatgggattgtactagtcagtgctctccaaagaaacagatctaaaaagatgcagacagataggtagacgcaaacacagaaagatttacacatatacagacacgtgtatacagagagtgaccaatagctacaacctgctctaagaaggacctgacagccagggcaagctggggattttcctgacatcagaaccatcctcccagccccagctcagcccgtgtacaacagaagccaggaagcacatgcaaagtgaggcaaacagggattattcatcacaaatgcactcatcaagccaaacttattcataaatttactcggtagaatgcttcctctgtcctggatgagacatggagaccactgcgggacttctctggtctcatgtatagacatgcatacataggtatatatgtggttatagataggtgtgcacgtgtgcatatgtggttatgcataggtgtgcacgtgtatatatgtggtatagataggtgtgcacatgtgtatatgtggttctgcataggtgtgcacgtgtgtatatgtggttctgcataggtgtgcacgtgtgcatatgtggttctgcataggtgtgcacgtgtgcatatgtggttctgc

SEQ ID NO: 41231 - DNA, 1074 bp, Homo sapiens
acattttttccttcatttcaactttggtgaatctgacaattatgtgtcttggagttgctcttctcgaggagtatctttgtggcattctctgtatttcctgaatctgaatgttggcctgccttgctagattggggaagttctcctggataatatcctgcagagtgttttccaacttggttccattctccccatcactttcaggtacacctatctgatgtagatttggtcttttcacgtagtcccatatttcttggaagctttgttcatttctttttatacttttttctctaaacttcctttctcacttcatttcattcatttcgtcttccatcacagataccctttcttccagttgatcgcatcggctcctgaggcttctgcattcttcacgtaattctcgacccttgactttcagctccatcagctcctttaaggacttctctgcattggttattctagttatccattcgtctaatttttttttcaaagtttttaacttctttgccattggtgtgaatttccttctgtagctcagagtagtttgatcgtccaaagccttcttctctcaactcgtcaaagtcattctccgtccagctttgttccattgctggtgaggagctgcattcctttggaggaggagaggcgctctgctttttagagtttccagttttctgctctgttttttccccatctttgtggttttatctacttttggtctttgatgatggtgatgtacagatgggtttttggtgtggatgtcctttctgtttgttagttttccttctaacagacaggaccctcagttgaaggtctgttggactttgctagaggtccactccagaccctgtttgcctgggtatcaggagtggtggctgcagaacagcggatattggtgacccacaaatgctgctgcctgatcgttcctctggaagttttgtctcagaggagtacccggccgtgtgaggtgtcagtctgcccctactggggggtgtctcccagttaagctgctcgggggtcagggacccacttgaggaggcagtctgcctgttctcagatctccagctgcatgctggg

SEQ ID NO: 41232 - DNA, 1035 bp, Homo sapiens
attttggaaaattttgagcaattgcagaagttgagggaataacactaggaactttcttgctcccactgtgcaacaaatatcactcacagaaaattttgttccactttaaactccatctcttcccctaagcccacatccaccagactatttttgaagaagtttattatcacattatttcagctacaagtatttcaagaagtgtctctaaagataaggtcaccctttacacacacacacacacacacacacacacacacacacacactgcaaaaccaatacagtgcataacaatttaataataattttttagtatcatcaaatgtcaggtctttgactttcaccagttatctgatctgtaatagtttgtgtgagtcaggctctaagagaggctcatataccgtggttggttgacacacctcttaagtctcatttaatatgtggtctccttctacatcttgcatatttcttgccttgttaaagaaactggaccactgtcctgcagtgttctgggcattctggatctttctgcctgcttcttcattgcatccttgaacatggtcccctgtctcatgtagctcctgtcttttgtcagttgggtctagagtctcaccaatattcaggtggggtcgtctgccctttggatgtctggttgtctttttcttcagttttggtgattgccaagatccaataactcactaggagtgatcaaagagtgataccctcattctagcacttcttcattgatgaactggaatacttccttaaaagaaacttgtcattctaccaagaaaaagttatgactgaggaaccacaacattctgtctaaaaatccacttacatggctccttatggaaagtccttagatctggcaacatgggattgcattcattcattcattcattcattcattggaaaacacgtgctgagcccctatgtgtgaggcactgctttaggggatagacctttgcctgaacagggcagacaaatccacatctttgtcctgattttctgctggatggagacagacacataaat

SEQ ID NO: 41233 - DNA, 1079 bp, Homo sapiens
aggggaaagcgatgaagataagtcacatggctgtgtttagaaaccttcagaagtgataccagaggtgaagtattctgtaatgagctgattaatacattgggcacagaagtggaaaaaaatcagaaaacttggaggtagaaaaatagaaaataattaacatgtatatttactcactgtatagtcttatatttattaaaggtttttaatttgttgttaaaaacccccacaaggaagttttcagactaattgaattcactagtgaattctatcgaacatttaaggaagaaatattaccaattctacacaaatatgtccagaaaataaaagaggaggaagtattttatgaagccaaaattaccccgatactaaaacccgtgcaaagacattacaagaaaaacaaaaacaaaaacagaaaactataggaccatgtctctcctaaatatacacttaaaaaataatatatattttccttaggaaaatattagcaaattgaatccagcaacatacaaaaagaataatgcatcataaaaaagtagaacttattccagcaagtgcaaatttggtttaatatttgaaaataaatgcatggaatttaccatattaacagactaaagagaaaaaccacatgatcatcttaatagatgcataaaaatcacttgagaaaactcgaaatctatttctcctaaaattctaaaaattatggataaaaaagaaacatcctcaatatgatacagtgcttctacaaaaagctgacagccagcatcacacctaatgtgaaagatggaaggcttttgccttcagatgaggacattgcaccactcccattcaacattatactgaaaattattggtagtgcaagaaggtaaaaaagaaatgtaagttatacaaattggaaaggaagaaagcaagctgcatttattttcatacaacattactatttacctagaagattccaaattatctgcaaaagcagctattaagactcacgtgtttaggatggttgcaggacgtaaggtaaatatgccaaagtcaattttttatttctttataaaggaaacaaaaatgagaaattgaaatta

SEQ ID NO: 41234 - DNA, 1034 bp, Homo sapiens
aataataaagcaatgctggatattgtcaaatgctttttctgcatctattgggatgatcacgtgatttttgtttttaattctgtttatgtgctatatcacatttattgacttgtggatgttaaaccatccctgcattcctggtatgaaacccacttgatcatggtggattatctttttgatatgctgttggattcagttagctagtattttgttggggatttttgcatctatgttcatcagggatattggtctatagttttctttttttttatgtccttccctgattttggtatgggggtgataatggcttcatagaatgatttaagaaggattccctccttctctatcctgtggaatagtgtcaataggcttggttccaattcttctttgaatgtctgatagaattcaactgtgaatacatctggttctggactttttttttgttggcaatttaaaaattaccacttcaatcttgctgcttgttattggtctgttcagagtttctatatcttcctggtttaatctaggagggttgtatattttgaggaatttatccatctcctctagattttctagtttatgctcataaatgtgttcatagtagccttgaaaaatcttttgcatttctatggtatccagttgtaatatctcccattttgtttctaattgagtttatttggattttctctttttttcttggttaatctcgctaatgatctattgattttatttatcatttcaaagaaccagctttttgtttcatttaatttttgtattttctttttgtttctatttcatttaggtctgctctgatctttatttcttttcttctgctgggtttgggttttgattgttcttgtttctccagttccttgaggtgtgaccttagattgtctatttgtgctcttttagactttttgatgtagatatttaatgctatgaacttcccccttagcactgcatttgctgtatcccagaggttttgacaagttgtgtcactattattgttcagctcaaataattttttaatttcc

SEQ ID NO: 41235 - DNA, 1093 bp, Homo sapiens
tgtgtagtcatgaattctggacttctagcatagccattaccagaacagtgaccacagaacccaacatgtgatttttcatcctcgcccccactcccacgctcccaccttttgtagcccagtgtttactcttccccctctatgttcacgtgtgctcattctttagtcccacttataagtgagaacatgcggcatttctgagttacttcacttaggataatggcctccggttccaaccacgttgctgctaaaggcatgatttcattcttttttatggctgaatagtattccatgatgtatctgtatcacattttcttgattgaattcttcgatgttggacacttatgttgattccatggctatgctattgtgaattgtactgtgataaacagataagtgaaggtgtcttttttatataataatttctttttcttagggtagatacctagtagtgggattatggatcaaatggtagttctgtttttagttttctgaaaagttttcatatgtcttttgtagaggttgtgctgatttacattcccaccaacagtgtataagcgttccctttctctgcatccttgccaacatctgttgttattttgaaaaagaaagaaattttgtggcaactaaactgataaacgtttcatgcctcttgccagtctgaacatatatgataaaaagtcatcttatttaggaaaaaaatcattcaagtcagcagcagttttcccattcatttattcagccaagaatatttattgataatctgtaggccaggcattatggttcatggaaaagaataaaaaggtgagcgaggcttgccctggaggagcgcaggaggtgctgtgatcactccaacttgtgagtactttcactgatatgagtttcgtggagtagacttctcacatagtttttgaagtgtagaaggcatttgggatagctcacataggatatctaggcatgtgattcctcacgttacggttctgtgcagcttccaagaaggtgagttctggtgaaggtcccgtgtgaagcttgggtgtaagacaagatgtctgttcttgagcttgggtgttactgcaatacacctttattcaccatt

SEQ ID NO: 41236 - DNA, 1045 bp, Homo sapiens
tgcaagtggcaagaatttggagccgagttgactgatggtctgccctgccttgccagccccaggagagggcagatggtaaaggttttgaggaaaattggatacattaaatagctcttgaagcaaaataaatttttttcaggcttcttagctgaattttttcaggagagcacagctggtggagtatggacagtgttaaattcctatttacttggaacccagaaaaccagagttctttctatagaaaaatgaaagcttaaatattaaccatgaggtacttcaagtttctgaggaaatttccaaatccacaaaatcctctgtgttttggaattcacagtctgaatttcctctctagttttgtccatgttttatgttgcatggtattaaaataactcacatatcaagaaatgtggcagagctatatggagcatatctggcctctgaactccaagttaaatgccctaaaacccttgcaggaggagcctgcatgcttttctcatcggaaaatctgctaagagattttagtgcttattttttagtgatttagtttagattttattgctttagttccttgctgttatgcaaatgtgacaggactgatgattggatttccagggactagaatcagcattcctggattcatgttttgctctaaccaccttttcaagctgctatcctttctggcctgttttctcatctgtagtctgagagaaccgaactgaactgggtctgaggtccattgtactagagaacactaaatacagtttataaaaattgtagaccaggggagattcatctgactgtccagggaaagtctttgtggttctctgtgttgttctgagatatttcagatatataattaacccataaatgggtgtgttgacaaggcaacgtgctcattaagagccagaacctccagaaaaccccggcagaatctagcatgaaaaagaaacatgtagtatttcatgaattatgttctggcaagttgaaggcacatctcaaacacaggacttttcaatcattgctttcagcggggttacagcagcca

SEQ ID NO: 41237 - DNA, 1420 bp, Homo sapiens
gggagaagtattagaaaaaaataaagggttcctttataacaagtaatatatcattacaagaaatacttcttactttattccctaaattagtataagaattcaaggttaggttgaactattgtcaagaaatactaatattaaagagacattttaaaaaatgttctcctgccgcgcacggtggctcacgcctgtaatcccagcacttggggaggccgaggtgggaggatcacaagatcaggagttcgagaccagcctgaccaacatggtgaaaccccgtctctgctaaaaatacaaaaattagccaggtgtggtggcacgtgcctgtaatcccagctacaggggagactcaggcaggagaattacttgaacccaggaggcagaggttggaggttgcagtgagccaagatctcgccactgccctctagcctgggagacagagccagactccttctcaaaaaaaaaaagtcctgctatgaaatttctttaccagtgttcttgttaatataatccatgttcatcttgtagaattttcatttaaaactagaaaaaaaaaagtcactcttctgccccgtaacagtttgacaaaacgaattatcactgcattcgtactgggaagtcagttcctctgggtcttatccactgtgtttatggcctacctctaccccgggagcggagggcttccaacccttcaaagcctccaacattcctttgtttggcagaatcttgtccaaagactgaatgtggactaagccctctgcttggccctgttgagacatcaggaactcacaggagccctccccatctcaagacgcccccatgggttgtggtcactgcaacactttcttttgtttggatgattgaagaactcagtcaaaagggctagtgaggactggaaaattctgtaatttaatttttttttcaggaaatcaatgggttatccttacacacatgtacagacacacacagatacacacatcgttttgctgattctttaaaaaattccctcagcaactaatcagttgtcatttatcaagcacctaatgtgcgttcagccctgcacagcgtggtcagcgccgcacagcttgttctctggggtttatcaatgctccgctttatgttgagaaacgtaagcacagttctcagcacaccgcggggcaccttccaccctctgactgggcgcagcctgtcgtttggttcacagctagtgcgactctggccaggctggtctttgagacggcccttcctcattgccgtaccgacgcctggcgtccagcccccggaggacctctctctggctctgtctgcttctgtggtgacctgatcttccacgcctgtgctttctgactcacctcttcatagaaggaattttaacgcccctttgagatcaaacaggacaggtgaagataaaatactgggtttg

SEQ ID NO: 41238 - DNA, 1049 bp, Homo sapiens
tgggaccgcccccaccagccaggcacaggatataatctcctcgtgtgccttttgctaaggccattggaaaagcacagtattagggtgggagtgtcctgaatttccaggcaccatctgtcacggcttccctttgctaggaaagggaattccccaaccccttgcgcttcctgggtgaggcaatgccccgccctgctccatgggctacacccactgtctgacaagccccagtgaaatgaacccaataccttagttggaaatgcagaaatcacccgtcttctgcgtcgcttacgctggtagctgcagactggagctgttcctatttggccatcttggaacctctatgcttgtatttctttacctcgccctattgcactgtctagaatcactcggagaatgttgggtagacacggtaagaagaagcatccttgccttttccttgacttaaggggaagcatataataatttacgtttcagctgtttttacttataacatttctgacaccaaggtatggggtttttgcttcataccaaccaattctctgattctctggacaccaactgtgagttcaacaatccaattcaattctgacattaaccccttggagttagtgcagaccccacagctcaaaggctcgatccgcttccccccacttcagatgccagtcacaggttgagggcttcctgaacttctgattgaccaggtagaaattgaggattcccatgactccttctgcaggtttgataatttggtggaaattaccagttattataaagaatacacctcaggaactgccaaatgaaagagctgcacagggcagggtatggaggaaggggcaggagcttccatgttccctctggatgcgccaccctcccagcaccttgatgtgttcaccaacctggaaaccctcccaactgtcatttagggttttaatggagtcttcattatgtaggtatgattgattaaatcatcagccaatggtgattcgcacagtctccaaccccttttccctttctataggttgagagacaggcctgagagttctaagctt

SEQ ID NO: 41239 - DNA, 1036 bp, Homo sapiens
cttaatcctgcgttctagtttgattgcactgtggtctgagagacagtttgttataatttctgttcttttacatttgctgaggagtgctttacttccaactatgtggtcaattttggaataaatgtgatgtggtgctgagaagaatgtatattctgttgatttggggtggagagttctgtagatgtctattaggtccgcttggtgcagagctgagttcaattcctggatatccttgttaaatttctgtctctttgacttgtctaatgttaacagtggggtgttaaagtctcccattattattgtgtgggagtctaagtctctttgtaggtctctaaggacttgctttgtgaatctgggtgctcctgtattgggtgcatatatatttaggatagttagctcttcttgttgaattgatccctttaccattatgtaatggccttcattgtctcttttgatctttgctggtttaaagtctgttttatcagagactaggattgcgacccttgcttttttgtgtgttttccatttgcttggtagatcttcctccatccctttattttgagcctatgtgtgtctctgcacgtgagatggttctcctgaatacagcacactgatgggtcttgactctttatcgaatttgccagtctgtgtcttttaattggagcatttagcccatttacgtttaaggttaatattgttatgtgtgaatttgatcctgtcattatgatgttagctggttattttgctcattagttgatgcagtttcttcctagcattggtggtctttagaatttggcatgtttttgcagtggctgatatctgctgttcctttccatgtttagtgcttccttcaggagctcttgtaaggcagacctggtggtgacaaaatctctcagcatttgtttgtctgtaaagaattttatttctccttcacttatgaagcgtagtttggctggatatgaaattctgggttggaaagtcttttctttcagaatgttgaatattggcccccactgtcttctggcttgtagagttt

SEQ ID NO: 41240 - DNA, 1055 bp, Homo sapiens
gttagccatttagaatgtttattttttgccttcagactatactcagagtgttcattttaacccagggaggatgatcaaacaaattactcagctagatgcatagaacaaaagtaagttcaccaggaaagacatgcctcgcagacagaatataaattctgtggaaatcagggtactcaaatcagaaagattcttgtttttataccagaaatgacttgccagaaaagacaaaaagtcttttatcatctccaggaaggatgtcagatcctttattaagacagccttgtaaccaaacaaaatcctgaataatataaaaaattctctaccaaaaagaaggaggcttggcctgagagacaatgcaccagggcagagaaagtgagccctggaagcagagcattcaatgggctcaagtgagtagttcacaccaggtccaagaatcactggtgctttctgatggtctttttcaaggtcgcacttctgacaccatttatgtcaccctaaataacacatagacatgggcgctctaaagaaaaatgatatttatttgaagatgggcattgcaatgggaatacatgtgccatagtaaactatgggcatatttgggaaactaaaataagacaaaggtttttaaaggaaaaatgcaggagaatgacataattgttttgcaataattatccttgggtacaaaggatcaataataaagatgatgctattctgagactggaaaggcagttgctgggcagatgtcctcacagaagcattttttgtgtaagtttgtgatggctctgtgcaaggttttgttttagtagtcttttgtgacagttttgttaccaggcctgcaagcatgagaaccccttcatatccttccccagatcaatttgtcagggttctgtttttgtttttgttgttttacacaaatgacttcattttgattctgaaaacttttacaaggtacagtttgatcaggggtccaggttaattgtttcccaggacgctgggctctgtcctgctttatattatggcttttctcttagcctgtcttccatgtgaaacaaaat

SEQ ID NO: 41241 - DNA, 1050 bp, Homo sapiens
ctgcaaagatgaataacaaggatgatgccagtccagggcgggatgggcagtggctggtcaaatgcccttgcagaagtatgttttcctgtaacatggtggtggcctttgtgcaaggttgtgttttttgtagtcctttttgttatcaggcatcgaggcgtgagaacccactctttatggccttccctggtgctttgtgaaagttccttttgttggtttgtttaatgccagttactccattttgattctgacaactttcacatttcctttttgagcaacaagggaggtttgaagtgggtgactctcaggctaagcctcctggaagtccactactgagttcaatcttgtctctcctgcagtcttttgctattatctctattatctcaaagtgctggaccaacattattttgttaggagttatacttctgaaaaaatttaacaaacaacagatactaagtttaaaaaggtaaaatacaaagcaagattaatactaatatgaccgtctcagtttgcgtaatggttttgcataatagacctaagtttgaaaggcaaccaatagaataaatcaaataaccatggggaattaggtgagacctgttgtagccatgtgacctatcttcttattttgtataactttcccagagaaatttatccaggtacagcatgtgatattaacaatagtacagacattttaaaatgtaaccagtagatactaaggatttcttgggtcaggttctgtcaaattataatagaagttactaattgtgaaatttcaattataccattatcctgccaagtgaaaaaggtggatattaagagagataagtctcatatgatgtggagtctcattctgatgtcatgtctacagcatgaaaaacatcagcttatccaagtttactgtttgcgtgtcactgggttatagcatcgagcagtttggtgcactttctatggctcatatatcagactttcagaacaaagcagtttccatttatagtaattctgtggaggacagtgagattggaggaatctaaaggaattcagatctagtttagc

SEQ ID NO: 41242 - DNA, 1660 bp, Homo sapiens
ctcacttccttcttatcagagggtagccaggtccctgcactggtatctatttagaaatgtacatggagcccccagcgaaatgtgcctacattgtgtgttccagaaccggaggtacccttaccttctagatatgtgatgacatggctctcacgtcaggcagactgctgcacccacgctctcggcctgccgtgcagggatttcactcgtggagtgaggcatctgggggctgtgcagtgaggagctttccatgtgttgttaagacaacctgttagcattgtcttctcccgcgtctcctggcctcttctctctttaaatccttttctctgtttgtcttaatcacattaacgtcctatttatgttttattcaatatacatttaaaatagaacttactatgtgccaggcattgtgttcaacacgtgaaatatttaatccttagaataaccatattgtcagcataatttacaaaaaaaaaaaaaacagctgtatcaatgcctgtgaatattcggctttactcgcccatttaaagaagagattttcaaattggctcaaaccaaaacctcacttcatggtgtctacaagacagtctgaaatgcagaatgttcagagagagacaaaggtttaccaggcagatgggacggtgagaaagtaggtgtcgcagtcctgatcctagactcagtggcctctgcgtcccccgcaggcattaaaggagacacaggacggcctctggccctctggaaacaagctctgcagtaagagcctgagacaggcagcacccagccaggcctgacagcttctgcagacagacagagtgagatgatgggggatttgatggaagcagtccctgtattttgtctcttctgtaatggaggagctgagccctcttctgcaagctgtggggaaggctagcggagcccaagggtccagggtccccaccttgtcattgtccctcggcccttctctgagctcatttctgtctccagtgtttttctgttggcttggcagggcaggatttgtttctgtcgggaactgatgatttgtgttttgatgcctgtgagagggacaagatctgatttgttttgcacctggaagggcgtgatttcctgcatttgctctgcgtcctcagggagtgggtgtactttagagttggactcttaagcctcagagtcctttaaatgatgtcaattctttttttttttttttttttttttgagtcattttgcgaacacagggatcaaggcttgggttttatcttcattattcccagaggagctggtgaatttgaacagacttcctattcaaattgcatttattttatagccttggggggtcaaggaaagcagctcttcagaggctgtctgcagtcggctggcctttgcggtttttaaagaagccattcttttttttaagtagcgtgtatttattatatgagtgtgagcatttgagagcggatggggacgccaacaaggtagcatcctggtgggaggcatgggctgcggagtgctggtttcctgccattgtcacgtcagctaaatggaagaaggcactggtgaggggctggatggttcaaaacatgagcacaagcaaatgcttggctctcttaatattcctattttggcctagagctcaggagcaggtagaacatgagcgtttgataacctg

SEQ ID NO: 41243 - DNA, 1105 bp, Homo sapiens
gtgtgtgcatgttctctgtgtgaacatgcatgtgggcatgtgtgtgcatgtgtgaatgtgtgcatgcatgtgaacgtgctgtgtgggcatgtgcgtgtgtgtgtgtgtgtacatgcatgtgggtatgtgctgtgtgtgtgcatgggcctgtgcctctgtgtgaatgtgcatatgaacatgttcatgtactgtgtgtatgtgtgcacatatgggcatgttctgcatgtgtgcacaggcctgcacatctgtgtatgtgagcatgcatgtgtgtctgtgtgagcatgtgctgtgtgtgagcaagcatggtttcttgacagcatgctaggacagggtttgtcttcttgcttatctttaacaagaatatacctgttcttttagcaatagggtactgttgcccttttggcctacaaaagccatttcttctcctaatatcttgatagatatgttgagtgctgttgtatctgtgtgtaactttgttaattttctctaacataaaagcagaggcttttcaccagggcaccaggctggcctctggtggtgaccaggggatccaacccccaagcccagctccactgcccacaggcgagtcacctggggccactccttccaatttagtgcacagcagccttctgctcaatgaaggggtccgttcttggaacctagaacctgtggtgtggagcctctgcttttgttatcttctaaaagttctaaaagttcatgatcttaagaccttgatgataatccaagatctgaattctaaagcgtctttcattgtttacttttaggatgaggaagtacagacaattggtcagatagaactgtgcctcactaagcaagaccagcagctgcaaaactgcaccgagccgggggagcagccgtcccccaagcaggaagtctggctggcaaatggggccgccgagagccggggtctgagagtctgtgaagatggcccagtcttctatcccccacctaaaaagaccaagcattgatgcccaagttttggaaatattctgttttaaaaagcaagagaaattcacaaactgcagctttctaaaaaacaactccaaagtgaagtctgtttattttgctgtttcccctccatgcc

SEQ ID NO: 41244 - DNA, 1108 bp, Homo sapiens
gcttggtgccccccaaagccagagtacgaggctgagaggatgcaggtgtcctcctaggaggtttgagtcagaaggcacgaggcagaagcagtgggggaggactccctcagtagagcgaggaggaggcccctcatccaagaggaggttggagcacaggggggtctaggtttgcagtttcgggaccggtagctgaggggtcccagggcctttcttctgtgaaggagaatgtgtccaccgtggggagggggtcgggagagagagatacttcagagtggacagggctgagaaagctttatgggccgcgaaaggcagagtagttgttggtggatgagggtggctgtggcaggtggcgtttcaggtgagacagctcggggcccagaaagacactgggaggaggagagctctgctctccagagaaacaggagcagagaggaaaacagagccgcagcgagcggcttgtggtctggggatgaagcccaggttgacagcatcctctgcttcgctggtggaggtgggggcatcattctcacacctgtgctgggtcctgtccctgccagccaagggagaccaggaccctgccactgttgcgctcaggatagtccagaactgtcagatcttttctgttgaagtttaatttctaatacacttgtatttaaaatcaggttgcagattttaaagatgcccttgccagagtatatggagtgatacccaaaatccagtgccttccaccaagccaggttagacagttatgttttgtcttcctttttttctcaagaagacaggttctacttttctgatggccttgtcttcaccatgcagttccctggggcagacttgtatttgtgcatttgtgtctgtatatgtgggcatgtggtgtgtgtgtgcatgtgtgtgtgtacatgcatgtgtgcatgtgctgtgtgtgcatgtgtgtgtacatgcatgtgggcatgtgctatgtgtgcatgtgtgtgtacatgcatgtgggcatgtgctatgtgtgcatgtgtgtgcatgtcctgtgtgtgcatgtgtgtacattatgtgggcatgtgctgtgtgtgcatgtacatgcatgtgtgcatgtgctgtatgcgcatgagtatac

SEQ ID NO: 41245 - DNA, 1048 bp, Homo sapiens
cccaccaccacacctggctaatttttgtatttttagtagagacagggtttcacaggttggccaggatggtctcgatctcctgacctcatgatctgcccacctccgcctcccaaagtgctgagattacaggcgtgagccactgtgcccagccttttttttttttttttttttttggagacacggtttttttcttgtcacctaggctggagtgcaatggcatgatctcggctcactgagttcaagcaattctcctgcctcagcctcctgagtagtagtgactattagcgcctgccaccacgcccagctaattttgtatttttagtagagatggggtttcaccaggttggccaggctggtctggaactcctgacctcaggtgatctacccgccttggcctcccaaagtgctgggattacaggcattagtcactgcgcctggcccataaaaacacctgtttctgttaagtcaaatatttgaggaatggcttaacaaaaatggctgtttctgttaagtcagttgtttgacgtttggcttagaacatccagccctagtgtagcttcctcatggatgtgttgttgtaagcaatgtattgtgaagtagccctggctttagcttgtgttattagtgcagtacctgtatctcgttggcatatgttgcaactagctgctaaatgtattttaatagggttcctaagtgtatttgaataaacaaagagccaatcattttcttgttatattttctccctagaaaattcaaaacgactgtagagaccctccggattactggacaatacatggactatggcaagtgtctcacacaattaaatcttaggcagaagaggcttgctgactgggaaccctagcttgaatgtggtcttaatatttattcttgttttttatttttaggagtttatccaatagactagattcttatttaaaaatatctttagtctttctagcagaaccctgattctcttgttctttaattctgtcttcatagaacaataacactttttttttttttttctgagacagagtcttactctgtt

SEQ ID NO: 41246 - DNA, 1006 bp, Homo sapiens
tttcttctttgactttctttagcttctccattactttctccgtgaataggggaggggggcatctgtgtgggagggggtctcctgcagtcacatcactctgcctggttttagatggagagtttgttacaaacgtctgagtcttggtagttttgttgtaagcatattgatagtctcatcttcctgggtgttgctaagctttccagcctcaggttccgactatgtaaaataaggtttttcacccaagggtaaaaaatgctttaccagctccaattctcaccctgcagctcatcctttttttttttttttgagacagggtctggctgtgtagcccaggttggagtgcagtgatgtgatctgggctcactgcatcttccacctcctgggcttaagctatcctcttgcctcagcgccttccaagtagctgggactacaggttcatgccaccacacctggctaatttttgtagagacagggtttcaccatgttgcccaggctggtcttgaactcctgagctcaagcaatcctcctgcctctgcctcccaaagtgctgggattataggtgtgagccaccacgcttgaacccttttttccttttatactgagagcttgcataattagttccaatgtacaactaagttttcataccatcttaactgtaaattctatacaaattcaacaggactcaattatttacaaaagctaatgtgtgacaacttgatcttcttacttggaatcttcccttctaaaatttgatttatcctgaagtgtctgcttgacttatatcctgtgttgctgctggctttttccatgtgcattttttgcaagctgctctttttacttcagtctcgttaagtcttgcagttctggctagaggcctactgccatgaataagctgccgctccacagtggcttctttgaagtcttagagtcagatgagtttcacggtgttcaggtttgtgatccagtgtggccccaggttctgggtaacacgtgtgatgcagtgctg

SEQ ID NO: 41247 - DNA, 2144 bp, Homo sapiens
agaaaaaaagaaagaaaaagaaaaaaaaccataaatagaacaaatgagcaaacaaaatttatttcctagctctatctgctgaaaagtgttagaaacaaggaccaacccaggggcaataagcaacccttgggccaggactatgacctctaaatacaaatttcaactaaaaagagccagggttccctttaacaaaataaggcaggagtagcaatatgtgtattaactgatatggaatttgaggccaaatgtatgacagtacaaaacaggactttaatgacaaaaagatgaattttataaagaaaatcaaaagaaattgtatcaagaaaaataaaatgttataaagaatgtcatggccaggcacagtgactcatgcttgtgatcctttgggaggctgaggtgggtggattgcttcagctcaggagtttgagaccagcctggacaacaaagtgagatcctatctttattttttttgaaaggcacagagtgcaagttggattgaaaaaacaagacctatccgagtgctgacttcaaaagactcatctcatacataatgacacccataggctcaaagtaaaggattggataaatatttattatgcaaatggaaaacaaaacaaaaaaaagagccagagtcactattcttatatcagataaaatagactttaaaccaacaaaagtagaaaaggacaaagaagggcattaaataatgataaagatttcagttaaacaagaagacttaactatcctaaatatatatgcacccaacattggagcacccagattcataaaacaagtacttctagacctatgaaaagacctagacagccataaaatagtagcggaggttttcgacaccccattagaaaggtcattgaggcagaaaactaacaaagaaattctggacttaaattggacacaaccagctggacctaattgacacctacagaacactccactgatcaaccactcttctcatctgcacacagaacatacatcaagattgatcactagcttagccataaagcaagtctcaataaattcaaaaaatcaagatcataccaaccacaatcttgggccacggtggaataaaatagaaatcaataccaagaagatctctgaaaaccacacaattacatggaaattaaaaaacttactcctgaatgacttttgagcaaacaataaagttaaggcagaaattaaaaaattattttaaataaatgaaaacaaagatacaacataccaaaatctctgggatgcagcaaaagcagtgttaagaggaaagtttatagcacttaacgcctacctcaaaaagttagaaagatctcaaattaaccatctaatataattcctagaagaactagaaaaacaacaacaaactaaacctaaaactaacagaataaaataagtaactaaaatcagagcagaactaaaccaaattgagatgcaaaaatccatacacagaatcaacaaaaccaataactggttatttgaaaagataaacaagactggcagaccactagctagagtaacaaagaaaacgagagagacaaaagatccaaataagcacaatgagaaatgacaaaggcaatattgcaaccaataccacagaaatacaaaaggtcctcagagactattatcaacacctctatgtgcacaaactagaaaatctagaggaaatggatacatttctggaagcacacaacctcccaagattgaatcaggaagaaattgaaaccctgaacagaacaatatcaagttccaaacttgaatcagtaataaaaaacctaccaaacaaaaaaagccctggtccagatggatgcacagctgaattctaccagatgttcaaagaagagctagtaccaatcctagctcttcgattgattcttggaatcatttttggaaatgattccaaaaaatcaagcaggagaaactcctccctaattcatcctacaaagccagaatcaccctaataccaaaacctggcaaagacacaacaaaaaaagagaaaatcacaggctaatatccctgatgaacacagacagaaaaatcctcaacaaaatactagcaaaccaaatccagcagcaacatacacaaatcaacaaatgtaatgcatcacataaacagaactaaagacaaaaaccata

SEQ ID NO: 41248 - DNA, 1001 bp, Homo sapiens
ggggggatgctgttaaggtgttcatgagaactccgcgccgtgatccaatcacctcccaccaggccccatctccaatactggggattccaattccccatgagatttggtcggggtacacagatccaaactgaagcagaaaaatagggtctggaagcagggaacataaggccgattcacacttcagctattacaggaaatatcctctccacagggtgcacaccgagtaaaagactgtgtatctttacttcatcctcttcatttacacagggtgcacccaaagtaaccaatggaatataacctctagagggtatctaaactcccagaaattctgtaacggggccttagagcccctctgttcagccctgctcccacactgtggagtgtactttcattttcttttcttttttttcttttttttgagacagagtcttgccctgtcacccaggctggagtacagtggtctgatctcggctcactgcaacctctgcctcccaggttcaagcaattctctgcctcagcctcccgaatagttgggattacaggcgcccgccatctcacccagctaatttttgtatttttagtagacacggggtttcaccatcttggccagtctggtcttgaactcctgacatcagggtgatccacccacctcggcctcccaaagtgctgggattacaggcttgagccactgcgcccagctgtgtactttgattttcaataaatcccttcattccttccttattttgtttgtgccttttgtctaattctttgttcaagacaccaagaaactggacaccctccaccggtaacatattttggcgagccagccaggagaaggtaggcccaaagtttgggatttatttttctcctttccccttttacatacagggagatttttctctgtctgtctgttcctttccacctcgggacccttggtgggaagcgcagaaacatggaagcaactgcaggtttctggctgtgaccagtgaaataaggggttt

SEQ ID NO: 41249 - DNA, 1050 bp, Homo sapiens
atagaaatagaaaggaatgctgtaaaaatacctaaggatgaaaaattcagagaggaatttctatttgtcctgcaaaacagtgcctgggagatatacacgaatgggcgtgcacatgcgtatatacacctaccccacacccccataagcatatacacatatatgtgtatgctgaccgaaaagaaaatatttctcaacatcatagcactgcagtcatttcaccaatctattaactcaacaaattcgtttcctactctaagccaggcattcatttcagggaaataagaaaaggaattgccagatatcaaagcattaaaagaaaggcgggctgggcgcggaggctcacgcctgcaatcccagcactttgggaggcgggcggatcacaaggtcaggagtttgagaccaacctggccaatatggtgaaaccctatctttactaaaaatacaaaaattagctgggtgtggaattagctgggcgtggtgtctggtgcctgtaatctcagcaactcagggggctgaggtaggagaatcgcttgaaaccagacgacagaggttgcggtgagccgagatcgcatcactgcactccaacctgggtaaaagagtgaaattctgtctcaaaaaaaaaaaaaaaaaaaacaaagataaagaaaggcgatgcccccagctactgagcagagtgaggtgatgtcctatgactcgaggaggctggaaaacggctggagtgctgattccctggaggcccgtcttgggaagatttttctcagaatccagctgctacttcagaaggatcccagagatcccccccatgctgaggggactctggtggaggggaggacacatggggggactcttgtggggggggggacacatggggggctctgagggatgagaggccacatgggggtggggctctgtttgaccgtctcagctgggcctgtctttccaccatcccagcccagtgccccatgtgggaggaagggctcacccagtatgcgcactctccagccccagctgtctcagggcccagccatttgaacaaattgaaaccaagtg

SEQ ID NO: 41250 - DNA, 1036 bp, Homo sapiens
tggagtgagggagatatcaaatttcattttttcacacatatataaccaattatttcagcatctcttatattgaggagttgcttctttacccagatagctacaatgctgacactaacataaatcagcttgatatatgtcagtttttttcctgggttctccattctgtttcatttgtatgtgtttccataactacactaataacagtgttaaattattaaaactgtataatatgttttgacatctgatagggcaatctttcatttattcttctctttcaggaattctttggctattcttaggccttttctcatccagataagatactgaatcagcttatcaagggccaacttattgaattgttattgaatttgagatgaatcaataaagagaaaggagagccatgaaattagaaaaactaccctaattaagtcttcccttctaaaagtcaggaaaactagcattacttgaaaatgagtaccaaaaaaactaaggtcaaatcccatacaaagtcattatgaagaaaaaaagagaataaaacataatttctttagaaaataaattatgacagaaagccatggcttcaaaacagatgaaaactaaaatattttaaaataagttaataaacatctaaaatgacattagatatgaaaaaatgacgtgtcagatttagaaatatacagaaaggagatgacaaactcagaaaagaagtaaaaattttaaaaacatttcagaaatgaagagagaaagaaacacgagcaaataaacagaactgataatgcattaaaagaaaagatgaaaaaatatgaggctataaaagagacgtgtggtacaggataacggtcacccaaagatgtccccatcctaatctccagaacctgtgcctgtgtcacctgacatggcaaagtgacagcaaatgtgactaccttatggatctcaagagagaagcctgatcctggatcatctggctgagtccagcctaattgcatgggtccttaacagtggagagtcgactgcagtggtatgaaggaaatgcagc

SEQ ID NO: 41251 - DNA, 2706 bp, Homo sapiens
tgattgaatgaagagatgcagaaggcaagagatagcaaaggtcattctgggctgggcatggtggctcacacctgtaatcccagcactttgggaggcctaggcgggtggatcatctgaggtcgggagttcaagaccaccctggccaacatggtgaaacacccccgtctgctaaaaatacaaaaattagctgggtgtggtggcaggcgcctgtaattgcagctactcgggaagctgaggcaggagaatcgcttgaactggggaggtggaagttgcagtgagccgagatgtgccattgcactccagcctgggcagtaagagcgaaactccgtctcaaagcaaaaaaaagaaaagctacctttaccaaagacagttaaaatgatggccaccaaggggcagtgtgcagcaggcagagaaggtggctttttaaattatttttcactgcctgctgagacaaagatgttacaccagaatatgccaccctaacatatgcttctttggcataaggattattttgagctgaagacgattgagaagaaacaaataaaagaaaaactctgccttccctttctttgcctaaaggcaggacatgctagttaatgatcaacccctgacctaatcggttatgttacctatagattacagacattttatagaaaaagaaaaacacggtgaaaatccctgtcctgttctgttccattgtaattaccagtgcatgcagcccccaatcacatacccactgcttgctcaatcgatcatgacactctcatgtggacccccttagagttgtaagcccttaagagggaaaggaattgctcacttggggagctcggtttttggagacgtgagtctgctgatgctcccagctgaataaagcccttccttctacaactcggtgtctgaggggttttgtctgtggctacaaacctgtctttggccagtctaatttacaggacctcagccagagaactaagatgggtagaggcaatacaggagatagaaataatttaggtaggtagatagggtgaaagagtccctgacaaaagcttttcttctgacaaaaaacagctcagaaattacttccattctaaccacaggcagtccaaataaatcacttctcttttaacaaagagcagcctggaagattggactgtataatgtagataagcatctccggcacagagggagagtttcttgggtagtcaccaaacttacataaatgggtcccagtaaaaacagtaggctttaatgagcacattcctttccccttttttggacagggacacactaaggttagctagaagcttgcatggtggggtgggggaaatgcctgcagctgcaaggaggtacccaggacaaggcatggaaactccccctattcttgttagcacatgcaaggtggaaggagaaaggcagtgtggagtcgcccaagctaagagcctgcctgcatgataaaagaatggggtaggggctgccagagattccactctatacagatgacacacctggtcctaaccaggttttcatgccctatgtagataagatacccgctccctactagctcgttgataaaaaccctccattttactgcagcacggcaacccgtctgggacctctctctgtgagagagagctgtccttttccttttgcctattacacttctctaacttcaccctttgtgtgtctgcattcttcatttctgtggccatgagacaaaaaacctcagctgatatcccagacaacaaggctgctttagagggaaaacggatagctaatattatcagttaattggctatgttaattgataccttcaaattaggtgttttaaaataaatgctgagaacaatatgaaagtgtttttcttttactaattctctgaggattttgttatttatttagctttacaatgcctagccccctttataaatgtaattattgtgttgctaagtgcatgtatacaaaaaattcattggttcaaaagccataggcctggtaccatagccatatatggtacgttcaaaccttggaaatgcacattctcagtgtgtcggaagctctgtactgctccttcttgaagaactactttgatttgtggttaactcgctgttttgactcactgttttaactcccattacttcagtatctgacattcagcctcagaatctggccagtgtatcagggctggaattaattgattaacaccattagatggcagtactatttaaattccaaaaatggttataaactcattctctaaaatgtgtgtcaaatagaatatttgactgataataactctaagagcacaaaaggattaaacacacacacaagacaaagtttgggatatacccattggaaaaacccttggtctctttaaattttttttcatatgtatgtatattgcacatattgccggcctctttatctcttttttccttttttttttttttttttttgagaaggagtcttactctgtcacccaggctggagcacagtagtgcaaacatgactcactgcagccttgaactcctgggctcaagcgaccttgtcaccttagccactgtgaccagccttcttttcccttttgactttgttatatcacactgactctagaaatgtggttctttattggggcgattttgccctcccccggggacatctgacaaggtctggagacattttgattgtgggtagggggagggacactctgct

SEQ ID NO: 41252 - DNA, 1088 bp, Homo sapiens
tgatatggagggccaactgtatatattgaaaacaatttgcatataagtagacccacactggttcagacccctgttgttcagggtcagctctatatctttccaactttgtgcattgattgaaaaaccaacaacagtatgatattagggctataacagatctgttaggccaagcccacatgcccctgaacagaacattctgcacattgggccaacttccaactgccggcacctgaagttatttgcattatcagctatctttgtccaccagagcctgctctgcctgcattttgggaagacctaaagtgccaaggaattaacacaccctgcaagtatgctcaattgaaggcaatgaatagaaaaagacccctgactccttcacccctggatttcagggaggtaaatccaagatgtatgctaaggaggtgacacttaatgtcagacacacacacctgttatgagagtttcctgattgaataagaaagaggcattccaggcagaagtacccgaacatacaagagtgcaagaccaagaggctaaggcagattgctctgtgcaagaagtggcaggtagtgtggcgtggctggagatgaagaaatgactggattgggaaggactttatccaccaatctaatgaatttgactttcatcttgaaggtgtgaaatagcgtgctaaacaagtttaaaagcaaaatgtcattagcctatttgtatttagaaagagcactccagaagcaaggaggggatgggtgaattggatgtactgacactggaacaaggaaattattccaatagtccaggaaagaagaaggacatcaactaaaattgcacaagtgaacatggaaaaaagaggatgcgtctgagaaatataaatattggccggggcggtggctcacacctgtaatcccaacacttcgggagggtgaggtgggcagattgcttgaactcaggagttcaaaaccagcctgggtaacatggcaaaacccctctctacacaaaatacaaaaattagccaagcgtgatggcatggcctgtagtcccagttactcaggaggctgaggtgggaggatcacttgagcctgggaggttga

SEQ ID NO: 41253 - DNA, 1017 bp, Homo sapiens
gtttgtcaccctgggtcaggccaacctcgccctcttcccctacgtcacccttctccactgcggttccctttgcagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcagggtacgctctgcagggaggtggccgccgtgagggaggaaagagcttagctgggaactgatctgctaatgcgtctggtgatgcgatgcttgagcaggcagagcctggccttagagaagcacactgcacatcccggcatgtgctcacacacatgcgtgcacacaccacatgcacatgcacacactgcccaccacacgcagccacaggcatgtgcacacatgcacacacaccacacacacacacaaacacacatgctcacaaacacatgaacacacatccaaagacatatacacaaacactgcatatgcactcacactcgcatatgtatatacatcacacatgtacacacaccacgcaacacacacacacagacacgcacacacacacc

SEQ ID NO: 41254 - DNA, 1013 bp, Homo sapiens
ctattgttatgagtggactgaacaccacaattatagtagtagagcattttgggtttgtctaatgcactaaattgtatcagtgggtttaataccttgaaatgctttcttcttgcatgttaagtgttttttatttttttctttagattgaagacctttctttagcatttcttatagacaggtctcctggtggtgaattatctcagcttttgtttatctgggaaagaccttgtctcttcttcatattcgaaagatagctttatggagacaatattcttggatataagttattttttttttctttcagcactttgaaaatgtcatcctactcactcctggcatgtacagtttccactgagaagtctgttgccagatgaatcggatctcctttacattttatttacttttctcttgctgcttttaggattatctctctttccttgaggtttaagagtttgattattatgtgccttttggtagctttatttgagtgaaatcggtttgatgttctctgaccttcccttacctggatatttatctctttctcaaagtttggcaagttttctgttaatatgtctttgaataagctttctacctccttgttcttgttcaacttgttcaacttgaacactaataattcttagattttatcttttgaggtagttttccatgtcttataggcattcttcattgcttttcatttttttcctttttttctctttctgtatttcaggtaacctgtctttgaactcactgattctttcctctgcttgatccattctactgttgagagcctctcatgatttttttcagttcagcaaatgtatttctcagttccaagattttctctttaatcgctttgttaattttttctgataaatttctgaattgcttttctgtgttaccttgaagatcaccaagtttccttaaaactgctactttgcattcttggtgagagagttcacattatcatcatcttgtgagagtcagtcactggttcccagctttgtatgttt

SEQ ID NO: 41255 - DNA, 1091 bp, Homo sapiens
attcttttatgtgggtgcaccataatttatctgattcatgttctattgtacattcaggtagcttccaatttgtgttgtaaatataaacaacgctatgataagcatctctgtgaacacattttcatactagggtgagtattttctcttaatactttttaggagtgtaactgctgagtcagtgtcttcactgtttaatagctgttgatacatattgccaaattttctccaaaaagtttgggccaacatgtgtatcttctaatagactgtgagcaaactatttgtctacatcaaacaataaaaattattttaggccaggtgtgatggctcatacctgcaatcctaacactttgggaggctgaagcgggcggatcacttgaggccgggagttcgagacctgcctggccaacatggtgaaaccccgtctctactaaaaatataaaaattagccaggcctgttggcccatgcctgtaatcccagctatttgggaggtcaaggcacaagaatctcttgaacctgagaggcagaggttgcagtgagccaagattgtgccactgcactccagcctgggtgacagagcaaaactctgtctcaaagaatgtatatattattttaaagatgtttgttaacacaaatcacagttgtttgcccaggctggatgggcctaggagggaaagtgacttatacttccccttcttatggatggagccactcacttcctgcctgaaaaacccaaagtagggacttctctggatcagaaagggtttcagttgttagaccgcaaaaaatggaaccatatttagtatactgggcatttgtatttcagtttttgtttatccactgtttaagtaacttttttcattgaaatactcttttttcagtaatgcctttccatatgagaataatttttcagttcgtgatattgtaaaaagtccttagatctatttttattattagatgtagaagaactttattaatatgtttctaactttacattgcacatttatgtaatttgttcttacatattttaaattttatttggaacttaatccttgtggattatatttgcatgtatggtattgtgtaaggctgt

SEQ ID NO: 41256 - DNA, 1052 bp, Homo sapiens
ttggtaaaatccatgtctgctttcttttttgcaattagaaataaatgaagtaaacttatttgagaagattttctattttgattgctttttgattcccatttttagtattttctatttctattaatgtctcatcttgtactcattctcagtgactccaagtattaaaaaataagggaattatgtgaagtataaaaatgttaaatgtttttccctgaaaaaatataagtttgaaaaagttaagaaatttaaaaaattgaaggttatatgtcttcaaataattattcaaaaattttcacttgtattaaaattaaaaatgtacaatgataagtatataatttgttgtatctaaactttaaatacagctgaaatgttttagtttatttaagactttaaagatacttttattgggaaaaaagaaaattacaatagaaccttcaagatctgcctttgccactgtaaagagtagtaattaacacatcacactggttacatccaaagacaaagctacatggagaataaaggccgagacaggcggatcacgaggagtttgagaccatcgtcgccaacatggtgaaaccccatctctactaaaaatacaaaaattagccaggcatggtggtgggtgcctgtaatcccagctacttgggaggctgaggcaggaaaatcgcttgaaaccagaaggtggaggttgcagtgagctgagatcgcaccactgcactccagcctgggcaaaaaagtgacactccatttcaaaaaaaaaaaaaaaacaaactgtttaatgttgcagaattctcctcacctgccctgtgcacctgctgtgatttcatgtcgattgcagaccatgagaccatgagtagagcaggtaacactcagcgagctggatgctggggtgcttctgggaaacaagctctattctgcaggagtctgctgcccatctgctctctgccaggaagtatttgacaagttactactgaattgtctttctcttatccaaatgtttctgttcctcagatggattggaagcagtgtttgctccccaatgtccacgggat

SEQ ID NO: 41257 - DNA, 1025 bp, Homo sapiens
ttaaagagcagttttaggttcacagcaaaattgtgaggaaagtatggagatttcccttgtgcctcctggccccctgtccctatcttccaccagagtggtacgtttgttactgttaccattgttgatgaacctacattgacacatcatcatcaccaaagtccacagtttatcagcattcactcttggtggtgtgccttctatgggttctgacaggcctataatggcatcatccaccatgacagcatcatagtgtatgttctctacatactgtagttccactgccttaagaatctgcctattcatccctctctccttcctaactcctgtcaaccactggtttctttactgtctccatagtgttgccttttccaggagatcatagagttggaatcacacagcatgcagcctattcagattggcatctttctctgcatagcatgtgtttaagcttcctctgtgtcttttcatggcttgcttgctcacttctttttagtgctggatcacactctgtcatctggatgcaccacagttttatttatcagttcacctactgaagcacgtctttgtagctttcatattttgcaattatgaataaagctgctgtaaacatccatgtgcaatttttgtgtgatgaacaattttcagcttattttggtaaataccaaggagtacagtttctgaatcatatggtaagtgtatgtttagttctgtgggaaactgccaaattgtcttccaaaaaggctgcaccattttgcactcccaccagcaatgaatgggagttcctgttgctccacatcctcaccagcatttggtgttttccatgttctggactttagccattctcataggtgtgcaaataatctcattgttgtttaaatgtgcattttcctgatgatgtgatgtggagtatttttatatgcttatttgccatcggtatgtccctctttggtgaggcatctgttgacatctttggcccaattttttatcgggttattttcttttgtatatattagatagcagttctt

SEQ ID NO: 41258 - DNA, 1014 bp, Homo sapiens
ttgactagaactcagttccaaatcaacatttcaaaaaagtttcttatttctgtgagaggcaacatatattatatttctactaatgtggcattaatgcttgtttttttcttttttagtccctgagtggtttcaaatgtgtgttttcatgtacaatttatagttctgaagagtgtgtcatttccagatatttcctgactgtctcatcaatgcccacatcattaaagttaatttcatgcctaaggaatctacactaccttccatttggaaaatgttctgcagattctagcaaagtcaacagccaaaccgtgaatgtaaaggctgccgtacagactacagaagtaggcagcttgccattgccacgctacctactttacattcaagtgatttatataagagccaaaaaaatgtgctccacatagtattgatctttcactgccatgcagggatgagctgtccagatgataaattaagacaatgagaacataagggattggcttcaagatttgtggttgccgacggaatttcttcagcagaaagagaaggaaactgaactacggaactggtaggatattattatttttactgtaaacgatccaagcctgtcaggcctgtaacttccaagtgcaatgtattatgatctacagtgtaaaacaaaagattctgaatttgagtcagtaatagctggtttattccaggattcaaatgtaagtaacttactctcaccaacagtagtcaaaatgagaagcctgctatgctgtggatttatggctcatggactctggatgagttctgcatttatcttcgtggagtgacgaataattgaattggaaaatcatggcatccagaatggaactgcataaaaatctgctggagtgtttccgaaaaaatgaagacctctgggcccttatcccagactttctatttcagtggtccatggaagagcctgcaagcttggcttttccatctcaggacttagctgcagggtctcagggcacactgcagagactcgtcatc

SEQ ID NO: 41259 - DNA, 1023 bp, Homo sapiens
tcctagcagcatggaagacactcctgccctcaagagggctaagtccagtaaaacccaaccaacaggagatagttgggcaggaagactcattctgagtgtagatggctctgggttttgtgagagggtgaaatctttggtcgttaaacaattctagctgccctagaatggtaaccccaagtcacttcagactggaaaagattttagtggctagaattaaatgtagagatggcaaaatacaccaaagccacagcattaatagacttgcatgaatttaggaataacctggaataattaatatttaaggcatttgcaatgctttaaggatgttgatattttaaaagatctgattctaatttgacatctgtattgaccttggacttgtgacttcttagttgagaaaaaaaggaaaatattactaagtttataagtatttaaatttttaagagaacttaaaattcaccatatttatgtttgctttgttagatttttaataattgattaagaactcaggaccatcttacattttatttttgtcatttaagtattcaagaaaatcttatatagtacatttaaaatgaagcttaacaattttaaaatactttaacaaagttgtaactttaactcattgcctgagggatttaatctgttcattgtgagttaactgaacatgaatcaaaggctactttgcatgtgattgttaaaatatactagatttctaaatgtaataaaaaatattaaataggattaaaggcttagagactagggttttaaaacgttaagtgtttaatgaattgaattttaaatttataaacatcaaaataaaccataaataattttcctgtgtacaaaaccatcttggtgcatcagaaactcatgctgcagtagcatcacggtcccacggttgtgtgttggctgtttgcttgccactccaacctctgtgcattcctgctgtctttgtggaattgtttgctgcgttctctgttgatggaagaggggcttcaaagcttttgggtgggcggcgtc

SEQ ID NO: 41260 - DNA, 1050 bp, Homo sapiens
cagggcgccggcccccaccacacactcaccgagtcctggaagctggcaccctctccatgacttcaggctcatgaacgcacttcgtgaaagatctggcactgcaggatgagcttcccacctctcgctgggaccgaggctggcacgttctgggaaccctgctttcgagtgtgtcacctggggcggatgtggcactcaccgatcttgtttcagggaactcacatcacttttgaaaagcgggagacagattccatgacttgtttttgttttgttttaatacattttaattgtgagaacgattatcccctttccaaaactaaagttttgagcctctcagagtaaatttctagatacgcttaaaaaaaagtaatgtttttcatcactgttactgctcagttgtcaaaataagacttgtgagtctttgggaagaagaggattatacttgtacttacaaaattattctaacaatgcctgtggctaagaggaccctcaaaatgagtaaggaactgtaacagctcacaagggaccacaggctctgcagagtggcttcggaatccaagactctgaagcacacctgggtgtcctgccaggaactgcagctgcgcgccacatgcgccctgtcagatgtgacttagggatgcgttgtcagcttcagtttgttggacatctgaggacagtggtatatttgccataagatatcagtgtagctgtttaactgcttaggatgggaacacaaattcaagaagctccatagttaaattatcctggctgagatggtagccaagcaagacttatttccagcaaaaaactagcaaggcagaagtatctcaaaccacagatgcaaaagacgaaagaaagctgtgatgtaactgatgggtccctgagtgtgaaagtgtgggctgcagagggagcctactgttcacacagggagttcaggaagaacaggaagcgtgcaggttaagtatggagaaagctgcttcacacgcggatacacagagatataatttattggaatggatagcagagtcacaaatatcacattaccttatatta

SEQ ID NO: 41261 - DNA, 1034 bp, Homo sapiens
tggaggagcagagtgcaggaggagcaggtctatgtctatgtctggaggagcagagtacaggaggtggactgtgtggtgaagccggtggaggggtggacctcgagccccttgttaaatcaaaatatctaagacaggtctcggtcagtttagaaagtttatttcaccaaggttaaggatgcacccatgacatagcatcaggagttcctgacgatggtggtcggggcaccgcttggttttatacattttagggagacatgagatatcaatcaatatgtgtaccatgtactttggttcagtcaggtaaagtgggatttgaggcgagggcttccaggtcatgagtagataagaggcaaaaggttacattcttttgagtccttgatcagctttccactgaatacacaatttagtctagctcagtgaatcatcatttttacataaacaataggggagaggaagcaatgagatacgcatttgtttcagggaagcctcggagggatgtctttgagttctgactgtcctttgtccacaaggaatttccttgtgggcaaattgtgagggaggtctgtagcttcttatctttgtagctatcttacttaggaatagaatgggaggcaggttttgcctgaggcagttcccagcttgactttacccttggcttagtgatttgggggtcccaagattcattttcttgtcacattcctgatggacatctggacaagctggctccctgagacagcatccctgcaggtaaggtgtgtcctaaaggggtgaggactaggctctgattaaggggtctgaggagtcatgctttaaaaaccatcaattctcgtcagatgggttttatttaaccttatgtatcatgacttattttccaacctggctctggcataacattacaagacaaggaagaaaataaaaatatttcactccaaaacatgtgtctttgccatatgtcgaaatggccctgcaaagctgtcctttgtgtgggaaaaccagttcagtcacattagtcatgcatctgtgaagaatctcta

SEQ ID NO: 41262 - DNA, 1053 bp, Homo sapiens
tggtcattgcaaagccaattataatttatttttggtgtttggaaaatggtctgtcagcatttccattataaatccctattttctttctctttttgttcttttctttctggggtttatgacagagccataaaacttggtctagattaaaacttggcctgttagagcttaggctgagattttttttcaatttagttcccaaatttttaaaaattgtttcagatgtttaggttgcaaatgcaaaatataatttcggagtttttaatgctttctaatttataacttaaaaaataacatgcaaggtttaagataatggtaaagataattcttttaactttagctaaccaattttctaatattttcaagagaattattttggaaaatgatatgatgctatttggtgtgattttgtaattttatttcctttcctctctgttcccacttcataatagaagagtttctaaccttttgcatatataaagcttttctctgttaaagggttaaatgtatgtaaatctcttagtatgtgctaagtccattaagtgaaagctatttttctaatttttaaaatatgaatttgtggaggcagatgggtactgctttagaaaactcttacgttccacatgcaactactctcacacagttcttttgttcctgtgagttttagggataaatgcacaagaatttctccacctgcagcagcagatcagaagctgagttagatatggtttcagtgttcaaagaaatacaaggcagaaggtggtagtcacgggtggaataacattcgcacaaggctgactgttctaagcactataaaatgatgtggaatcgctgccagagagtagggatgggaacagccatcctgtcctgggaggatgagagaaggctgcatctgaactggcattacccattctcacatactgttagataaaacttttggttttacgaggagtttaaaggcacataaaatggagaaatagaaagattgaataaacttgttttacctcctgtgtggtcagcaagtttgcactgaaagccgtgtggtgtcctggtctc

SEQ ID NO: 41263 - DNA, 1075 bp, Homo sapiens
aaccccagcaccacacagtacccagcaccacgcagtacccggcaccacgcagtacccagcaccacgcagtacacgctccacacagtacccagcaccacgcagtacacgccccacacagtacccagcaccacacagtaccgagcaccacatggtacacgctccacactgcctggccgaggcgttcactcacaccccaaaccctagcaccacacagtacccagcaccacgcagtacccagcaccacgcagtatccagcaccacgcagtacccagcactgcacagtacccagcaccatgcagtacacgctcctaacaaacccacacctgcacctcctgaatctaaaataaaagttgaaaaaatggaacgtgaggctttagagcaactgccttcagaagccacactgagtctctactgaagggagatggtgcaccctgcctcaggctctgcagcctcactgtggcgaggagaagcctcctggcgcgcccctaattacttgaaaaatgctgttccagttgtgttgtatgaaagtaccagataagtagcactcagtcaaaactgatattaatagtagaaatagtaaccttctgtggtcattcctgttaggtcacgacggggcagtgaatgccgtgtgctggagccaggaccggaggtggctgctctctgcggcccgggacgggaccctgcgaatgtggtcggctcgtggggcagagctcgcactgcttctggtaatggacagtcatctctgccatgggcagtcatttccaaaggagctgagagcttctcaaaagtctcattcttttaccttaacaggagatgaggaaagggacgtaagccaagagtttgctttaatgcaataaaagttactgattaaaagttattgcttcaatgcaataacagttattgattagtttctttttttttttttttttttttttttttttgagacggagtctcgctctgtcgcccaggtcggactgcggactgcagtggcgcaatctcggctcactgcaagctccgcttcccgggttcacgccattctcctgcctcagcctcccgagtagctgggactacaggc

SEQ ID NO: 41264 - DNA, 1026 bp, Homo sapiens
ttacaaaaacttgctctgtttctgtgggcgggggggaagggccacatttaaccatctcaactgcacaagccacatcgtttcactttgggtgtgtaacgtttaatagtggcatcgctcaacgttgaaaatatgactggtctctcagcacctgcccagaacacagaaaaatgagtgtctttatttccattatgatctgtgacaaataagtataaattcaaattctctcctggagagttcaggggcctctgagcatacagtcaggtagcacatcccagcttgaaaaccactgagagcaaccgtatttaatttaataaaggagttatgtgtttctgctttagatttcagaatttttcctatcaaaaattgtgtctagtccaaagacaggtacttgagtcccaggccttccgccgagcatgtgcctggcacagagtagattctcagcgatacgggatggcggcttctgagcgcgctgcgcgggagagctgcgtcatctgtgacgcgccctggagctagcggtgatcgttgtgaagttctggggtcaggcatttcggaagattaaatctaaaattccattacagatagtggaactgtataaaaacgagaaatctttgtccaagtatgaagtgaagatgcgcatctctcctggtcccgagctcttggttggctcgagctgcgccgagtggcttctgctctgctccttctcggagcggggactgcccacgccggcctccatgctgcttatgtccccacacccttgactgcttccccagcgcggggtccatgtccaggggaagtctaggtccagaggtctaaaaccctgacctaggtagggttttagaatccttttcactctgtttctgaagcttctcatctcatcacactcaccacaggggaaactggccaactgaaaagaggagggaggccttccgtaccgtgaggagatcgtggggagagagaggaagaggcacccatgtggtcccccatgggcaccttgcttcgtggggattggctcccgagggcccggcc

SEQ ID NO: 41265 - DNA, 1054 bp, Homo sapiens
ttaaaattcttttaacaggagatgggcagtggctggcctgtgggttggccaaccatctgttactcgtttttgatgccagcctgactgggacacctgctgtgttttcaggtaaaacatgtcttaatttcagtcagtatgaacttaaggatgggtctcacttaggtcctggttatcagttgctaaaggacacttttgtttccttcaggacatcagcaaaccaaagccatggcttgaattggagtctaaactagatttactgagatcttcaaccaaacagggcaaacataactcatgagaacagcgtggcagcactttcgtggctgttgccctggaggccaagagccattcatttgtagagttttaggggagtgaatgaagtcaaatcctaaataattgaaatatatttaattaatgtaatcaaaaggcatacagttgaaatatattttgaaatttagtggggtttgtacatagacatttttataaatgtaacaaagcaaacaatttttttttaaaaaaagtagatctgagagcaacagtgttaaaattatgaccatttcaactcataactgggacatatatttgattcctaattctaatcccataaaacctgccagctcttcattaggatcctgatatggcttgctttagaacttacacttggtagatattttaacagaagcacagaaacaacacaaaatatctcactagtccttctgtttttatacaggttgagcatccgtaatccaaaattctgaaatccaaatacccccaaatccagaacactttgagtgctgacataacatcaaggagatgctcgttgaagcatctcagatttcagatttttggattagggttgcttacctgccataatgcaaatactccaaaatctgaaaaaatgggaactccaaaacacctctaatcccaagcattgcgaatatgggacacacagcctgtcgcgtgaccaccccaagggcagtcattaggaaacgcggaggtggggcctggtggggctgagttggggacagagacagtgggaagcaggcctaggcaaggc

SEQ ID NO: 41266 - DNA, 1270 bp, Homo sapiens
ttctacagtgtgactcctgtgaactaggcttttctacagtgtgacttctgtgaactaggcttttctacagtgtgaccctgtgaactaggcttttctacagtgtgactcatatgaactaggattttctacagtgtgaccctgtgaactaggattttctacagtgtgactcatatgaactaggcttttctacagtgtgaccctgtgaactaggcttttctacagtgggactcctgcgaactagggtcttctacagcgtgactcgtgtgaactaggaatttctacagtgtgactcgtatgaactaggattttctacagtgtgaccctgtgaactaggcttttctacagtgagactcatacgaactaggattttctacagcgtgactcctgtgaactaggcttttctgtagtgtgactcctgtgaactaggcttttctacagtgggactcctgcgaactaggcttttctacagcgtaactcgtgtgaactaggaatttctacagtgtgactcgtatgaactaggattttctacagtatgacccggtgaactaggcttttctacagtgagactcatacgaactaggattttctacagtgtgactcctgtgaactaggcttttctatagtgtgactcctgtgaactaggcttttctacagtgtgactcctacgaattaggcttttctacagtgtgagtcctatgaactaggatttcctacagtgggactcctgcgaactaggcttttctacagcgtgactcgtgtgaactaggattttcttttttttttttttttttttttattttttttttttattttttttttttttgagacggagtctcgctctgtcactcaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaggattttctacagtgtgactcgtatgaactaggattttctacagtgtgactcatatgaactaggcttttccacagtgtgactcctgtgaactaggcttttcgacagtgtgactcctgtgaactagggttttccacagtgtgactcctgtgaactaggcttttcg

SEQ ID NO: 41267 - DNA, 1510 bp, Homo sapiens
caccgagaagtctttcatcacaatgaatcttctcatatgtctaatctgggggctgtttatatgtagagtaatattctttcttaagtgcgttcttttctgatttgtctttttcacttcgtgtctgtgagatttgcttcagttgctatacagcgttctgttgtctggatatactgcggtttatgtacccacgatttattcagtattaacagacgtttggcttgtcccaggctgctgttgtgagcagtctttgcagcaccctgctgtaccctggagccgggagggctgccctgatcttctgtgcgggcagctgctgggctcggggttccccacatggcaggtcgatggcagacgatggcaagggtcttcccaggtggctggccagaggttactccagcagcacacgccgcctctcctgcccggagctcttgccatggctgcatgtcgctggacgctggaatttctgcttacccagtgtgagacaagaatagcactgggtggtcacaggaggacggaaaacccaggcaacagcgaagacaggaacgtggcaaagtaaccacagggcggcagaaaacccaaagcgagggagagagaaggcgaacccaccagcgtgatgtgtcctctgttctcccgggaaaacccgagtaagagacaacgaggctgtgttgggggttacctaaaaatcccctcctttcccagaatacctgatgatgatcccgcactgtcactaaagaaacacccgcaaaagaacacaaactcctctgtgcgcgcttccttctgaacggggctcctcctcctgagcgagccgcctccttctgagcgcccctcctcctcctgagcgcgcctccgtctcctgaacgcgcctccttctgctgtgcgcgccgcctaaccctgtgcgcgcctcctcctgtgcgcgcctccttctcctgtgcgcgcctcctcctcagctcgcctggcttctcacttaggcgtgtgctttcgctttgcagcaaaagctgctgcttttcgcatctaaattcttgctctgaaggtgccaagaacctggaaaccggctgggagtggggtctcaccagcctttggagaccctcctgagccgtctggcaaccagtgacgatacagaggtgtcttatgatttcgtttgcgttttcctggttaaacatgaggtggttattgcttgtgtttaatcagatacgctttactgtcataagcctaatttgcatttattatctcttcgctattattttgtacaggatcttttggattcatgttcttgcgtgattgatttctcaggaactttctgagtttggttttggtgtgccagctccacagaatgagctagggagagctttctctgtttctatacctgaatgcttggtgtaatattttaaattaggtatatgattgattttgagtataaaaccagccttgtatgtcagggataaatcccatgatgtatactctttttgttgtgttgttgaatttggtttgctaatattttattgaggagttttgc

SEQ ID NO: 41268 - DNA, 1980 bp, Homo sapiens
tagcaaggccataataaattattcttgattgccttgacaatatttcctattggtttgttctgagcagcagccaaacaaatccacatgttgcatctttcaaatatgtataaattaactttcactttaagatggtaaacgtcattatgttccctttctttcaaggctcactgataattcttttttcccttcagtgaccagtctaaccctttaattggtcttgtgaaacctactggacctcatttgaaaaacggaggcatttccgcagccgcctttcaccttctgcctggtagctgcctgactgctgggcctcacctcccagaagggccatctccccggccagcgacctggcgaccccacccttgggcctctccccgggccgggctcggctaggctgggctagggttcctgcgtcagtccgtcctcagacatgggctgtgtccttcatgctcccacgcagcccttgagcttgacttcggggacttctggcctctcccttccctaccagactttttgaaatcaggcctcgaacaccttctgtgccattcctgggtctcactgactgtgtggttctgacccgccttgcagatcggggagagctttcaggtggaaggcggggactcagagctgagcctggggctggagctgtttgcttgttcgtcctgccatggcggtccctgctgctgggggtttccagcaggtcccccattcctccgccctgtttccatgaaagacccactgtcggtgtgaactgcccgtctcctgccggtttatgctctgctgccgtcccatcaccatggggacagttctgagaaattgtgagaatgaaggccggggggaggcggccaggctcagccagcattgcagcctctgggccaagctgactcctcggctgggagtggcctctgacctccttcctcctcattaagtcatggaacttctgccttgtaaggaggtgctaattattcaccattgaaaaggcatcttaaattgcaaaagacactatagcagagaagacaacagcaagtgggtgtgaagatggctgagaagagaatgcccctgggctgctgcggcctaatgcggagctgggagctgtcggagctgggagctgtcgcctcctcctgggccatcccagcctcctcctcctgggccctcctgggccttcttggctccttcctcctgggccctccaggcctcctcacgtgatccctcccggcctcctcgttctcagccccccgaacctcttcgtcttcctggaccccacaagccgcctcacatgctttccccccaccccgcctggtctctcttggccctgtcagtctcacctcctaccattcatccttaacaattgacagcagcagaagtcagataaacctccaggtggacacaggcaggtccccagggaaacccaacctccaaaccaaagacagcttcacgtctgaaagccaaaccacatgtctcggatgaatccacagacgggattgagaacctcttttcctgtttggcatgctttcctctgattggcccccacccttcacctattttacatattcccactcctccctaattggtttttgacactgctgtgcccatctttgagttgtaccttttttttttaaccttttttgcatagtcacaaaccaatcaacatgcactcccccattctgagtccataaaagccccaaactcagccacactgggggaccacctgactgagggtagggggctgccctctccgggtcccctctctgctgagagctgtcactcaataaaactctccagctgggtgcagtggctcacgcctgtaatcgcagcactttgggaggccgaggcaggcggatcacgaggtcaggagattgagaccatcatggctaacacgctgaaaccccgtctctactaaaaatacaagaaaaattagctgggcgtggttggcgggcgcctgtagtcccagctactcaggaggctgaggcaggagaatcgctt

SEQ ID NO: 41269 - DNA, 1091 bp, Homo sapiens
ggcccacgctctccactcctgcggagagctcacagccaggccagggggcgcacgtggggcccaacgcccacgctccccactcctgcggagagctcacagccaggccaaggggcgcacgtggggcccaacgcccacgctccccactcctgcggagagctcacagccaggccagggggcgcacgtggggcccaacgcccacactccccactcctgcggagagctcacagccaggccagggggcgcacgtggggcccaaccttcaggaataagattattgtgtattcttttctttttttccttaaatcagtctttcttctgagaacacccgatgtgtgtggatcggaagctcagtgggcttattcgtatttaacctggcaaacctggaagtggaagctgctttgtattacaagggtaagatctttgatttcaacgccatgtaactgtaatgttttcctttgactggtatgtggggtagtgtaagtgtttgtggagaaggccttgccgtgtgaatctgaggatgagatgcttcagtcacaactcagcattgagcacgtgagcacctctgtgctgctggatccgaaggacgagggcccttcccggaccctcgggcactcagccctggagccactccttgcctacatctgccaggccctcgcctggcactccaggccgcccgggccccagcagcgtggaacacctgcaggaacacccttgggaagcccctggattctccaccatccttagagagcctcccagagccccaggctcgcacagcgtaaacccggccgaggcgcactcctctccaaccctggctcccttccccagtttctgccagctccagaaatgtaggaatagtcacctccacccccaccccctcccccaagacccccatctcatccccccacccctcctaactccatggatgccaccagccgcactctttctgcccaggagcccaggcgacttctgaaaagcaggctggattccgtccctctcctccactgcagcagggcctcctcggcggcctcccgggcactgctcctctcggtgcctcctttctagccctgaacgctcagacctctgtggggctg

SEQ ID NO: 41270 - DNA, 1654 bp, Homo sapiens
tcccccgtgcccgcacgctgcccgcgccccggagaggcgccctggacggctcctgtgtggcatcccccgtgcttcttgtgctcccctttcctgtcatctttacacactgttgaaaaacctgaagatgttggcctttttcaaaacattttttaggtgagccttttaagttcatttcacaaagcctggataaagttgctgtttttataatttgaaaaagataattttgaaaacttagattttttttttccttttgacaaagttgaccgctgttgccttgtcttctcacccagggcatgtgggacgtgctcttggctgtgaagctgtggggtgtgtgcagagagcctggggcctggggttcccagaggagcatcttggggaggcctgcacagtaggatcctgcccatgtgccctgagctgatgtgccagccgtgtgaaagtgctctgacaccgtgggccgtacggagggcctccagaggggatgttgaaggcaggagacagctgtgccgggagcctctgcaggccgtggagggcccgtcctgtgacgtgtctgccctccctgctccacctctggtgttgctgcttctgcgtcaggacccttgctgcagcgccatgtctgcatcttctttgcttttgtagctttggatcttcagtttgatggatggacaccattatcgtcgtgtggcacgggttgacctaaggaagaagacagagactttctccacaagaagggttaagtctgggctgtgcagccagccaggtgggttgctcagaccctccctcaggcctcccacttggcccagatctttcaccaggcgccatgtcaagggccctaggtcacacaggggagagagagatcccaatgtaggagaagccaagggctgcaacctcagaaaaccactgaggccctgcaggtcatgtgaggggtgggccatcagcagatggaggcacctggtgtgggtggggacgggggtgagaggctttggtgaacagaagagcagaggcaccaaggcagcagctttgcagctatgggttgctttcctgcagtgggtgaccaaggagggcaggtcatgctgatcagaaaggtacactgcatgactcagatgccacctgcacctacccagcaccctccacgtccccacctggcctgtgaatcttagacgccacctacacctgcccagcaccctcacatcctcacctggtctcctgcgcatcacagatgccacctgcacccgcccagcaccctcgtactcacctggtctcctgcgcattgcagatgccacatgcacccacccagcaaccttgtcctcacctggtctctggctgtccagagttgcttcctgttgacgacagctctcctcaggtgcgctttttatctcctgtactgtcacaaaggagctgaccctctcctggaagaaaatgttgattttacttttcaatccaggggccacctctttcattggtgtgtgcagctgacgtttcatattacagaaatcatctctgggctcacagcctacactctcttcctcattctggttactcattctttcttttaggttgtgtttttttgtagatgactttaaactatttcttttcatattaggtctgaaattacttttatccagtataccaattttttcctgatgttttaaacctt

SEQ ID NO: 41271 - DNA, 1115 bp, Homo sapiens
cttgaggaggaaagggtaactcatgagcgcctattgccgcaccgtcttgtcttgtaggaagccctaggtggagaacagatgctgagggattgggaaggcagagcagtacattctgagttacaggcggggagcctcagggcagatgcatggggcagccggtggggagacaggattcctgaggagacgccagcttcctaattcgctcagggttagctccagtcagtgtcggcttttaacactgctgagactgtgcctgtcgcctgagctttcctcttagctcagacacctgacttttcacccttggtttatatacagagaattccagcttgaacagaggaataatttgggctttattttaatagcagcgattttctgtgacatacatagaacgtcctgatgttaataaccgccacaaagtcccaccaccgaccttcctgcacacattctctcagactcaggctgttcgggccgagctgcagggccacctgggcccggtgactgcggtggagttctgtccctggcgagcaggcaccctcatctcggcgtctgaggacagaggctttaaggtgagggatggacgctggatggcgttcccgcgtggcacgtgctgtggaaagaactgtggtgacgggagctgtgcggttgcttcacggccacggccgcctgagtgatgttgtttctacctcacttctgcaaggcgcccgctatcctgatttccacagaaacgccaagcccggatgttttgccggggccgctggctgggcttggattcctgacaggacggttctgcggccccggatttcccacaactgcattcagggcctgggagcgcccaggcacgaattcttctccacggcattcccaggcccagagcagaagagccagtcccagggtgtggagggttcagtcggcacaaaatgaggctctagaagaaaatggaatgcgaattcagtttttatccagctgacatcagtgtgcgcctgacagtgtagacctgaccagcgagtgtgcacctgacctgacagggtgtagactgctacagtttccgcttggtgcctctatcttggcagcgttgaccaagtgcctgggaactgtttttcaccttgtttcatttt

SEQ ID NO: 41272 - DNA, 1664 bp, Homo sapiens
actttagagaaacatgttctgcaaaactattatttctcagatattccctgattgtaggcatccttcctagcatagcgcttttgtttatatcttttatcaaaatgttcttttcatcaagaatcagacttttcccaccagggttagttaaaggaaatgtgtcacctcttcctgcctgtgtgatttcgacctcgtgtgtgactagaacagtcagctgccccattgcaatgttagaaagcagtgttagaaatcaggaagtgggaatctaagggaacacgaaggaggacttttgtttcctctgaattgttgctctgcccaagcctgattttgtaggtgaccccaggcctggggtcgttttgtcaacatggctcacaaagctgttggcctgaatagcttttcttttgatagccacttaataaacgtaggcgaggaaggatgttcggcatggaatgtgaattggttctcatgggcctcatgtgtaataggcgttttgggagagaagacatttatgtcttcagactatttttggactaattatgaaattaaggctcataaatttaaaaagttcacatcatgagttaagccacagagagatgatgggaagtatctaggagttaggtaaagggcttcacactatttctagtctgtctgtgaaagctttctggatatgttggtgtttgagctgtatttcatgttttgttgtaaacatcctgtgatagattaacattaggccaccccaccatttataacaaaactaccattaatgtgcaaagaattaacattgttgtgtcaggaaaaggaaaaccaaagtgaattaggaagaagcagaaaactgttagtgtttgaaggaagatactgggtcccagatggagagaaccatcagcctggggtcaggttggagccacacccctgagtcaggcacatagcaggtgagtaagcaggtgcctgctgcagatgtgtgtgcagcccgtgagatcctccccacgcttccttagcagcaggcgtgtcaactgaaagacacttcactcggggagaatgactttcagacatgaggaatggttgtcacgtgagtccgtgaagtgctcacattcttttaacagcatactcaacaagtcaacagtttataccatttgattttaaagatttcaaatgaatactgagcatttcctggtaaaaggcactttttaatcaacataaaatgtcaaaaggaaataacttaaatatttttcaggatatgatgttattcatatcatagacaatggactagctttattttatagaaactggagaaaatggaaatgtatatttcataacactcagtgtcataactctccctattcctacacaggttatagtcttgccttttatttttaacaatctgatggtaactggcataatgtactcagtattctaagttgtatttgttgatggcgatatgtcgtattactaaagaaagtcttccagagttaaatgtctgtttgtaagttaagtcaccatatatatacatgtttattttttctgcatgtatattaagggatatttgtcttatttagatggagtgctgtaaaattcaagaacagtgcccagcacttcgtgcctggagttccctggggatattctcagggcgatgactgaccattaggaacccccgatgctctcactactcc

SEQ ID NO: 41273 - DNA, 1027 bp, Homo sapiens
cgtttcttacccatgccttgttttcccagggacctcattgctcccctcattcctctccttattcttcagttttcagctcagctgttacctcttctggcatgtggtggagacatgttctatatttgattaactaataagtgataaatggaagaacgaggtagcctgtatctttttattagtgtgtgtgacagtgaatagcagtgaaatggttaacttgagagaataatttagtagtacatagcagggattttaacaaatgaattaacaatgaatatgtaagataaatgtatttgaaaaactcaatcttttaatttcttaggtttgaagttatgttgttatactcttatttttaaatgtctgtgatctgtgttttatttttgttaattttcccagcttctaatcctacgaggacaccatcagccaattactgctatggcttttggaaataaagtgaacccacttctaatctgctcagcatcactggattatgttataatgtggaacctggatgaatgtagagagaaagtacttcaaggtaaatgaaaatctaaaacatgtttttaaaaacctgcaaaaggaataactcatccttcagtatacttggtaccacccaaggggtgtttcccttgggtaacagcagtccctcggggggtttgggataattttgtactctctttaccttgaacccaggcatgcaagcaggcgctttatatgggaagggccccaggccattcagacttacggacctttgctgtctgttatgctgatcttataggctcattggttttgatcttatgtccctttttattttaagaactgtccattttgtatcaacctgaaaacatgtaggaaagttgaaatattctttccttgcacagcaaggggtcttgagcacctgtaatatttcaggctggagacacagtggtgaataggaagggcttggtcccaaatcctgtggaagtcacagctcagagtttgagagagacactgtgtaagccagcgactgagtggctgtgaattgtgagtg

SEQ ID NO: 41274 - DNA, 1049 bp, Homo sapiens
agggatggcttccctggactggagctggagactaggagtgcctacaaggctcttctcactgctgcttctacttttatatttcgcttggctgcctaaatatgcttcagctctaggtaaggttacatccttctcctgtgatattgatttttagattccccagtgggggtgtttggaggcagttttcccccctctcacattttgggaactcacagttttttgcctgtctcatggaatttgcagtggcctgctgcttctttaaaaggatctgtgaattctttcattttttttggtacattcctgcagtggttcttggaacaaaacttcacagtatgagtatccacatgcctttcagtccatcctagtgggagatgcacattagtcctgtctcctagctgccgtcttcttgcctaaccactttaaagggtcactgtaataatgataatctatgtactcatatatagaaacctgcttattaatgtctacagaagtggtttgtaaactgcaaattggcatacaagtactattatttgtaaaatgctgctgaattctataggaattacagaagagaataagataattatactacaacaaaagtttatgttgaagaaaaagatggaactcaatcacaatttgatgagtgtattattagcatttttgaaacaactataattttttatgtattcttcatctgtctccgaagatgttttatgttttgggaagcagtggatctggtgacagcaggttcgtattgttcccttaggacacatctgcccagcacctactgccatgctcaagttacagagtctactgagtaactgtggtagctttggaaggtgtagctattttcatatgacactcaaagtatctttgcaaatattaaaaaaaaagtgagataaaaattgtgaattggagacaaatttgctttaaaataatgtacacatgcttttattttgtttttctccaaatattgagaattttcaagcctttaaaaattacgtttttttaaaatttaatttaatttaatttttttgagacagagtctcgctctg

SEQ ID NO: 41275 - DNA, 1377 bp, Homo sapiens
tgttttactccttttggcttttgttttgtaaagaatctcctgtgaggagttctgtttttagaatttaatattgtttggttacttccctgactttagtgaaagatattagagtatttactatgccagtatctaacttaaactattagtattaaataagtatatcttttacatttagtacaggtaccataaccaagagatttcttagttttgatggattaagagagagcattctgctgtatattatggcaggtacagatatgatcataactgaaccagaatttggattatagaagtgcacttcctagctgttttttatttaggtataggaacacacaatgagaaccttatgtttagaatgtagcagtaacaacagagggtaactacactgcaagacttaaatggtttgagcatgtgacactatccttttgttggggggagcagggtataaaaatatacatacaggagattagtttaatagtaaagttttatatgtatgtttaacttccatgatatttattattttgtagagacatttgtgattgtttagagttcttgtttttattctatttatgtataaggttgactttttttaaataaataagccaaaaattctttttgaatgcctctgtcatcttttgcaaagaaagataatttaaaaagtacaaaacttaagaacaaattgtttaggtctaacaggttatgaaggtggcagtgagacatttcaaagctggaatatatacaacgtttgagttttgtttaggttcctctttggttcagtaaattaggaaagggatgcatttggcagggtgggaataaagcagaaatgaaacaattctacttaaaataattattttcccagttcatctacgtgtgtgtgtgtgtgtgtgtgtgtgtgtgtgtgtgtgtgtgtgtgtgtgtgtatgtatgtatgtatgtccccttaccccatttcattcttggcccatgcttgctcttccttttttaccactgttatttacttatttctatagcatgagtgaacgtcattttgtaacagtcaagaccgtgacgttcggatgccctccctcccctggtaattttaagtgcagtgaaccctttttcctttgtcatttccatgtgtaaccaaatatgtctaaaattcagacaccttcactggaccatgcatgtttttaatctgaaagatcagtagtactcagagtgttcgtgtattttttaagtgactgcaatttttttttgcttgtctgaaaacttatttttcccttttataattttacattttatagtgaatctttctaagtatagattcttttattagacatgcaaagagaataatcacacaactaagttttccacaaacgtttatgtacacgccaatgt

SEQ ID NO: 41276 - DNA, 1023 bp, Homo sapiens
gtggatatactgttagactaagttgcattttttttagtgcctttcattaagaaagatctgggtttaatctaaggattatttgatccatatgctaaatttagctaactctgggatagaaaataataaaacctgttacttacattgtagtgatttttagcataaccttggtaaagagcctatatgattctatggcaagaattaaaacatacttgttaacttgttgatctgattatcctcagagtaaaggagtaggttgtcagcaactattattatattttgaacttttcctccctctgtctgcccctcccttttcttctgaagaaaaggtgaggtgagagatgagtagccttatttgcatatagggatttaagaatatcataaaaggaagaattagctgtacagtttcatatttgggatggtggtagtaaaatagactaccttttgattcttttggtctgaaatgtattagaacatgcttttattgcacttatgaaggtgtattgaaggaaaattttagagtaagctgatgagaaagttttgccaagtgaaattgttaaacaccttgtatgtcagaactgtgattgtggtaaataattcacaagaacaggctgaagtaagtcacctttccctcaaactaactagaacacgttctaacatgttcatttacctttcttcaagtaaaaaaagcgacattaagttagtgtatttcatattttattaggaaatgcttttatgtaattaacttaaaaattcttttttttttttgtagcctatagcaagcaaattttaagcttaattcagcaagggttggcttccaagggtggctgcaataggctgcagctatgtgatttttgtacttgtttttacatatatagcttatgtaatttctttatataaattaatgcttaataactgaaagcaagtgagctccaaagatgaaatttcagaagcagtatacatgaatgagtgtgttctactggtctgctaagagctttaaatggaagtggccgctcaaagcacagt

SEQ ID NO: 41277 - DNA, 1099 bp, Homo sapiens
cttttactttttaggatagtttcaacttaggatgggtttatcatatgtaaccccattgcaagtcaaggatcaacctctattctataacagagtataattgtctaatttttctcttttttttaacacagagtctctctctgttgtccaggctggcatgcagtggcgcgatcttagctcactgcaacctccatctcccgggttcaaggaattctccctcagcctaccgagtagctggtactacaggcgcatgtcatcacagccatctaatttttgtatttttattagagacggggttttaccatgttggccaggctggtctccaacttctgaccttgtgatccacccaccttggtctcccaaagtgctgggattacaggcatgagccaccatgcccagcccttgtctaataatttttacagagttttcagagtgtttgtattttttgtacaaagcttgtacaatatatttttttaagttgcaggttctttgctaagtgcatggtgtgtgcgtgtggtcccagctacttgggaggctgagggaggaggatcactggaacacaggactttggggttgtagtgtgctgtgatcatgtctgtgaatagccactgcactccagcctgggcaagatggcgagaccacatctctaaaatgcaaaaaggcaaattttcttcaatttttagttctgtataattatgtccgtgctttatttgtaatctttttttcacaaacattttaatgcaacatggctactttttatataaattcttgggaatgcattttagcaattggtgaaatctgatactgtgagttttgaaaattgtctccatggtgtgtgtgtgtgtgctgatgtttttggtgaaattttaattgattgtaatatttcttgtgtatggaatttgaagactgggaactataatatgttgaatttttttttattcatctagtattctgtagtacttgttagtagttagtgcatttcattatttaacagttgtttccaactaaagggatatatgttcaaagcacatagaatcttaaaaataaacttgtttggttgaaaaattgatatatttgccttttgcaagataatcttttgatt

SEQ ID NO: 41278 - DNA, 1114 bp, Homo sapiens
atccatacatttttttccccctgagcttgggtaggagagtttgctttaatcctagagtgatgcagcagtttgatatgtttatgaagagcagaaaccaaagcagatttgcatttacgggttcattgaaaatgttcttatttggattggattgaagatcagttttaaattttattccaggtcttgctcatgccaaactcttggacccttttaattataatatgaagttaatacttgtatgactagttgtccttagacagtctttcatttattgagacttactgttcttttattctttctctaattattatttttgaatcttttaaatgtataggatgataatgaagataattcaaatgatgggacccagccatccaaaaggaggcgaatgggctcaggagatagttctaggagttgtgaaacttcaagtcaagatcttgggtactgtcattttatcggttattaatattttttgtgatgttcctctttgccttaacatcctcttccctttcccccagctctggcaaaggcaattattaaaaattgtagaatattttcttcctgttctataatgtgccatcaaagttggtcttgctactgagtgtaattaaaaagcaattttatgatagtaaaatacatacatacataaaattaatcattttaacaatttttaagtgtgaaattcattggcatcagttacattcacagtgttgtgcagccattaccaccatccatttccaaaactttcactaccccaaactttataaccattaagcaataacctccctttctccctctatttagcgccttgcaaccatcattctactttctatttccgtgaatacgactacttagttacttcatataagtggaaccataaaatatttgtccttttgtggctggcttatttctcttagaactttgaatatcttcaaggttcatctttgtagcatatgtcagactttttttctgtttttaaggctgaataatactccattttatgtatatactgattttgtttatccattcagatgttgatgggcatttgggtttccaccttctggccaaggtgaataatgctgcagtgagcattggtgttcagagtttgtgttttcag

SEQ ID NO: 41279 - DNA, 1045 bp, Homo sapiens
gaatggtcatccttcccctccctccctcccctgttgtcagtgcctgctcctctcacttgctgtgtaactgtgggcaaggacaccctcgttaagcctcagtttccccatctgaaacctgggtcgagtggcacatgctcttgcccggctgttgtggcgactaatgcagccaccagagtgttctgcacagcgcctgtccagatgctggccgtgtggtttctgacttgtagagctagacctggacacctctcgtatttgaggtcctaaaccatgtcaccttgcgctgtggactcattcaggccacagactgtctttggtttgtctggtttctacagtgtcagacagatagatgcttcagagtgactttttggtgaacaaacctacgaggagacacgtgatgttcatgtccctgtgttccaggtgccaagtgtgtggacctcggtgatgcctacctgtgccgctgccaggccggcttctcggggaggcactgtgacgacaacgtggacgactgcgcctcctccccgtgcgccaacgggggcacctgccgggatggcgtgaacgacttctcctgcacctgcccgcctggctacacgggcaggaactgcagtgcccccgtcagcaggtgcgagcacgcaccctgccacaatggggccacctgccacgagaggggccaccgctatgtgtgcgagtgtgcccgaggctacgggggtcccaactgccagttcctgctccccgagctgcccccgggcccagcggtggtggacctcactgagaagctagagggccagggcgggccattcccctgggtggccgtgtgcgccggggtcatccttgtcctcatgctgctgctgggctgtgccgctgtggtggtctgcgtccggctgaggctgcagaagcaccggcccccagccgacccctgccggggggagacggagaccatgaacaacctggccaactgccagcgtgagaaggacatctcagtcagcatcatcggggccacgcagatcaagaacaccaacaagaaggcggacttccacggggaccacag

SEQ ID NO: 41280 - DNA, 1077 bp, Homo sapiens
gagagggagaggaggaaggaagggaggaacacagagagagcttgtgtgtcaggggcaccatttcaacccgagttcccagtgctggaacagcatcacactgggaaacgttccattttctctctggagctggtgtgcttgacctctctggagcaaacgcctttccggatactccctgtgacacgcactgtctatgctggccagagagcaggctttcactcctgtgggctgctgaggccaggtctccaaggcctgtgtgggcgaggggtgcacagccccgtctggcttgaatgctcaggcagcaccttgtctggagaagcaatgtcttcccaatagtgacagaggctctacctgcctcttattaggtattgatgtgtcaatgtcatggcaggcaggtgactagggcagggttggggccgtgctggctcctggttctggctcatggggacctcaggagccctctctccagctgactgaggcctcgcctgcacgcctggccgtcccagcccattggtaccggatttctctacagctggggattgggtaggtcctggagctgcccagaaactccagggaactgtcattctccttccttggaactggacaaccttggagaggggctctgggaggcccagaacctctggcaggagctgggtagtgcctggggttgagggtgggtcttcccattcactgagtgccttgatgtccttgctccttagcttcccaaattccctccggaacttactgagctccttctaagctttgccttggcctgaactggttctggggaaaaacaaaaaaacaaaaaacaacttgtggagctgcttgttaatgagtttcataaccaggcagcaagagccagctccaagcctcaagcccactgtctactccctgccctgcgggagcctctggccagtctgctgcctcccacccttcctccctgcctctcttcaccacagggtagccagaaacttaaacttttttcttcaaacactgaagtctctccccgcccccagctcgcgcgtgccatagattagatctctccggggataggcgcagggacacccgccggctcccatt

SEQ ID NO: 41281 - DNA, 1037 bp, Homo sapiens
ggaaaagtcaaatattacttcaaggtctctttcctgggagactacaagaaaagttgcatgcagaaatcagtgtaacaagagcaagaagagttacgtaggattatccacatcctgcttcacctcctgcttcatagctcaggcaagcacttccctgtgctctgctgtgcacagccagtttatcagtgtgggaaaaaatctataaataggatggaggtttacataaaagagaaacataggaaaagaaaggggaataaaaaagaaactgtagagcgaatttgggggttaatgcagaggaaaaagctaaagtgagagacatcacatcagctgtgagagagaaacccagaaaatgaatggcaggggcatctgggacaggtttctcttggtaacaagttgaccctttaaatagactgcaagatgtatttgcagtttttatttggatgctgaatgaaatttcttttgagtataacaaccacatgagctcaagattttatttgggcaatgatatggtttggctgtgtccccacccaaatctcatcttgaactgtagttcctataatctccacatgtcatgggaaggacctggtgggaggtaattgaatcatgggggcggttacctccatgctgttctcttgatagtgattgagttctcatgagacctgatggttttataaggggcttttcccctgcgtcactccacatttctccttgctgctgccaggtgaagaaggacttgtttgcttccccttccaacacgattgtaagtttcctgaggcctccctaaccatgctgaactgtgagtcaattaaacctctttcctttataaatcacccagtctcaggtatgtctttattagcagtgtgagaatggactaatacagcaaattggtaccaggtagtgaggtgctgttgtaaagatacccaaaaatgtggaagtgactttggaatggggtaacaggcagaggttggaacagttgggagggctcagtagaagataggaaaatgtgggaaagtttgaaacctcctagagacttggagggc

SEQ ID NO: 41282 - DNA, 1035 bp, Homo sapiens
cctccgtccgcctgcatcacctgctcgtatgcatccacctctctcctcttctctttatcctggagagcccttgggagacttttcaggtccttattaaatgcaaccagccacaaagccagccctgggccttggtcattcactgtcgtggtgtaaaatggaattacattacaaagtgagggctttcccacacctagcagagggggtgatggaaagtaaacgaagtgttggggaagattggaactttgatagaagagaaaagaggctgaggtgggagcaggttaccacttctgtctgggacagaaggacggaggatgtgggtggcacaagggggccaaaggcctgcccttcccagaagctacccccaggtgggagggcctgtggtaggaggaggatggctgggtgaaacacagatgtccagttgcatctgaatttcaggtaggataaacacgtcccagatacagcatggcaatacgtatactgagcatgagctcttctttatctgaaattcaaactgtaacaactggccatcctgctgaatgttttctgttcatgtttggctgttttgctaaatttctggcaaccgtaggtgaggctgcctagggggtgtgtgaggtcacctgacctatgggaatcacggaacctccctctgggtggctccgtgagtgtttcagggcaccatggccaggcgcagggtggttcactcttgcctctttctccctgcactccgagtgccctcagtggggactgttttcgaggtttgtttaagagagaggctcaggacttcgaagagaggtttcctcggctcagagtgcagagagggagggtttgaattgtgatgtctgtggtgagggtggctaggcagacagtgcatgaggacctggtgtcctcctggaaaggacacgccggccatctcggggtctttctgcttctgagtgtctgggaggtgcgctgggaggaaggaggtgactttcctcagtgcctggctggtgggaacacaggaccaacacctcccgcctaccgtgcagcaggcccttt

SEQ ID NO: 41283 - DNA, 1024 bp, Homo sapiens
tccgggtcatgtgcttctcaagagtgggagctttgccagggaatcgttgtcagatttctgatgtgtgtaattcatccaggtctggaagggtctttattcagtctgaaggacattttaattttgtgtagtattttcatcacaaatcctcgtacacatgagggtattggaagaaacttgaacctttcctttgtgctcactgtcacatgacatctcacccaagtttcatgtcccaccaggttggttttaagaacatgcagaatgtggagcatgttccgctgtccttggacagagccatgcggctggtgaaagatgtcttcatttctgcggctgagagagatgtgtacactggggacgcactccggatctgcatagtgaccaaagagggcatcagggaggaaactgtttccttaaggaaggactgatctgtgtgctcttatcaccaatcagttcagacctggttgattttgtactttggaactgtaccttggatggttttgtttattaaaagagaaacctgaagtactcattttgctataacttgtcttctctaagcaggacagatataggaagtagaatttcttttaattttcttcatttttcccacccttttctatttttctgagattttttttttttttttttttttttttttgcattttaagtaatgaaaacaggtcatgttaattttcccttacactaatgaggtaggaatttctctgtaaaagttgaccttttgagcaaacttatcttatgaagagggctctggtgtttacgcagccagcttgcctgaagggacctttaaaccatccagaagggagagtatttactagggttttattaagactctaatggttataaatgaaatatcttaagatttttcacttctgggactgttaagccatctggaatagctattttggagaaaaatcttcaaccaaaataaaactgtaaaaaaaaaaaaataggcctttatacaagctgtagccagaaatctgggataatttttacaagcactttagtaatg

SEQ ID NO: 41284 - DNA, 1027 bp, Homo sapiens
taagtaagcagcattttcttcagatgaagaatttctttaatcttttttcctgaggtgaggtgggactacaggaagagaagcccggttggcagctttttaggcctcagaggaggaagggggctgaaggtctgtgttttgtttacatcaactttccatttcatgtgttttgctcctaccctttgccactctagagcctggtcccctaagtccagagcctctgctaatgtctcaggagacttcctttactgtcttctgtgttggtggatgcagggacctggagagcagtgctccatattgaaaccttcaggacagcaaggtccacagctctttcccttggtgtcaaccgctgtctgcactaacctctctgtctttaatctcttagctgctctcatgccttttaaaaatttttctcccaaattaaaagtggctttagtttttctgtagtgaaaacaatcagtacatgtttatacatacactcatgcagttttatgtaagtaggactttggtatctgtttttctgtaactatacattatgtattatcaaggagatctaagctatatgcataatgatttttgtatttaattaacaaaaaatttttttgtcttctgtttttgctgctgtaatacatagcatcatttacctaaccagtcctctaaagggcattttggcttcctgttttcttaatataaacactatgatgaacatccttgtacatacatttttgtgtacttccccaattatgcttgtcttgctagaataaacttcgagtagttgaagtattgggtcagataaatttttttttgtattttgttgagtatactctttctgaaggatacgccagtaccctgagtacccgattttatataaccttcccagtattagaattaacacattttgaaacatctttttgcctattgaacagtttattattttcatttatatatattcttgggcatgttttcatatgtttattgactttataaatttcctctttggagactgattcatatattaactgttgcccat

SEQ ID NO: 41285 - DNA, 1047 bp, Homo sapiens
aagggctcacatttgttgggtgtcctgtgatgtgctgggcagtcctaagcccttgaccattctgttattttgaagctttaaggagatgcactaaatggaagtccatataatagagttggatggagtacctggaaattcagatggtccaacttgaatgagtgaataaatagggaaagctatctgattaaaagtgggtcccctctccatgtgtgaattgtcaagttgtggggattactcctgtttttcataatagttacgttgatttttcaggtgaagcacttgaggaagaactggattccatggcaaaacatgaatccagggaagataaaatttttcagaagtttaaaactcagatagcccttgaaccagaacaggtaaagtggagctcatagctcctcatcgtgttctcttcaggccatgttttatgagtataatctgtaagaaataacttcatagtaacattagtctgttccttaggagcctataaaagcaggcttttgttatcttgttagaggagttcctcacacagatgggccatgtagaaaggtgttttgcagtgctgatccatttaatagttactaaaagactaaaggttatactgtttatcatacagggttcattttctaaagcaagcatcagggatgggagatgaatgagatgttgcctaaggtacatgaggtttaggcaccattggcccccccgccagaaagaaaaaaggttatttttgcccatttccaacaggtaactttggcttgtaaaatgtgacatgttaacatttttctccttaacctcccctaccataaacgtaaatcacgaaagaaaactaaactcccataaaccagtcactggttcaaataaatacacaggaagaatagatctaggtcttaaacactaaggcagtttttagcaatgcatatgcttttagacaaaatacagaaaaccactcagttgctgtaggaagcttattacagtgaaatttacttatgtttgtagtagttttcaaaacactatgtttcacttggtatttgtccctcctaaaatttttta

SEQ ID NO: 41286 - DNA, 1086 bp, Homo sapiens
tcatacattccaaaacatgttttgagtcttactctgtgcctgaccttgtgcttgataacagggatataatgggaagcaacactccagtggtcagatgctcacagtcttatggaggagcccaaataatatctggggaagttaaagtccatataatgactgataagagtacaatacaggtgccatgggaacacgtgacatcactgaagactgcctggaaggggccgcgcgtgtgttcatgcctatacgataaacatgatacataatgaaaatgcttatctttaggagaaaggagagcctagagtagcaggatcaaggatgaaagctggacttcaaatatgccttgttagtgtaaatgtgactgtggaactgtatgagtattttaagattatggagtaaagtaagttttaaaaagcagtccctaatcatcaaaagtaaaaaactcttgatgtagtcatataaccacactaagaactcttccaggtgacttcaaaacataggacagtacatctctagtagaatatgccctgagaatgaaaagaatgtaacagtgttagtattttgaataaacatgttattactagactgttgcttttattttgagatggttgtgtgtgtattggggggaaaggaaacgagtaattatgttggtgttactgagaactgagatgttgggcgtaggaggaagataatgttgattgtgtctacgtaccatttctctctaaaaggaactccaggctctttggagaggtggttgattccagaactaggtcaggaaacgttcatataatgtgggaacatggtcatatcaaagattaaggataaggattactagggccatgtcagaactcaagcaacatgaaaaggctcctgcttgcaaaagatggacagtttgaacatccacaaggacgctaactgcatcagatatgtttaatgggttcaaaatgatactttaaaaaaactcagtaatcatctttataggatacttgggaacagactcattttcaaattggtaaataaaaggaaagagtttgccttcgaggggtacataacttaattatgaatgaagtgatatgtgtggaatttact

SEQ ID NO: 41287 - DNA, 1042 bp, Homo sapiens
tgtcttctgtctaaacacactggctgtttggaagcctctgagccttgcctgctggtcaggttcaaggaaatgcttggaaatttgagaaccagagcattggcctgggctgtggctctcggcagggagagacggccgcccagagcagcgagtggccaggaagtgtatcctagccccccaccccgcccccgtgtccaccgcaggacagagcttcggcagaaagcacctcagctttaggtgaattcgagctaggacaagttccgcgtttccctccagcccagcaggcagacggagggtctgtccctcctccagaacggtcccttgaccccagagatgtgaggacaggctgcgtgggcggcgggtcctccatgggagcctgggctggagagagtgctgcctccttcctctctccccacccaaggctgctctcattaaaatcaaatttagcctcttgcatcattgtgcccctggttgttggaacaaaagcagagagctggggaaggttcctgacagactgggcgtgtctgtgagtttcatgcagcctgtggtcaatggtaggttctcccctctactccaggggagggccacagcccctcgcaccctcagctgaggtcatggttgggccatttcggtgaccctgggacagacgtggcggggatggcagggcagcgctgacgtcctggaattagttttgctgtagttagagctgtctgtggtgtctccagagggtgagtaagaattacaggcctttcaccgtgttattagttggcagccgagcggccacagaagaaagcgcagacgttgcagggccctctttaagcagaggcgccttcaacacatctgcacttgcttgaacccaaagttaaaaacactggcgtcggtgccctctccccgtcatccgactcacgggcctgttctttccatgctgatgttcgtcctcgctgctccctgcaggccgcatgcgggtgctgaaggtgcagaattcctctcccccggggaggcggccgtggactcctatcccaactggctcaagttccacattggt

SEQ ID NO: 41288 - DNA, 1030 bp, Homo sapiens
gtcttggcagggagaggaatgagagagccgtgcacaccagccagggcgttcgggaggagcagcacgcaagttagaaagtccccagtgccgctgtccgtatgagcttctctccagctcattttccccatctgtccagtgggatctcgctgcgtgggaccaatgcaaggataggatgagatgtgcatgtgagcaagcttgttaaatattaactagtactttgtgcgtggccttccacaacagtcccctcgtgtgcacaggcagggtctgagcagagggagggctttgtggattccaaaggccaccaggcccttggcaggcaactgcagctcgccacctccctcaccgaccggtcagctttccaacaccaacactgaagaggtgtgggagttctgtgccaggagctcccagagcagcttcagggagagtgtggggccccctgggacctggggcatctttgcccaccttaggagtgctttgtccatctggacaagctaggcttggctcactgccacccctctttggtccagctgtcccggggcagtggtgcccaggctgcctgacattgcaggggtgtggacagagcccttgccagggaatccctaccccaggattctggtgtggcctccgcctgggtgtgtcctggttaattcctgtgcctactgaaggcctgccccagctgatctcgctcgctcgcctcctagaccatgctggccacattggttctcatccagtcttctggggtggggacccgtccaaggacaggctggctgctcagtcattctgcagggccaagcagggcctgcaaggacgatgggcagacacagccgcatcacccaggcaggacagcaggctctggcccaggagatctgggggtgaatcctggctctgccagccattagccagagtggaagtgggcaaatggattaacgcctccagcacctggtttctcaccgagaacacagagaaggttataatctggacctggtataatctggactctgacttacaaatctgaatgccaagcaaaacc

SEQ ID NO: 41289 - DNA, 1071 bp, Homo sapiens
cagagcaggtgcaggctcccagctcttccagccccttacctcgcagtaggttcccacagttctagcctccttgatgccagccccagggtgcccactgctggccaactatgtccttttcctcaaaaccaggtccctcggtgcccagggtgaatgggtatatgagcctgggtgtgggcacccggggtctgggacaccgagcagacctctctggcttggagatgtgtgcggtgggaagaacagggtgacctgagctctcccggtgtcacattctccacatctgagccctctttgggtgaggccctacttccagcacacacagctgtccccattcgtcttcaggaataactgacccttgaggccagacagtggctgtgaagagcagggggaccgcctgaccgtgacccccaaggacagacgctggccctcttgacggacgagatgaccagggccaaaggcggcaacatgggggcccacgctgacggcagcatctcacacctggatgtgtttctgtggtccacaggtctgtaggaggtggaactggttaatttaaagtcaggttggggttgttgttagaaagggttcctgctcccacgagaaaccaaggatgagtggtggctgcacccagtctccatccccatgagcaccctgcggggtgttgggacccccaggcccgggccacacacctctctctttcagggccgtctctccctgtctctccagacctgctctgggttcttccttctagagcttcccagtgggttgccggagctgtctggggttatgtggcttgcctaaggccacaccgattggggcctggcaccaaagtccattagtatttctgtgacagcagccatctttctatgtaagacgcttatttcataagaaatgccagcatctcttggagtccttctgaggaggcaactgcatacgaacatcgcctctgtctcgtgctgtgacccggggagagactgtgggcaaaacccagtggcgtccgagggtctgtgtggccccgaactcttagtgctgacagcaacatgaaataatgaaggcacagggcactctgttcgtgca

SEQ ID NO: 41290 - DNA, 1050 bp, Homo sapiens
tgttagcaggacgtgtgaggccaggagtggtggggtaggggttggacgctcaggcctgctgcctgtgggctggctctcgaacttccccgggcctcagcctcctcgtctgtgaaacggggtcacacgagctgccaggcaggccacagcgttcacccggcagctcaagcccagccacaaccacactggctgcttttctcaatgaagcaaagtatttaggtgttcaccacgtggctgtggggcctttccggcagctcctcgccctgcaggcctgggctcagcacttcctggcagccggggcccctttccggtgctcccgtcctggagggtccctccgtgtgtcctgcggggcctccgtccagtgccgcgctgcgtgctgcctcctcagttcacccgcactgaccctcgggtgtggcccctctgacgggactgcacgacctgctcaatgtcctggtaagctcgtggcccagccggggagctgaagggaggccgggacgccaagctccaagcctggtcagagggagggcggggcagggtctgagtgacaagtgtgtgggcatcgttgtgcggcctcaccaccgctctgacgcctcctggctctctggacatgacccgtgtccaccacgtggcccagccgaggacagggctggtcactcctccatcccagggctcactcagccaatgcttattgattagtatagactgggaaaccgaggtgggagaggtgacaggagctgacacaggcccaggacgcacagatcactcccgtccggccgggagctgacacgggcccaggacgcacagatcactccggtccggccgggagctgacacgggcccaggacgcacagatcactcctgtccggccgggagctgacacgggcccaggacgcacagatcactcccgtccggccgggagctgacacgggcccaggacggacagatcactctggtccagcccaaacccagtggcatggacgggacttgctcagaacctgttagtggctcagacaggacataaagtgagggttccccagtgctccccaccgcacag

SEQ ID NO: 41291 - DNA, 1044 bp, Homo sapiens
aaaacagcaaaaccctcagagagtgcggttctgggccctgcacccactttaccgatggggaagctgaggcccgtccctgcagccgtccaagcccacactggcaccctcccctcggctgttccgattaggccttctcagcctccccaggccgtccgaccctggccgactgaggatgtgtgtttccgtggggtctcctggaaaagattaccccatttgttgaaaatcaaggaaagtcattttttttttccaaaagcattccccagaacggcaatatcgagggtctttttgtattttctccagttatgacggtcgccggggtgccgctagtgtgtgggccatcgttctaattgtcacgaaagggagggaagattaaaaggacgggaaagaaaatatggccttcattttcctcgtactggggacgaaaatggaagccaggggatttcattcaaaagcagtttgctcaggtctggttgtttttaatgccaaaaaaggaaactgcagatttaagatctccttagacaagcagagaacgggctcaaacactagcccctaactatgcatttagtttatttttcttactgatgttttttttaaacatctagggctccacggaggaaaaacaagattgtaacagtaaccttggtgctcaatatttaatcctggtttagtagttagtagcagcttacccttttattactttgaaatgaaaggaagcatcacaagggtttcataggaaagatgtctgcacctgtgttttcaggctaccggggagcccgcgttcatttccagtctagtcgtacttccctgagtcctgtccatgaatactggatgagccgacagtagcgtgtttaaaactacagtgggtctgagactttcaagcaattctttttccccgtttgcttttgaaataaagtctaaaccatcgcaattgttttcaagtggaaatgacttcagacttttacagttgcaaatcactgaatcattttaaaatggattttcattaaattgaccgtaagaggttgaagagcctcttctgagatgatt

SEQ ID NO: 41292 - DNA, 1636 bp, Homo sapiens
tagtagaactagtgttctgtggaatgagttttgctcaaagccaatccttccaagttgaaaacaacgaaggctttttaacctcaaaaatatccaacactccagaatttaccacccctggaactgcgggctgactgcagcggaccatttggtttgacctttagtgttttagaaaaatgaaatccatttgccagcgcttaaaacccgggagattccacaaggtctagattctttctcttgaacctcaggatcccggccagtctgggcctcggctctgcagggcgaccctggcgggcagcatgttcagtttgccgccatacctgccactgccctgccctgcaccccaaccctcctttgctgctggtttcagaagtgcacagagatagcaatggccacagacccagtggggttatgaagcaaatgtgaccttcaggcgccagcccaccatccgcattttatttttaagtagctcctggaatcctcatctggccttgcgcctacccagggccctgtcaaggcgaatattatgtgggatcgtggaaagtggtctgttctcagagtttctagcagcagagactagttcttaaaaaggccgtgggtggtacacatctttaaccccccataagaaacgttccgggaacacggagaattgtggccacagctttctgagaacagcgtgggaggacgggagccacgggctggtgtgtaattgacggcctgtgacccagacgtggtccccccgaagggacgtggacatgacatacaggacctgtgccccaccccgctgttcgtgtggcgatgatgtcggcccgtggcagggccaggatgctcccaggagttgggcggacctccgctgcgtatatggaaggaaggacccggccggggaagccgagggctgggaaagtgaccggggcggcgtctgtagtctgcattgctggagtgttggagcccagacggaacacagtctgccctgagtgggaggtgtgggctgcagggcgtgcgagctggggattcccgccagctctggtttccagcacctggaaaggtcaccagagtttgaatctggtaaattcttcctggattgggggctgagttccctccctgggcctggcatgggaggacatcctgggacgggctctccttccagtggaggcaggggccagccttggtggaggaagcctgggttggaggctgagttccctccctgggcctggcctgggtggacgccctgggacaggctctccctccagtggaggcaggggccggccttggtgggggaagcatggcaggggccggccttggtggaggaagcatgcttacacgcttacacgcttacgcgcttacacacttatgctcagacacgaccttgacaattcctccacgtttccaccatgaccacatcggtcaaacacttgcgtggaccggcacctcacagggccctgcggctaggctccccttcccctggagtattggcctgagatacaggagccctatggtgtttacagaatggcactgacctttcataaacagccccacctgtggcctcctgtcccttggccagggtggagggacagggcggtgcccacattgcccttcttgggctcttactgtgggaggcgtccacggcagagccaagggg

SEQ ID NO: 41293 - DNA, 1293 bp, Homo sapiens
aggccccaaccaggagggagggccgccccgggagtgggacctccgaggcacaggaatgctgcagaccaagtcccggcagagctggtgttacctgggaaacggaggccaggagaggctgctggtaggaagagcaggaccgtgcagaatagatgggcctctgcctgcacgcggtacctggagccagccagcgggggataggcggcctctgcggccgctgctggcctgccacggggggtcttgggcggcgctgtgagaccctggttaccagggagggtgacccctaataagcaaagcatggaggcgagtaactcgggcaggaggacgtccattcccaggctcggaggcctcagagagatggactttgggcacttcaatagctaaactgtgggctgacgctccctggagccatctcaactcggctgcccaggacccttccccaggccagaggccaggaccccacatacagggctggggacaggcggggtggacccactgcctggggtgctggagatgggcagggtggacccactgcccggggtgctggagatgggctgggtggacccactgcccggggtgctggagatgggcagggtggacccactgcctggggtgctggagatggggctgggtggacccactgcccaggatgctggagatgggctgggtggacacactgcctggggtgctggagatgcccggggtggacccactgcctgaggtgctggagataggcagtgtggacccactgcctggggtgctggagatggggctgggtggacccactgcccgggtgctggagataggcagtgtggacccactgcctggggtgctggagatggggctgggtggacccactgcccggggtgttggagataggcggggtggacccactgactggggtgctggagataggcagggtggacccactgcctgaggtgctggagataggcagggtggacccactgactggggtgctggagatgggtggggtggacccactgcctgaggtgctggagataggcagggtggacccactgcctggggtgctggagatgggtgggatggacccactgcccggggtgctggagatgggcagggtggacccactgcctgaggtgctggagatgggcagggtggacccactgcccgggatgctggagatgggtggggtggacccactgcctggggtgctggagatgggtgggatggacccactgcctggggtgctggagatgggtgggatggacccactgcccggggtgctggagatgggctgggtggacccactgcctg

SEQ ID NO: 41294 - DNA, 1081 bp, Homo sapiens
gccccaaagcaccccgcccggccccctcctcccaccaccactgcttcccctgcctcacgtcccgccaccaacgcgcccttcagctgctcccttgtcctctacccccatgtacctgtttcctgcgctgccacgtgctccttgccccgtgacccctgttcctgcttggccctcactcacctcactcccctgtccccttgctccccgcctccaccctccacgccccaagccccgccccccacctgcctgctccctgtgccccctccacctgcctatcctgtgccatcctcctccttgcacgccgccctcccgcgaccctcacctcccaccctcctccctgcctgagccccctccaccccacccgggcccacgagccagcgcttctgtccagatacctggaaaccaccgcagaaattcctgttaggcggtttggggtggggtgtgccctgatagctgccccctttccttccctcgggggcttgcaggacttgcacctggttgagggcacgcgctttgagactctgctctggtcatttcactttctgtcccattcatcctactcccctgcctttccgctctggcttggaccactgtcctaagtggaaggaggccgcttctcccctccactttataacgttccccatcttttttagagctctgatctgatccggtcgttccctttccttagctggccattcctgcagggtcttgccctttccctcccctggctgggatgtggaatgatagcaggcgcctgcttcctgctggcgggaaggctttccgaaggagggaacactgatgctataaatccgtgggcggtagggagcaggaaagcagtgagggatctggccagctcaggccgtcccagtgatgtcccagtgatggtctgaatgtagtgggaagtgcagggggtgtcaatagaagtgatagacccgagttcaggttgttaaaagatcactgcagctgcgtggagaatagattccagaagtagaggaagagctggacttggggaaatgccgagatttccacgttggttaactttggatttcacatggtccagaactcctgtggagcttggggaaga

SEQ ID NO: 41295 - DNA, 1026 bp, Homo sapiens
tgacctctgatctttctgtctctgagttacctgtcatcgtagtcagacatgtgatcttttgtgtctggcctcttcactgtgcatggttccaggtttcagccttgaagaggtaggtttcctgatgagaaatggcttgaaggtggtgagttgaagagtcactcggggtattctggggccaggatggaagccctgactcgctccctcgtctgtgctgctggggtccacccgtagggccggctccaggtgtgacatagcacctgctcaggacacccctgctttgcctccatggccaggcttcattctccggctctctccctccagcagcagagtggctgcctaggggctgtgcgcagagacacagggggaccctttcccaccaggagcctttgttcaccccccttggtctcatcaggccagcggaagttgagtcaccatgtacgctggccggcccctcctggagctggcgtgggttcggcaccaggcagcacagagggcccctgaggacatcaggctctgcccagtggggagaaagtgggcagagtgcggggtcagtgtccatgctgcccggcacttgcagcaggcacttctggcactggctaaatatttgggctgcggagggcagttcaaggggccagggcaagaacagagcccagcaagaagtgcaggcggccggctggtttttctctcccaccttccttaagcctgaggcagagcatggcccacaaggaaagtggagtctgtgtcatgggccaagtcttactcctcaaaacagtgtgatgactctgtatggagagctctgtgtgaatactgaagctccatagctgatagctgtcggtgtaagcctactgtcactgtctaaaaataaccatcactgtctaaaaataccgtcactgtctaaaaataccatcactgtatcgatagctgtctgtaaatactggaactctgtggagcacgctctgtaaatactggaactctattgctagctgtaaacggtgtaactcagtataactataccgtaactctaaa

SEQ ID NO: 41296 - DNA, 1021 bp, Homo sapiens
tggacaatattgattcttccagtccatggagtatgttaccattttttgtgtgtgtcctcttcagttttctcatgtcagtggtttatagttttctttcttttttttgagacagtctcgctctgtcatccagggtggagtgcagtggtgcgatctctgcttactgcaagctccgcctcccaggttcacgccattctccttcctcagcctcccgagtagctgggactacaggtgcctgccaccgcacctggctaattttttgtgtttttagtagagacagtttcaccatgttagccaggatggtctcaatctcctgacttcgtgatccgactgcctcagcctcccaaagtgctgggattacaggtgtgagccactgcgcctggccttatagttttcattgtagagatctttcacttctttggttaagttaattcctaggtatcttattttgtttgtagctattgtaaatggaattactttcttgatttctttttcagatttgttaactgttggcatgtagaaatgctactggggcttttttggtgattttgtatcctgcaactttactgaatttgtttatctgttctaataggttttttgtggaatctttaggtttttccaaatgtaagattatatcatctgcaaacaagaataattatcttccttttcaatttggattccctttatttttcttgtctaattgttctagctagagcttccagtactgtgttaactaacagtggtgaaagcgagcatccttgtcttgctccagatttagaagaaaggctttcaatttttccccattcagtgtggtactagctgtgagtcttgtatatggcttttattgtactgaggtgtgttccttctatacccagttttttgaagatttttatcatgtagggatgttgaattttatcaatacttttcagcatcacttgaaataatcacgtagttcttgtccttcattctgccgatatgatgtgtcacattgatggatttgtgtatgttgagccatccttgcatt

SEQ ID NO: 41297 - DNA, 1042 bp, Homo sapiens
ctcccagattcaggcaactactgtcctgcctcagcctcccgagtagctgtgattacagacgcgcaccaccgcacctggataatttttgtgtttttagtagagacagggtttcaccatatcagtcaggctggtctccaactcctggcctcaggtgatccacccgccttggcctcccaaagtgctaggattacaggtgtgagccacggtgcccagcctatgtctgctataatattaagtatagaaaaacaggcttcagaaccatgttcagaagcatgtgctgagtaacagcgtttgagtccataaggaccacgtggaggagggtggtcccctctgatagtaacattgtgtttctcctttttctgtgtttggaaacactcactcactgtctgtgctacagtttctgcgtgttgagtgcagtcacctgctgcacaggttcgtggcctaggagcctcacaggctatatcgcacagcccaggcatcgcacagccaggcacgtaggaggctgcgccatctaggcttgtgtacgtcactgtagtacgttcacacggcaacgaaatcacccaatgacgtgtttcccagaacgcaccccccaccgttcagcaacgcttgactgtaccagcggtcccctgccattttggcaccagggactggttttgtggaagacaatttttccatgggtggggcagggagcagggtggtttcaggttgaaattgttctacctcagatcatgaggcattcaattctcataaggagcacgtaacccaggtccctcacacgcacagttcacaggagggtttgccctcccctgagaatctcatgccgccactgatctgacaggaggtggagctcaggcggtcacactccttcaccatctgctcacctcctgctgtggggcccagttcctaacaggccttaaaccagtcccagcctgtgtccaggccttgcgtacccctgcccagcaccggccagtatttctttggaaacacccagaagcccaggtgcccacaaagctctgttcagctgtcagcagacccctccccg

SEQ ID NO: 41298 - DNA, 1503 bp, Homo sapiens
ggaggtctggtctgctgggcttaactctttaagccacttgcccgcccctctctgctcctcaccacctcagaggagccctgcctgcccaggcggacaccacgtccgtgtaagccccaggaccacctgtgctgtgtgcatcccagtgtgcacagtgcctgcttcatgattcgctgcagagacggcgttggtgtgaacgggatcagggtctcgccctgcacccgcggctctcgctctcctgcaccctgggcggggctccctgtggcagcctccctcccgattatcctggcaggcccggcctgtgtggttcttacgcgtgagggggatagtgagtcccagcaggcaggcaggcttgagccctgagtgttggaattgtctcagtctctgacttgtaacctccaggcacaggagacgatggactcactggccatggtggagggtgtcagcagctgccaggacctctaccgcaagcacattggtcccctcctggagcgggtgaccgcgtcgcaccttgactggaccgcacactcgccggagctcctgcagttcagtgtcatcgtcgcacagtcaggtgagccgtcccgacagctggcgtgccgtgcctggccccactcaggctacacacctgctcccccaggtgctcagcaggtaccagcgccgaccagctgagctgtggttcactgaagcgtgttgttaaaagtacccaatagtcactcttgcctggggagaagcagcattttaaggagcatcgcattgaagactgtgggacgcagctcttccacttggcccgggcacacgctttcatgtgaaaccttcaaagtgtgcttttccgtggcctgttttgtagcctggcttcttaaatacgtctggattttgttgcagaatctagatgtctagccgcatgggtgctgtgtgtgtgacatgggggccttagccccagcccctctgagaccagcatttctgtggttctctttgagcctgcggatcagccacttttcctgggatggacagtgtggcccagtggggcttcagcgcggggcaagatccactgcagaaccctaaggagacgtccgctcagcagccatagtgccttgggacacacggcccgcgctgctccacgggccgtgaactcgccgcggtagctcttcctcgtttgcctccccggccctcccgctcccgcctgcagctccgagtgcccccgcctcctgttggatgtgtgcaccagggtggtcgtgctctgcatctgaggatgctaagatcgttcttacacaatctctgtgcctggtagggactcaccttttttttcctgagacttggaaaaatacccaaaattgttctttgtcagttgcattcaaaactgtttccaaattagaaaagaaaatactggctgggcgtggtggctcacgcctgtaatcccagcactttgggaggctgaagtgggaggatcacttgagctcaggagttcgagaccagcctggccaacacggcaagagctcatctctacaa

SEQ ID NO: 41299 - DNA, 1127 bp, Homo sapiens
ttggaacacacatctctttgggcccacatctcctgtcattcactgaaaggcaggaagactgcagtatgccgttcagtgtcaagagctgggtataaaactgtatgggtttttttgttttttgttttttgagacggtctcacgctgtcacccaggctggagtgcagtggtacgatcacagctcactgtagcctcaaacttccgggatcaagtgatttttctgccttagcctcctgagtagatgggattgtaggcatacgccacctggctacttctgtatgtttttctagaaatggggtcatatatgctgccaggctagtcttgaactcctgggctcaagcgatcctcctgcctcagcctcctgagtagctgggaccacaggcacccactaccacgcctggctaatttttgtattttttgtagacatggggtctctttatgttgcccaggctgacctcaaactcctaggctcgaacagtcttcccacctcaccctcccaaagtgctgggattaacaggcataagccaccatgcctggtttaaaactgcatttcccaatgatgattatgttctctgagccccatctgagcgcacacatgtgtggtgctcttgggagtcgggggcacagcctcaaatataatacaatatttccaacatcgtgtccttggaatacagatgatttttattttcttctttatttttttctatgtttttctaagctttctctaatgagcatgcactactgtaataaacagaagacaaaaggattaaaacaattttttaataggagaaatttttaaatttctcatttacaaaagttctatgggaagataccttttaaattttaattattttaaacatacagaaagggataatttctaaactttgagaggatgggggatctacaaagacattgatttgactatatacatttgaaccaaaataaaaggaacatagacttaggaaaatatttgcaataaggatgacagtgtgagatctttgttacataaagctgacacaaaatgagaacaaaagcattaagagttgggcacggtggctcacgcctataatctcagcactctgagtccataaccgagcagcctgctctgatgatagaggctgaggcaagga

SEQ ID NO: 41300 - DNA, 1432 bp, Homo sapiens
tcctgcctcagcctcccaagtagctagggctacaggcgcccaccaccatgcccaaatgatttttgtatttttagtagagatggggtttcaccacattggccaggctggtctcaaactcctgacctcaaatgattcacccacctgggcctcccaaaatgctggcattacaggcgtgagccaccgcgcccagccttttaaaagcattttaagaggtctcaggcagtgcctttcacagagaggaggctgcagcctccacgcaggcctcaccctctccgccttcttcctttgacctcggcatgtccttgatgttgtacccaagggtctgtgccgctctcctgtgactcttcttacaagcaaatgatggctccaggagctggcctggaccctgaggcctagaacctgccccaaggggaaaagcacctgctcatttgtgtttaggcatttactcaacgcttctcttaatgtcttggaaagtgtcacttaggagacaaggcagtgctcactcttggctgacaacaaggtaactgtagacagaagaatctattattaggcgtctccatgttctcttcctagctcattgctggcactgtcatccttacgttagtttccttatattttgttttcttttcttttttcttttccttttttttttttttctggagacgagagtcttgctctgttgcccagtctgcagtgcagggatccgggtccaggggatgtctctgagcccccaatcctttacggggccttttcctggggtccctgtgggctccatcccgggatgcaggacagagatgtgggatgcggaagggttccccgcagggatccaggtccgggggcaggaggagcccagagggtggcaccatcacgcaaaggcctccagaggcgtggcccgggacaagcacagcgccagccgcctgcgctgccagggcagggtccacacccacagactgtaacctggacccgggcagggcggggtccacacccacagactgtaacctggacccaggtggggtccacacccgcggactgtaacctggacctgggcagggcagggtccacacccgcggactgtaacctggacccgggcagggcggggtccacacccttggactgtaacctggacccgggcagggcggggtccgcacccgcggactgtaacctggacccgggcagggcggggtccgcacccgcggactctaacctggacccaggcagggcagggtccatccacacccacagaatctaacctggactggggcagggcctaaacccagggactctaacctggacccgggcaggggaagggtccacacccgcagactctaacctggaccagagcctgggagggtccacacccgcagaatctaacctggacctgggcagggcagggtccacacccacagagtctgtctaatctgcagaggacaag

SEQ ID NO: 41301 - DNA, 1063 bp, Homo sapiens
ctcccgaagcgctcggatcacaggcgtgagccaccgcgcccggctgatagtcgtattttttgtagggttgtggtctctccatgctgcccaggtcggactcctaggctcaagcgatcccctcgccccagcctgcctggaggcgcgcgcgtggtctccgcgccctgttgcgccttcaaagtgcccagaatggtgtctggtgcaaaataagcagcggcggggaacaccttgccactgtcaccgtcatggggaggatttctcccggctccccagggctccccaggacaggtgggcggtgcggtccgaggtctctgctctcgctttgcagcttgtggttgctgcgtctggctctgattccgggtgggaagctgcccataattgtgtcttctaagcttcagtcatagtattgcccatgaagtgcttgcggctctaattgctaaagctttgtatgaaggcttttgtgtgtaatctgtttttactccctacatctccactgtggagaaacaccgtgtgttttggtttatctcatctgttgttggacacttgatagttttttgaagcctttagttttctcaaattatttctctaataatttccttttctttgtttaccctttttttctgactgttctggaaatactactgtttgggctggaaggcttgggctggctttataattttcttgtctttctcccatttaatgtttgttctactttctagatttcctctttttcttccagtatatctatttagcattttagtttggccatggtattttaaatttcccagagctgtttttttttcctcctttaaaatttgtaatatgttcttacttcataaatggagtatcctctcattcacctgctttttgtttttgattgtgctaaaatacacgtaacgtaaaacaacatcaccacctagttacataactttttcatcatcccagatggaaaccctatacctgttaagcagccactgcccattcttccgtctccccaggccccggcaacggctaatctgctttctgtctctctgaattgggctgttctggacatttcatgtaaatg

SEQ ID NO: 41302 - DNA, 1092 bp, Homo sapiens
tgggattacaggtgcctgccaccacacccggctaattttgtatttttagtagagatggggtttctccatgttggtcaggctggtctcaaactcccgacctcaggtgatctgcccgcctcgccctcccaaagtgctgggatgacaggtgtgagccaccgtgcctggcctctttctccgtttttaaattgggttgcctctttttttttttttttgagttgtcagaattctttattctgtatactagaccctcattagacatatgattaataaatactttctcccagtctttggattgtctcttcactctcttgttggtgtcctttgatgcacaaattgatgaactctaaattgattaactctaatttttctgttttttcttttgttgctcatgcttttgatgtcatacctaagaactctgcaaaatccaaggtcaggaggatttgtcctgtgttttcctttaagagtttatcattttagctcttgtatttaggtttttgatccattttgagttcattcttgtgtatgatgtgtggtaggttctgacttcgttcttttgcacgtggattttgttcaagcatcatttgtgacaagactgctttttccctattgagtggtcttggcacccttgtcaaaatcaattgattagatgtgtgggtttatttttggacccagttctgttctgcaggtctgtatgtttttatgccaatgccaccctttttttttttttttttgagatggaatcttgccctgtcgcccaggctggagtgcagtggcgtgatctcggctcactgcaacctccgcctcccaggttcaaacgcttctcccgcctcagcctcccaagtagctgggattacaggcgcccgccaccacacacagctaatttttgtatttttagtagagacagggtttcaccttgttggctggctggccttgaactcctgacctcatgatctgcccacctcggcctcccagtgccatactattttgtagtaagttttgaagctaggaagtcggggtcctccaactttgcttttcttctggaagattttttactatttgggacccattgcagttccatatgaatttaaagat

SEQ ID NO: 41303 - DNA, 1034 bp, Homo sapiens
cggagaacacgggctacacgtatgcgctcaggtgagtgtgcacctgcacgtggggtcctggccttgcaatgcccactcgctgtcgcggtggcgtggaccttaacaggaactccatagtactaccgactacatgctgtattttgaaggtgaaaaaaaataataaactgtatcttatggctttagaggtggttttttcttacggctttaaggtaaactgaatctgttcatcctggtgactgggtggttagtcatcgcacatggcttgctggcttcgaccccacccaggtggttgtgatgttgagaagatgtctctgtggtgatgcctggtgtttgtgagaacgtatcagtggcttggtatttttaagttaacagaaataacctggaaaattatttcccatttcaaaggaaacatcatagaacagcgttgaagctcagggttttgagaacacaacttttgtctgaggcggagttttctgcttttattcatattccgatccactgaaccaagacattggagtctgaagaggcgctgccctgccccttctgctttcagttttccaagtagaaagagcgactgaaacgaagtttgcgtttgatgacattacgggtcagcagcaagggaaggtacacagctagacgggcccggatttgatcagcaggttggaaaacttgtgcacccagcagatgtttaaggcaccaggaaaatgcttgtgtaatttttttcagtggcttatccttttttttttttttcgtttttttggagacagagtctcaccgtcgcccaggctagagtgcagtggtgcaatctcggctcactgcaacatccgcctcccagattcaagcagttcttctgcctcagcctctggagtagctgggattacagacgtgcgccaccacgcccagctaatttttgtatttttaatagagatggggtttcaccatgtggaccaggccaatctcgagctcctgacctcaggtgatccacccacctcggcctcccaaagtgctgggattccaggcgtgagccaccgtgc

SEQ ID NO: 41304 - DNA, 1043 bp, Homo sapiens
gtggctggagtcggtgtcagggcacagccgtcacactctgagcagcggtctgaagcacgtcagtctcagacacgtggactgtgccgcttttggtccggctcccctgagctgagttaacctcgtgtgcctttgtcgggcaggtgctgtgggtccagggatgcttggtatctgtctctggttttcaattggagtcaatttttttcaatcttttgatacaaagtacatctaaataacacatttttaaaagaacagtgcataactaatcagagagagacgttaaggcctagtggtcttaaaggtgagatctcttatcttcagagtttttgtcagtcttgtctccttgttctgttacttaattctctctaatcctagactggagacctccgtttgaaattttatgttcccccaaacattgcagaaaaggtaataaagtgctttaatacgatagcctactgggctgtgttgattcctgggatggtgctgggccagcatccgtgtcctcctgtctccactggacactggtgtcctcctgcagggctctgggcatacctgtctgtaggaaccatgttatggatggtggctgggttcacaggttttcttaaactagaatcacaattgtgtaaaatattctgctagaaacaaacccttcttgagatgacactgaaattctgtctggcttcataacagtcatcagcattcaacatagcttagtgcagtctctctcttgtccccacctcagcctctaagttaaagaagaacctctttcttaaattgtgtgtagtgactcaaagcagtttgtattaacttactgttggtcatgaacgtatgacagggtctagctctgttgcccaggctgaagtgcagtggcacagtcatagctcactgcagcctcaaactcccaggctcacgcaatcctcctgcctaggcctccctaagtgctgggattgcaggcgtgaaccactgtgcctggctcatctttttatttaattacattagttgaataattatatggaaggtattggaagtgactgtcttttggtcac

SEQ ID NO: 41305 - DNA, 1079 bp, Homo sapiens
ttagaagatccagattagttccagagatcacatgtgctaattttgggaagccttggtattggtgtttgttctgttttgctcagctagtgagagtggttaccaggcaacagagaggcatctgctgctgctgaggcttgtgccttgctgagcgggctgtgagaagatagatgggctttcctctccttccctcatgttctgctttcctccttaggccaggtgctgtgtgtgctgccgtctgtctgtattttcttcaaggataagctttcaccttcagtcagaagatggtatctgcatatatctggaggcattttaggaaataaactgtgaccagtgccataatgctgatttattaaccattgtaacctttacattttttaatgggttttgttcttatttgataagctgagctcaacagcaaaaatgtgtgtgtgtgtgtgtttttttttttaggtcttgatgatgatggtgatcttaaaggtaattattttagtccttttatcttcatatacttttcaaaatagaagttttagttaaatatctgcagactgtgataaacaggttccatctactgtttgaaaactttaggtggaaataaagctgccattcagggaaacggggatgtgggagccgccgccgccaccgcgcacaacggcttctcctgcagcaactgcagcatgctgtccgagcgcaaggacgtgctcacggcgcaccccgcggcccccgggcccgtgtcgagagtttattctagggacaggaatcaaaaatgtaagtctcagtcctttaaaactcagaaaaaggtgtgttttccaaatttaatatttcctttctgtaagtctcagtgtctgcactatttgtcttggagacttaaaattatcccttgaaagcataagaagtacaccccaaaccagctttgtccttcctgtcctcttctagtttacattttatgtggttagtaattttgtacctaaaagtatttgaaattctataaatttggacttgacgtgagcaaaagaaaatttctacgtaagcgaaactaataaaactacagtcactttcagatgcacacctttatttttata

SEQ ID NO: 41306 - DNA, 1122 bp, Homo sapiens
gggggttaccccgcagcgccctctctgggatctcctgggggttactccgcagtccagtctccgggatcccctgggggttactctgcagtccagtctccgggatcccctgggggttaccccgcagcgccctctctgggatctcctgggggttactccgcagtaccctctccgggatcccctgggggttactccgcagtccagtctccaggatcccctgggggttactctgcagcaccctctccgggatcccctgggggttactctgcagtccagtcttcggggtaccctgggggttgctccgcagcaccctctccagggtcccctgtccactgccagctgggctcttccccaagtgattatctttggtgtccattctaaaagtgcctgaaatgaataatttggctacctgacttatcaggaagtagatattggctttatgggaagaaataacgcatgttcatggttttttaataggcggtgcgtctttctacgtgaataggattttgtggctggccagatacactgcatcatctttttcatcatttttagttcaactttttcaagtggttttaatgaagctcagttatgaatcagaaaattacaaattgaaaactcatgaatcaaaagattgtgaatccgaaagctataagtcaaaaagccatgaatcaaaaggtatttaaatattttttccctcctttttccaccaatcacactttcgcagtggagaaagtgctgtgactttcctcgccaggcgcctccctcgctgcctcctcctgtggtcttggtgctggctctctcctggcttccccctctggatcttgcatccctgggagcttgtggaacttttcgtttgttctgtgtgtggtttggttccctcagagctgatcagtgttgaaacatctttaaagttatttcttaaacaaaaagttaatgtgctcaacttttgatttttattacctttttaaagcaaaaactttacctgagtggtatttagaacctgttttttcagaactttttttctttttgagacggagtttcactcttgttgcccaggctggagtgcagtggtgtgatctcggctcaccgcaacctccgcctcctgggttcaagcgattctcctgc

SEQ ID NO: 41307 - DNA, 1080 bp, Homo sapiens
gcggagtctcactctgttgcccaggctggagtgcagtggtgcaatcttggctcactgcagcctccacctccagagttcaagcaattctcctgccacagcctcctgagtagctgggactacaggcgcacaccaccacacccagataatttttttgtatttttagtagagacagggtttcactgtgttagccaggatggtctcgatttcctgacctagtgatctgcctgcctcggcctcccaaagtgctgttggcatcttaaaaaaaaagttagtttcaaaaataattgtctcacctgctaatgaataaacataaagccattgatttttcttttaaattctcataagccatatttctttgcatgtcaaccatgttgtaattacatagttgcaggaattcacaagcaggtgttaagtcactgtgaggagatagccacccacagtgagaactggaacaaaacttactttgggaggctgaggcgggtggatcacttgaggccgggagttcaagaccagcctggccaatgtagcaaaaccctgtctcttaaattaaaaaaaaaaaaaaacaaaaaaaaactggaacaaaacagatttcatgagcagtttcctgctttttgtaatgtgaggtttgatactaagttgattgtggcacattccgtcatccggcagtgctgtgttaccattctgaaacactgtttcactagaaaatattagcctttagaataatgttagttttggtcttaattatttcctcgcctagcacatatgaactgcaggtgtctatggaatttcaatctgctttaaaatatggtatgatcttcccaatataaattgtgctggcaccaatggccaatatttgtagggcggcttccaacctccgccccctggggtttttaggagatatctgcattttacacctgaagtatctgcaggcagaagtgagtgaaaactattaaaaaatagaactgagcttttcaaatggtcatgtcagtgcaatattgccagcacttacaagagttatttggcttttcatattttttgaggagactcttgacccaccgatgcaggctttggtgaagtgtg

SEQ ID NO: 41308 - DNA, 1037 bp, Homo sapiens
ttatattcttatttttcaaaccaacctgtgagataagaaaagcagatatcattaaggaaaacaaatgtgcagaggtgaggcagctgggagggcctgggcaggatgggggacccaggtccaggcttctgccctgctgcagttcccagtggcatcagtcacctcagaaggctgtgatccgaaggggcagcgactcagggtagctcaggccattcccacagcaccagagagttggtaacgtaggtctcaaagacaccattttacatgaaggttctcctgaaggcatcagaagccttgtagataaaaccgtaactgcttttctaatactgggggggtggattttgcacaaaattatctagagggggaaaacagattggtgaaccctgactttcattttttctaagtcaaaggttttcattgttactcccaggtgccttcgaaacatctgcaagtttttagtcttgctcatcccactcttccttttactaggtaagtcaaatctggctgagttgcctccgatggctaagcggtacacacatatgtgtaacttagtggaaaaaaatgagcgtgtaagtccatgttttgagaagcgtggtgtacctgtgtgtgtgtggtggctcttctcttttagcaggtctctccttacggggccagggcaatttcttttcgttcttgcccgtgttgaactgggcaagcatgcatagaacacagcgggtggatgacccccaggacgtgtttaaacccacgacttctcgcctgaagcagcctctgcaggtaagagggtagaaaggcctctcagctggcactgcacatgtgaggtcttcagggacgttccacactgctgtgagccaggcacttcagttgggtgtcctgttgtaagaagtatttttaaatgtcagataagcaagtctttggagctccttaagtgttctaggatagttcaaatgcacatttaaagtactctcatgattcagttagttttaattttaaaaacataatagtattcatcactgtacaaagtacagaaagtatagagaaga

SEQ ID NO: 41309 - DNA, 1040 bp, Homo sapiens
tgttttttatggctgaatagtactccattgtgtatatgtacgccattttcctcatgcattcatctgttaatggacattgaggttgcttccagatgtgagctactgtaaacaagcagtgctgcacaaagatagaagtgcaggtctgccttcagtagactgccttcctttctgtcgggggtgcacccaggagtggcattgccagatcatatggtagctctgtttttagttttcttggggacctccaaaccactctccatggtggttgtactaatttccatcccaccaacagtgcgtgagggttccctttctccacatcctcgccagcatttgttactgcctgtctttaggatagaagccattgtaactggggggagaagagatctaattgtagtttttacttgcatttctctgaatatcagtgatgtcgagcacttttcttggaaacattttaataaatcctgaagtggtgcagtactattgcttccaaaatggtggaactggacactgagaccgatctgaactttgctttaaggtggcagcatcttgagtactcgctgttctgaaacttacgaaaccaaaacggcgctgatgagtctgtttgggatcccgctgtggtacttctcgcagtccccgcgcgtggtcatccaggtgagtggccgccggtggccggagctgctcctcttcagcatggactcggttagtgttcacgggtcgtaggtccacagctccatggaacttcgtaagatgaacacgtctgtggaactggtaccacaagaagtggcagcgttcccacaccgaggagtccccggtgtccccgtgtagcctccacgctacacatctgttggcttgggtttagcgtcacacagatgggaccgtgtggcacatgctggtcctgtcagccttcctccctccctcttttgggtgttccagccatggtgttgtgagtggcagctgttcctgctcgggccgtgggtcttccgtcacgagagtggcagctgtgctttctcaggtgttgagagacaataggtggggaggcccta

SEQ ID NO: 41310 - DNA, 1030 bp, Homo sapiens
ggctcaccagcactttgctcctgagggcacagccggagcccctcctcactgcaggcagacgcagcctctgctgccacgaagccacacagccctgcgcttggcatgcggctgctttttctgtgccagctcacgagtgccaccggcacagtctgtgtcacctggcagggccaacaggttttctgcacagggttgccacagtgttcctgcatggcggtcctgctcctggccataacatccttctcacagggcttggtgatcctgaccctcccagaggagctcactggcctgcagtgttgtcagtgtgatgctggtggggatctggtggtgagagcacagcatggcttcagtgtcttagagactgagggagagggtggagctcagccctcccctggcacagttctctctcagaaggaagtgcacggtcactggaggggcagacttcatataaatcaccaatcactgtgctgggactggactgagaaactgtcggctcctgggaagtaaagagaatgtttacagaacatagggatagcagatataagggaccagctcccaccccaggaccaaggtggagcctcgccagagcgtctctccagaccgttgggcggagggtgtggcccagctcactgaacgtcagggaggttgctgtggtgccacacggtggaatgtaccagcatgctgggaaagcctgtgcacaacagggtgactcaccgggcgtttggctgcaacacccccaagaggggtaccagggaacctcagtgtccacccagcaccctgagctggcaagggctaggctttgggctggcaaagggagagcagttcaaggctcagctccgtcttcacagcgcggtagaagacggcttgggggctgaggggcagtaaatccacagctggcatagaggagaagccggcgggtacgtgcccatcgttcaccatctcttctaaacacgaatgaaatgcgtgtgtcgtcctcacacactgaaggcaggctgcgtgcacggtctcctcctccgttgcgcacagcaacgtg

SEQ ID NO: 41311 - DNA, 1049 bp, Homo sapiens
tgtaaataataatcatgtgtcattctgttacagacatactttccattgttgctcttaattttgtattaacactcagatgccctgagtctttcagaggtttttattttttgagaccgagtctcgctctgtcaccaggctggagtgcagtggcacgatctcagttcactgcaatgtccgcctcccgggttcaagcgattctcctgcctcagcctcccgagtagccgggaccacaggcgcccgccaccacacctggctaactttttgtagtttttagtagagacagggtttcaccatgttggccaggatggtctcaatctcctgaccttctgatccacccacctcggcctcccaaagtgctgggattacaggcgtgagccactgtgccccaccccgtatttttatttcactggtgattatcagaggcagtagttacatctactcactcgctggaacttcttccatagcatttcttatccctagaagtcctttcccatttcaaaatagatatgcaaatagtcccttgtgtcttctgctagttctctgactcggataaaagataagatagagcttactgttctaataagtgcacagtccagtggcgttaagcccagtcacactgttgtgcagccatcaccactgtcatctccagagctgctccatcttctagtctgaatctctgtccccattgaaccctgactccccacaccccagcttaggccggcactcgctcccttctgcctgctctcttcccaaagtcggtcttctgtggcccctcctcctgctggtgaggcctcatctccccgggctcagcaggtgctccagagcttccactgtgagtgctgagggcagcagctgagcatggtctgtgtgtccggcggggtcacttctctgccactcattagtgtgtcctgttttggcctcagttttcctaatgtgtataacggggaatcgtgctgacctcaggacatgtcgtgggttacatgaagccctcaacaaaacacaccccttccttccagggaaggcctcgtgactgccatggaggaatgacc

SEQ ID NO: 41312 - DNA, 1051 bp, Homo sapiens
tactaaaaatacaaaaatgagctgggcgtggtggcgcacgcctgtaatcccagctactcaggaggctgaggcaggagaatcgcttgagcccgggaggtggagcttgcagtgagctgagatcgtgccattgtactccagcctgggtgacagggcaagactctgtctcaacaacaacaacaaaaggttaatttccaactcagctgcttcctgtcagacgtcatatttggggaagtgattggacttggggttattaatatgaaatacatgtgtgtgtttttcccaccttgatttcagaaaagacccgacgacacagctttccaaatagtggaacttcggattttttctaactggggccatcctgagtatacctgtctgtatcggttcagagttcatggcgaacctgtcaagtgaagacactactcattatttttgtacatttttgtatatactgggacagcgtgaaacactggaatccttcatggacgagggcatatacaatgatgggacagtgccacactccttcaataaacgtggctgctggccagaggacgtgagcgtgtgacgggcgccttggcgccacctgttgggtgctcactgcctctgcaggtgcagaggggtcagcagcaggagaagcgtgttgaacacgtggctctcagacactccttgtttttaacgggaagctctttgcatttgcatttcctcaacaaaggagcaaagcagaggaagctgagagtctggcgtgttcttgacgctttggtcttcagccttgcactggctcttctaaaggacttttggagggcagataatttcatctgttaaatccaacacacatttctttcagggaaaaacaatgtcaccaaattttcagagttctaaactcctttccttcaagccggaattttccttttttcagcaccagtaggtactaagtctccagatggggaaataactaaaatgtgtttttctgctttgttcgctcttacttctgaggaaggtttccagtcaggactcgctgtaccaatatccatggaggaatatgggagcgtttcgc

SEQ ID NO: 41313 - DNA, 1058 bp, Homo sapiens
tagctggaattactggcgcgcaccaccacccccggctaatttttgtatttttactagagacggggtttcaccatgttggccaggctggtctcgaactcctgacctcgcgatccgcccacctcggccacccaaagtgctgggattacaggcgtgagccacggcgcccggccagtagactttactttttagagcagtttttggtttatagcaaaatggagtgtggtgtgtcctgaattccccctttggacagcctcctgccccacagacacccccccccgagtagagtccctcagggacccatcactcacatcggggtgcatgcctggtgtgtggggggatgaggaaccccatgagagcatcacgcagtgcagctccactccctgaagaccctctgctgggcctagattttaaatattttctttccatagcaagtggaattgttacctggaaaactctggaggtgccactttggttgtagtttgctagttcatgtttgaattaaacaccgtctgtcacgcccaacctgtgcctgcgccccgctggctggaatgtagcctgggtaagcgagtggccggcacgccgcggtgccacgtgctggtgagcccaagcgaaggtggactcagcagccccagccacggagtggatgccatttcgttgcttaaaacacttgtttgtgccaggaaatgagaaaagaggagtgtttgtgtcggtagttgtcaatcttagctgacctgaacgggctgggatgaggtcctggcatctgtgtttagtgttcacattgtttgtacggacctactgagcagcccgggctcaggacagtgcatgtgggcccctgatcgtggcttatgaggagacatcttacatgacctgaagggcagccttgtttccagaattttctattaacctcaacatagtataaatacacaccagccaggctacatcgcattttactgttgtgttgtagatgcttttcttctttgaaaactgagctgtttaattggtttagaaagagattcgcgttcctccttagatggaactactaattttatctctggaag

SEQ ID NO: 41314 - DNA, 1113 bp, Homo sapiens
ggccaatagtgcgcagcatgcagagccgggccgggagaaggcccggccatgcccagctgccccccactctccccggcctcgggcttgagagggtacctgtcctggcttagtcacctggaaaccaaaatccttcgcagcttccagaattctccagtacaggaggagaagccgtccacgttcagagccgccttagacggtttgcctgtcaccggcattcctggacctggaaacgggtgcccccagccaggccggggaccactgtgtgcccagaattctcctcccgtcctttttccccttgcccggctcccagctgcccagggaagaagggagccggctgcaaggcgcagtccaaaccaggccgggggccgtgaccatcggcagtgccccccagagcaggctcctcgtgcaggaatatgggtcactgccttccagggagtcctttttttcttctggtttctaagtcgccacctcttgctttacctcagatagaagcatccagaacgctgtagtatcggcaaagcagaagctggtgtggtgcttgctcagggtcggtgcatgcggttctgcccgtggccccactggcggcatcgtgaggccaggcgtgtctgggagcttgtttttccagagtgccctgtgccagacggctcccggcctcctctgagtcagtcatgtccctgcaggactggaactaggacggccggtcacagagtcagtggtcctgtcgaggctcctgctgtggtgttggggtgggtctccctccagaaccttcactgtgcggggagcacagcaaaaccggaggcctgccaacggcctgcaggctgacgggggtgcgggggcactttctctcttgggtgcgggcttttccctcctggtgccctgcctctgtgcagcacgaagcggtctcctgtggggggagggcctgtgtgccaggctaatgagatgcccggatgtggcggggctgtctgtgtttggggtccctggctgtggtgccttctgaagaggagcccttttctgtggttaactgagcatccaaccctttgcgttctcggctggccttcccgtcctggcaacaccaaggtcattctggtcctcagtggcgttgctgtggctctt

SEQ ID NO: 41315 - DNA, 1051 bp, Homo sapiens
atctgccatccggaccccaggctctgggcgcgccgggacgcctttgttccaggtggcgagatatcgtccccttgccgcgggcccgcttcgcgctcgcctgctggggaagagtggaggggtgggggttctggggctcggcccctcacggacagcggggtgggtaactgccccccaaaagcctgggcggcttgagaagggccggcggcagcacccgagtcaccagaacagcggctgcgtccgaaccgggaagcggcgtggtgggttggcggaggccgggccaagtgaggtctccaggcaggggcgaggaggggaggaggggccggcttggctccgacccggaggagagagggaaggggacccccccccgcccccgcaccgcctcaaccttccgcgcgaggctctgtcacccagcctggagcgaacgagtctgtttaccttgcgcctgcaaaatattcagatggaaacatgtatttattcatcgctttgcagaagggaacagctgaggaaggggaggcagaagcttaaacagttaacacattgagaaagtgggagaaaaaaaggtgtctgaatttttaataataaccccggtctcatctttttcttacgactgttttcccgtaaatttgctatcatttggagatggctgatggtattgttttaaaaatacagtgtcagcttggtggattaaaaattccaagatgatttgtgcataattaaatgtttccctggagcaaagaaatcctctttttctgcggtgggtgcggtgtggggtccaggtctgtggtgcggtgtgcggttgtgggtgctaggcgttgaggcagacgctggcaaaacgcctgtttatcaccaatagctttgtctaaaaaggtgtgtttgtcctgcgcttggacctcctctcatgacctcttctgcttggaaatcctttcatccaatttgttctaagtgtcttaagtgaagtcaagacccctccatgtctcccctaatacgataatgactaattcttacaggcaaggcagtccggaattcgcaccaaaaaaaaaaaaaaaaaaag

SEQ ID NO: 41316 - DNA, 1070 bp, Homo sapiens
gcccaggccagtttcggggccttctcggggcccggcggcgccccggactcggccttcgcgcgtcgcagccccgacgccgtcgcctccccgggggccccagccccggccccggcgcctttccgggacctcgcctcggcagcggctaccgagggcggcggcggggactgcgcggacgcggggaccgccggccccgcgcccccgccgcccgcgccgtcgcccaggcccggccctcggcctcccagccccgccgaggagccggccacctgcggggttcccgagcctggcgcggcggccggacccagcccgccggagggcgaggagctggacatggactgaggccgcggcggccgggagaggcgcgtagccggcccgcggccgctcgctcaggctccgactcacgcaacgaatcaggtgatcggctctagaaacactgctttcccttcttttcttttgttttctttcttttattattttttttaagagtaaacgaaagtgctgtatgaattcggacccaggcagcaaccacaggactgggggtgagaccctcctcctcccaagagagcaaaaaggacccatggcccccaaaaaaccccacaacgagaatcctcagccttgtaaaatgcaaaaatgtctaagaatatttatatatgtaccatttttgataaataaagctggtcaaacgcaagttttcaggtccatctttttaaatttgccaagcgcccagccccgccgcccttcccacctttccacgcctctctccgcgggtggggcccggagggggccccgcacttcccgggggtctgcgcttaatgcgtccttttgtgtgcgtgtgtgtctgtgttttctgattcaacacatttatgcatctgcggctcccggtccccgcccgccccggcgctccccctcctaccccgcgccgcacacgcacgctcacatccgccgcgcgcccccgcgcgcactggcacacgccggggcgcgcggcgcggggtgacggagccgggggctgcgagggccgggccgctgggctcctgcagagttttgatatgaaagtaattattttccggtggctg

SEQ ID NO: 41317 - DNA, 1046 bp, Homo sapiens
cccccgcggcgtggcacggcctgggcgttggatgcagcagtgaacgggacccacgcggggactcagggtatgacgggcagaggggtaggtggggtgggggcaggtgaggcgggggtgcccagcggtcagggaggggctctcgggaggtgacattcggccgagaccgagtgacggtgtggaacccgggcgcactgggaggcacgatccaggcggagggagcagccgtgccagggccctgaggtgggaggggccgggcggcctcaggctcagcgaggggctgaggggccaacgtggccggagtggagtgggcgaggggagggagcgctggccaggagagacaaccacgagccacacttggggctgttaattttctgggaaccacattcaaaaggtaaagaagaaacaggtgacattcatttttggccgggatacagcgtcttgctatggggcccaggctggtctccacctcctgggctcaagcgacctcccacctcagcctccaagtaggtggaacaataggaaatgaattttaataatgtatgttatttaaccagatattaatacatcaaaaacatggtcacttaaacgtatcgtcaatataaaaaatatccacgagacattttacagttttttttttttagagacagggtcttactcaggtgctgaggctggattgcagtggtgcaatcatggctcactgcagagtccagctcccgggctcaagcgatcctcccacttcaaactcctcaatagctaggacttcaggctcgtgtcaccatgcctagctaattttttattttttatagagacagggtctcactatgttgcccaggttggtcttcaactcctggcctcaagcgatcctcctgcctcagcctccccaaagtgctgggattacaggcgtgagccatggtgcccagcctgcttcagttttaaaatttgtatataaaataataaagttaaatacaacggaaagttcatttccttagttgcgtgggctgtgttttaggtgcccagggggtcacagacggccgggggacgggagg

SEQ ID NO: 41318 - DNA, 1001 bp, Homo sapiens
catgtttccgctttcctacagtttcaggaaactgggagtgtcgtcttaaaatcatagagttttagagcaggtacaagcgaacttgagtggccacatgccccaccccccgaccagctgctgtagatgaggaagcccaggccatgaggtctgctggcctgtcccacaggccggtggggtctggtgtagagccttcctgcttctccgcactgtgcgtcgggtgtcctggggaaggtattggggtggagactgccctctccctgccctcccatgcggggccggctcatctcgtacagcgggggctagtgtggggtgtagggaagaccttctccctgcttgcaaggagctcaccatgccttggggaggccccctgtccccagaaggatctagaaccaggccttggtagagggtgcttgcctacgcgaggaggagagcagtggggagtgtttctggaagaagcagggcagggaaccacgtgctctctgcagatggtgatcagaaacctgaaacggcattggggtgggggagtcggggtttgggaggaacccccaagacttttgactgcctgtggggctgtgtggggggcaccaggatcagggtgagggcatcccatttggcaaagctgtggtccagacaggagacgctggaggccggagcctgggcaggtgctgtgggttcaggcgggtgatgcttgagggctgggatcaagcctggttggcgcgtggatgaggaaaagagagaggggcaggggcaactccggtgaatgatgcggttgggggctggggggcatctgggccccccggaatgcccctgactggacttagaggctgggagcggattgaagccccagggcggccgggggagaacaggatgctgatggggagctggaggccgaggacaggaggatggtgtggtgggagccagggcggggactggagggggtgtggtgtgttctgcagtctgctctctgctgctgcagctgcctgagtcacctctggatgtag

SEQ ID NO: 41319 - DNA, 3205 bp, Homo sapiens
tgaggcaggaggatcgcttgagctcaggaggtctgcagtgagctgtgatttcaccactgcactccagcctgggtgacagagtgacaccttgtctctaaaatgaaaattaaaagggaaaacatgatcctccagaagctgaggtggctgcctggggatcacctgctcctgaaagcacagttctggacgactgaccctgggctgcctgccctgccggggggagcccagggctctgatcctcaccctctgcaaggtgccttcctgggcggagccgccctgccctgcgctttatggagcccaggccctcagtctggatcctggaaaggggcgcccggcgtcctggctccgtcactcatccccagctgcagccgcaggaattgcctctgtctgaggctgctggcagttccttttccttgagaggaagtgatgcccccgctgagccttgtttagttctgcgtcacgtcgaggtgtctggccttgggttgaaaaccctgcctcttccatccgaaaaccagttacctgagagctgttccaagttataggtggtgccggagaactttgctgcccggcgctgctcccgggacgtggggcgtgagcgctgcacccttacttacgtcggctgctggggccccacagcggaaactcagacccgcccacccaggcccccgctgtggcgctgaacactgcacttctctggtgaccaccgaaactcagaggagctcggggtgtcgggtgcttgtgcgtggcgatgctggtgttttgttagctgctgggcgtaagacacaatgcgaggacgtcgttcctcgggggctgctggaggggagcttggctgcagtgctgaccaggtgctaatgcagtagcccctgccttgggcccggggtagtgcacgggcgtctctgcgaccccaggcacgctttccccctggatgacaccctaaggctgcgtctctggccctggggtgggagcgctttctacatgtgctctggcggccctggaggccatgtgaggtcggacagttcacaaaaccccatttagggcagtcgtcatttttagatcagttgctttacaaactttttttgtgcatacaaaactcttctctgaatgtccttccaaaagcaagctgtcatctttcttgcctctgatgtttaaagcgacattaggttaaggctacttggatttattctgtgcatggtggggagagggaggcgccagcaccatcccatcccgtgctgggttcctgagagaagctttgctgcttggctgggccgtcccgctgcgtcgtctctccaggcgcgtggctggtccaggcttcctcggcagagcagagtcgtgacctgcccaaggaggtggggggcaggcttgcgagcacagcgtgggggccgcctgggagccctgcgtccgccaggtcctcattcttcagagggccccagtgcaggtgtgcctcgaagtactggggttggagcggggcacaggcgtgcttcagtagccctggcaaccttgacctcctggaagtagtcagccacccctcctggggcgcccccggctaccgtgtgcctccgcagtgtcacagggcatcgcggaggcatctttttagtggaaagatccccacgctgaactctgcccctggcatctggccgagccccacacgtcaccgtgggtctggccagacggtcctgtcccccggaccttccttttccgcccggctgtgctgccacggcgggcagtgggcccgggggcccaggagcgggtccttgctgggtgggaggcccgggtgtgtgggaatgcgcgcggctctgtaaacatctggtgactcaccgcatagctatgtcgtggccggcctgtgcactgacgtgctcgcagtggagctggaagcggtgcccgcggcccctccctctgacatggaaaagtttctcatggtgctcccagccgccggcatttgcaggtccccacggtggcggaggcagctgggccccagcctctccactgtcaccctcaccccaggacgtggtgcgaaggagcctggagcccacctggccgtccccgggaccggctggtgccatcctgtgccatctacgtcagcgccctgagatcagctggccttggcaggggcagcggactcggcagcctggcgcaggaccctgtctcacctgtgcggccctcttgttgtgggggtttgtgggttgcgggggtggggcccccatcggaggcagggctggagggtggagggatttgggcccgagggctccctggcccagggtgtggggagggtcctgggctggcagggaggacgggatgcggtcacccgcccccatgatgcccatgtccagtggaggtgctgaccaaggacaccccccaccgccgtgtgctgctctgatgttcctgtgggaacctgtgtctggtatttggggtatgggagtgggtgctgtgaacccctgtcccgcgagctgcccggcgccttctgcccgcccgtcccggccgccgggtgcaaatgggtttgttgactgcctgccggcctcgtgatgtctgtgcaacctgacctgaagtcaggatcgcgtttgggcttctcggtttccatgacaaccgtgggggctggctcggtcccaaggtcgccatggcaactatcggagggctcatgccggggatgctttggctgggtttttcatgaatgattagaatgtgtgacacaatgcagacgtgaggacggcgggggcggcggcggggacgactcccgccagacggtcaaatgctcggcagggcggcggctcccccacctccctggtctctggctgcggcccccggacctgccgcccctcaggaaccccacacccccttgggccgcagggtcctcgctcgggggcagcttaggtggaggtggtgatgtcacagccgcagcggccagggccgtggtaggtgtcccgtggcctgtggggagggcggggcgggagggcggctgggcctccacccaggcccaccgtgggggatggcgatgtcaggggctccccagaggccccctctcggggatccaggctgggtccggagcaccggagcctttgccagtgtagggtcgctgtccagcggggccccacactcctcggggccggcacagctgtcttgagggagggaggttttgccaccagtcactttggtcctcggtacggggcaccttgtgctgtgcaggtgcagacgtcttctctgacctcagggagag

SEQ ID NO: 41320 - DNA, 1056 bp, Homo sapiens
agagcaaaggcctgcgtgttcccaaacagccgttgcccccgtggccgtggtaggtaatccatattggatgtcataaggaccagggggatatttaaagagagaaacagaaaatatatagagatataaaattatattcacagtttatctacagatttttcgtaacaatctttcttttccagtttgatactgtaaatctatcagagcagagccgggggcacgggcacaggtgggagttgggagcaaagcggaggcccgggctgcccgccgtcccccttcatctccccacggactgtaccaggcagctgggccccgcaggacaggccgcagcgggtggccggttctgtcccgtcttggggttcttggtgtccacgtcttgtgggccgtgggcttctacctgcccttggcctgcagtgctttgctggagaagggactccctggtccccagggtggacggagccgctgtcaccgcccagagctgggccggggaagcacggtgtgttctgcttttcttttcagattgttgaaatttcattgtcatgatttaatatatggatttttttatttaagaaaaagacgagggactctttgtcacgtgggtttgttttctgtctccgtgcctccggcttcccaaagagatccaggtctttgcgtttccagggcgtggggaccccggccccctatgccgccacgccgccacaccgcctcaccctggcttctgtgctacttggcagttccatttcattatttattttttgtgctgctttttatcatgatataaattattgaaaacagatcacatgtgggcccgtgtctggccgccgccgccctgccccgtccctgcggccaccacctaatttattgccgtgcgtcctgctgctgtgactgcttttgtacctttgcaataaagaattttctggtttcagaccctttcgttgcgtagctggtgctttcagctggggctttcttgggccaagaaccacaccccccccccaatcccaggggaccctgcctgtccctcaccggggtcaggatccgggcactacgtgtaagtggctt

SEQ ID NO: 41321 - DNA, 1025 bp, Homo sapiens
gagcaacttgcctcagtttctcagcttaaaaatgaagatgaaaaatgagggtgcctgtcttgtgggatttagaggggcagccaacacacagcagcaattcgctggaacgttatatgttcattattttatctttttttttttttttttttgagatggagtttcgctcttgttgcccaggcttgagtgcagtggcgctatttccggcttattgcaacctccacttcctgggttcaagcgattctcctgcctcagcctcccaagtagctgggactacaggcatgtgccaccacatgtggctgattttgtgtttttcatagagacggggtttcttcatgttggtcaggctggtcttgaactcccattctcacgtgatccatccacctcagcctcccaaagtgctgggatgacaggcgtgagccacggagcccagccaagctttggagttttatgtgaactgaagtatttcgtttaacaccacacagtaaacacaaaggaaacccaccgttgctgggccgccttccatcatggcgcagaattgagagtcgagcacgtcgctttgttttctgccaaacttagccaagctccggtcttaaaatcttttcgttcctagcgtgaggctttctgtctttgttgcaaatattgaaacctgccacgtcacctcttgcactatttgtttagttctttaagaaatgaaaccttaatccatgtacaatttctaaaagcctttatttcaatattttaagaagttatttcccctggcaaagaagccgccctgttgcccggtgtggagctcgatgacaaagctcatcagcctgagtggaagctcattcattattgctgcgttttcgctcttccaggagagaacggagagccagtgtgctgtgtgtcacggtccctggatgaacgtttgtggaactggattgaattaaacaagacgtgcaaagcaagtggttcacgaggtagtgtgggggtgtagggatggggactgacccgggaggcaggacacagcccaagccctgccttgg

SEQ ID NO: 41322 - DNA, 1024 bp, Homo sapiens
ttgaggtaacactaacctttgcctccctgaaccctggggaggggctttgcatgcgggaggtgctgcacaccggcggaccgtcgaggaaacaggagcttttctctgttgcacacttgtagggtgttcctgctcttgggggcagggcagggggagccctgcagcttccatgagtcgtgtggatggcccaaggtcacatggtaaggtcgtcaggcactcggcaccgttcccatagccccttgaccttccccagcactcaccgagtcctcacacagtggggacgtggtgcaggcagcagtcccctccgttctactccccagcccggcctcctggagggcaaggcggaggtcaggggcctgctagacccaaccctgcggccatgtccccaggagccagccccgccgagtcagccctcccagccctggccttgcctgcaacccccgccagcctcccctggacaataggatgggagcagggagcggaagagaggactgggtctgggggagccatgagggagcccccagagctggtgagatccctcaatgggcccccctctgtgggcaccaggtccggcaactgtgctgaaggaaaacccacatatgtccagcgtgcggctccatctcccatactgccttgcactcaccttccctcccctactgaggaggaaatgagtgtctactgggcacccccttgtacccagcatcatgccaggagccttcagtaactggtgatgcatcccccaccacaaccctgggaggcggacaccgtgatgatctctgtttgacagatgaggggactgaggctaagagaggttaagtgacatgcccaaggtcacacagcaggcgcacggcagagccaacaccatctcctggcccacgatggttctgtgtcccctgacgcagcaggtgcacaggcgggccccccacctgctcctagctgggccgggtcaccgtggcaggccttgcggctcgaggcccaactgccctgatatgcctatcacagcctcatgggctctgcggcagagccc

SEQ ID NO: 41323 - DNA, 1022 bp, Homo sapiens
ctggctaacacggtgaaaccccgtctctactaaaaataaaaaaaaattagccgggcgtggtggcgggcacctggatttcccagctactctggaggctgaggcaggagaatggtgtgaacctgggaggcggagcttgcagtgagccgagatcctgccactgcactccatcctgggcgacagagcaagactccgtctcaaaaaaaaaaaaaaaagaaaaagaaaaaaaggttatcagaaatacaagtcagccaggtgtgctggtgcacacctgtagtctcaggtacttgggaggctgaggcacgagaatcactttaacccaggaggtggaggttgcagtgagcctagatcccaccactgcctgggcgacagagtgagaccctgtctcaaaaagtgaaaaattaaaaaataaaaacgctgtcagttactgtgaccattactatattacacttttttttttcataaaagacattttagcatgaaaagcaggaaggacaccacaaactaaagactttgggaacatctagtctacgcccctcagtcctgaggaaacttgtccctgaaggtggagtaggctgctgagaattcccagtgggtctatactgcttggcccaccagactctcctgctcagaacagtgttctttctaacgcttcaattgttattatggtttaaaaatcaaaacttttggtttaatgattattttgagcccttggatattctgctacttttttaaaaagcattatttgagcccatcgaattcacagatttctaatacgtagattacttctggaattgggaagagtcagaggatgctaatatgacgacagggttggccaggctgggtgacggctgtgggtcctcagcgggcccacgtggccctgaaggtgcagtgttggccagagtgacaggtgaggcatctggtcctgaggactaaggctcaggaagccgactttgtcatggccctcctggttgtggtaacgcaggttttgtgctttatgagaagagctgcccttcagggtcatt

SEQ ID NO: 41324 - DNA, 1085 bp, Homo sapiens
ttaaatatttacttgtttgctaaaatcttctgtaaaaagtcagttttcattgacattgggatgggattctgcctgcctagatgttgcaacaaacctttcaaaatctaggcatctctggaagatctaatagtggatattcttgagatggtcttcttcatttgcattgtgcattgttaaaagcttttcactgttattctcctgtagtctttggttattaccagaacttaattgacctgtcttgactgtttacatttccatcaaagggagagaggagagttccagtccccccagctgtcatgtttaaaatctgaaacaagctagggttaggatttcttttgctcacagtgaaagcatttagacaattcattgtctcttcttgaagacttgtttagtgtgctcagttaatgtattaatgtttttcttggtaaaaatgatcatttgaaaaatctctcttgttcagaattactgggagatgtactcaaagatcggccccaggaagcagatggaatcgattcggtgattgtagtggacaatgtccctcaggtgggacccgaccgacttgagaaactcaaaaatgtcatccacaagatcttttccaagtttgggaaaatcacaaatgatttttatcctgaagaggatgggaagacaaaagggtgagtgttctcctgttggagaagtatcatctgtgtctggcacgtcatgatgagggagtgttgcaggagatccttactaacacagctcctgccttgcccaggcacgtgggccgttcacttcttcaggccgccctcagctggaagctatccagagcagtgaatgagaagatgataaagtttgtttttttaagttaaggttttaaagtttttaaaattatctagaataggccagcatggtggcttatgcataaactcccaacactcttgaagcctgaggccaggagttggaggctgcagtgagctatgataacgtagctgtactccagtctgggtgacagagcaagactctgtctctaaaataaataaataaagtaaaaactaactagaatagttttagtttctagaattatcaaatacaggtaatgctgctgc

SEQ ID NO: 41325 - DNA, 1052 bp, Homo sapiens
ggtgtgagccactgcgcccagccgtatttttttaacttgttagtctttattaaacatgggtaaagatagagttccacactgcgccaccctctggatcacttagcagccttgtgtgggatcggtgagatcttctgtgctgatcttggagaaaccggagcgcctgcagcgtattgacaccagaatgaacaagcgccgctgcttcccgcttccgcttgggtctcttggggccgggcagtgtggggtttggggagagagctggttccgcgagttctgacggcgtgttctggccgcacagacagactgtgatcctctcgtgagaggaggatagtgtacagtgttgcccttctcttctaggtacctggtgacctttagccccctgatggacacgcaggatgaccctcaggccataatcatctgggacatccttacggggcacaagaagaggggttttcactgtgagagctcagcccattggcctatttttaagtaagtggaccattgtaacgagctctgtagcctttgtcttttcatgggaataccctggcacttttgtttttcttaggtggagccatgatggcaaattctttgccagaatgaccctggatacgcttagcatctatgaaactcctgtaagtggcctcagtgatggcaaacgccccgtccggtccttgcttgtaaccggggtgtggtgcctttccttatttgtgctagaagaggaggaggaggtttcacagatgcataggaaaggcctgtctcctgtgcctttttaactgcccctgctctgggcagagctcttcagtcactcctgcccacctggcgcagccgtgggaagtcctggatgggagttaatgcagtgggcttcagaactgcagttctgggtggcgggtgggtggatgggttcactgtcacgctctgtgtgcactgccccctaggcaaactcacatcagactcttgtttccttttgtaaaaagttaggtgtgtttctgagacactgacatgatttgactcaactgcagccttccttttttttgggcagtctatgggtcttttgg

SEQ ID NO: 41326 - DNA, 1860 bp, Homo sapiens
ccccattggtgtgcctttagggccctcaggaccctggcctgcagcctgcagtgtggaccctgggactgcttgtgcccaagtgtggcgggcagggcggctcctggaggtgggatctgggtcagagttacttcatgcatgtccagtggcttccagtagacgtggtgccggcagttctccagccttagaaccgtcttccatcctgagggctgtggctttcatcactgcacatgctcgtgtgtgaaccaggcatgcacactgaatctttcattgtgacgttgatctttgatttaaaccttttctcatattttcactgtccagaatgtcaccccttcccccttttttttaaacagggtgttgtcacaaattttgaaattttccgaatgagggagaaacaggtacctgtggatgtggtcgagatgaaaggcaagttgtattttagtcactttgaggcgaatggggcctacgtgctgttttactcttggctttaacacttccatgcgaggggttgtctgagcagctgagtcaggactgtgagccctcaccatgaatagtcatctccaggtcacagaacgtgtttagagcctgggcaacatagtgagaccctctctgtacaaaaaacaaataaaaaaaattagccaggtgtggtggtgcgcaccgatagtcccagctgtttgagacgctgaagcgggaggatcacttgagcccaggagcagaggttgcagtgaactgagattgcgcccctgcactccagcctgggtgacggagcaagaccctgtctaaaaaaaagagaaaagagattgagcctgtgttcttgtttggctttttgttttgccatggagaaaaggaggaaggaagggttaaaaataggtgagaaaatgggaaacatggccgcccttccaggcagggagaccggaggtcaggatcccactgtaggtgcacactgggtgcgagggaagcggcatccacagctgctgacaatgtcgggctcctgcggtcctgctgtgggtgtcctgctctcaggaagggagcagtttcacgtaggtcactccacacaagtggaagcagctgtctctgaaactccaggaatgtgcacctttcctgctgttgcttgctctcccgtccttttaatgaacttttacacgtcgggggatatttctctgtggttgaatagtgaacattttaactgatcaagagcactatgttctgaattgaccaaaaagggaggggtctgttttgtgcattttagaaaccatcatagcctttgcctgggaaccaaatggaagtaagtttgctgtgctgcacggagaggctccgcggatatctgtgtctttctaccacgtcaaaaacaacgggaagattgaactcatcagtaagtaacctggtccctttcctcttctgagtaggtcagcacagatgatgacccagtcgctgcccaacagtgagcatttgactggcctaggaccactgctgggcaggccgggactcgcctatgaatggggtgtggcctcggctgatggaagtgagcgatggcctggaggtgccgcctccttgcagggtgtctctctgagccccgttgagccctcacgtttaagcgagtatttccaaggcttccattctctgccatcatctcaagtgaagctttttctcttctggctgtagctgctgtccctgggcttggggtcacttcctgtggacatactcctgccagtccccagtctgggtcaggtgcctttgaccagggtgcgcagagctgttgcacacagctgtactctgcccccgtgcacccggttccaggggtgccacactgcacccacctggggctcgctcctcacagtggtgcgtgggccctcgcctgtctca

SEQ ID NO: 41327 - DNA, 1025 bp, Homo sapiens
gtgggaagggtattcgttacacagctgtgaggctgccttacctttgtggttggtgtcacggtgtcggtctcagctgtgttccagcagtgtgtcgaaatcatggagaagcttccagctttctgctctgagttaaaagaatacccttttgttgctgctctcccttgcttcattgtccacacttgctactgtatttttggaggcttacttagcctcagataacatttccagtaaaaataatatgatggcagtcatatgtaatactcactgcacactctgcatctgtgatttggtaagtctcacagcggccaccagaggctgttgctgtgcttgtttccatgttaacgccgaggctggctccctggggaccccatgccgcagcacctctcaggagtgggatgccaggaggtatgcgtctccatgaagcctgacggtcctgtctgtctttgcagtatgaacggtgccttagcgtttgtggacacttcggactgcacggtcatgaacatcgcagagcactacatggcttccgacgtcgaatgggatcctactgggcgctacgtcgtcacctctgtgtcctggtggagccataaggtgcaggcctgtggggcatagttttgactgtggatagaagcagggagtgctggctagctgctgactctggtgctgtcctgggacctcagggaaggggcaccaagcctctgtgttgaacagaagccttggctggtgttagtggcaggaggaggaggattctgggttgtagaagaggtggcgccgagtgcaggagcagcccctgctcatggttgcggggaggtggggggtcttaccctgggcccagggacccctgaaaaggagtgagaatgtctgcagagaggagtcgtttcctttgaagtctgaacagagttccataaccgcagacattaagatctgttttggggtcagtggttgagtccagctgccgcgttacccacaactcgtattccaaaactgctggttaagtttgtcaaggactttcagtatttagtgacttg

SEQ ID NO: 41328 - DNA, 1025 bp, Homo sapiens
gtgcacggctgtgactgtggtttcagcagttctgagacaagagccttccaagtcgggggctggggagcagagtgcgggagctcctgagtcctgggggcctccgcgcctcacagcatgggcacatgtgggacagaaggcctaatggggtgcctgagggtggcctggttgctgtccccccagggtgggaccatgagcgagtaggggtggcacacgggctcagctctctgtggccggggtggctcctcttgcgggactcaacgtcagccccaaggcgatgttcagggggtccctcagccttttgaggtggtgccgtttagggccgccatgcctgtctatccaggggacggactccgcctgctgttcccgcgctgagctacaggactcccgagtgtgagccgcggttcctctgttgcagcgcagccgtgtgtgctgtggagccgaggccgtcctgcaggaagccgcgtgactcccgcctcctccctgtgctctctggctctggactgtgactgcgcctggattctgccattgcgacacatttttgtgcctttcagcccctggtgtctgcagtgggggatttaaggcacccgcttccacttctttcttgtttggagttttctgttggaaccgccggcgttggctccgaagacttagcgacgccactggcggcaccttctcctgcgcccagtgatgtttccacggtgcctgtacacagccgagcagcatttccgttgaaggacttgcatccccattgcgggcagtgctggacgtgtcccggagacccaccgggagggcgccgccatgccttgtacccccaccgtgcaggttgtggccggttttctccgcaggttgaacatggaaataaaagcaaacttgtatgaaaaaccggtctttctcctctctttgaatgtagatagagaccttgaacttggtgcctgcctccctccccagtggcaagggcctgcttgccaagccagacctctgcagggcgctgtcccgtccggtcgtcacgcacactcggccaccct

SEQ ID NO: 41329 - DNA, 1035 bp, Homo sapiens
actgttggccaggctggagtgcagtggggcaatcttgactcactgcaacctccacctcctgggttcaagcaattgtctctgcctcagcctctcaagtagctgggatgataggtgccagccaccacacccagctactttttgtatttagtagagacagggttttgccatgttggccaggctggtctcctgacctcaggtgatccacccagcttggcttcccaaagtgctgggattacaggcgtgagccactgtgcccagccacgaattgatttaactcttaagtcagttgagtcaagtgagttatcgtttggattctagagtcaaatacctatgcaacaaatatttgagccttatgaggaatacagaaggtacatgagatatgatccctgtcttctaagaacttgaaacccagtttgggaatattggactggtatacgtgcgtggatttcctgtctacctgggaagggccaacagagggcttagagacgggaaggaagagaacagggtgagctgatagcctctgtgctctaggaccggctctgcagggaagttactttacttcaaaggctaagtttgggctcagttttcattcaggtctcctgggatataaatcaacattccattctcatcaatgtgaccgttaattacatatttttatttggatatactgtcagatatagttaactgaacacaaatgaagtaattgtataagcaaataaaccatagtcctggaggtaccgcgtgaaaatgtgtctcacgatggaggttttaatgtagtaccactgtgtgtaagttccaggcagcccaggacatgcagagagcaaatattgacaccaggaacagaaactttccacatttttgttgactacagcgatgggaactgcagtgaattatttgccttatatagtgtctgtaaagctggaaaagaagtaggtagtttctggtctttgtgtcagtagcataaataaataaacttgaaacattcttgcgcttcttattgaaggtcatgtcacttgatttagtgctcaagagctt

SEQ ID NO: 41330 - DNA, 1002 bp, Homo sapiens
gggaggccgaggtgggtggatcacgaggtcaggagatcaagaccatcctggataacatggtgaaaccccgtctctactaaaatacaaaaaaattagccgggcgtggtggtgggcgcctgtagtcccagctactcgggaggctgaggcaggagaatggcgtgaacccgggaggcggagcttgcagtgagcggagattggcgccactacactccagcctgggcgacagagcgagactccgtctcaaaaaaaaatttttttttttggtagatacggggtcttgctttgtcacccaggctggtctcaaactcctgagctcgagtgctccttctgcctcagcctcccaaagtgctgggattacaggcgtgggctgctgtgcccagcaggaataatttctcagtgcatctctgatggggaggctaatgaagaaaggacacctggtttgaaggcttctctgtgtctgtccgtgggcgctactgatctgagccaagcaccattccgcaggcatgcctgaaatgactcccatggctgtcatggtgccatctggagagcatttgctcactgtaatggtcccgtcacacttgtctgatgaggatctgttggttgactttgacagtgataaacgaacacagcctatctgggtgttttttgcacttatagtttgggggtttgaagtactggctagaagctggcggggtgtgtgtgtgcaggtgtgcgagtgcatgtgcaagtgtgcgtgcaagtgtgagtctgcacttgtgtgcaagagaatgtgtgtgtgtgtgtgtttggagatttggacttgaaaattctagctcaggtctttggggtagtgtttgacctgaactctgaaaggcagagggtcccagactttcctgggatgatgggaactgggcaccccagatgaggctcggttgtgagtaggagcggggtgggccaccgaagagaagacagagtgggcctgtagggccagcccgaggtacccacagtggagggtctacaggc

SEQ ID NO: 41331 - DNA, 1045 bp, Homo sapiens
gaattgtggtggtggtaatggttttaactggtgttaatttcagttcttttaaaagttgtggtaagatacatgcaacataaaatgtgccctcttccccatttttaagtgaacagttcagtggcattaagcacattcagtttgcctgccaccgttaccaccatccatctccaaaattctctccatttacaaaactgaaactctgtccctattaaacactagctccccattccccactgtgccgcccccccaaagcccctggcaccaaccattctacttcctgtctctgagtttgactagggacctcctgtaagtggatttgtacaatatttgtccttttgtgtctggcttcttcatgtagtataatgtcttcaaggttcattcatgttgtagtcaggatcaccttccttttaaaggttgaacgatatcccgttgtatggacagaccacattttatccattcacccagggatggacacctgggttgcttccatctctcggctcttgtgaataatgctgctgtgaacacgggtgtgcagatacctgttcaagtccctgctgttttcttttgagacggagtctcgctctgtctcccaggctggagtgcggtggcaccatctcagctcactgcaagctccgcctcccaggttcaggccattctcctgcctcagcctcccgagtagctgggactacaggtgcccaccaccacgcctggctaattttttgtatttttagtagagacggagtttcaccatgttagccaggatgctctggatctcctgacctcgtgatccacccacctcggcctcccaaactgctgggattacaggcatgagacaccacgccccgccgagtccctgcttttaattctttggggcagggatccccaaccccctggtgatggaccaatactggcctgcggccccttaggaactggactgcacagcaggaggtgagcggcaggtgagcgtgcattcccgccggagccccgcctcccgtcagatcagcggcggcattagattctcataggagcgggaaccctcctgtga

SEQ ID NO: 41332 - DNA, 1033 bp, Homo sapiens
cattggtcactggcgcatctttgtggcggctgccctaagtctgtggcgggattccaatgtccaggccatctcagtgttgacattatggcttgtttttcttcattcaggttgagctattcttggttcttagtataaaaagtgatttccttgaaaccaggacgctctgagtgtttcatcgcgagactctgactcttgctcaatcctgtgttgtggcaggcctcctttcacgctgccctgtaggtcaagggggtaccacctcgttatcacccgcgagggtggaggtccagttcccactcagccatcatcgacacctgcaccgggaggggctcctcattcccactgggcagggtgggagttcaggcccctcactcagcctctgctgatgccgccctagctaggagggaaggtgctgacaccgccctagctgggagggaagggccacctgtactgctcctgctcagcctttgctgatgcagggatggccttgttgccgccaggtaatgatggtcccgactctgcccgacctcctctggagccccaccagtgcgggaggggagggtactgggtgcagccgggcaagggtgagtgtctgggctccccacacagcctgtgctgtggggaggactgtggtgttttccgtggtctgcctggggtagagcggttcctgcctgtcggtttctgccttgtcggtctgctcctctccctgacctctggctggagagaagaggctttgcgtgggtttttatggtctgcacccattggcttttttaggcagttggtttctccagcatccagctcagatgaggcagaaagaaaactgaaggagctccctgccgtgtcgatcgctggccccccggctcccggcccatccgcctccttctccacctttccagtcttaggttgcattacacatggagcgcaggtgttgagtggtactgacaggaggaattgggaggagtgaatctgcttcacgctcttggaagcggcagtcccgttactagagctcccatcttccttgactgctgggccttcg

SEQ ID NO: 41333 - DNA, 1069 bp, Homo sapiens
tgcgtggctgtgcgcgcggggacctgtgtgcggcgtatacgcattggcgtgtgcgtggctgtgcgcgcggggacgtgtgtgcggcgtgcgcgcattggcgtgtgcgtggctgtgcgcgcggggacgtgtgtgcggcgtgcccgcagtgtcgtgtgcgtggctgtgcgcgcggggacgtgtgtgcggcgtgcccgcagtgtcgtgtgcgtggctgtgcgcgcggggacgtgtgtgcggcgtgtgcgcattggcgtgtacttggctgtgcgcgcggggacgtgtgtgcggcgtgtgcgcattggcgtgtgcgtggctgtgtgcgcggggacgtgtgtgcggcgtgcgcgcagtggcgtgtgcgtggctgtgcgcgtggggacgtgtgtgcggcgtgcccgcattggcgtgtgcgtggctgtgtgcgcggggacgtgtgtgcggcgtgtgcgcagcttcgtgtggatggctgtgcatggcccttgttttcttcagtcattgcacgtgcagaagagcgacgtggacctgatgagaacgaagctccggcgcctggaggaggaaaacagcaggaaggaccggcagatagagcagctcctggatcccagccgcgtaagctcctggcgcttcacggacggggcaaggggagggtcctcggggcagcatctgccagccagccctgctgggggctacaccgaaggccgtcttcatgtctcaatctgcttaccacagggcacggattttgttcggactctggcagagaaaaggcccgatgccagttgggtgagtatggtgtgtgcaggacagagcctttccccagacgctagttactggggacagccacagagggacgcctttccctgcagcacccacgcgtgaagagcagcaggcaggggggaggctgcggacccccaaacccttctccactgacacctggggacaccacggggaggggggccagcaggctcaccacagaggccaagcaagacactgtaggaaaaacccatcacaacgggcgacttccccctcacacctgagaaaatacattaagcttaacaagcgctcccagcgcttt

SEQ ID NO: 41334 - DNA, 1019 bp, Homo sapiens
ccactcacccccgactggggaatcccactgccaggcttccagtgggtgaatggcctgggccgccgccagccctctgtggccggtaatgaccccctgcttggcggtcaggctgtgggatgtacacagggtgccgtgtgtggccgtgggagaccaggctgcctgtagcccccgggggagggaggcccggcggccaggaagcaccgtgggcctcaggcagggaggctggaagcggctgagcccaggcagacctggggggcggctgggggccctttgcagccctctcccaggggagcccttagcctggcatcatgccaggccccagcaccacccccatcgccaagctactgtcatttgagtgcggggcaggggaccaagctgtgggcatttccttcctgcctagagatccggattccagaagccccgtgaccagggtccctggtcacccggagtttctctctggacggatcatggcagagccccatggtggggtggggatggctttgcttatcaaaatggcttgggaatccggtattccgcgggcagcctagcacctggactcttcagaactgcgttgtctgtggcctcccgcatccagaggagggaggcggaagtggaggagcagggcacctgggagcccactgctcccagcctcgcgctcacttgcacccaggccccccagccgagccgatgacgtttcctaacagatgaggaagggggcgagggatcggcccaggcacgcccagacacagcagggaggagggaggcggaaggattggtataaaatctcacgcctgcgttctagaagcccagccctgggggaccgttcagtgtgggggcaatgcacattcaggaacttctggaacttattccatgctgatggctttgccacttgtccctggaggactctgttgaagctgcaaggagggtgtgcttcactttggaaagttctctgccctgagggtttggcccatttgtcagttcttaagctccggggcagccctggggcgtggggggcggct

SEQ ID NO: 41335 - DNA, 1048 bp, Homo sapiens
tgtggcgtgagctggtcctggcgtgcgtcctgcccctgcccttccaatactggtgcttttcggcaactgcttggtgtctctgagccttcattgcctcatcctgaatctgggctggccgtgcctcctgtgtagggtcacccctgggaggcaagggccaggagcccccttcctgggagaatgggcagtgggtgggcctgggctgtggcaggcgccccttcctgcctcccctggtgaggagttgctggctgtagtggggggtggacccctcacccatcctgactgagggctccctcttagctgtctctgtgctgccccaacctgggctgtgccctgctggggagtgggcatctgccccgtggttatgggggcggggggatggaggggaggtggggcctggggttgggagttgggggtgtggcacgggggactggcctttgtcctttgctatttctggcccccgtggtctgctgttgggaaccctggtgaaacccccggagggaccagggccaggtcctgtttcaaggccctgcgtgggactgcctgtcactagtcacttttcccacagccccaggaggtggggagagttgtccattgtacagattagcaaactgaggctccgaatcacatagtgagtaagtggtggggccgcagccctgctgtaggtccctcgtccggccccccgaggagccggggtcagcctggagtcgcaggctccccggattcccccacggctgccttgccgctgggggtgtgaccgtgggattagaagctgatgggggctgagggagctgtgagagggcagggggtggaggggcatctggggtcggctctgtgcagctccccagccagtgactgtcgagaggggctcccgtgctgcctgagcatctgagtgaatggggggctgttgttcacaggagggatttggaggcccacaggaggcctgagactccctggtggccctgcagctgagctggcagggctgggcctgaggcctctggcgtggcccggggccagtcagtgctgcatagtgagtcctgaatgtcaagtg

SEQ ID NO: 41336 - DNA, 1642 bp, Homo sapiens
tatctcgctctgcctccgttttctcatctggcaagtgggagtgggtggctctggcgccgctgaggaagtgatctggacctggaagccctttgatgtacgctgatgccccgagctctgggtggacatgccaggccggtggctgcggaggtcacacctgtttaggctctgcgtaatgcgtgtctgggattgacctgctcttccagtccccagctcctcaccccaggaggagtttccctgcgaggctgtgagtcccagatgtggggtgcagtacagacaggccctcctagagtcatgtcccaccggagcacagggtcgggggagcgagggtgactccagccagggactggggaggcctctgcaagtggagagcagagggagggctcgctggaggagtctgaccagcccggggccaagatgcggctggttgacatggcccccaggccatgggagcccaggggaggccctgtggatggaagtgcagacgtgggcatgggtcctgtggagctctggtcccggggggcatggtcagctgcccctacaggtctgttctgccgttggcctctgagctataaggagggtactggcagggcctgcagtcacagccggtggggtcagcacctccactccattcccagccccacacaggcaagggcagacccagggagccccagagcgtggcttttccaagctccctaacgtttatagacaacccactgagcacagagcatgggtaccgtgctgggactgttaatatgaggccctgccaagtgactggactgtctccgcctccctgtgtgatcttgggtaagccctactgggccctgaggacccctctgtgacatgagctccctgggaccatgagaccgccctgagctgattcagtttcagtggctctggtgccagccctgggtcctgcccctggagggtgggggtgcagggcccagcagtcctcctgccattgcaggggcggtaggcacttgtgcatggctgaaggagtgggagggtgcccgcccctgatgctctgcagtgcccagattgctggctgctgggcagccgtggacacaccggtgtggctttggaccatggcggctcatttctgggtgtgccgggctggtcagcacctccctggctgggtggaggtggaaaggccgccttcgggtgtggacgtcggccggcttcctggagggcaggacacggcatcctcccactgcctggcaaccgtctcctgggagatccagcagcaatcccattgcccactgtggctgagcctctcatcccaagggggggccaggcaggggaccatctgccccagcagctcccaaggctggggtcccaagagggccacactgctgaagcattgagatgtggggagagaggcgtttctctgcagtagtgccaatgagggcagcgcaggtgtgcctggtggccaccccacaacactgagggccccagctgctgacaccccccagggcacccccaagttagcctctaggtggtccctggccccatgatgaggcgcagccctgtatcagctccccatccctcccccggcacaggaagtgtgtggaggttctggagggctgagccgggggcagggctatgctgaatccagggacctggggttgcagggcctgtgtgcttt

SEQ ID NO: 41337 - DNA, 1059 bp, Homo sapiens
cggtgctgagtgggggtgagtctgtgtccacggccgtgtcccagcgggttccccagggttgggctgagccaaaagagtggggtagctgaggccgagacacccctgccctgtgggtccatggtctcagggagacaggtcccaggccaagatgctagtgagcaaacaggaccacctttcccaagtgggaggctctgcaaagaatgacaggaactatgtggggtggcgggtgcccgcgtggcagggggagcggcaggtgacccagggctgcttcgagtagatgcccaggggaggccaaatgggtggcattaaagtacagccagaggtctgggtgcagtggctcacacctgtaatcctagcactttgggaggccgaggcgggtggatcacctgaggtcaggagttcaagagcagtctggccaacatagcaaaaccctgtctctactaaaaatacacaaatgagctgggtgtggtcgtgggtgcctgtaatcccagctactccggagactgaggcacgagaattgcctgaacccaggaggtggaggttgcaatgagccgagatcgcaccactgcattccagcctgggcaacaagagtgaaactccatctcaaaaaaaaaaagtagagccagaaggacgctgcatctcttctaagagccccgaggcaggaggcagacccgaggggagaatggagggtgggaggccagtggggctgagtctctgtggcaagcttcgctttattccagggggaggccattggagggagggaggcaggggagagatttgacccatgattgaaggtccctttcaaagcttcctcaggcctcaagggttacaagagtgggtgaggaggatacctcaagcaggagacagcaggggcttgaataaatggagcaaaaggtggacagggatgggctttgagggcggagctggcaggacttcccggtcagttggatgtagggagcgagagggacggagcaggagttggcgtccctggtttcagcagctctgtgctgcgggaccataagctgtactgtgggtgggggagcaggtctggaggtgggg

SEQ ID NO: 41338 - DNA, 1091 bp, Homo sapiens
cggggagggctggtgaccgctcagtgctacccaccactgtccttggccccggtgctatcatcctggtccctccaggtccctactgtagccggcggcctttggggggatctcatcaagtatgagcagcgccccctacacgtgtacatgtacacacgtaagtgtgagctccagcctgcgggccagacagcccctcccagaaggcagcaaggccagccacgctggcttcactgcacaggcggccacagtgatgcctggtgctctcctatgttgttaaatactttcatcattttttgaacttttaaaatgtttttttttaatgttcttttataattggaagaactgaacttgtaaagagttcggaaggtggaacccaggcaaggggcagtgtgtggggactctggcttgatgggagcccagaccccactgccacacacacagacataggcatgtgtgtaaatgcatgcagacacacatgcgaagacatgtacacacagacatgcacacatataaacacacagacacatgcacaccggcacacgtgcacacgaaacgtgcacagagacacatgcacgtgtaagtaaacatgcagacacatgcacatgtgtaaacaggtgcacacagacacacatgcacacatgtaaacatgcacgcagatgccctgaagatatgcgtgcagacacaggcagacgtgcacgcagtctcacagggacagctgttgcagctcagccttccctgatgtctctccgcagacatcctgcagtactacctggcctgctcgccccgcgccgccaaccccttccagcaggtgagagcctgggaggccgggactgggcttcaggagagtctgaagcacattgctgtgtgtggaggggcccagcaggcctggcgcctggctcctcagcctgcaggactggggaactgggggagggagctggacaaaggctgtgtggatgtcaccaacagcccctggggttaccatgccggtgacctggtgacctggctgagagcctttcggggggacctgctcaatgcacccgcatcgctgggactgcttttgctccttggattggccttggtgggggaaggaggag

SEQ ID NO: 41339 - DNA, 1050 bp, Homo sapiens
gcacacacgtaagcaccggtgagcacacggacacattacaggactgcgctcactctgcatggagagttttgtcagtcagtatgagactcttcccttgtctttagctgttccttgaaataatactttcaaaagcagagcaggtccgtgtcagtagacacgtgggggttcgctgtttctcccattacaataaagggaggtctgtcttcacgtagtggcgaccacactggacaggcgcttctgggtcctcatgtccttggtagaccccacgggtctgaggaggggcctggggtcaccatttctcaaggcccagagtccttgtcctcaggacctgcactgagaccccagggtggggggtatctcagtcgaagattatgggctggagggagacctgggggcttcccagatggggcgaggctggctcgaggtcccccgtccaaatgaagtgctgaccatctgcggtgcgtgccccccaggaccccctcctccgcgtccaggaggtgctgaatggcacggaggtgaacctgcagcacctcaccgccctggtggactgccgcagcctgcatctggtgagaggcagggcctgggacagggccatggcagcttgtagggtgggaacaggggagcagctgttcgggaggatggggaccctcagcagacagtgggtcctcagccctgcctctggggggcggtccaggccgccgtggctgggctgaaggtctcacgctgccccctccaccctccctgtctctggatcctgccatctcatcccacggcctcaggactacgtgcaagcgctgaccggcttctgctatgacggcgtggagggcctcatctacctggccctcttctccttcgtcacagccctcatgttcagctccatcgtctgcagcgtcccgcacacctggcagcaaaagaggtgaggggccctggggggtcgcaggagcttgccccaggccacatggcatgcgggacacttcaggggcatgcctttatggacacccatgtgccagtcccagaggtgagggacagacacctcctcacctcgtgacc

SEQ ID NO: 41340 - DNA, 1025 bp, Homo sapiens
agcatttattaagtcattttgtacagtgggatctgtagattgttagagcaaccaggttcaagtgaagaaatctaaatcacttaggatgacctttaaaataatgtgtttattaagttttctttttttaaacagtgacttgcattttgcactaagacctgtacgttcatacatttgaagattggtgcacagactgaaatggtggggaaaaaatctgccagtggctttgttttgaagtatattacatagatttcaagtttttatcagttgcactttgaaggttgtgtaaagcattgcattttaacaactgaaatgttaatgaaaatacattttaaaaatatattaaggcaacaaccgaactttgttaggaatattttattcctttttggcagtaaaaacattggtacctgttttacatttatatggcttatgaaagtgtacagatcttttagtgtaaaatttcagataggttgtcacaaattttaagttcattgacgggtttctgttctctttgctctgtgaaatgtgtaatatatccatctttttttatatcgtattgaaaattcatattacagaggagatgtcaccatttgacaaaagctcatgtatcttgaaaatgaaaattctggtgctgttataagagatttctgatgggatgatgagttggtcatatgtgcaggagtgcattctcttgaatcttatcagatgtaacattctaaatggaatagttaccactacgttggagcgcctcctaagtaccatattattacattgtagctaggtgaagctatgactaatttctctgcacctcatgtaagtaggctaggtcgtgtattttgagaaaaaacgtgcgacattgatcagtaaaagttacatttttataacctaggttacagaccctctatgtaactgatcatgatgggaaccgccaggttcaggtcttccaaatgtaactttaatatgccctggagtttcttctttctatgcggtgatgagaatttctgagttgtatgctctgcttattgctg

SEQ ID NO: 41341 - DNA, 1829 bp, Homo sapiens
ttcagtgaatccctgaaatgcaaaagtctgtcacagttagatacctacctgccagttattgatcctatacctgagatctgttctggagaggttactactcttagagcttcattatgtgaacagtgttgccactaaatccaaatacaaaaatcatgattattatgggagcattgctgtagggaacccttgtttatgtatgtgcaattctagtgtttaggtggttggcttcctgacagaaagctccaaagccagaaactcattccatcagcctgataccaatctcctgtgggtattgtgggaatgaaagcagtttttataaagctttcctagaaacatggatatagtaaatggaaaagacattgggctaagtatcagtaggcctcgtttatacttcattctgtaactactgtgcaatatgaggaagtctattagtctctctgagtctgttttctcacctataaaaggagggattagactagatgttcagaattgttctactctgattctctgatcttctatatgttgtcttcctttctgcccttcactagagtctgcatgtgtctcctgtctggggattctgtaactccatatgtcttagcttagaacctaattttcttcattttacttttctcagagtatttacaatgttgaagacaactaagatgcaatgtagtatttctccttaggtgctgccgtctaacacatgatatatttactctagcctaaaaatggttcatgttcaaaattttaggttctgtaaaacaaattggtgccataatttatcagtataagcctgaaatttggagaaataaattttcttaaaatgtgagatgcttatttatatacatggctggaagaaggggcaaggctaacaaatctggaggtaattaatgcagtgagaaacttaaaaagatatgagaaaatggcgatggatgagaatgtttatatttactgtacagtgaccatcagtaatgaaagagattagtagatgtctgtttttgtgcttaacataatgttatgttggtttaattgtcttcattaggggcttttagtaaaacaaagggtctttaaaattaacacagtaatttttcactttaacaggcttaactggcactttattgatatacagacaatgtctagtgaagataacagctatcaattaaatagtccaatttcttgaaaacagatagtcaggtaaatctatttctgatttttggagattaggtagatgaacatgggtaagactatagtttctgcagtgtttttggctttggttcattttcaaaaaaattttttttaaatggataaggctaggctttagagttgtgggttcaaagaatgggctagaccctggggtccatattattacgtagaattagtctttgtgcagtgtttggttgccttttctcctttctataactctccatggtattctagacctaattctttaccttgagggggttggaagctctcaagtgtgtaagcttaattttacaacgatgaatagtctttccaatgagaaaaaaatagagggagataaccacgtaatgactatggtgatttggggaggaatatggaaacttggggagctctggtagttgcctttattaagaatagttggtagcaggaattttagcaacccaagcaggctaattagaatatatttcagttttagagtaaggagggattttgtatcataaaggtataacctatcatacttaactaagggtgctgatttccacaggtggtagtatttgtgagtccctctctctggtgtgatccttaatttattttgtgtgtttgtgagcctgttttcaaagtgaaggtca

SEQ ID NO: 41342 - DNA, 1101 bp, Homo sapiens
agggagcaagtttccagggatgcaactttgatttatattattgtatagtcatgcttttacttctgattttttttattcagcatttattcagctcttacagtaagctgtaatgatttgcagaacataaaagaaaacatggctgttaccctaaagcattttatgtaacacctttaaaaggaagagatacatgagttcacaaacattaagcatatttatgtatttgccggccaaaggtatttttactctatgtagaatttgttttatttttgccttgtaggcatattccctttttctaagcgtgctgtcttggctcttctaaaatggttgtcttagctaaaactcctggttgcaagctagaaactcagtctgaactacttaagaaaaaaaggattttattgtaggagtcctggggtatcacagtataattaggagaatttctttacatttggcaagtttagtattcacttccacctagggaataactagagccacatgctcaaaagctcccgggtactgtccttttggccatcatctctcagtttgcttctgtgtctgtgctggcatcattctggattcactggaaattgctttctttttgtggctgaaacccagctgtcaccactctttgcattcctattgcttcagaccctcaaagatagacttaaagctttggtgctgagtccaaaatctgtgaaatgatcagatttgtattttaaagtcatcttgagtggggggaataaaccattatttttgttgcaaaattgagaatgggttggaagaaaccagaatgaatgactgtagatgtgttggactgtaacaacaattgaggtgagagaaagtagcagcttgggctaggtggtggtgctggagatggagagaggtagatgcactagagagggatttaagaggcaaaaaatacatgggatttggtcatgggttgggtatggaaggtgaatgagaaaacatcaaaggtgacgtccaggtttctggcttgcatgactagttggctagtataaccattcactgaggttggaccacctctgggcagcatgatcattagtttggttttgaatttattaatgtgagggacctttgaggcat

SEQ ID NO: 41343 - DNA, 1025 bp, Homo sapiens
cccagaaatgcttgtggagggtcttgtaaggggttgagtgcctgtaagagcatctgggggcttagaccggtggccctcaaggtattaattccttatcagtgtgttcccatctacacccatggctggtgtggcctaaccaagctggcttaccttttagaagtttctttttattatctcctcaagagtacatgctctggcttcttggcctggcaggctttcattacttacatgatacatatatgtactctttgataatcttatgtttttgtcccttgtaagtttctgcaattgtatactgcattgatgaaggagggtctgctctcctctcccagggtgtctagtgatggcctgcatgtctctggtctgtttattgccaactcaagtaccttttttgccattccatcgtgaaagaaatcaaaatatagcattttgaaatacatttgaaatgttctgtttaaggatttcactttagttatactgtttctactttatattacaaatctggtttcctcttccatttgcctatatctaacccattcttagtctttttttttttttttttgcatttgcttttctgaaaatttgagcattgaaagggagggcagcttgatcatggaccagggctttctgagaatgcgaaaaaatgaatttcaccttgccaaatagaattgcctggatgtggtggagggatatgatgaggcagaatcacaattcttctacacttttgaaattgttctccccaatttattccccctttcctcattctcttctgatgtatgggtttaggaagctccggatgactgtttcacacacgcactcccctctcattctctcctgcccgtccttcccaccgcacacatgcgctgaaggaggtgagcattctggagacctgagtctcatttccagatatctttgccatcgtttgcagttacagctttttttttctatttttttccccctatctcttgtaagttctcatattatacatactttgaactgtggagatagccacaagtaaaataaaa

SEQ ID NO: 41344 - DNA, 1050 bp, Homo sapiens
tcagtgtcagagttccctgttaaaaaattagccttaatattgatttcctcctgctcccaccttggttggtatatgaaaaccctaaagatgaagcatttttaactaatttttgttctttacacataatcagaaatcaaactaaatccatctgtgatgttagcttatggtctttctagattttagccaaagatcttgtatattttaagcagttgccctgttttaatattaatcatggccatcccagaataagtcctgcttgacacagggcatttgttcaactagttatctttgttaaaaaagaaaataccataagaccagtcatattttgctgcatctagagtgagaccaaactttataatatagtgataagcttgaccaaaaaaatgtttaacaattttggtatgtttcaggaattggagaaattagtatgttggtactgtaaggaaaaatgtgggttaaaaaaaaaatccagctaggactcagcagtcttaatttaaaccttgtgcttgacaaaaattgaatgttgcctgtatactccagacacaatcgtgaagctcagtttctgtatttttcttctgaaatttaacttctgctaatataacataggatatgtggatgtcttgcaatcctaaaattttaagatatttcagggcttatcaactgaaggctcttgaaatgaaaactactacatgtattcatcatacgtgaaataaaatctttttgaaactaaaaatcctttaaaaaattcacaagcaagatgatactatagaatttcttttgacagattccttagaaacgtcaaaatcaaagtgaaaacaagttggaaaatcctctttgattttgctgggtcacttaatttgagttgatttcttcagagcacataacgtttcttaaagtacagtactaatgacagagtcccaggtggccagccttgtgagctgcgaactttgtcctgttgtactacctctggctctagagactcagcctaggaatgtgaattggtgagaatatgtcagaacctggcttcctattgtaggaactcagtgcact

SEQ ID NO: 41345 - DNA, 2110 bp, Homo sapiens
tcaaacagtcctcccacctcagccttccaagtagctgggatcacaggtgtgtgccgccacacctggctcatttttgtttttgtttttgttttgccatgttgccgaggctcgtctcaaactcctggacccaagcaagctgcccatctcggcctcctagagtgctgaaattacaggcgtgaaccaatgcaccagaccaggttttgcccttttgtttgcaggtccctttaactgtgatgctgtctcctagcccccttcccccactcgaccgagggccaggcaaattccaactcatttgctgagtttcagtcttcaccaagtctgtgaacttcaaaagacgttattcattgttacattccctgcatccggcacagtacctgatgtctgatgggaacccaatacatgtttgagtgaatgaatatgttgtataattcttttttctttatcacgattgctgctggtgccgattgaatttccagagcttgctgtaaaagataggaagaaaatatgtggtaacattggccagtgtttgggccataagatgtgtagaggttctaaggaaaaatacacttccaaactcattcacattgctggtcatgttcagttcctgtggctgtaggactgaggctcctgttttcttgctggcagtcagctggggccacacactgcttctagaggtcaacttgaattccttttcgtgtgccccactccatcttcaaaccagcaatggtgtgtcaggtcctttgtatgctttgagtatttctgacttacgtttttagttggagaaactctgggttcatgtacctagatcaggtccaccttaattatttccctgccttcaggttaaatgtgctgtagaatatgacattgtcacagaagtgagatctcatctttagttacaggttccagagtatggggcagaacatttttgaattctgcctagcacagtgtttatagtttattgatctgtagataggttgggtaaaggttcttcttcagccagtaaaatgtcatcttctctgtcttttgattgcagggtttctattacctatgtccatttctttaagccgtttggtctcatattcctctgtgtgttacaagaattgtatcatgttatctatttcatgtagaagtaagcatgagagaaatgagtgtaaatgggctgttggccctcacagtaaaatctggtatctattctagggagatactcatgtttttctcctttttcacattgctgtcgtagggtcagattcatttttcatggtcatttttctggttctcttttagcatttgaaattgagtagattgttttgattgtaagaatgttttttaaaagtaaatttttattaaaatgtatatatggaaaggaagacaaatagtatattgcttgataaattttcacaaagagacatgcacatgtaattaatacccaaatcaaagcattagaatatttactagtaccctagaagccttacctactcaatagctcccttaaaggcagttttttgcttgcctgttaatttgatgaactttcagcctttgaaaagtcgttacaaaaagccgatgtgtaaaatgtttggaggataggataagaataggaggtggctcttggaagtttgtttgctcctgagtatgggacctagtgatcaaagatgaagtggaactagatactttatcttccctgtaataggaaatacactcccattgtataactgtaatttttactcataaaaatgggttttgcactcaaagcaaaagtaggctcttacttttactgttaaaatagaaactggaaaactgttctttagaaaagtcatcctaatgggttcaatttgaggtagttgctggtttttatatttttatttttttgaccagtgctttaagtttttctcctgtaattttattaaacctatgcccaggaaaaagtaaacggcaagatttcagaatctgaaagtttcttacgtttgaaagaaagtcctcccatgcttcatttttcctaacagaaggtaaactttccatgctgaacttgtctctatttttaacagaggacaagctttaggaaactgtattcaagccacatatagtgtggtagattctggtggtggagcagcta

SEQ ID NO: 41346 - DNA, 1079 bp, Homo sapiens
ttaagttttacaataaaatgtaaccttgcaatgtagctttgcattttatggtaaacattagttactgcttactttacaggtactaaaaatcaactacttcaatttcagaatgtaactttctcatgccttattttatttcgaccagtattaagcctctttatgcttagaagatggtgttgaatctgtttcaggttaaaaaatactttattcaaactattattttcttaaaagttaatatgtctaaagtttttgaaagacactgatcactgagatgtttggagatttaaactggtttatttttggttatccatggaaaactttaaaaaatttctttattgaattatagttttaagtctccttattttattctcgatgattaatgtacagggcgtggcttacttataagtgtgactaaagttgtgcaaattaatcctagcagggctccatcctttaatgtcagtgccgtcagttgttctccccttattcctattattctggcattatatcttatctgtatgtaaattcttattctgtgggtgaaaagggatatggttcaacaggatccaagaacttaaaaattgccctttttcacatttctcataagtagtaagtctcctaaagcgaagtcagagtcattataaaggcatgataatggagtctgttatctatttggaaaaacaacttttattgccatttataataaatgtaaatggcctgccatttattttagaattactctgtttctaggccctagaaaggctctgcattttataattaaagttagtagaggctagaagaacttataggaatgtcataatgtgctgtaggggacagtgatacttttaaaggttctgacattcagccagtaaggtgcttctagttccagataacttcttttccccccaggaatagatacagaaaatatttttggtaaatctgccaagttttttatgtgattctcattatgttaaattttattatcagtgcctaaataatgctaacattttaagttaaacagttattcagcttaccactttgacattaccactgattagaattgaaggctaagttgagcctgg

SEQ ID NO: 41347 - DNA, 1033 bp, Homo sapiens
gagtgacataaacctaaatcatgtctttccactgctcacttagattataaatactattgcacttagaatacaatttaaaatccttgctgtggcctacaaggttctgtgtggatggtcccagttatctttctttatttaccccctaagcattatccacctggcttaccaagttacttccaagctgtctcctgattgttctctatttaaaacaactgctttattaacttactgggataagatacataatggtacttatcttttttttttttttctgttccccagtagactataagcttcataggtaggaatgttattttgcttcttgtgttatcttttcttcacctggtacatagtaggtgctcaaatatttgccaaatggaagatggggacagggaaattattctacaggtcttgtcttaattggaagattgaaggataagagggtctttgtggagaaagtagtctgtaagaaatagtagtaaaatatgggactgatcactactgccaggaagaggaaagtaagcactagaactttcaaattcacagaagcaaaaatgaaatgaatagtaatccaaccagaccagtgggagtcaggaaaggaaaagtagaaactgcaagatagaaaagaaagatgaagaaatgggaatgggccagagatttactgtcttaccaaggtggagcagccccatttctctctaccctcttaggactcaaaatccctggacttcatataacaaagaagcataggaagatgctgaaaggtggagagaagactgtggccactctagagtcctggggacttgagaaatgacaagggtgtcagttcccctccttactatctcccacatgtctagtacagggcactgcagaagcctccatccctgaaccaccagtaggcacagacagcaaaactctgagaagagcctgttccccatagccagaggacaggggaagggagggtggtctaacaaaacagagcttttgtcagtactcactctgctccagctaaaccaaggaaactgccctcctccct

SEQ ID NO: 41348 - DNA, 1087 bp, Homo sapiens
cgaagagcagaagtcagtgaaattgaaaagaggaaaaagaaaaatcataaaaatcataaaaagttatttctttgaaaagatcaatgaaatttagcaagactgacacagataaaaaggaataagacccaaatcagtgaacaggaatgaaatagaggatatcactacagaggctgcagccattgaaaggataattaggaaatcccacagataactttgtgctcataaatttgacaatgtagaggaaatatctttagttttaattagctttttattttagtttttctcaaaaactaaaacttaataaaactcaaccaagacaaaatagacaatcagaatgtaggcatacctcagagatgtggcggatttggtttcagactactgcaataaaccaaatatggcaataaaaggagtcacagaaagtggtttcccagtgtatatatataaaagttacatttactctatgaagtgcaataacattttgtctaaaaatacacacagtaattgttgctagaaaatgctgacacaaagtgagcacatgctgttggaaaaatggtgctgatagacttgctgaaagcagcgttgtcactaatcttcaatttgtaaaaaaacaagtaaaattaaaaaaattggccaggtatggtggctcacgcctgtaatcccagcactttgggaggccaaggtgggtggctcacgagctcaggagatcgagaccatcctggctaacacggtgaaaccccgtctctactaaaaataccaaaaaaatagcggggcatggtggcaggcgcctgtagtcccagctactcaggaggctgaggcaggagaatggcatgaacctgggaggtggagcttgcagtgagctgagattggaccactgcactccctggagcctgggaaacagagcaagaccccgtctcaaaaaaaaaaaaaaaatcatctatgaagcacaataaagtgcaataaaacaaggtatactgtaatgttaaagccattaaagaaattgaattcttaattgaaatgctcccttaaaaaagaaaaaatctctgggtccagatggtttcactggacaatttaccaacatttaaagaag

SEQ ID NO: 41349 - DNA, 2610 bp, Homo sapiens
ctagaaaaaaaacttcttgaactgaggagttcaacatagttgctgcatacaggatcaacacaaaaaccatgtttctataccctaacaaaaaatatgcagaaactgaaattaaaaacacaatgccatttatgttctaaaaattgtgaaaaagatacaaacttcaacatgtgtaggatatttgtgctgaaaattacaaaactgatgaaacaaatcagaggacccaaatgttgccacaaaccatattgacatactggaatattcaacacggtaaatgtgtcagttctccctgaattatcgtagcttttatgcagttcctatataaaatcccagcaaagatttttggtagatacataaaaaggttattgaaaaacctgtatggaaaggcataggccccagaataactaaaacgatctagtaaaagaataaagcagttggaatcactctactgatattaaagctttcccttatagtgatagtaatcaagatacacagatcaatgcggtggaacagagaactaaaaaaatacataaatatgccaaattaatttttgacaaaggtgaaaaagcaattcactgatagattattcttctcaacaaatggtgttggagcagaaattggacatccatagacgaaatgatcaaccttgatctaaattttatattttatacaaaattaactcaaaatagattatggacataaatgtaaaattgtaaaactcttaggcaaaaaaggagaaagttagccaggtgcggtggctcatgcctgtaatcccagaactttgggaggccgaagtgggtggatcacctgaggtcgggagtttgagatcagcctgaccgacatggagaaacaccgtctctactaaaaatacaaaatcagccaggtgtggtggcacatgcctgtaatcccagttactcaggaggctgaggcaggagactcgcttgaacccaggaggtggaggttgcggtgagccgagatcgcatcgttgcactccagcctaggcaacaagagcgaaactccatctcaaaaaaaagaaaaaaaaaaggaagtcttcagaatccagaactaagcaataagttcttagtctttacaccaaaatcacaatccataaaagaaaaacttggtaagttagaaccagttaaagactttttctccatgaaagagcatattaagaggatggaaagacaaggtacatactagtagaaaatattttcatctgtctgccaagagactaatacctagaatatgtaaagaactttcaaaattcaataggaaaaaacaatccagttggaaaatggacaaaagacatcaacagacttttcaccaaagaggatatttaagtggcaaataatcacagaaaaagacatacattcagtattactagccattagggaaatggaaattaaagccatagggagaaaacttctgctaaatggctgaaaaaaaaaaaaaagcaccaaatgttggtgaagatgcagagaaacattgctcatacattgctagtgggaatgtaaaatggtacagccactctagaaaacagtttggcggtttcttataaaactaaacgtagaactatgatacaacttggcaagtgtactcttggatagttatctcagagaaatgaacacataatcatgcaaaaacctgtacaccaatgcttagagaagctttatttataataaatacccctacacaggaaacagcccagatgtccttcagtgaacgcattattgaaccacagtacttctgtatcatgattacttctcacaataaaaagggccaaagtattgatgcacctactgtgaatctccacatcgagtgataaaaagcctattctaaaaggttatatgttgtataattccattgatgtaatatttatgaaatgacaaaattctagaactggattagtggcttccagtggctaaagagcagaagagagtaggacggacatggatgtggctaatgaaagagtgacatgtgggatccttgtggtggtggaaatactctatcttggctgtatcgatgtcaataatctgtatgtggtattgcactagctgttcaaagtgtcattgttgtgggaaacttggtcaagggtgaatgggatctctgtagtatttcttacaactgcttgtgaatctgtaattatctcttaataaaaagttaaatatgaatggactgacttctattagaagacaagattggaaagtgccttaaaatacaggtgataacaagtaactcttcaattgttaaaggggaagatgaaagtgaagagatgggcaaaaagataccatacaaacaaaaaacagaatggcagtgttgatatcagatcagttgagactaacagttgaaagcagtaaacatattacggacatattattgataaaagacatttatgaagaggataaactgtgaaggtgtacagacactaaaccatagttgctaaacacatacaaccaaaaaaaaaaaaaaaaaactagaaatgcatgtatattttcactaagtttagttagatcaaacaaagcaataaaaggaatattttgtaccaaagcctatggacacagtgaaaactgtgtgcaggggaaaaaatctacagaattaaatgtcttcaggatt

SEQ ID NO: 41350 - DNA, 1048 bp, Homo sapiens
aataacaaaaggtcatgctattggtgatgggtgggtaaggtacctactaacagtaagtttagcttagggagaggtaagccattttaagtctatcagtatataatggatcacagaaggagagagtgggagacactcagtctatcagaaaacataggatggatgtgccacagaggaagaagttgtcacttaacaatgagtgtggaaaaaaacaaagtttatcagtgtctgtgtgggcgttatttatttggggacagcatcctaaggcaggcatattcccacagtggaaatggatgtggtgtgatgccatgaacttgtgaagcaagtgagtccctttgttgtgattccaaatttactcagcacataactgattattatctgctccccagtgtagttgtagtgggacagattacattgcccagaagagttcagtattcagtcttcttggtggttattttgttgtaaattaataatactgatagtatgtcattttgctttttataattgattgtctttaactttgccctgaggcatttttcctaatcaactctagaccatgatagagcctttgggccacaagactaacagtcttaccttgaaccaccagtcagtgaggtgtttgggaaaaccttttcctggtgatgtctcatcttttccttctacagtcaccaatgtcatatttactgtgttaagatgctaggctttgtactggcttgtttacttctcacgatttatcttgcagtatgatagtttgtgtgacactgaaaaaaattagtaggactgttaaaatagttttttccccccattaaaagtagaatgacaccgttttgcttctgaagaatttggctttaactggtttatattttgagctgggtattaaaggagaattatggtagggtaaacacaattagtgacatctggttgccccaagaatcaataatatctgatactacatacataaatagatatctatgttgtgataatatatcttagtttcactgggtaaaactagaagaataaaaaatttgaaaacagcttggttactgactaa

SEQ ID NO: 41351 - DNA, 1054 bp, Homo sapiens
taaatagactagaggattctgctaaaagacacgtcagattggattaaaaacatctgagatactaggtttacaagaagcatatctaaaaacaaagatacagaaggcaaaataatggaaaattttatttcaggctcactttaagcaaaataaagctggtataacatgttgatatcagacaacatagaaatcaaggcaaaaggcattagagatgaagaggatcactgcacagtggtaaaaggttcagttcagatataggtacatattatataaagcaaaaatatacagaaacaagaaaaatagctgaatgcacaatcctagtgggaagttaacatacctttctgaatagtacaacttgcagacagaaatcttaggatatggaagacttaaagaacatgatcaatgaacaaatctgacctcatggacattcatagaatgttacagttcctgtataatccattcttttcaagcacatggagcatctgacattgattacatataggaatataaagcaagtattgataaatttcaaatgattgaaatcatgtagagtatttttcttacggaattatagaaggaatcaaccaaaagataacaggaaaatccttgtatgtcaataaattaagaagtatatttcttataatgtataatatataattttataaatatataaatatatatttataaaagtttcatttaaaaagttttacaaaatggaaaaatctgtcacttaaatacaaaatcactgtacttctgaccctactaaatgtaaaaattgtcaggatttgggaggttttttttttgatgtccaaatacttgatacacgttccagagatccccaatatttttgtgaattcttcttaggaggctagtgatcatgtatgtgggattaggaaagtaattgtttgagctaaatgggggaagagatcattcctgctggtagcagggagggtgtgccacgacgagagatctgtggatttactgaaaacacgagatttacatccagagcttagttcacaggctgtggctcctgtttttattcatttagaggctgata

SEQ ID NO: 41352 - DNA, 1028 bp, Homo sapiens
caaaacaaaaaagtaaattggagtgcctcatacaggagtagattgtttgctagagaatggtggtagtggacatgtgtctcaattgtattcattttcagtttgagtgagtcacttttcatcttgtgcttttctaacacctggaacctcttttccaagaaactctggttccttttaggggagaataatttgaaaaccaagattctgggtaccattgcaataggaggccattacttcagaactctttcagtggtcggaactaagaaataaaaataattgagtttgtatcaatgttttcaattcaaatttagcagaaaaattcttccccttaacttatttcattatatatttctattcattttctcttacactgaaaatagtgatttcttaatgatatcaacttatttgctttatcttactatacacataaatgttttaaaattgctgtattaaaattaaaactattgaataaaatttaagatttccttgcaggtttttttgaagggcatagtcctttcaatatatactgctgaggatgtagagacagaacactgactttagaagtctcttcaagtcttttttccaggctgggcgtggtggctcatgcctgtagtcccagcactttgggaggccgaggtgggtgtatcacctgaggtcagtcaggagtttgagaccagcctggccaacatggtgaaactctgtctctactaaaaatacaaaaaaattagctaggcgtggtggcgggcaccggtaatcccagccacttgggaggctgaggcaggagaattgcttgaacctgcgaggcagaggttgcaatgagccgagattgtgccattgcactccagcttgggcgacaagaatgaaattctgtctcaaaaaaaaaaaaaagtctcttcatatattttttctgtgtagatattttaccgattcgatgttaatagtggtttatttctgtttctctaattctgagttttcaatttctggattaattctttccatataaataggtttgaagtcaaaattaaataaaa

SEQ ID NO: 41353 - DNA, 1034 bp, Homo sapiens
tatttttatttttattttttgccaggaatgagttttaaagaatgtatcttttttatatttgtaatttgtcatcgttgtaatttcatgtgatctggatctttaggtacatgtttcacaatggatggaatagaaaagttaggaattttgtgtaggaaagcaaggaatagaatagaaaataaaatagaaaagttaggaattactttttatgtttgcattctctagctgctcactttttttgactatatttcaagccaactgtcacagggcatcattccaggtcctattttggtttctttcctcagtcaatactagaaaaccacagagtgccattcccggcatttcatctatcccatacttgtcatttgtaaaacaagtgcctagtgatgttaattatttctgtagagttgcatttatgctcttttaatttttctgtatttgtgctgaatttccatagtctgtggacagatttgctctgggtgctatagtcagctgagttggagtctagaccatttataacttaactcttcgacctatttaactgtctgcttccttgctcttagtttgagttactcaaattccagttgccttaactgtaaaattggctagtagagccatgtacctccagggaattcagtgtattgtttagatgatgattaggtcttatttatgttttcatataagctattataacaaaattgcagtttaaaatgaatatataggaaaatgttttctttagaaacttagaataaaccagaacattcttaaatttccacttattgcatgttgatggagcttgactctcttccctgtaaggatgaacattgcagaaagactgtgaaaaagtggtgccatcacatcatcagatctcttattgcagaagttataattctaagagaaaacaatctgcaataaggagttctatcatatttttgtaagtatattattgacttccaattaaaattagtcctagtaataatggcatctgtgaataaggaaatctgaaaccaataacgtgtaaaattgagttaaatatt

SEQ ID NO: 41354 - DNA, 1065 bp, Homo sapiens
ttctccgttccccagacagaatctgctgggttcctgctattgacatcaaagttacttgttctcccattaggctgctgttaaaacgaacacttaaaaattatcttttgtccatcatacttttgtgggaaacatttttctccaatggatttcaaatcccatatctcttactatggtatttccatccaattttcatggttttgaagcagagcaatcagtatggagtagggggatggagtgaaaatgataactttataattaaaatcggcacggaagggtttggatcacgggatggtgggattaaaggtgtaacctgtgaggacagtaacagaggagacccactggaaacattgtaggacttggagagcctgtcgggtgagtgccctggggatctttatgtgcccatttgtcattttcacttctagaagtgagaagcatcaggacactgtctgtgccacctctgtcttcccactctattccaaacctcctgggctggtaggagggctgaatgagataacacaaagcacttagaaccgtgtgtgacatgtattaggaactgaagaagagttagctattacacataacatttgattggtattaaataatataaacattgcttcctgtactctctattatataaataaagagcaaggaatggtgtgtaattctgtgaaactgtgtagtctcagatttggatctgtctttgcatgtgctgcttcctcctgccccagttagtaagtgtcaataatcatgtaaattcttttttttctttccttttcttttttcttttttttctttttgagacagagtcttgctctgttggccaggctggtgtgcaatggtgtgatattggctcactgcaacctctgcctcccaggctcaagcaattgtcatgcctcagtttccttagtagctgggattacaggtgtgtgctaccatgcttggctgattttttgtatttttagtagagacggggtttcaccatgttggcgaggctggtctcaaactccttaagcagtccacctgcctcggcctcccaaagtgctgggattacagacgtgacccagt

SEQ ID NO: 41355 - DNA, 2305 bp, Homo sapiens
gggcaagcttgccaactcttacatacagagtgttctgatccaaggaaaaagtaataaaaagtacccaattatagagcagcttcctgaaatcaacatttgttctttcttttacatctcctattgaagaataggatgttgtatataagaggatagcacaaaatgtttcctcaagttttcatttatgtcactgaagagttgactttaaagaattattataaattaataaaatgtaaccatttggaataagctatgtaaatgaatttgaaagtttgaagttgttgcttttctttagtaatgaaaaactaacccatgaaatgtgtggtagatttttcacttattaagagtaaatatgcgcatttatggcgtgcagtgtttcacttaagaaagtgggtatttcagggcagcacctagccactgctggtgtacagtgcggactgggagcacagtgccctaggcacaggcagcctgtgagtatccgtggcagttcgtttctaactagcaaaggaaaaggacttctaaaatcaatactggttttaaaatgtatcattactgttatttggctcagttggattcagagccataataaatagtatgaacatcggcctaagttaaagtttgcatttagacctgattgtgaatggaaagatgtacatatgacttgagagagtatggttttgacagagtggttgttaatgcctcagaactaaagaggtttcatgaatacataggttttcagtacagtctccttaccggcaggggaatatcagacaagtggtgtttttcagacagtgaagcagatggctctttctcttcagtacagggtgtaccaacaaagagagacagttacacaaatgttaacccctgagggagagagaaaacaattgcagtcagttgttctttataagtctgtatcttgacttcacagtggtgtgaaaaagtaatttcttcttttataaaaagcattaaatgcacaggagcagcctgtaatctgagtccaactaaaatggtggaagatgatgtaatcacttaaaaaggaaacagactgttatgtttgacatttctggagtaacgtggtggtggactacttgggcccgatataccgcttccaaattctcgttaaaacgtccagcagttgtgctataaagcaaattgccatatgccaagatctgggcagaatgttcttcaatatggctggtgaaacagattgcgaatggtcttggactatatagcacatgttctattctctgaactagaacaagacaaatgccccacgctgggtaggacatgttttaaaattcatgtacacagtgtgcatagctttgggaggccttgggtcatgctgagtggtccaagtttgtcattcccagtctgtggagccagtcatacctgggtccctcacctgctcctcctctgtctccactagctcctttctctccactttgacttaaaaacccaaactcccaacatgcagccccgcagcaggaggcagagggaggtgctaagggtgccgtccaaccctgactgcaaatcacttaaaagctttttgaaacggaggaagagccgtgcatccccgtgtttcgtgtacaacatatgatacatgtgacagttgacaagagtgcctgagtctcagagcaggaagagttatcctgcctccacatgcattgaagggaatatatgtcacacgttactagccaggctcagaggagaacacatctcatttacaagttcaaatctgaaagggagaaatgtgctagtatttagtggatcttgaggaaactagggatgtgttacccatctgtgcaggaacattagatctagatggggctctcctagtcaaaacgctgagcatgtggcgtaggaaaaaatttccaggatgcaggggaaggacagaatgacttggaggacagtgtctctctctgaaaatggttacatgtgaaacacaggtaacaaatttaggataaatctggtatcttaaaaaaagaaacatgactttgggaaaagaagaaaccagggggccctaagggggaaaagactgagatgaaaacagaaacatacaaacaaaaaagctgatcgaaataaaagaatgcgaggaaaccaaaactgcaatgagacttaaaatccctactaagataatcagaagacttgatctccaaaaatagaagaggagtatggatggcaaacttggacactctcaggatgcagaggagaaaaagataaaagtgggtaaatacgaaaggtagacgtggaggacagataatggatccttcacccaagaggagttcctgaacaggaaactgaagtcatc

SEQ ID NO: 41356 - DNA, 1026 bp, Homo sapiens
gagcacacagtgtaggagagcgtgcattgcaggctttactggcagaattgcaaatgtgtaaaggtgatggattttatttcaaaagccagagttacctaaattctcacattgtagaaacttgcttcagtctgtttcttatattcccaattttaaaatactttatacaagacataggaaaagaaaaatgcaggcttttgatgctgaaacttaaattttgtaaactaaaatccagtggttaatttgaaaagtaacatcaagtagagtttattctatgctcaatattaagaattattgcttagtattaagaaatttcctatacggatgtagtgtgttttacagtggcgctatgtccttataaactgataagctgaaaatattgtaagttgaaaatgcatacacctaacctactgaacatcatagcctagcctaccctaccttaaacgtgctcagagcacttacattagcctagaagggcagaatcacctaacacgaatcctgtcttataatcaagtgttgaaagtctcatataatttattgaacactaagcgaaagtgaagaacagaatggttgtatgggtcccattgcaaagttgaaaaattgcaagtcaggttctctctgtaattcaaattatgaacaagtcaatgacagaaaaccatatggtctcaatagatgttagggaggtacttgacaaaacttaacatctatcccttctaaaaagaaaatcccttagtaaaaggattgaaaggtgttttccatcttaacatagtcaaaggtgtgttgcaaattaatagtcaacatcatttatgacagtgaaaccctagaaacatttaagcttcccaaataaggttgttggcaacaccattaaaaatgttctgttctttttttttttggatgtgcgatactttacttggcactaaaaagtaaatactaaatgacaagagaaagcaaaattgttatttgaagatattatatgattagaaaaacaaaggtcaacagacaaatggttagaagcaatttaataaaagt

SEQ ID NO: 41357 - DNA, 1769 bp, Homo sapiens
ccatgaagttttggggtaattcatatacagcaataagtaactgatcagatggattattcagtcagtggtgtggggatagccagctagaattggggaaaaaataagttggattcttactgaattctgcatcaagaaaattccagatgtgctgggcatggtagcttatgcctgcaatcctagtgctttgggaggctgaggtaggaggattgcttgggcccaggagtttgaggctgcagtgagccatgatcatgcctctgcactccagcccgggtgacagagtgagaccctgccttgggggaaaaaaagaaaatctcagatggatcaaatatttaaatgtaaaaatggaaccgttaatttattataagcctgaaaaattttaaacttttggggtggagaaggatttcctaactatgaatatgcaatccccaagccataaattaaaataacaaaccttataaacagggtgaaagataaaccaccaattaggaagatttgagcaacctgtattacaaaaggcagtgtctcggagaactcttaaaaatcagtaagaagactctataaatgggatggctgaggacacgaacaggcaattcacaaagtagaaataaatgtatgaacagatattagccaagaaatataatttagaacaatgagaggtcacattgtatttaccagattcacagaggtgaaaaagaccgacaaggttaaagagattccttgattggcaggaagattatacggtgtgggtggggacacagatttgtctgacttttctggagggcagtctagtaacatgtctcaaaatgcaaataccaaatgagtgcacattgattcagctattgtgtaaatttatgctaaggtaatcggacacacacagaaagatgtgtatactgttaaaaaaaaatcccgaatttcaaaaatgtcaaattttcttcctttttcttttctttctttttttcctctatttccccttctattgtctctctttccagttcctcttggactttcctggatctgtctccacttctcaacattgtactcataccttttaaatcttggtttcttctcaatattagtaatttctttaattttaacttccttgttgccaactctctattctgaaatcgattctaacattcagccctgcttcgaaaagtttattttggcaattacttttgcaaaactaatttctgataaattttttcttttaggattctgttctgtagtgggtgtatagctgttcaatctctctgaggatatgaattagagttttaaaaacttgccttagacacgttgattgtggctgtttctcccagggtttgtggctgtgtgtcttcatcttgctccttccctcccatgctttaagatcttcaagtcctgatggtcctcagctaaatatccatgtttaacgataaaggactaggttaattaatactgcagctgccgcaggttttctctgtagttgtgtggacattccagctgccccctgcgctaaatggaggatggactgcaggctctggaatgtggtcaggttgcttggcaagcttccccgtggggtgctgtttgggtggggaaagctgggttccccccacactgctatcataagcagtacttggtcaggaggtgcagcagtgtaccctgtcaggcagagctgctgcttttcatcccacgactccccgtctctgtgtctgttgtaacagttctgagttccctttgttctctctcaagccctaatgtccacacctgaagctctccacagagaactcatc

SEQ ID NO: 41358 - DNA, 1059 bp, Homo sapiens
cagtgaccgggaatggggataagagtgttccaagctttggaaacaggatggggaaagacctttattcgtagatggaggggaacggggtctgccagcatcactcctcaaggacatttactattgctgtggttcattttcattctgtatttttcttctgtttaatgggatttgggaggaagaaaaagatgaacttggttttgatccaagtaacctcagagaataatgacgtgggagcattttacaatgcaaacaataaatggaaaagcatgaatttatgtactgtatgtgaaatatatagacacatacatacatataggctgaacatcccaaatccgaaatttgcaatgttccaaaatccaaaacttcttgagccacctacatgatgctcaaactgagtgctcattggagcatttcagatttcgtatttttctatttgggatgctcagctagttgatatgaggcagatattcccaaatctgaaaaagattcaaaacctaatccaaaaatccaaaggctctctggtcctgaacctttcagataagggattttcaacctgtatttaatattgggaagcaatataccaataccaaaaacgttgtctgtgagaggtgagatgacaaatgatttttattacctttttaaaactcctaatttgaatttcaacttttctatgactgtggattgtttttataatcagaaaaaaagttcctaaaatgatgtttatcttatggtttggcttatgtaaatgcagagtttgtcactaggtcaatatccgcaacattataaagatgttactgtgtacttactggaaatggcctgtgattggtgacaaagctgacttacacaaaggagaacattatccttaggaattcttgctagtatctcataatgtaattgttttaacgttgttaaatggttcacagtgatcagagacttaaaatctttgtctcctacacagcgttttaagagttacagaaaagctatcattttgagctaccttgagactgaagtgtctgcagaatagcacttacatattcaggctgacaatatgtgtttgag

SEQ ID NO: 41359 - DNA, 1059 bp, Homo sapiens
tattttccaacggaggtggaaggggttgagatccacagcccaggggatatgctttgaaggaaggagaaaagcacctctccttccctaaaagaaggcaggaaaggtgtgtggacagaaattctagagagcatgaaatgcgggtaattgggctgcaataagaatccagtcatggttagagaacctgaatttaattaaggtcagtgtatgtctgtagagtgccattatcttacatagaaattatttttgaaaattttagttgacatttttgaatgatacctactagtactacagataatagaagcataaatatgcacaaaagcagttaaaacttaaccgttcgtcttaaagtaatttataactaatacttattgatgccctactctgtctcagtcaaaaagctaaacaccttccctatgcacaagaaaaacctatgcagtaggcgttactagttgtcctcattttatttttattttttattttttttcaaacttaaacatttttttttgtgtagagacagggtctacctttgtttcccaggctggtctccaactcctgggctcaagtgatcctcccgcctctgcctcccaaagtgctgggattacaggcatgaaccatagcacccaccctttatccccattttaaagatgacaaaacctaggctcaaagaacttaacatgttctagatcacgtggctagtaagtggtgacaccagaatttgaaccacgtatctgactccagagtggtggtgccagctgctgttctgtggattgagccatatgaaattgactatttagcaagagaaatataaaacatcggcatttttatatgtctctacctaatacacttcctcacctcaatcattgccaaggtcagtggactgcttacttggtgccaggcattgccctaagtgttttgattgccataatctgttgtaatattttgaaatatttgcagtcttaattgtcctgatttaaaaaatcatgtttttgaatatgataatatactttaaatgagtatgtttgattagcgatgttgctttttcctatgttggcaaaatta

SEQ ID NO: 41360 - DNA, 1025 bp, Homo sapiens
gagcatatgtttactcttggctgacacgcctctgaaccagccccaagttggtgtgcatggtgctagggcatgatttcaggcccgactcatacccccaagctagacacctttgtgcagagtacatctatatgtgtactagggattgcctactgaggtttttcctagttctccctttaccttcagaaggcatagagcacctttaatagccctcctgccttggccctcatcctccctccccaccaacccctgaattcctttagagattcctcatctcctcaaagtccagaggtgggctgtcttctcccacctccttgtaggagctcaccctgatgaaggttatttcatttctgaagctctgtctcctttttggcaactggcaccagcaaggatcagatccttctaaaactgtctcctgtttataacagaatctgacacttccaacatcatgtaagagctgcatatgccaatcacagtggagtttttaatcctgtacccaggtctgttgtgaggataaatggtaattcccattgcatttttgtgtgtgataaagtatattgcttaagagagttctggggatgtatagtggtgatgattacacaacgatgtgaatgtatgtagtatcactgaactgtacatttaatgtttaaggtggtaatcttttgttacctgtctattaccacaataaaaatggaaaaatatattgcttaataaaataatacttgataaagtccatgcagtgtttactacatgtcagtaccattttgaacattgtacacgttgcggtttacttaatcctcacaacaaccctgttaagtagctaatattataatccttatttgacacatgagaaaaatgtgctacatagaagttacataatttgctattaagtgagagaacgagattcaaaccaaagttgtttagctccatagctcatgctgtcaaccactatgttaatacaaatctgcattgtcctaattttattctatatttatgttcagatagaaggcactctgggaatctggaga

SEQ ID NO: 41361 - DNA, 1669 bp, Homo sapiens
caatttctgtgggaataagcctcctggaatttgatagggattattttgaatgtatagatcaatttggggagaattgccattttaacaatattgagtctttcgatccataaatattgaatgtctcatcatttaaaaaaacttgaattttcttcaaagctttataatttttacagtacaagtcttgttcttatgttacctttatttgtatgtacttttttaatgctattgtgaatgtgtctcttaattttacttccagattgtttattgcttatagaaatataattgatttttatatattgatcttgtattatatcctgtgaactagatgtgctttttaaaaattagttctaatagtttttttgtggactctttggggttttctatatacaggatcatgtcatcttcaaacaaagacagttttaccactttctttacaaaccgaatgtcttttatttgtttttcttgggtggttagagcttccagtgctgtgctgaatagaggagatgagagtggacatctgtgccttttaccctgtcttagaggaaaagaatttggtctttcaccaatatgtattatattcactgtaggttttttgcacatgttaccaggttctattctaaggttgctgagactttttatcttgaatgcacattggattttgtcaaatgttttctctgtacctgttgagatgttcatttggtttttattctgtattaatatgatgcattactttaattgatttttagctgttaaaacctcacatttctggggtaattaaaaaagatggcttatcatctttttttatatgttgttgaatttggttcactaatattttattgaggatttttgcatctgtgtttgtgagagatactggtttgtagttttcctttctggtaataatttgtctcgctttgctatcagggtgttattgcatcccataatgagtgggaatattctagaatgagatgtgagtaatattcttaaatctacttcttatacttctcggaagaatttgtggagtattaatattatttcctccttcagtgtttgatgaaattccccagtgaaggaatctgagcctggacttttctttgtgggaacatattttaaaagctcatttaatttttgtacttgctgtagatgtattgagattttctattccttctttagtcagttttggtcattcgtgactttttaggaatttgtctatttaagttgttgaatttgttggcgtaaagttgttaatatttctttgtctttctaatctgtgaggggtcagtggtaatcatctctctttcattcctgatttttgtggttttctttctctctctctttgccaagggtttgccaattttgtttttaaagaaccaccttttaatttttcctctgttgtttttctgttttacatttctttaatttctcctgtcatctttattttcttcattctgttttcccttgatatggtttagtcttctgttttctacattttaaaggtgaattcttagattattgatttgagatttttttctttaatataggaatgttaacactatacgtttttttctaagtcttgtgttagctgcatctcatacacttggacatgagttgtatttctattattcagattaaaatacttgctcattcccccttgtaattttaaaaaaatttt

SEQ ID NO: 41362 - DNA, 1047 bp, Homo sapiens
gtctaattcatttatatttatttatatttaatgtaattattaagatttaagtataccttttcattatatgttttctataaatgttatatattttttgttccttcattcctccatgactgctttcttttgtgttaaatggattcttttcttaaatgcatcattcttgttgtttcttttagtatatattttgagttactttcttagtggttatcctggggatcataacaaataacttaaaattcagttcaggttaatcctggcataatttcaaacatacacagaattttttctcacttgcatgctttttttgccttataaattatgtatttatatgttataagcctatcaacaaagttttataattattgctttatacagttgccttttaaaacaaataggagaaaagcgttctcaaaaacaattatattgtattttatatttacctatttaattgcctttattggtactttcaaatttttttcatatggatttgaattacttcagctggaagtaatcctttagtgtttcttgtagagcaattctgctggtgacaaattctctcattttttctttatatgggaatattttaattttcgtttttgaaggatagttttgctggatatataatttttggttcgtagtcttttctttcccccccccagcgctttgaatatgtcacatcagtgccttctggtctttatggtttctaacaagaagtcagctgttaatcttatagaggattccctgtaatatgcaagtcattttttctgttgttttacagattctgtctttgaacattttgtcttaatgtgtgtttgactctttgagttaccctatttggagttcattgaacttcttggatatgtaatttaatgtttctcatcaaactagacatttttggctatcatttctgttgtagtgtttttgcggtttttaaaaatttgttcttagggtttttatctctgcttacattacccacctcttcttgcatgttttacacttttttccattagagcttttggcatattaatcatagttatgaatttc

SEQ ID NO: 41363 - DNA, 1024 bp, Homo sapiens
tattcttttcctcagaccacataatctcaatgtatctttgaatttgctgggtcttttttctgctcatttttgtcagctgtggactccttacatgaatatttcctttcagttatcatacctttcaattccagagttttaattttgttcctttttgtgatgtctgtctctttcttgacattttttattttgtgagagttaaagaattaaaggaaagtatgagcatgatggtttcctttaaagtttacgtcttaagttcaacatctaggcttcatcagggacagcttctattgactccttttcctgtgtatggtctgtacattcctatatctttgcatgcttcatattttggttaaacactataaattttaaattatttaatgtgtaaactttggaagttcaaatttgttatccccccagagtatcatcctgttgataaggctgctgttacttcgtatagtgacttctctggactaatctcataaagtttattttcttcattgtgtggggacactgaaatctctgttgggtttgattagtggtcagttgatgattggacacaaatcccttttactaagtctcccatccttctgtgaggggctctgtatatgtgttgtgtatggctctttcctcggcttgtatatggcccggtacatgtgtgtggagttccagatacccactgtggacatctcatttcacaggtctcccatttaaatttttggctggactcttggctgcccaactggtatggccgacttaatagctgtggtgttaatcaattgcagctgattgtttttgacaaatgccctagggtagagggcttctcctgcttggtgagctctgcatgacatcaagtaatgataatgccttgtgaatggggcttccctgagagctgtgaagcaggtcagacagtgacagtgctccagagagggcgcttttggggaagtctgaactgggtctgctccctctggtggctacaggactacacattttcacattgttagggaggctgctggttcttagccta

SEQ ID NO: 41364 - DNA, 1047 bp, Homo sapiens
aaggataactaagaatttgtccttctcctcaaggagttcccacttttgtggcagagagggccttgaaaacaaatcatttaactgccacttactgagtgactagcacaggtgaggcatcctaccaggctctggagaaagagggaaatatagccctgctctcagcaaacacaggtggatgagaagggtataagcagggggctgggaagcagagagagagagaacctaaaaagacttaggcaaaggcgagtgtatgataaaatggagaacgccatagttcattctttcatttttttttttgaagtagagtcttgctgtcacccaggctggaatgcagtggtgcggtctcggcttactgccacatctgcctcccaggttcaagcaattcttgtgcctcagtctcctgagtagctgggactacagatatgtgccaccatgcctggccaattttttttttcataattttagtagagatggggtttcactatgttggccaggttgatcttgaactcctgacctcaagtgatatgcctgctgtggcctcccaaagtggctgggattacaggcagaagccatggtgcttggccagttcatcctttaattttggctctaataaattcactgtatgactaaaatgttactttttcttgatgttattattaatcctgtttaaaattagagcattggctttaattatttttaaatttagacactggttattatttctaaaggaagttataaacaaaatttcatacagcatgccatttgacaaattaatgaagaaatatttaatacatgtgagtatctcatttgttttgttattcaaggggattttagcttattgctttttgctttctgtatgttgaactgatattctttttgggcacctgtttgtataaacgtatcaatttgacctgtacttgaattaactgtttattttttatatgttggacagtactacaaattgctctatttatgaactgtatgtttttcttcaatatgcagtttggaatcctgctgttggaaccttatttgcttctgtatgctcac

SEQ ID NO: 41365 - DNA, 2495 bp, Homo sapiens
attcaatttcatgttggtgtttctacactcctttgcctcactgagatttcattaatcctcatatccttaatcgcctcccctttcccttatgatggtctgttttaagattctattatggttttttttttttttttggatgcctttgaggccatctgaacaatactcttggttaacctgagaatggattacaatctgatcacatacttactgctgtgtttgtgtctcgctgcctgtacagtcaggtggctgttctgcctcttcacccttggctgactttcacccatggactttgaagtgttactgcttctattttcatcaaattttatacaaattacaccgtttttccgcaaatgtacatttagtgaagtttgtttggctccagaatccagtccttttgcaggacaggagcagaggaaatggcagtgaaggagagggaagtccacgtaggaagaaatcccaagactggaggtggattggagacagcaacagaagagaagagcgttggggatggctctgagttgaagctaggtgactgttgacccagagaaagaagttgagaggagaaccacgctttgtatttaggtgggctgtggtggggtggaggggattgaggtgtggagtttgatttttgacattcttgtgtttgtgttggtaagacaccttgtggaactctcctagcagagtttaagcgaatgagcgtatatatttgatgaggtgtatatttgagagtgacagcacagaggtgatcataacaggagccactatttgttgagtgcatactagctacagtgataagtgcttcacagacatgctgtctgtgcttcaatgtcctcacctgtaaaagggatttaatagtaggattcttgtgagaatgaaatgaattgatatatataaagtccataacaatgtctggcacataataagtaatacttaagtgttatcataatcacattttaattcagtatccctttggaaagaggtattattgcaggttgaacatccctaatctgaaacattttgagcactgacatgacacctcaaagtggaaaattctacacctgacctcatttgatgggtcacagtcaaaacttcatttcgcgcacaacattattaaaaatatataaagttagcttcaggctgtgtgtaaggtgtttatgaaacaccttatgaattgaatttcatattagacctgtgtcccatcttcaagataccgcattatgtatatgcaaatattcaaaaatctgaaaatatcagaaatcaatcacttctggtttgagacgttttggacaaaggatactcaatttgtgtacacatcttatatgggggaagctgtgactggagcaatgtaactactctgccaaaggttgcataactcataagtggcaggtgaaatgatatctttttttttttttttttttttttttggagaaggagtcttgctctgtcgcctaggctggagtgcagtggcacgatctcagcttactgcaacctccgcctcccaggttcaagcagttctcttgcctcagccttctaagtagctggggttacaggcacacactaccatgcccaactaatttttgtattttcagtagagacaggctttcaccattttggccatgctggtctcgaactcctgacctcaggtgatccgcctgcctcggcctcccacggtgctgggattacatgtttgagctaccacgcccagcccaaaccatattcttaactctgcttgtctctcacctgcctttgtggaaataaacacctcaacagaggcttcatggtgtagaggaaagacaggacaaaatacctaacacacaaggaagctgttttgcttattaaatgaacaatatgcttttaaatcgtgtaagaagagctttgtaatgaaaatcatcattataagaaagaaaaacttacagaaaggtaggagtgaggcttggtatttgagctcctgcggaagaccaagagggagaagggaagatcagtgtagggcaaagcaaatccaagagagccgggaagataagaggaagaatcatgtagtttctgcatttacggacaaaagcgcttccaaaagtacataagggttgatgctatcaagtgctgcatggaggtcattgagagtgagaactaagaaaaggcagttggagtcacattttggtgttaaccagattaaatttccttttggagcaaaaacggttgactacacatacagttataagaatcaggaacatatgatccaataacatagatgaatcaggaactgaaatttggggtgtagatttattcctttgactttctctccctttttcagttcatgttttaccaatagagtattctggtagcagcactgtctgacatttgtcagcttaattagagatcagttacaaacttggctatcttatggatctgtgatacttcccagcaaatctgaaatgcaatacgggcactgacatgaaatgatgaaaaatatgctaattttaacctgaaaaagctcccta

SEQ ID NO: 41366 - DNA, 1045 bp, Homo sapiens
ggcatggcggtgggcacctgtaatcccagctactgggagggctgagacaggaggatcacttgaacccagggggcggtggttgccttgagctgagatcacaccactgcactccagggcaacagagcgaaacttcatctcaaacaaacaaataaataaataactaggaggctgtgcatggtggctcacacctgcactttgcgaggccatggtgggaggatcacttgaggccaggagtttgagacagccttggcaatgtagcaagatctgccatctctacaaaaaattaaaatatcagccagatgtggcacatgtttgtggtcccagctacttgggaggattgcttgagcccaggagttcaaagttgcagtgagcagtgattgcaccattgcacttaagcctgggtgatggatgagaccctatctctaaaaaataaaaagataacttgggctgctgagtggagaatggattgggagggggcaagggattaagtggagagagtatgttttgggctgggctgtagtggcagcagcagagatagctatgccttggaagacatatttttgcagaggtggaactgttaggatttgtatgccttatgggtgataggcagaaagaggaatcaaggactcctagaattttggcttgagcaagctaggcatagaggcaggaagagacaaggttggggtgcggaggaggaggagaaatttgaagggtcctagggcattttctgagacgagtggcctggagaatgtgacggaatggactgtttggcccagcccacggaggaggagagtgctgggttttagaaatggggcatctgagaaccctgacttctgtcatggtgcctggagtctaaagtggggagcagagcatccagcgaaggtgggtagtgtccgaaaatctggagaatgtttgtttctttggtatgttttagtttttttcttttacatgaatatctatagatcttccttgatcacaaaaaatgaagttggcaaatttatggaactgtgaaagtaataccttatgtttttgtgaaactttgaga

SEQ ID NO: 41367 - DNA, 2203 bp, Homo sapiens
acataatcgtaaggttgttcaaccatcaccactatcttgactgcagaacatttttatcaccccagaaagcaaccctgcgctcactagcaattcctcctactcctccattcccccagcccctggcaaccgctaatctacttgctgtattctggacatttttacaaatggagtcatataatgtgtgttttttttggtgtgattctcttctttcacttaaaataacattttaaagatgcatccatgttgtagcatgtgtcagatctccattcttgatggctgaaaaaatatttccgtgcacggatataccacattttattaatttatcagttgatgaacatgttggttgttttgacttttcggctattatgcataacactgctatgaacatttgtgtagcagtttttttgtggacacattttctttcttttggttatacacataggagtgtaattgctgggttttgttaacttgatttttatcttttgaggttgtatccaactttatatcatttatttatcacagtagctatgaaaggaacctgaagtactgaaggatttgatgggctagaggaaaaagtgcatatgttacaaaaaatatttaaaatgaggttcattcatgcattggttaaaatagggcagacctggacacataaatgtgtcaggagaagtaaacaaaacgtgtaatacttatatagtggaagagtgtattgcaggtgtatgtgtgtagagaagtgtgtagagaagttatatctatatgtaatctcaacagaggtagataaaaaacaatgagaggtaggttaaatgagaagtagattaaaaaacaacggtgaaaaatgattaaaaaacaatgatgagtgaataagtgagttgataccatttatgtaagttaagaaaaccacaaagtaatactatgtattgctcatagatggaaatgcccatatacacacacagaagtacaaaaaggattggaaggatacccacaagtccatgatagtagttgctttgtatccctacttctgagctgcaaacccatgccagttttccttaccatatatttatatataaattatatataaatgtatatatatatattcatatacaaatcatttctgttacatgactgtacatttcttcggagtagggactatgttttcttcaccaatttccattgcctagcacttaagtgtgaacacatatttttgaatgactaactgaatgaattaaatgattttgggaacaagatagggcaggactaatgaataagccactctcccccatcctgctcattgtctctgctccctaccttcatattctgttagtgttgtcataatatgaggcttgcaattaccagagcagttccatatgacacgacatgctaataaagcagatggtgtgtgcaaataagcaggataaaagaggtctttgctgcaaaagtcattgctgtctcctttaaagtatgaagtattttatgatttctcagtagattttatcttcattgtcaaggtaatgattatggatcgtataaatctttatggctttgttgtatcaagtgtcaaattacacagcttaggtagttgtagaaagaaagatgtctgtgatcagattaggaagtcatattactaaaagtttttgccgttcagggaggagttggtctcacttttttgtgttcagatagtggagaactgtgctcccgttctagggccctccctcctttctctttattaacttctccccacgggagaaagaatggcaaattggaaagctcggggcttgacattaatatgagtgaagtcactgtatttccacatggctttcgttctttttttttttttttttgcgggggaaacaaggggtggaggcctgcagaaaggtgccagctatcctctactttttgcctgctgtcttcaggcaataaggagattagggaggtgttcccctggcaggcctaatctggtctatacttcttctagtccagcctttgcctggacaggtaaatcagttcaggtttgctctgtgaacctggccaccttcaggtctggaagaagaacataggaagccctgctgacgtcaggcttaagctgtattctccagcacatttaccagaagcctctggggttgtgtgtgaccatgcctcgaataaagcccatgttctgatccccatctgtctgtcagatgttatttgtggatgttatttgtggttatgc

SEQ ID NO: 41368 - DNA, 1055 bp, Homo sapiens
aagtgaaattagtggagaatggacattttctacattgcgtgagcgtctacagctagagagtatctctaggcagtgaggtagctttctgttggctcttagatgggatcacattctttgggcttgacagtggatgttatgtcaaaagtcataactcctctgatttagagatgacatttagagtactgtaggtttatgagaacctgctcttaaccttaaataacagagctgctgccagggctgctgccttccttcctggtttttgggtgcttgagactcttggaaagtgggccagatgcagtggctcctatctgtaatcccagcacttctggaggcttaggcgggcatatagcttcagtccaggagttgtgagattcttggaaatgtaaagcatagttgatgagagggggaattaaatagcagaccggatggttctcaaaataaaataggaaattagaagatatgaggccttaataacaacaacagcaaaaatgagatgtatctatctataatgagatttctgaatgtcataatacagagacaattctgtatccaattagaataaaacttgttaccttcaagtggaatgaatcaaatgcaataattctatacccagccaaactactcttacataggtggtcagaggatcaatatttaaaaacctgctattattctaactttgaatcctttcaggaaaaaaaaaatttagaaaatacttaaggcattggtgaagtcaagagtgaaaacctcataggaaagaatatgtggcttatatgcaaccgattaacttgagtcaaatctaaataaatgttagtaggttgtgaagctaagtggattcattgacatgaaaaatactatagaatataaccaacttttcttaatactggaagtccttttgaaaaatcaaattattgctgggtgtggtggctcatgcctgtaaccctagtaacttgggaggctgagggaggaggattgcttgagctcagaagttcgagaccagcctgggcaacatagcaagaccccatcacacacacccagaaaacatcaaattatttctt

SEQ ID NO: 41369 - DNA, 1047 bp, Homo sapiens
tttagttttgcttttgatatctgaatggattaggaaaattccttccaagaaaccagagaccagaagatcagacaaataccatatcagtttctctgctttgaaaattataattcaaccttgtaaaatttttctaacgttgtgttctctgtaaataacacagagtaaaaataagtcaaaccatttgttttttcctctaaatgttctgaacattaaacaaatggttcttggcaaacacatactattttttttttttttttgagatgagtctctattgcccaggctggagtgcagtggtacaatcttgactcactgcaacctccgccttccaggttcaagcgatcctcctacctcaaactcccaaatagttcggactacaggtgcgcgccaccatgcctagctaatttttgtatttttagtagagatggggtttcaccatgtttgccaggctggtctcaaactcgtgacctcaggtgatctgcctgccttggcctgcctaagtgctgggattataggcgtgagccaccatgcccggccatactaatttaattttaggaatgttgtattatagttcattttgaacaaattgtaagaagattattttgtgcccatatgtgtgataatcagaatagcttgatgtagatatttggtatctttttagaataattatgtttagataaatcttttctgtggaaacatattcctaaacatttaagcctagttataccaccctcaaatataagaagtttatgaactttgtgggctgattcaggaaatcttttcacactgataaaaacaggagactttaatattattttgggaagaaaaatgagaaatttgaagatatgtctcttatgaatcttgctgcatcagtttgttttctgctgatagtctggttgatgcacaatttagttttcaaagaatttctcttcaaaaataccggctaggcacagtgttcacaccggtaatcccagcactttgggaggcagaggtaggaggatcgcttgaggccgggagttcgagaccagcctgaacaatgtaaggagactc

SEQ ID NO: 41370 - DNA, 1034 bp, Homo sapiens
aagacagtccatgaagtggtgagtgggagaatcaaacttttgtggtaatcttttattgtaatctactttcagctcagagaagcagcatagcctggtggactaagggaggatggggagtttggagctctgagatatgaactgttttgcaatgactagttttgtgaccttgagaaaggaccttaacctctgtctatgtcttcatatgtaaaatgggatctacctgatagaaacataggtgcattcatatgtgagcaaactgaataattagatctcacataaatcaggagtgattttttttttaaatggctgaagcctgcggtttataaaaagattctccctagaattcctttaagacctaaccttttctcaggggtgtttaaactgtgattaacaaatgttaaattatacatcccagtttacaaaatatacccgttgaatagagtgagactaacatgactttttgtctcataaaattatgacaataactcagtcagtctgtgtgaaatactttgtaaacagagctttgcaggctgcagtaaaaaaaaaaaaatatatatatgtattttatatttaaaaaatatatatttttatatatatatatatccccatacctgaagattttggggtgaactttttccaggttaagaatgacattagtgccaactgtgctgtattttggctatcgtgatgacattagtatcatcaaattggtcgtggcattgggacactggcagcatgtcatcctgccccagtcaagaatgactgtaggcagtttcagtttatctgttgctactagaattttgatgtagcagtgtcaaaaggttgatttgtactatggcaatcttattcctagatgtgaattctccagggggcaaaatatcctaaaagctaacatgtaaacaagctcaaaggattaatgtagtaggaagaaatagtagtttgttatatattcatgttgaatttaggtaactattttagttatttaaaagattactaccgaagggaagaaacatattttgctaggtttcgcatag

SEQ ID NO: 41371 - DNA, 2024 bp, Homo sapiens
agtactcttattaatgttcttggctatgaaccatgtaatatttttctcttatttttatcgtgtaatattttgaaggtgactgaaccttaaaagaagtaattgccactaaatcgtgaagaatgtttaaattagaacagattctttgtcctcactgtcttcccctttccctgaaatctgtagtctagagttgtgaataagagccagaagaatgttaaactgccttttaaaaactcgtctaccctccccaagaacctacatagacaatagaatgttctgtaatgaaagtgtatctttacctcattatttatttattttattgagcaaaaaatgtagaacatagaatgtctaacggattagtcacaataaaaaaaatttcctgggttatatatgtaaggggcagcggctgctcctctatcagtccaggagagcctggtctgatttcacattgcttttctttccacatgatctcatgacactaaaagacgattaatacatcctttaaaaatcaatacgggacattttactgtagtccttcacctttattgttcagtacccttcaggggtgaaaggagatattccaatgcaaaaaatatgtctgaaaacctgagtggtaagtaataaaagtttttttttctcttaaaaagtcttataacattgttatttcccagatttgaggggtgggccttggggtggaattaaaaaatcagtgtaatcatttgtaaggacaaaatgcgagtttctataaagaatgttttagcataatgtcactaatgttttgcagtgtgtagagagcaaactttaaaaaaagatgtgaaaatttacaaaccagtaatcctctatttcatgtgccagcagtcaaaattacgtgtgatcggctgggtgcagtggctcacacttgtaatctcagagctttgggaagctgaggtgggaagattgcttgaggtcaggagtttgagatcagcctgggcaacagcaagaccccttctctacaaaaaataaagttagctggatgtgatggtgcgcgcctgtagtcccacctatttcagggggcagggctaggagtttcaggtttcagtgagctgtgatcgtgccactgcactccagcctgggtgacagagtcggatcctgtctctgccaaaaaattaataatactaaaaaaattagatatgattaaggataccaaaaaattattcagataccttagtggaagctttggctgaatagaagttccatcttttgtagtactgaaaccaagtgaagggattacgtagttgacatctctgaaagagagaacgcagtggtaatgagaatactccccctacgtttgtgtatgagccttggcagtttcttttacactctctcatttaatcctctaagacctgagacattgttggggcaagtggaattattctgcattttatagatgaagaaatggacttggaataattaagttatttacagctaacccgcaccccagatctcttgacctagccccctgcatcctgcctttgccccagagtgcttttaatgttctgcattgcatggtctttttgttcattttattttatgtatcatagttaatactaaactgaacgtttgctgctaagacctatattattttatattcccaatgaatatgacttctgcataaaaacatttaactagggtaatcattttatagtatgtgcctgttgtctctgctatatctatcaccttcatgtgaagacagagaaaatagaatatgctgtgtattcgaaataatttcttctttacaatgatgtattctagattctaacatttacatatgagagaagcttcataaatgttacgttttctgtggccgctatttctgtcttatctgtgctgtctacacagtgaggacagctgcagagacactgccagtctcatgaagtgtccattgtgaaggcccatgtgtcagtgctgctgatggcatgcaggagttggtcagtaggatggttaagaacatgggctctggagtggacggtgtctggcttcaatctggg

SEQ ID NO: 41372 - DNA, 1029 bp, Homo sapiens
tattctgtataattggatcatatgtatgtgcacatgtgttcatatttatcgatatgtgagagatgatgtatagagtttggtaatagtgaggaagacctcttaccccaaactaaggtgactggttttgtcttgaaagtgggttatagtaagtaggggagtggtctcttcactgctgtttagaaggacttctctggacaaatgtgtggatgaggtattattaagcccaggatcttgaagatgagtagaatggtagcataataatctgggtgagaaatgtttggggcagataataaagtgggatgtttgagagagattttaagaagtagcagtgctagcatttgggatataaaggaagggaaggggtctaggatgatacgtagatttctagtttggaacaagtagacttgcagggatttggtttatgaaaacgaggggaggaatgagtttgggaatgggaagctagtgagttctgttttagacttaaatgtttggaggcttttagggttttgtggggacaaatgaagatctttattggttggctgaatagatctgaccttagctcatgtgaaaagagttggagattttgacattatcagtgtatataggtggtattttagtcatgggagtatatgaaattgcatagatggaataattgcatgaagagagaagagggatgaagatggagacatctaagatgtaggcaaaggatcacaagaagacactgagaaggaatggcaggagacataggaagaaaataggaagagaggagttttgcggaagccaaaggaggagaaagtttcataaaggaaacgatagtcattgcagtcagatggcacagagatttcacatcagctcatcctcaaacctgtctcctgggtttggcaataaagaggtcatcagtggctcaggcaagagaatgggaggcaaagtgagaggagtttataggttggctgctaagtggatgatacagtagctgggagatgatgtagggctgagcgagggtgtgggtatgtaagatgaacaagacgt

SEQ ID NO: 41373 - DNA, 1075 bp, Homo sapiens
agtgaaagacttagagaagtgtatgcaggtggtgttgggcaattgcaaagagactagcctccaaatgggagtgttagcatagcacgcaggcttctctccttatgagctctgactccaatattgactcttttttgtatacagaaaacataatctgttcagaactcattacagtgaaggaacttgtattttaaaaacagagatagagaactaaatttgtattgagttaaattgtataaattctttaaggatttcaagggtaagccgactcacatgattaaagtaagttatgagcatttttgtttatctgttcagtgtgtttggggcttttgtcgtgtcagctttctttaggacaggtagaattttatctaacctcttaagaacaagtggttattttctcaaggactctaggatggtgctagataccccagattcttaggtgctggctttatgtgttgcctttgctaagcacttggttgctttctgccactctttggaagcaggtgattgatactagaaactgacaggttgtgagtgatgtacccttccattaaaaacagatatactaatttgcttttcaattgtagagagcctcttactataaacatccctgtaataaaggtaaccttataattagtatgtcaaaaaagcaagaaagttatgatgaacatgcattaataacaaatcaaaacctttactaataaaatgtcacattgagaggacttaattttgtgtacactttcatactaatataaggcactcttgctaatagtgaaagatggaaatatttgccaaccagctatgttatagaagaacttcctacaatattgtcctatgtacggtgacatttagaattcaaggaaatatacatagtcattgactttgtgtggaatttccctcccctcctccaccaccctgttagaaatccccgctgttgactgtttccagaagtcttgcagggtgttgtgataagagtccaattcctcttcccattcctgcctaggtcatctctttcttccctccctccttttgttctgtgattctttgttttatttttcaccacagaacatacttcatt

SEQ ID NO: 41374 - DNA, 1069 bp, Homo sapiens
cttttttacttatataaacttggacccgagatcaattggttgcctgcttactcattctataaaaatttggaggcaccatacagtaagaatacataaaaataatttacatcaaggaaaaccaggtccacaaataaaatcgatacagctagattatgaaaatcaactcactttctagagtttcatctttatcattcattttaatgttacgttttttcagttttcccatttaaaaatgaacttttattaatgcatttcgattttttcgtgttccccaagatttgtgtgtgtgtgtgtgtgtgtgtgtgtgtgtgtgtgctgtgtacatttaagtctatgcaattctgttacaggtgtgggtttgtgtttccacagtcaagatacaaaatagttgcattactgcaagagtcccttgggttgtcctttcataactatcccttcccaatctctgatcagctgcaataacacatttgttttccgtttctataatacggtatgtaaccttttgggatttgctgctttactcagcataattctcttggaaataatctgatttgttgtgtttatcaacagttaattcatttttattgctcaggagtatttcatgatatggaatataccatggtttgactcttagccctttggaggacatctaggttactttcagttgttgagctgctgtgaaaatttccatgcaggtttttgtgcagacatcactttccatttctctaggatctgtgcccaagtgtgtaattgctgggttgtatagtaattgtgttcagtattataagaaactgccaaactattttccagagtgactgtaccattttactatttcaccagtgcttgagtggtaccgtttctctgtatccttgcctgcatttggtgttatccttatttttttattttagatattctgataggtatgcagtgatatcttgtggctttaattcacatttttgtaatggctactggtgttggatatcatatgatatctgttcgtgtcatttgtccattttgtaattggatttttgttttttttttactgttgagttttaaaaatatatattct

SEQ ID NO: 41375 - DNA, 1052 bp, Homo sapiens
tgttcattcctcaagggtgatttcactgatgtagaattcatggttgacagtccttttctttcagcacttgaaaaatgtgttgaaaaccttctggtctccatggtttctgttgagaagtctgctattatttgaattgttattcctctataagtacagtgttgtttttctcactgatttcaagatctttttcttcagtttttattaatttgtcttgctatgtttttccttgagtttattttgtttgggcttcactcagcttcttgaatctgtagatttatgtcttttgctaaatttgggaaatatttagccatcatttctttaaatattctttcagccccagcaactttctcctctgcttttgaagctctactgacataaatgttggatcttttgcttttgtattacaggctctgaggttcagtcatttttctcccagtctgttttctctctgttgttgctggtcaattccattgctctatcttcaagttcactgattttatgctttgttatctgcattctcttattgagctcattcagtgagtttatctttcagttattgtatttttcagttctttaactttcatttgtttttaaaaaaataacttctagttctagatttttttgttttatttttttccgagagaatacatagttgcttgttgatgtatttttgtgatggctgctttaaaatccttgtcagataattccaacatatgtctcttcttggtgctggcatcagctgctagctttttctcactcaagttgtgattcccctaggtttggttgtgatgtgtgactttgaagtgtctcttggacattttggctgttatgttaggagactcttggtcctacttaaacctgttattttagctgacagcccccttagttaggtttagcactcaggttctggcctgcttttgtgggtggttccaatgagacctcaattttagagcgtttgtcttgctgtttgggtgtcttttgttcatctgctgccgataggactcccccgatccttgcaggtgcctctcaagggtgcacaaggtgcttccgca

SEQ ID NO: 41376 - DNA, 1030 bp, Homo sapiens
ctgaagttggagaaatgctgcatgctcacttggctaacaaggtgaacattactctgtcaccacatttttatctagtatgcgtcctaatctcaaggatccagctaagttgtgtgttgtcagttggagacattagcttgggcagtaagctcagccttgcactgcttctggcaggtttactcatcttcatccactcttatctcgatatgaggatatctgttttttgagcatgttccatatccatgtttcatgtgaaattgcttgtcattcttgcttatcacttaaaataataactggctcccttcttttgtagcatttgctaatagtggcagaactatttatacgattatgataatctgtcaagaggattatgcaaagtatctccccccaccccttctctaaagcagagttaaattgaacactgtaaaggacattttcataaccaaggatttttaccaattatttactgtggatttaaattgatactgaatgactggaggcattgatttttaaagctggaaatatttacaaaccatccaattctttttccttagtattttgtctctagttacttcgaaatctctctcctctctctctctacacacacacacacacacacacacacacacacacacacacacacacacacagagatgtaaaacatacacatagaaagactttaaggaaagacatcaaaatggtaaaagtcattatacctggttggttgaattgaagttattttatacttctttatacttgctttcttcatggggaaagtatttttatgatcaataaaaatatttttctgtaatatgtatgtactactttacaatattaaagcactttcacatttttccaaaaattaaaagcacagtgaaatttgcacattgagaaacatttggagccaattaaatgccacttatgtttctctaaaaaaaaggaaactacttttattcatgtaattaagagccccactcatgaacattaaagaattgttgcccactgtacttttggtatatgtagaaatataaaa

SEQ ID NO: 41377 - DNA, 1065 bp, Homo sapiens
aagtatgtaattttaccatgatataaagctgtgattgtcagtaagtggtattaggaatctagattatttttattagaacttatttctttctgcaaaatcattatcatctcctgatattgtaaattgggttatttcacaccattatttttaatatgtgttaatcctcaaactacaggtacttaaaaccttgctaattaaggagtcattaataaagttagcaatatgagccgtcagtttcgattcttcacaccatttagacgcaattcaattttgcgtatttacactatgttttcagtttggctcagatgtttgaagtaagtcaagagtaagaagtgttgtcaacttcagatccataggccagcttagcttgttttcaagatgaaggactgataacattgtaaagaaacagagaaaatactgcttttcttagccaagaacagagtaagctttgtatggttttactttttatagtctactcggcttttctgttcttaaaagttgcctggttatagtagtttaaaacactctttgggactttatccattgaacttcaatgttctctgaaacaaatattgaagtgttttgcatttgattttgaggaaaggtttattttccttttgaaaataatcaaactctttaagttgttcctaaccatagtcacttttacttgaaggatgcattatagtcttgagcattttttcacttttgtaatcggtatgaccctcttgtgtttttgctgatgagatggtagcagtgctgtggtattgtttgcaggtcctttcttatcctttatctgtgtctccttcccactgtgttgtgggttggtaaatgcatagttccctccattactttttcatggctgaagggattgtaaatattgttttgcatttctagtttttttagatgtccatagaattccatctttagccatagtgcttttataattttgtaatacctttgactagctggggagggggtatagataacagtttagtttccacatattactcattttgtgcaattttattgtgcttctgatatatgcccagtatgctattaggtgct

SEQ ID NO: 41378 - DNA, 1036 bp, Homo sapiens
taatcatttccttgtgaatatttctgtctctaaatttttatcttattgcaatccctgcaccactacaatgcgggattttaacaagtggaacagatatccttgttttcttcttcattttaatggatgcttctaatattttaccattaaatgtaatattttctctaaatttttgatatataccttttatcagaatttgctaagcatttttgttaggaatgggtgttcagtactattagatgatatttatttcagtctctgatagttacatgatgtttctcctttaatacatgactatagtaaattcattggaacatttcttttttctcctctttatcattaaaatgtttatatatacgttggataagctctacatggccataatacttgtctaacattttaaaatttatttttagtttttaactaatacataatagttggacatatttatggggtacatgtgatattttgatatacgcatatgatgtgtaataaatcagggtaattgggatatctgtcacctcaaacatttatcatttctgtgtgttggggatactccaaatattctcttgcagctatttaagaaatgccttacttcagtatatgtgaggggttgattccagggtcccctgtataaccaaaatcgaagcatgctccagtccacaggtggccctgccaaacccacggatacaaaatttcaccttctgtatccatgaattcacatccctccaatactgtacagttttgtaggatttgaactgcatgggtccatgtatacacacattttttttcaaccaaacatagatcgaaaatacatattcactggatgcgaaacctacatatatgggggctgacttgttgaatatgaggttccacaaggccgacttcgggacatgagtgtgtgaggatttcggtaaacatgagggtcctggaactagttccccatgtagaccgaggaacggctatattttcagtttggttggaaaaatatccttgtataagtggatcctggcagttcaaaccagagttgttcaaggat

SEQ ID NO: 41379 - DNA, 1022 bp, Homo sapiens
tgcttagcttttaatgttaattaaaattatatggagttaaattttaaatctttaatatctgaggttgttttcttttccatttctattgtactttatttggatcttctttcttttttcttagttagacttggcaaaacttagccagttttatgggtcatttcaaagaacctgggtttcaaatgtgctggtatttttgtttggttttctaattcatttctttttttatgtctaataatttattctactttcctgtttggttttgtttttacccccctaattttgtaagttataaactaagtttacttattttcaatctcttgtgttttctggtaaatgcattttatgctatgattttttctgaccctgctgtggctgtttcccagtctttattttgtgcgctttatttgttatgtatgtatgatgaaaatggaaatttttcttcagtttttttttcttcatcccaaagcacaagtaaggcgttaaatttcaataggtagatagatgtagagatagtagatttttagccacgttttaattttatcctattacatttattttaaaagatttggaagacttgtatttttttaatttgtaaatatatccttttgtcctaaaacttagataatttttgtgaacattccacatgtttgataagagggtgcattactctctgcctctcttaactgtcttattctctaccagtttatcttatataaatattaaaactattattacatgtgtaaaggttatatttgctttgctaagattgtattagctatctttttatggtctggaacagaggttggcaattttttcttgtaatgggccggatggcttctgtcaaaaccactcagctcgccattgtgttgtgaaagtcgccttacacaatatgtaaatgcaagtgcagctctgttccaataaaattttatttacaaaaacatgtggcaggctagaattggcccactggtcttagtgtgccagctcctggtcagcataagccttatgacactctgaaatttaga

SEQ ID NO: 41380 - DNA, 1075 bp, Homo sapiens
taatgaaaggtgcatatctggagatagatggaagtgtaactcaagatgtgattagctacccagtttgtttttattaaaatgttatttttttctgcatatttgtaattcagggaaagtttctaatgtgaaaaataaagtagcttttcttaaggcaacgtataaaaaataattggtttaacagcattgtgtgaatacagatgagatggtcctattaaaatttgatcacaaagtatacatggtaaatgcagcaagattcatgctaactaattactatttcaagtttggagtaaaatgctgaattatgggatgctgtaatgtcactaatgagtcctgtcatggagaaatgatattgccaattacacataaaatagtcaaaggctaatacatttggagaattgtcaagatgggtttttttttcccctcgtgcttactggttatgtgtttgcatttttgttgagagaatacacagaaatgatctactgtcacttgctttcaagctggaattattctcttcatatttaggcgtaggtaccaattaagtgaaaagaaatctgtcttaagtgaaactatggactactagtatagtgtatcttgtagctgtttaatgttgtaactgctaggttctttactttgcatccaggtaatgtaatgtgaatgatggattattaagttcttttcataggaaataggcatattttaagttaatagtccttatcactgataccaattagccgaagagaaatgaattccctggatttacatttcttaatagttctttcaggattgctttgttacttttgaggaaggtgtatgaaatttggcctaggcactgtatccggtgtgaaataaatttatgcattcaataagtatttattgagtgcctgtgatatgccagtcattcctgtgttctgtatatcattttaaagattaccattcgttttcttctgatatttctttaaacatcttattttttgtgtcaagaacttaccatatagaattctgtgacttcccgccacttccatttagctttatatcaaggatagaattcagtatgaacacatgaagacctgcatgc

SEQ ID NO: 41381 - DNA, 1191 bp, Homo sapiens
ctaaaacattgaaagtcttgagcatgcagattaaagatctgggcatattatttcattgcagggtgatctgcttgagctcttttcttggggtaacttttgtcagtatcttttcttagtatctttagagaattcctcttggactgattagattccttagggaagactccttcagttttctgcttggctattaactgtttttactattcttccctctgttttctccaacttgctctttccaacttgctatgggctagggaatcaggaaaaagaaaaaaaaaaactgatcaggacagtttcaaagtagaacagttaggttccgagtgacagcctaagggattggcctgtgcgtaaaatgctttaatgtgtggaatttatgacattgattttgatgacccaggagcatgtttttatttcgtgctcctgattatattgtggaaaggtgatttagtcatacaacagaattctaagtagatgaagtattaatgcaaactgttatagagtatttgtttttcttaatccatttcatttgatccactgtgtgtacttttccagttgattataaattgatttgttcattaatttgttctagttactggtccataattatcataatgtttttattttttgttgaagtatgtgcagtattttggactttttccagttatgatggactatcagtatgttctcacaagtaatgggacactgtattttacaaatatttattactcttgatgttctctaagattctgtattatgagctcttgttgatttacagacatttggaaatgtaactatttgattcttattcttggttaatgttttatcctcctagaccaaaggtgtttattctttagaactttatatgtttgttttaacagctggatttctagtgataggcaaacttttaacaaaaattccaattacatataagcttactgccatttgatttctataattaaaaatattaatattattagtggggtttagtcagtcactatattagacaaacgtgtgagttagaaattcaggtgtacacaaggattattaattggggcttcttcaaagaattttgacattagtaaaatttttcttttttttcaaaatgtttcaaagatttttttttaattaattaattaatttatttttagacaaagtcttgcttaaagtcttgctcttggccaccaggctgga

SEQ ID NO: 41382 - DNA, 1028 bp, Homo sapiens
ctgccaacatgtgacctcaggcaaataccgttacttttctgtgtgtgtttcctcagttgtaagacagggtaatgataatacacaccttcttagaggtaatgtctgtaaagcaattaaagggtgcctggcacgtgataattgctatgtaggggcttattaaatacaaccacaatgtttggggccgttgtgttacctccattttacagttcccaaagtgagacccaaatagctgagtgttacgaagtgtccctccagtagcagagctggtctgtctgtctctgggcccctcttcctcaactgtgcttacctgcatcttcactcaacacttaacctctgtttaatgtcacagggcaggctcagagagcagcagccagacatgggtgttttctaccttcggccctgcagaggatttctgtaagaaaagcagcatgacagagagagccccccaggacatacagaaaatgagtacttagagtctaaattatagagaatggaatgttaagtcagtggttctcagttcagactgcacgttagaatcacctagtgggcttttaaaatatacagatgccagggcttcaccccagactcattaaatgaaggtctccgagtcatgaataacatcggtgggtgggggccaaggactttccagagctccccaggtagttcagatatgcagccatggttgacaaccattgacttagaactgggagggggctcccttattctcttgttcctccagtgtttcctaagcgtcgaccttatcaaaagtaggtctgacagtgtgttcccagtgcctggacctggatattttttacttcagctttaattcaaaccattatgtgctgctagtcactgtggtgtgggagcagcagtgcacaaggtggtgaggaagccagcctgcctcaaggagtttaacatttcctaggaaagcagtgtctgaatacttagatgattctataactgacttgcacagacgttctgctgtcacagtaggtattactgaataatgtggctgctccaagtttttt

SEQ ID NO: 41383 - DNA, 1761 bp, Homo sapiens
agtatttaccaattattttaaaaatcctttattatgaaaataagtcactgtggacagttaaagcataaaaagtttaaagaagcaaaaaataagcatacaaaatcaaccattattttaccattcttaggcagccactgttttttttgttttttgtttttttttaactttttagagcaattttaggttcacagcaaaattgagtagctggtacactgatatctcgtatgtctcctgcccctgcacgtgcacagcctcctccatgatcaccatcccccaccggagtggtatgttgcaaccattgatgagcctgtattgacaccaggatcacctgaagtccatactttacattagaattcactcttgatattgtacattctctgggtgtgggtgaatttatgaggtgtgtattcatcatcacagtttcctacagagtcctttcactgcccttaaaatcctctgacctctgcatagttatctcttccctctaacccctggcaaccacacgtcttttaactgtctctgtagttttgccttttgcagaatgtcgtatcattgggatcatacagaatatagacttttcagactgataactttcacatagtaatatttattgtttcctccctgtgttttcatagctcatttgtttgataactcacttgttttcagtgctgagtaatattccattgtgtggctatatcaaagtttatgtattcacctaatgaagaatatcttggttgcttccaagttttcgcaattatgaataaaactggcataaacatctgtgtgcaggtttttgtatgtggaaataagttttccatttctttgggtgaataccaaggagtgtggatcatatggtacgggtatgtttcgttttgtaagaagccaccaggctgtcctcagaagtgactgtaacattttacatccccagcagcaatgactgagaattcccattgctccgcatcctctttaccatttggtgttgtctggattttggccattctagtgatatgttgttgttgatgaagtatctattaaggtctttggctcattttttaattggttgtttgaagcaactacttttaaaggtattatttccttcctgtctttttatttttatgcttttttatgtgagtggttgagatttggggtaaatattccatctgttttttttccatttaacgtcacgatgaaatctttttctgttttgttaaagtgcattatgtcattgtaacaggtatgtaattataatgagatttgacattcacctattcttagaaattttggttctttctacctttgcaaaattataaacaatattgccattgagatgattgtgcctgaaaacctcccctgtgttttgtgttgttttcttagagcatatcctagaagctaagtgactggtttggagaacagagacatttttgagggtctttaaacatattatgagattactttccaatgtttatattaataaaaatactagcagctaacagttactgagctctatgtctgtgacagacactagatttagtctttcagatgtttttcagttctcccagcaccactgtgggtggacttaggacagttcttgttttatgggtggagaaactgaagcctagaaagatggtaaaagtggccaataagagacagtaataatgacagagtcgaataaagagatatgctatatagaggaagactattttttaaatttcggttattctcaagttgatttacagtgttaacagagttccaaacaaaatc

SEQ ID NO: 41384 - DNA, 1103 bp, Homo sapiens
tttagtaaaaaggatgttagtatacatatattgaatgcaaatattgtgtgtataaactagaaagccatgcaagagaatattaatagtactgatgaactctggatattgggattaggagtgattttatttgtgcatatgtttttctattttacagtgctttttcattgagcacattctgcatttgggaaagaaaggttatttaaagttgttcttattaaagttactgcatttaattctgtttttgccattgtgtcaggcaagtaaaaatgctagatatcaagttaccagaatcttctctggagcccttcctctgggggttacatgtatatgctgcctgtcttttggaatagtgatttgtaagtgacatggtttaagggtttggaccaacaggttcatagtttcaccctgctttcttttagagctgctggataaattctgtccggtttcaatgatttatctatatttaggttgtcaacctaggtaagaacatcctgtgcagctctctgtttgctctattgagtccttgtatggttatcttgttagtatagtgctaatgataacaggctgtgtgtaaaagctctctgtacacagctgtcgaactctgctgtgtttggtggtgcagactacaccctgaatcctgttaaagaaaacctttgagatcataacaggatgtttggaagttttaatataaatctcttacttatatcaaaagcagttgaagcaaatagtcttaaaatatagtagaattctaatgtatctgacctgcttccttaagaattcagtttggctatggtaatctctgcaatcttctccttaaataaaaactgaaacattaagtctgccccttttctttaatccctgttcaagagggtatgtcgatacttgaacccttttaccagcatttaaagaaccagctgctgctggcatagcatgtctgagattgcattttgtcctgcctacctttttattagaccttgcacagccatatttgtgagtggattagtttcctgtttttgccataataaattaccacaaattgaccagtttaaaacaacactcatttatcatttcccagttttgtaggtcataagtctaggtaaggt

SEQ ID NO: 41385 - DNA, 1040 bp, Homo sapiens
acatgttcactttgagaagtctgttaggtagccagaaggaactgttgcacaggcatttcgatgtacaaatctggagttatactctgtagaggtccagattagaaaaaaaattggagggtcatcaatctaacaaaaggtttaaaaactgtgggaatgtactgggtgcagtgagtcacatctgtaatcccagcagaaatgaagatcatgctgtaagagagtgggattacaattgacctccccatgtctcaggttccacatgcacagattcaaccaattgtggatcagaaataggtggaaaaaaaccaatacaacaatagaaataatacaagtaaaaaaatataactatttacgtagcatttacactgtattaggtactataagtaacccagtgatgattggaagtgtacaggaggatgtgcatgggttatttgtaaatactatgccatttcctatctgggacttgagcatctgaggttttgggtattcttggtgggccctggaaccaatgcccgtggatcccaagggatgactgtatgcctgtacgtgatgatgggcctctctccatgaatttaagtcaccaggactgggtttggggagtgtcagctcattttctgcctgtttatcagcagacacagatggggtagttttctcacttgcacctacggaaaatcctccttgctcctggggttgtttgactcagtgtctcccttttcttgtgtctgggaggttgatggcatagtacatttactccccaagtagtctgtgagtgtggttggttaaggtggctgaactgaactcggcatctcccagcaccaccaacctggaaagtgtttttggtaggtgctgtgtgtacaacatccttctgattgcaaaggcctgtactctagcattaggtcgggttaattcctgtcaggtcttttttttctcttagagccccatttctaatgaagggattaatttggcaggtgatatcaacttgcaagccaaatttagagttgattttccaaatgacttctcccaaatgccctattatttcctgt

SEQ ID NO: 41386 - DNA, 1033 bp, Homo sapiens
gccaccacacctgctaatttttgtatttttagtacagactgggtttcaccatgttggctaagctggtgtcaaactcctggcctcaagtgatctgcctgcctcggcctcccaaattgctgggattacaggcaagagccaccacgtctggcctctcctgtattttggatattagctcttagctatatagtttgctcacaccttactcttaatttgtctgtgaacgtggctgagaactcaattactctaccatcttgggcagcttagaagttgtgggctccggagttgtaagacgcatttcgagtggcggttggttacctatctttacttgctggtggattttaaaacatcctaatttacaaaaccagcagtaaacctaaggcaaggcttttatagaaactgtatcttttaattatttttttcctttgaaattgtactaaaaaatttagacaggcatggatttgaaggatgattacttacagttacagaagtggaaaatccaaaggaaatgactttttaacctctgaaaaagtttttaaagttaacatcagggaatacgtggagaagtaaggaaaggaagtgaatacattgtgctgagagatgtccacattggtgactggagagagacgccctgatggcattgctttctctgccttgacgagttctgtatctcatcctgaaagtgttgtttgcctcttcctgtggagtgacacaagacatcgtgttaagactgttgccagttctaggaatctttggaaattctgatgttctacagagagagaattataaacgatttttgattgagagggctagtttaaatgcagtgacttttaattatataacctttctcattcaaccagttgtgagttatatctcctgtgtgcatggcactgtgctagataccatggttacagtgatgaataagacagaagtagatcctagctttgggtgatatttaaagcccagttggggagacaggtatcagtgcgataatctcagaaataaagaaataccatttgacccagccatcccatta

SEQ ID NO: 41387 - DNA, 1049 bp, Homo sapiens
aataactgtctaatattattcttcagaatgttgcatgccctaaaactaaagcagccttacccaactttgcagtccatttttttcttttctgagtgtactttttaagatgtcattgtcatccctgagttgggtttgcctcctagtactaatttaatgagtgctggtatttacttacagtgctgtggggttttttttccccctccttttattgagccatgtttgatactgctttctctgacgataaaacagtaattactgcttatttctctttatccttttatcctaccatgacagttttatttctcttcatctaattagtggttcacccatctattgcagaatagttgctttgtgattagttaggcaagaacatcttgaaataatgcttatctcacattcaagatatttatctaatgcccgacaggttttcttcacttggagctttaagtgattaaaaagaacacttggtatatatttcataactggacattttacaacctaatttaaagacaatattccaaacataaaggtttcaaggctgaacatttccagaagaatcatgaaatgctataagcttaggccagaagtcagatatttatgccatccagtggttgcactcagataaaaattcatcaggagcaaatactattgttgtgctttttcaaaaagaatatgtgtgaggtcatttgccaaatagattttacatctaactgtgaaagtcactgtgggaacccacctgctctctcccctacctgagcatctgtggaatcccttcccgaagccttgtgattctcatctccaaccctacctgagcatctgtggaatcctttcgctaaatctcatgattctcctctccacccctacctgagcatctgtggaatcccttcctgaaggctcatgattcttgtctcccacccctacctgagcatctgtggaatcccttccctaaacctcatgattctcatctacctgaacatctgtggaatcctttccctaaacctcgtgattctcatctcccacccctacctgagcatctgtggaatcctttc

SEQ ID NO: 41388 - DNA, 1060 bp, Homo sapiens
actgctggagtcaaaaattaagaaaactttgtaatgctgtttaattcatgacccagacccagggcagggtccttaagagctgcttctggtgacactgcaggatacatctcacctgtacccctgtggaaagccaagggtcagtgggactcaacccatacatgctccttgggaactctctctcatgacaagcctggtcttatctggtcttatctcagggtgttttggtggaaatctttttttttttttttttttgagacggagtctcgctctgtcgcccaggccggactgcggactgcagtggcgcaatctcggctcactgcaagctccgcctcccgggttcacaccattctcctgcctcagcctcccgagtagctgggactacaggcgccggccaccgcgcccggctaattttttgtatttttagtagagacggggtttcaccttgttagccaggatggtctcaatctcctgacctcatgatccacccgcctcggcctcccaaagtgctgggattacaggcgtgagccaccgcgcccggccttggtggaaatcttgactgtcaaagttaccttctcccccacaaaggaggagggggaaagctgccgtctagaaggaaccctagggagaaagggatgtgcttggaggtcaagaagagtcacagggtgtgtgtcccacccagggcattcgtgcaccttagggctggggccatgaggaggctgtaaactggaaagatcaaggcagtcgtacaaagacagggcaaaacatgctaaacagatgagaggcagacagctgcagctgtctggaggtgctgtcacagttggcacccagtgtctacagggtgggttccctctttgtggaaagggaggtagcattcccgggtggggcacagcacaccctgccgagtcctggaaagagggtgaggagcgtcactgtctggaaattcagggtcctacccaaatgtgaagtgtgtggaggcagggtggtgtggaaggcacactggatttaaagcaggaagagggactgtgagagccagctgtgctctctcgtcactttctgcctg

SEQ ID NO: 41389 - DNA, 1223 bp, Homo sapiens
atagacacatagttcagtggatggagtagagaacccagaaatatattcacacatggataaccagctgattttttgacaagggtacaaaactccatagaatctgatcagaggctgatgtccagaatgtgtaaagaacccctacaactcaacaacaacagaacaaacaaagtatttccccagagaagatatacaaaaggtcagtaggctcatgaagagatgttcagtgtcattagtcattagtggtcaaaccacagcaggtcatgacattaacaggtcaaaaccacaattagacacaacttcacaccccttgtaacagctaatataaaaagtagaaaattaacaagtgttggtgaggatgtggaaacagtggggtccttgtgcattgctggtggaaatgtaaaatggtttagccaccgtggaagaccgttggttgctcagaaagttaaaaatacaattaacagcaatttcacatctaggtatataccccaaataattgaaagcagagacctaaacagaccttgtacaccaatgtttatagcagcattattcacaacagcaaaaatgtagaaataatctaagtgtccatcagcagatgaatggattaacaaaatatggtctgtaggtaccatggactattatgtgcccataaaaggcaggagctttgaaaaatgctgcatcacgtggacgaactttgaaaactaatcattcactatgctaagtgaaacaagccagacataaaagaacacccattgtgtggtttcacttacatgaggtctctagaatacgcaaattcataaagtcggaaagtagaatagaagtcatcatggccctggggggagggagagatgggagttactgtgtcacaggtacagagtttctgtttgggatgaagaaaaagttctggatagaaatagtggtgatatgcacaacactgtgaatgtacttaacactatgaaattgtagactttaaaatcattaaaatgatagatttcaggcatattttaccacagttttttaaaaagcaattcaggggaggaaaggtgatcttttcaacaaatggtgctggagcaattgggtatcaacaggcaaaataatgaacctgacctaaacctcacattttatatctttaaaaaaacttaaatgaacaacaacaacaaaatgacaaaacatacgagagatttaaatgtaaaatgtaaggttataaaactttttggaaaacacag

SEQ ID NO: 41390 - DNA, 1043 bp, Homo sapiens
tggggtggtggtggcaggcctcagtaggagctgatcctccattccctgctcagcagtgacaggtggtacactgatccctgcaacccgtgcagtctcagcaggtctagcgtggagctaagcctctaccccaactcagcatcaggtacttaaggagggtgagagaagctgtgcaagttaactattaagcatcaccccacacaccctttcagtcaggcacagggaggaactgaccttcagtcccaagctgcagctacaaagcaatgggagtcagcctcccctcccccttcctggtggttgtaaagtgcatactgaagctcacccctcactgagaagcagcaaggggagaggagtcagtgcttcccttttgccatgatagtgttggagaagcccagcataaagctgaacacacatacccagccggcctttatgctccacatccacaatgggtaagcccactaaaaagagatgcataggatgcaaaggtcttattatatcatacccaaaatatgtgggatatacctgaagaccatttatcatacttagaaccagcagaatcacaacttgaatgagaaaagccaattatcagatgctaaatcagagatgaatgtgatgttggaataatctggaaaatattttaaagcagctagtcataaaagtgcttcggtaagtaattttgaattctcttgaaataaatgaaaaaaaaaaatagaaaatcttagcacagaaataaaagagccaatggaaagcagagaactgaaaaatagaataaccaaaataaaatactcattagatgggctcaatagtagaatagagatgacacagaggaccgaatccatgaacttgaggacaggtcaagaatgtagccaatctgaacaactaagaaaaaatagattggacacaacaacaatggacccaaagggacctgtgggacaagactgagaggtaacattggtatcatcagaattcataaggagatgagaaagaaggttgggctgaaaatgtttgaagaagtaatgtttgacagcatctccgatttggtaaaa

SEQ ID NO: 41391 - DNA, 1046 bp, Homo sapiens
ttatctcaagagcttagagtaagggaatgagaggagaaacatggcaccctcaaagattattagagaaggttctatttccaaagattagaggatttccaagaggaaactactctggaaaggatttttaattgcatttagggaagccagtgtactaagagctgagacaatcagtgctcagtgtagtaatgatacagctacttcctaactcctttctgggtgctataaagacaaagttaattgtatcattactatttcaaaacaactgaggcttttaaagtgtttcttaggagtgttacaagcctgtctgaagtcctggagagcaatgaagtgtagatccaggaggctgcagtcaatgcagtgtggtggttgagagaccaggccctgaaatcagacctgggtcaaatttcggctctaccagtttctggtcttacgccctttggcaagttagttaatcttttgaggtttaattcttacatgtagtatgagaactgagaagtaataactgtatctatactgaaggagtgttataaagaataaatgagataattaacacaaagcacttcataaatgctctacaaatgccagctttgctgccgttgttagtattataattagaagcaggagcagtagtggtgcagaggaatccagagacaaatttcgtctttgtttctaacagcatgatttctagaaagtcacttagctttgcagacctcagtttcctcatctagagttttagtatgttggagtagatagtatgtaaagtatcttccagtgtttatcttcttggatgctacagtgaactttttagagggaaaatactacagcggctgaaagcacaggctgaggagtctttcaggcctcagtttggatcctgcctccattctgaggcacacaccgctcatggccaatccatgtcctgtgtcctctgccttccttagagtttgccattttgttcagaacagcactgtgagctccctcccacctccccgaccctatgatgaatcatgattgctctaggacaggtcagcagactactgcccaagggg

SEQ ID NO: 41392 - DNA, 1032 bp, Homo sapiens
tactactggtgaaattttgaacaaattatttaattttactaggcctcagatttcctctctgtttcttactttagtaatgaggattaggttagatgaaaaatataaggcttttgctccgttcctactacagaggaagcaaataattggaagttattatttttatttcccaatgaatccattcataattctaaattattttgagtctgtgtctacacaggcccatatctgccaaattaccttttgcaaaaaaccatgttttatttagaaatgctttgacagccagaacatgtgtgtctattgcaaacaaaaatattttcagtttagaaatacttgttttgatcatccgtgtggaaatgaatgttttgtatttgagttgttaagctacaaaatatatttgctaaatgtttttgcaaaaatattcatccatttcttagaataatgccttagagaagcacccagtggtaattatgttcttaggcatgtttatgacacagaacagatcgaaccttttggaaaaatctggaatggaagctgggactaatagcccagtgactctagatgcagggcgtcacctacctcatcacgacgctaatgtttccagggcttgctagttgaatttccacatgacgattagcacaaatccagaactaaatgacaggttatacttctgtctcaagcatcatatgatattgatttttttttactgtaactagaaatttttttcctggagggtcatgagaaaaattgtattttttgacaaaagtataataatttacttgagacttattgttaatgttcagtgatagtggcagggatttatccttttataatccttacattgtttctctttcaaatttttcgtgtagggattataaaaataaacccactggatagcttgtaccttttgctggcatttaggataaagagaaacccaataaatcttgcgtcgagtggcctcactgatattgattgaattataagatcatagtatagcttttacagataagtcaccaggaagacatcacacaatgt

SEQ ID NO: 41393 - DNA, 1032 bp, Homo sapiens
tccaagggacacgttgcatatgtggagagcagtggcaaggaatgattgattgcttgattgaccagtaactgattggatcactaactgataggcatgaaaactcctccctcactaattcctatataatcctcatctgagcccaggatttggtgatggtgctctgtaatatgtagtccaactttctctttctcacagagcttacatttctctgtgtttgtgtgtgtgtgtgtgtgtgtgtgtgtgttgttacctacatttaaggttactcaaaaagcagcaataattgtatcttatgtaattattgtctaaatttctaatcctttggtgccgatttctgaaacaatgttaacaaaagtaatcaaaggatgaaataatatatatttaattatttttgagttgtgtcagttcttatattaaatagtgtattgaatttagggactaaaatgtaattataacaaagcaattcactctaagaacatttgattgtttataatactgtagggtgtctaacagtagataggagacctctgatatttaccatagaagttcctttaaaaaaaaaaactcataagtaatacggtttatggaaaaattcatcttgtttatggaatggtagtgcgaaatagaacttgtattttagaaatgctttaaagatcttgaatgagatatactctctcaggttcttaaacataagaatcagaatatgaaaggcatgttttattttctagattttccttctctcgccatttgactaattcttacagtaaaagtaggggaagtgaatgaagtgaacatcaatgatcccatgctaggtttgtttatcttacttttggaaaacaatgataatgattctgtgtagggctgtggtttttaaattgcttgtctgctaattataagaaaagccaagatattgaaatttgtgtagtgctaattactcatccctttctttcccgctgcaatttacagtgtgtcttcagggtgtcagtcactgatttggagcttctgcctctgcttcttctcagcaattaggtc

SEQ ID NO: 41394 - DNA, 1029 bp, Homo sapiens
acagaatggggaacatagaaataggcccacataagtacagccaagagatttttgacaaaagcataaaagcaattcaatggaggaagaatagtcttttcaacaaatgctgctagagtggttggacgtgcataagcaaaaaaaaaaaaaaaaaaaaagaaaaaagaaaaattgtatcttgacctacaccctaatctttatataaaaatttacttaaagtgtgttggattaagtgtgaaatgtaaaactgttaaactttcagaagaataaacctctggggtttagaacttagtgaagtgttcttagacatgacaccagagacacagtccataaatgtaaaaattcaataagttggaattcattaaaatttaaaacatctgctctgcaaggggatgaaaagacaaaccatagactgtaataaactatttctaagctacatatttgagaaagtggccatatttggaatacataaagatttctcaaaattctacaattaaaaaaatctaatgctaaaatgggcaaaagacgagacattttactattgtacgttttcttgtgggagcaaagtaaatctttttaaaaagcaactgtgtctttttcaactcacttcttggaagtgatgatggaagtgtgtattcgtggctcctgcagaggttttagctggactttccatactggacatgaataagcacccctctccccctccacattagggccggatagcattcaccactctcacctgcttagtcttctgccccaaactgcttcattcatacctgcttctggaacattttctcgtacactgactccagcacagaggctgttctttctaagttctccctgaattagcagtgatgagatgcctcatgacccgagaaacctggccttggctgttccccatgttggactagtattggagatcacatagtttattgtttcacttgtcattgactagaaaataaattagaaagatggttcaagttcagcatttttactcatggtactccttgacttctgcctgttttgcaaaag

SEQ ID NO: 41395 - DNA, 1035 bp, Homo sapiens
ttcatagtttctgaaattatttgacatattacttgactataaaggaaaaaaaatcagagattttattaaaactctgtaaacattcctaattaaacctcacatgttgttcacaaaccttttatgttttaagctgcttcaggacagagaattgattctcctctcatttttcactgacagatctggtggtacttagagccagtaacatgcagcagttaattatgctgctgtcccacatgtgtacattttgttttcttgcctgtatttgttataaagagggttcatgttacattcctctgcaccctccagaatgattaggtgggcgtgagatcctcacatactgaacacacacttagtaactttcttgttgactggttattctgttgtttcatgttattttaatgagactgggaaaaaagccattgctcaaatctggttattctttattaaagttctcatattggaattattaaggactaatgtcattagggacatttctacttttgatatagaaacaagctgcttagggaaaaatctcctgttttcatgcttgacagtgtagtttctcgtagttaaaacaagtctttatgtactgttttatctcctgtgctaaaacagaacggtgaaatctaaggcaaacattgtgtgtgtgcttcgacactctcgtaaattactcttgccattaatttaaccacagttgtgttatcacttgacctaaaggggctcctggatgattgggaaaccagcagagaggctaatgggccaacaatcttggcagccaacctccgtgtatgtcttggaaaattccttcaggatgtttgctttggcatttgattgttcctatcttcagattaccttattttatagtatattgaatgttgcatcattaacaaatacctggttgatatctttattactgtggcttcaggcagtaatacaaagatttttctctaaaatacaaagtgtatttgaaagcttttctttacatgtatatcagtttcaaactttacaattaaattttattcccaggaaactctc

SEQ ID NO: 41396 - DNA, 1110 bp, Homo sapiens
accctgttcacaaatatactagatcgtcataaattgtacaaatgtaattgtaaatttaaggttttattttactttttgcagatgagctgcagactatatataaattcatgtatgtatccacttaccagaaattttattaaatcaaaatatatttgacccagcattttccgatccgtttacagtgggagaaggtaggctacgtaggttcttccctcctcaggtggcactagtcaagactgacagagccaccagcaactgatagcccaaagatatcctctcagcctaccgaaccagacacccctcaccttctacctggtgatgcagggaagcccagggaagtgcgttctgtcccacaggaggcaatagcagggatagagaaggatccccagaccctacagaacaaaggagaccaggacagctctgaaaaacacattatcattggaactacagcccaaaaaagtaggcaaagtcctataccctaaacccatcaggcaactgccatctaaaataaaagatttaaataggacaaggagtcttaacataatatcgaaaacgtccacagagaatggaaaattactgaacatacaaagaacaaggaaaaatcacaacttgaatgagaagacacaatcaactgaggccaaaattgaagtgagtcagctgttgcaattaccagacaaggattttaaagcagccatcataaaagggcgtcagcagcaaactattcattctccttgaacaaatgaagaaatagaaaaatctcagcaaagaagaagaaattatttaaaaagtgaaagtgagtgaattgaaacattccataaccagaattaaaaactagcaggattagctcagtaataaagtggagaagacaaagatagatcggtgaatatgaggatagatcaatagaatttgctcagtctgaccaacaatgaaaaaggtagacaaaaaaaaaaaaaaaatgaacagaggctcctgtgaggctgtaaccaaagatctaactttaattttattggagttctagtaggagatgagaaagaaaattgggactgaaaaagcattcaaagaaataataggtgaaagctttctaaattgggggaaaaaaaaaactccaca

SEQ ID NO: 41397 - DNA, 1050 bp, Homo sapiens
tgtatttacacccatccatgagtgcaggcactgctggtgtcatctgaatactctctatgaattctcccaacatcagtttcctggttttgatgttgtttggtaaactgtagttactcagcacgatgttggcactggggcaggttgggtgaaggatgaatgggtttcactgtacatttctttgaactcctcgtaaatctaattatttcaaaataaaatgaattaaagacaatatgaatgagagaacatcaaataataaggctttcacagtacagcgtaggcttctaaagtttgggaggagggccttgagatgatttggtaacacctctgtgggtgcacccttctgacgcaaatgaccctctgttgtctcttctgctctaaccaggcatcagctatgtgggtgtctggtgtttccaaaggagggtaggatgagatcagagagtgcattgtgtgctcactgaggaagggggaggaataatgatctgttcccaggattaagaaagaggaagaggagatacaggaccataagaaaagagaacccagagctgagagcttgtaggaatgtctctgctccattctactagggcttagaccggttggcataacaacttcatgaactgtcggccatccttaagctctcctttaggtaccaattatctcctgattttctcttcattattaacagtaaattattttcctttcctctttcctttcctttcctttctgacaaagtctgtctttatcacccagtctggaaggcagtggcaacgatcatgcctcactgcagccttgacctcttgttttttttgtttttttgaggttatttttgtagagccagggtttcaccatgttacccaggctggtcttgaactcctgagctctagtgatcttccttccttggactcccaaagtgctggaattacagatgtgagccaccaggccagcccaggttagcagtaaatcttgctaagattggcccataaagaataccctggcttggtagactgtacagaagaaggggagactcggagaccacgtcctatgccatagcca

SEQ ID NO: 41398 - DNA, 1060 bp, Homo sapiens
cactgtcctcttcttttctgaaacagagccatcacattggagaatcagctggtgatcctcgccaccacaaccagtgatgccggggcatactacgtgcaggccgtgaatgagaaaaatggagaaaacaagacaagcccattcattcatttgagcatagcaagtgagttttgaaatcccaaatggtaattctgcaagcaataaaatcttgctttaatcagtaaccactgtctgacaggacattttgcaataaattttctctctctagtgtagtagttacggtttaatattgatccagtgccaatagttcggagagctttagggctcttgctttcttcaaaatgatatgcggaaaaatgtgaatctcagtggtacttctgaatgccagatcttttttgggaattaaaaaaaaaagtatttgctttttatacacagtcaatgcatgttgttcctaacaacaaagaactttcaatttaaatgaattgtatccatgaacctaaatcaggactagattagatatacattatattcttttaatctaacaggaaaatctttgagaaattctacctattaagttgtacgaaaattagcagtatttaagcataatcagttgatcattttttccacctaatttaactgaaagcctgattcttgaagacaatgcacacaaatcatgggtatttgtcgattttatttgaggggactttagtttgagtaaacttagttttacatgtttggactttaaattctactagcaagagttaattgctaaagaagggaaaatcacccaaagcaggaactctgaactaatctagattcagacatccatatcagaaggcttgtcatcagatgtttgcagcatgaagcttcatggtatgaaatgaaattgtcatgcggttgagaaaatagggttgaaactagtcatggcggatggtaaatttcaaaatattattatcatatcatatgagtgaattatattgatttgtttgtatagtagtggattttatctttttaaaaattgtcttgaaggaatcgtttcccctgcaagtgatttgaaaagtat

SEQ ID NO: 41399 - DNA, 1050 bp, Homo sapiens
tttccctgaactctccaccccgctgccctggtgagagcttgctgccatcccaggggtggatccactttgaagttttaatgtgatgtgaagccagcagatgttaaggacataggtgggactgttgaagcatcctgcatgaatttttcatggccagctcccactgctcaggtgcacaccagaaaaagaagggtttgggcctgcctgagagtagatgtgtcttccgaggtcagacccgggaaagctttatgaacctgtcaacctatttttggcttttgctttgaagattttacgttgagttaacctttgtggaacagaacttctgaactgaattactatgtgaataagagtttcttcctctaaaaaaaaaaaaaaaaaaaaaagccacaggcgatgagacgaattctatacagtggttaatcagtcattgtttatacgccattgtacatgccttagacataccatcagttctgatccaatattcaaaatgtccaatgtaatgagattctctactagggatgaagcttggattaaaaagaaatgactgcctctctccttcctgtttttttcacctctttcattttaatgtctcctcttcaaacaacatttgcagataggatatcatttcagctgatcctccttcaggctgacaaacccttgcttttaattctgaagaccacttaacattcttttgtcctctataatgctaatttaactgcagactcacgtagggttagtagttgaaagtggattcctgagaatgtccatgaacagtcatttcagaggactgccctgtaaaacatggcttttgtgtgcccaggtacaactctctcctattttccttgtaccgttaacattaaagggagagaggggaacaggcagatgccttccagatggcctctgacttggctcgggttcctaaaacaataggaactgtttgaaatattactaaaaaccaatctggggcctagccccacatcacaaatgagcaatttagaaccaagcatagttttatagattgtatgacactttactgccagaatttttcagaaa

SEQ ID NO: 41400 - DNA, 1030 bp, Homo sapiens
tttttaaaatcatgttgtaatttcttaatctggctgctgctgtagtgaatgcagcctaacgattggtcaccttttggtagcagttcaactccacctttaccacttagtcataatgttttattactgttcattgtaaacgatgttcttttggctcttgtagaaggcaattacagcaggtaattaaaattgtagttctttacaatgtgtttgagaatattaaatcaagcccacagaaaatcaggtaaagtatctgttaaagtgaaaggccacttaacaatgctgaagaccattagcaaatccagagtgctatattccctgcttttccaagaacacttcgtatctgagatgtaaagaaatggaatttatatcagaaataataggaaccagaaatttatctggagatgtagattctttctgtgtgttctaattagtgagttcttcgcaatagtctctctctctgattctttgttatttcaggtaattattctgcctgcacccctttaccttttatgatcttgaagaataccctgtttagcacaaaattagttccttccaatctagtatacctctatgtttggctgagagggtcttaggaaagtataagaaagcctgtgacctctgcttgtcagtgtaaactgttattttgcccaggaataactagcaagtgtagctttttgagacggataccaaagatattattttatgtagttttagagcatcataaaaatgtgagctgggaattccctagctcacctcagtattaggcctgcatgaccatctgggaagtgtgaaggctataacggttttgtggtttttctagggaggaagatacaaatgtcaaaactggaagtgcggaactctagagaagctcttaaaagaatgaaggcttttccattttagttcctaagtcgaacttaaagagtaggagtcagagctgacataagtcagtaatggcgagcatccggctggccccgtgcggtagtttgctgtttcactgatgatgtattttgttgaggtgtgtcccatctga

SEQ ID NO: 41401 - DNA, 1054 bp, Homo sapiens
gtgagtgggatttgaagccaagttgaatctcctggcttcggattctctattttgtaactgcagatgggatatgatttattaactttgtcgctagctatttgaaaaaggagctcttactatggagaagaaattgttacattcctatcacccgcaaaataggacttgactctttcttcctcaaattaactaaagtcaacctgttttcaattggtgatattccttcattagttttaattcatttttcagcacacctgattttttaattcattatgcttttgatggaaattaattagtttcttttagatctaaaacaatattattgtgggcactcagacattgttacacaaaagggccttattatgaagctggtctcagaatgaaagcctgggtctgtttcataggaaactcgcctgacgatgaagccatcgggacgctgaggctttttggctgcctggttctgagcctcagttttcccatctgtgaaatgaggagcttgagccagatgaactctaaacttttgtttgatgagcacaacaaaatgaaataaaatcttataaaatagatatatgaagatgtatatgaaggtttatggtaatattatgttgatcaaacattttcttagcccaatagagaatgaaaattaatatcctactacaactttgcagaaatcctatttatttatttattagacagagtctcaccgtgttgcccaggctggagtacagtggtgtgatctctactcactgcaacctccacctcccgggttcaagtgattctcctgcctcagcttctcaagtagctgggattacaggtgctcaccaccatgcccagctgatttttgtatttttagttgaggtggaatttcaccacgttggccagactggtcttgagctcctgacctcaggtgatctgcccacctcagcctcccaaaatgctgggattacaggccatgagccaccgcccctggcccagtttaataattttagaccgtattgccaattatttaaaggagaagggtgagtttgtatttctttaattaggtttaggtaacggc

SEQ ID NO: 41402 - DNA, 1014 bp, Homo sapiens
tttttctgaaaactttcatcatggatgctatagagttcacaatatacatttaaaaatctgaatctacctccacataatgctatgctgcttcacacggagtataaggaccttataacagtgtatttctaattcccctctcccattccttctactattattgtcatacattttacttttacatacagtatcaacacaccagatatttttactattacagctttaaccagtcagtaatcttttagagaacttaaaaataaataattttaatttaccttcctttattccatttatgatgcttttcatgtcttcgtatttatcccagtctctgacctatatcatactccttttgcctgaagaattttctttaatgtttcatgaagagtatgtctactggcagtaaattccatgagatttgtttttgtctgaaaagtctttctttctccttcacttttagaggatatttttactgggtgtagaatcctgtattgagatgtttttctttaaacatttgatgtaattccactgttttcttgtttgcatgagttctgccaagaagtctgctatatttcttatcttgctcctctgtaggcaatatgtctttttttcctctggcttccttaaatattttttatttgtcccttctttttcagtagtttgaatatcataactagatgtagagtttgtgttttgttttgttttgttttgctgcttgatgtcctctaagctttgatgatttggtgtctgtcactaattttggaaaatcctagcccattattttttcagccatttcttctgtcccttctgtttttctttctgattttataattccaattatgtatatgttaggctgtttgatattcttccacagtgcttgcatgctccatttagttttgtttgccttgttttttctctttgcatttcagattgattaattcctattgacccatcttcaagttcagtagtcttttcaagtctgctcatgagcccatcaaaagcatttttaatctaaatact

SEQ ID NO: 41403 - DNA, 1065 bp, Homo sapiens
gtaattaaggggcttggtacccatagagtcatctcatcatcactgtaataaatcattcttatatttatttattggagcctgaggatgttaaacccttacttttgtatgaccattcatagcttattggtgctttcatctttatagaaacacattagagtctggctgcctcagggcccattccctagtcacttccagccagacatccatgtatcaaagctctagccaatcaacatgtagtggacgtctgctaagtagggcttccaaggatgttttctgtttagaataaaaagggggaaatgtggctagccacatttgaccactatcccttcttctggaacatggatgtaaagctggagacagtgtagccatctcgtgaccacgaagcagtgatgaggaagacaagaagcaactcacggaaggacccatgccccctttctctttccactccgctgtcctgaggcttcttcttcttcctcttcttttcaagttgcgtaaagtggatacttagatccctgaagtcagacctttcttcttttctagtgtaagtgcttgatgccatcagtatccccaggcactgctttaggctcatctccccatttttatgttgggtcttcattttctttcatgacaaaatatcttctaattccctttgcattttctcctttcacccatggattatttataagtgtgttgttaagttctaactctttggcgattttccagataactttctgttactgatttctgatttaattctgcggtggccagaaaacatactctgcatgatttcaatccttttaaatttattgagatttgttttatggcccagaatatcttggcatatgttctgtgtgcacttaaaaagaatttgtattttgctgttgttgggtggagtgttctgtaaatatcaattaggtcaagctggttgatagtcccgttcaagtcttctgtttactgattttctaagttttaaagacattttaaaaaatgaaaaacgaaatgtttatatatttactcacatattgaccatttctgctgttctttatcccctgtgtacattcagct

SEQ ID NO: 41404 - DNA, 1050 bp, Homo sapiens
cttggcctcccaaagtgctgggattacaggtatgagccaagttaactatcgtaatgaccccatgtccttgtcagtgcaccacatcagaggccacctgatgtcaacttgtcccattattgattattttgagtgtgattattaagctaaatggggaccaacaggtttgtccaaagggaaaggtgcatttttcctttgtgagttatcaataatctgtgtggtaataccttgaaactatgggactattctgtttcttaacactctttactcactcacgggtgactcttgcctcagtcaactattaccacgatgtttgtgtcctaacttctaccatcctttgtgtgtttattaggttagtcttcttctgtaaggaactccttttccttcttcacatttccattcctttttttaggaagggactcttgttctttgtgttaattgaatatgttataatatcccgttactcatttaggtgttaacattgtttcagatttggctgctgggcatggtttcagagtatctcctctatcttttccggatgttctcctctgtctttgagtgtgtctcactttctagcacaacaagctgctccaggctcacctgtatttttcctgccccagccctggaatcagccattgctccaagaagctttggtgcctttgagtgcaatatgatatttacgaaccaagatctggctgctaagtgtgcttattacttccttggtgttcttactcccagactcttcagtggctagaaatgtgcgcgtgtgcatgtgtgtgtgtgtattttaaatcatgagtttacgctgacatctctaattccagttcatcatcacagggttcttcctctcctcccattccatgtttgtgtctcccttctcccacaataagaaccctgattccccatcacattaatgtatttacccacttattcaatcctacaattcacacaaaattgtttttggaattgctataccgatactactgctcactacaaattcagtaagagagatttaatatttccttctggttcttcttgtgcctggaagatgtc

SEQ ID NO: 41405 - DNA, 1050 bp, Homo sapiens
attccattgaagtattaaatctctattttggagaagaactgctaagaattttaaaaatatgttaataggctgttgcccaatacaggctgcacaccttcctcgggcacttgacaagcttcacgagctcgtgtttagtttagatactgaagcaaactagcccataaaatacggtgctgtaaatataaacctttacgaacctcttggggtagtccttctaaaatgtaaattaagatattccatgattcaagcccataaactgaaaagtagccatcaccctgagtagtaagttgctttctgaaaccccagactgtaaattgcctttggcctgtgctcactgagttctgagtttgtatgcacgatgctaactaatgatgaaattttcaagaatggtttttaagaggagcccacactatcttaggttatatggtctctgacatatccttctttggcttaggggcttttttttattttcttgtttgaagagccaccatattttactgctgagcccgagagtcggatttcagctgaagtagaagaaactgtggacatcggatgtcaagccatgggtgagtgcagagtggctgctggacaaggagccatgactgggaggaagggaaacaacctttttccatagcagaattgccatcattctagggagacattgagtgtgatggcgaagagcagacttcagagagtagatcggtcttggggcagtgactgtgggtaaggcatttgactttgccaagcttttgcttcctcccctgcgaaacagagatgatactatttacccagcagagcaaaaaggaagcccacatctaccccagacagagaggggactccatcatatcctgtggactccccttccaaggccctgacttcacaagtgtgtgaccccccgagattcggggcagaaaattctttctcatccatggggtgactaggactggtgagcacagccactctagaaagggagatgggtgtacatgtatttgtagtaggtacgtgaggtacaaggcaattttgttccactgatgtattgcacagtggtga

SEQ ID NO: 41406 - DNA, 1028 bp, Homo sapiens
ataattttaaatttttggaatcagccttgaaaataaaaaaggaaatatccagtcatcagagtatttccactctggccttagcccagaaggggcacagtgcatgagtcgaatgggcagactactcaagatgccctgctgctttctggggcctctcaccccgagcagaggggacagctgtgggtgcacagtcagcagcgggacgcggagactcggctgttctctcgcgcttcttgagcgggtgtttggccaattgtaaatttccatgtcgccacccgactccctggggtttcccagggctcagaatccaaatttggtttaggtacgtgggtgccgaatgcaaaacaaaacaagcaaaacaaaaaccagcaagtgaaagacgacctaggacccccctgggggccaccctggagacggtcgtcaggcctcggaaagagctccttcctaaatgatttggagtatgacttcaaggaagtctgcttttctgctactctgacagctcagaaagaaccccctcggatccctgtggtttcgtagtagcttgttatatgtgattaaattggaggccccttcctcagatggaactgggttactcgctctcggggtgcccctcgtcccagggttgctctgccctgaggagcgccaggctgtaagtgaccagccagccagatgcgatgccccggcgtgagcagtctatccatctccctcttgtggaatcagccctgttctatctcagggtaattgctgagaaggtagtttgtaaatgtctgtgcttatgactatgaagtctttaaagaactgggcacatttgcaaaacccgatcaaattattgtggaaaagaaaaacagcactttcattccatatagcaatgagtgctggccctgcccgtggtcatctaaagactgggcaggctctcaattgattgtgtatttgaaaagaaaaatgtgctcaaattgctacagatagattaaatgagaaataaatgcaattttaaggaccatctgccagaatggtcacattttaagaaagtg

SEQ ID NO: 41407 - DNA, 1073 bp, Homo sapiens
aatcaaagccaaagtaccctatccaatcaacaccatagatacatcttcaggaaaaagccctcctttatgaaagcaaatccaaaaaattagaagaagcaactgttacaccagatgtgcagatatcaacataaggacacaagaaatatgaaaatgcaaggaagtataacacttccaaaggaacatggtaattctctagcaacagattccaatgaaaaagaaattatgaaatcccagaaaaaaaataaaaaataatgatattaaggaaagtcagataaaagagacacagataaataatacaaaataatccaaaaaacatttcaatacatgaatgagaaatttaccaaagagataaatattataaaaaagaaccaaacagatatccaggaactaattaattcattgactgaaatttaaaaatacaatagtaagcttcggcagtagactagatgagacagcagaaggaatttcagaatttaaagttgaataaagactatgtgatatatgagtcaccataaaggaatgagtatttgaatttttgatgtcccagaaggtgaaaagaaaaccaaagggatacaaacctgatttaacaaaataatggctgaaacccaagtctagcaagagatttagacatccagatatgggaggctcagagatccacaaataaatagatactattcagaaaggtcttctccatggcacattgtagtcaaattatcaaaagttgaagacagaattccaaaaacaccaaaagaaaagcatctactcacttataagagaacccccatcagactaacagtggatttatcagcagaaaccttacatgccaagagaaaaatgggatgatatattcaaagtactggggaaaaaaataacttgttagccaagagtactatatgcataaaagttacccttcacaaatgaaagagaaataaagtatttcctagataagtaaaagctgagggaattcatctccactggactggccctacaagaaatgcttaatgaattcccacacctgaagtgaaagaacaatatctaccatcatgaaaatgtacaaacgtataaaacccatt

SEQ ID NO: 41408 - DNA, 1044 bp, Homo sapiens
ggaggggtaggcatgggggcattgtcagagaggaggtagggctctcaatggcaggcggggaagcagggccaacccgggcagctgtgtttgtgtttgctgctgagatcaatggatggaggggcactttcaggcaccgcacaggtgcctgtggtgcctgacttagggaatgggagtgcactgtctctcttcccctcatccttccctccatttgctcgtaagacgccagcctccccaaaagcgtttccatttccacctgctcctcatgccttgcacagcagctatggctatagagagaccatggaaggcacatggcagggcttgggagtaacggcatccgggagaacatcaccatcaggacatccacctatctcctccagatagccaggcatcctctcctccctccccatcaccacacagtgtgggctggccctgatgggaccgatgggacctgctatgggaacactaaaaggctctaaacctgggtgagctggtgcaagagatgtgggtcagaactgccagatgtccctgctgtccggccagcagcgacttgctgtgggccctgctgtccctgagtcgcaggcaggtggtccatctgcatgtggggcggagctctgcgcctgtggccgcccttcctcaagcagtttgctttgctgagctgcacctgcatcttggatttttaactcatgttttagactctcaggtcttttctctggggtggcatcctctgatcctaggaatgagtttatgttctgatgagaggttcatcatcatgacagcggctgatgatcatggaacattttcatggtgcccgggacatcctcgtgttttcatgttttattacaatttattcttataattgtctcgctgagttatttttattttccctgcttcacacattaacagactaaggtgtcgagagtgtaatttcctaggcagcaagtagctcagccaggtctgacacccagcttggacgccagcgttcaagcgtaactctgcggctctgcctgcccgtgttagcaagggggccgcagggcacagaagctc

SEQ ID NO: 41409 - DNA, 1061 bp, Homo sapiens
ccaccgcacctgacctgtaaagaggttttacatttttaatgtaaaacatcttaaatatatgcaaaaggaagaatagagtaagccctcttatacccatcagcaaaagtcaatgatcctcaagattttgctgcatccatccatccctggttttttattggcgtattttgaagcatatttcagaccacatgtcacttttcccccatacacatcacacatgtgtctaaaatgcctgttcacatgccaatatggatgaatttcacaggcataatgtttaacaaaaggaaaaccagacccctgcttggagcatatactgtgtgattccatttatagaatgttccaaaacaggaagaagtaatctttggtgttggaataacaggttttcctgggacccttgtggttacttaccgtgggggtgacagtgactgggagggggccacctgaggagggggcgtctggaatggcaggagtgctgtcttttgatctgggtgcttattttgtgtatacaccagtcgtctgtgagcttgcctgtatgtcttacttcagtgaaaactttggccaggcgtgatggctcacacctgtaatccacactttaggagaccaaggcaggcggatcacttgaggttgggagttcgaggccagcctggccaacatgtgaaaccccatctctactaaaaatacaaaaattagccaggcatggtggcgcacgtctgtaatcccagctattcaggaagctgaagcaggagaatcgcttgaacctgggaggcggagtttgcagtgagctgagatcatgccactgtacttcagcctgggcaacagagtgagattctgtctcaaaaaaaaaaaaaaaagaaaagaaaagaaatttttacatgaaaatatggatgtcttttctcatgataccattgtcacacctgataaaattattattatttttttgagatagaatctcactctgtcacccagacaggagtgaagtggtatgatctcggctcactacaacctctgcctcctgggctcaagcaatcctctcatctcagcctcctgagtagctaggaccacag

SEQ ID NO: 41410 - DNA, 1039 bp, Homo sapiens
aaaaaaaaaaagtaaaataaatgtaatgtttgacaggagtgttgatattttcacttatattaacaagtaagaaatgaagcaaaacacatatagatccgaactttatttgttcctcaatgatgtcagcaacttctttgctgtattggagcatggttttctattactgggtgaatagttcctcaacattttgtgctattcacaatataatggctgcagacatcacagaatttgaagtttaaccacattgttaattttctgtattacttatgtctagggtttggcaaatggattctgcagagtcagatggtaagtattttccacttttccagacacgtacagtctttggcacagtctcttttgttttgctttgttttgttttaaccaccctttaacaatgtaaaaaaaaattttttagctcaagcaagagccagattttgcctccaagccctgaattgtagcattttcagattttcacagtgtaaatatctctgcaatagttgttgcaagctgcaaagtggagtatctgaaccaatgcggagtatctgaacttggagttgggaagataatttccagtatacagatggagtagagtaaccttaaaagcatagattacagtaaaataattagaacatgataagtgttgagaccctttcaatagaatttatttcactgcaagtttaatgtagggtaatttttttttttttttttttgagatgaaatctctctctgttgcccaggctggagtgcagtggcatgatctcggcttattgcaacctccacctcctgggttcaagcagttctcctgcctcagcctccctagtagctgagagtacaggcatgcaccactatgcctggctaatttttgtatttttgtagaaatgaggttttgccatgtcacccaggctgctcgcaaactcctgagctcaagtgatccacccgcctcagcctcccaaagtgctgagattacaagtgtgagccactgtggccagcttaatgtaatttaatttttaataatgactgtgtttaacagccaattaac

SEQ ID NO: 41411 - DNA, 1030 bp, Homo sapiens
aaacttctccccttttttagtcttggcatgtttggttacagatatcgcattgaataatttaaaatgcaacatcaacaatgactcactcccccttggggcgtgagaggggaagtatacctttttctaaccgtgctgaaaggtgtgcattttggtaaaatcagaactcaggagataacaaatttgttctttgcctcagatattagtgtgttctctctcttccataaccaatacactctctccgtttggggccattaaatgcatttcctggccactctcccctccagtaagaaaatgacaggtaggctccccaggccccccttagaggcctgctttacagacgcacctttatataactcaggttcactaagtacttccattaaagtcttgttttcaggtttcctgcccctgccgtggaaacaggtgcactcctgagtcaggcccagctttagtgaatcttgaaggaggctttcacggtattttttttttgtaattcaaggggaaaaaatttcaacctcagatcgtctacgaataggccagtagcaagcctgttatttatgaaatgttatcggtgtatacagtccttgcacatttatgctccagggagctcgtgttctcggtgggtgcattaccaggcattgtggtggggctgtcaggctacacagatgcccgcccgctgacttggtgcattagatgtgcgtgaagtgcttggcccactgcgcctgtctgtttttatttgacttcacctgcacatgtgagcaatatctatgtaggcagcaatgtaaaatttacaagaacaaagcaaatgtgcagaaggaaaaacattaagtggatgtccatgtccaccctcctagaaaagagctatttgcttttttttttttttttttttctgtcatggagtctcgctctgttgtccagactggagtgcagtggctcactgcaaactctacctcccgggttcaagagattctcctgcctcagcctcctgagtggctgggactacaggcgcacaacaccacgcccagctaattct

SEQ ID NO: 41412 - DNA, 1120 bp, Homo sapiens
cacatatgtagaacaggctgtcataaacttttttggttaggtaaagattcttaagcctggactacatttggttaggtaaagattcttaagcctggactacagcctcacgcctgtaatctcagcactttgggaggccaaggcgggtggatcacttgagttcaggagttcaagaccaccctggccaatgtggcaaaaccctgtctctactaaaaatacaaaaattagcttggcgtggtggatcacgcctgtagtcccagctacttgggaggctgagacagaagaatcgcttgaacccgggaggtggaggttgcagtgagctgagatcacgccactgcactccagcctgggcaacagagcaagactccatctcaataaaaaacaaaatgaaaaaaaaaaaaccaaaaaacgattcttaagcctattatgttgaaagtcattaagaaattttaaggatttcagcgcaaggaagttagatgcgtaagtttttgtcaccctgaatgggaaattcatcaccgaatgtcaggaattactgtgtctgttttctctccggctttggtacctggtattgccactgctactggaaattgtgaatttgtttactgtaaactacagattctcttgctgtgttggaatgtgattgccttggacgtgcttggatttggtgggaggtctatgttgtgttggtgcccacaccattttccaaagctgtgttgtccggggccaccctcttcaccttgggacaggtacatgccacacacacttccagtagagctcccactcaggaaggatgccagaattcaacccctatttgttactggaagtacgtaattccaaatcttcaatatttttaattattggtgggggaaaaaaaagacttgtgacccagcttagagctgatcttgctctactgggtgacactacgcctggtgggtaagcatctcgccagagctcccaggcacagggggagtgtgcgtgggttctgattcagctttgcttggtgttgacttggaggaactgcccgggtctccgtgatagcgtttcttctagaccataagctccctgtggctggggccgagaatttatgatgtttcaccagagacctagtgcaggcactggctcc

SEQ ID NO: 41413 - DNA, 2040 bp, Homo sapiens
ttttactgtgtcggccaggctggtcttgaactcttgacctcaaatgatccacccacctcggcctcccaaagtgctgggatttcaggcatgagccaccacgcccagcccaggccattatacatgatttgattaagaagaatctcgtctgccctcagtactgcatttaaccttgctgggaaaggggtgaactgtcttccatctgtttcctcagaggacgctgagctctgatcatgttgcctctctgcccagaaacctcagtggctcccgtgtacccagggcaagaggccctgcccctcagcagagaccctgttattatgaagctgtcctctaacctgttcccctaagtgtcaaagggcatggttctctttgggcagaatggctgctggacattctctgcttataccagcaattcccagatttgttttagtctcagggcccttttatactcttatactcctacacattactggggaccccaaagagctttggtttatatgagctatatctgttgacactgaccgtattagaaattaaaatatgcatatttatttatctactcaaaaatggtaataataactctatttcaaaaatatttttatgaaaaaaaaactatatacccccaccccaagaaaagaataagagtttttttggtagaactctgtaatgtctggcttaatagaagacagctggaatccatggctgcctccgcttttagtcggctgtgatgcgtgttcaggctgaagtacatggagaaaagccagcctcctgcagatacgtagttggaaaagggagtatttttgtagccttttcagatattgtggatgttccttgagacctcactaaaacctgacaaggggtagtttctttttttgttgttttgttttgagacggagttttgctctgttgcccaggctggaggggcagtggcacgatctcagctcactgcaacatccgcctcctgggttcaagcaattctcctgcctcagcctcccgagtagctgggataaacaggcatgtgccaccacgcccagctaattttgtatttttagtagagacagggtttcatcatgtaagccagctggtctcgaactcctaacctcaggtcatccttctgacctcaggtgatccgcctgcctcagccacccaaagtgctgggattacaggcttgagccaccgcacccggctgggtagtttctttttttttatttatttttttgagacagtgtcttgctctgtcacccaggctagagtgcagtggtgcaatcatagctcactgcagccttgacctcctgggctcaagcagtcctcctgcctcagcctcccaagtagctgggaccacaggtgagcaccaccagaccagctaatttcttttatttatttatttatttttggttgagatggggtcttgccgcgtttccctgactggtctcaaactcctggccttaagtcatcctctgctataatatccttaagtcatcctctgctataatatccttaagtcatcctctgctataatatccgtagatgttttatactgtgttacgttaaaacctattgctctttcattttgaatgagtcctttgccacccctgtgtgattttgtaacatcatacattggccattggcaagaatattgattgagttatgcagatcttctaatgttaattataaaaaacaaagtctgttttatcctgaggttcagctgatagttaaacttgatcccttcgaacccaataaactctgtttttaaaaacagaaatcttttataggaacaggctttttgtagtcagttaatttttaaagctgttttaaaagttgagtgacacagcatattttaaatagactttttatagagcagttttaggttcacagcaaaagcatatttttatagaaataaagttatataatttagtcattggccttattagcatgttgtgatatgacttggctacagttagtatatttttttaaatgtacagtaattttttgatgatttagggtggcacgattcatcctgttagttactgccgttattttccc

SEQ ID NO: 41414 - DNA, 1045 bp, Homo sapiens
tctctactaaaaatacaaaaattagccaggcgtggtggctcacgcctgtaatcccagcactttgggaggccaatgtgggaggatcacctgaggtcgggagttcgagaccagcctgaccaacgtggagaaaccccgtctctactaaaaatacaaaattagctgggcgtggtggcgcatgcctgtaatcccagctacttgggaggctgaggcaggagaattgcttgaatccaggagggagagattgcggtgagccgagatggtgccattgcactccagtctgggcaacaagagcgaaactccgtctcaaaaaaaaaaaaaaaaaattcccacaaaaattagctgggtgtggtggcgtgcacctgcaatcccaactacttaggaacctgaggcaggagaatctcttgaacccaggaggtggaggctgtagtgagctaaggatgcaccactgcactccagcctgggcgacagagcaagactgtgtctcaaaaaaaaaaaaaaaaaaagaatcttgtgctgagtctgacccctgacatacattaggaggggaggcttccatttgtccctgtcttaactctccttcttgaagccaaaggaaagacgcaaatcatctaggagattctgatggataataaagaagagggacaagcttgctgatgtaggggaaataaatcgccgaggctctgtctagcttggatttactgtgtgtattggctgtgggtggattacaggtgagctcataaatattagtattttgctcatgtccttccagatttgtaatttccttgataagcaggtgtgtgcgcgtgacatgtctgtcgtctacccgtcacacggttgtaccaggtagcctttgcttaataagccctcggagtactcgtcctttgagctcgtgggacttgcggggtggtcattaagcgttggtgtgaataccgggtatctccgtctcccagaagctgcgagtccctcgagggcaggggctggttctttcgggaggcattttgttctcagtgcctcgcccagtgccagtgaagacacacttccaggt

SEQ ID NO: 41415 - DNA, 1049 bp, Homo sapiens
aaaagtaacatatggcagtcacattacattatgaccatgaaggctaaatactcccagtcactataaatacagaaaaccaaacctggtgggaaaaaatgcgtgtatacgtacccctacgtgtggaaaactggctaccgcatgcttaacaaaataacttgggaatgaattactcatggtgaggcttccgatcagtgtctaaccctggtagcgtctgccagtagccacaccgaaagggtctaccaagggtacactatggacatttttcatttaaaggtgaaagattttttaaaatgcattgctaagaaacatccctggccgggcgtggtggcgcacacctgtaattccagcactttgggaggctgaggcaggtggatcacttgaggtcaggagtttgagaccagcctggccaatgtggtaaaacctcgtttctactaaaaacacaaaaattagtcgggcgtagtggggcacgcctgtaatcccagctactcgggtggctgaggcaggagaatcacttgaactcagaaggtgaagattgtagtgagctgagatcacgccactgcactccagcctgggcaacagagtgagactctgtctcaaaaaaaaaaaaaaaaaagaaaagaaaaggaaacattcctttcatcaaaacacaaataaatatttttcaaaaattaaaaaaaaaaatgctcaaaggattaccgggtactttgtgaataaatgttttccctatttcggaactggataagctaagctgggatccacgcagcacgcagcaggagggattgccctgtgtgctaggcaaggctgacatcagtgacagcagcgtcaggctgtgctcggatcacgggcccatctgtagttatactttttaaattttttttcttctgttgtttctgtagagatagaacctcactgtgttgcccaggctggtctcaaactcctggcctcgagccagcctcccaaaccaatctatgtttcattctttttttttttttttgagaaaaagtctggctctgtcacccaggctggagtgcagtggcatgaactcagct

SEQ ID NO: 41416 - DNA, 1033 bp, Homo sapiens
aggccgaggcaggaggatcccttgaggccaggagttggagactagcctgggcaacataacaagaccctgtctctacaaaaaatcaaaaccatttgctgaacagtcttatttctcggaggagtttaagcaaacactgcagggcctccggcattccagtttcaggccttatctgatgtggcccaccctgggaccgtcacctgacttcctgtccctgcacagagaacttgctggtaggaggtggtgaggggcctccgaggtggtgggtgagcatccctgcaagtcaagctctgctgttccccggccttcccttgagactcttgggggcctgggccctgcgggacgttttccccctgcctcagagccaaaccacttaacagaaccaggcgagccaggtttagtactttatcgggtatcctaaagacacgttgcagcctgcaaaattcgaaaagtacctggagtatgtaacagcttttgcctcccattcttgagtctttcatttcttcaaggacatggtagcaacatttaaagaaccttttgaaaagagagaggcggccgggcacagtggctcacgcctgtaatcccagcactttgggaggccaaagcgggtgcatcacctgaggtcaggagttcaagaccagcctggccaacatggtgaaaccccatctctactaaaaatacaaaaattagccgggcatggtggtgggcacctgtaatcccagctactcgggaggctgaggcaggagaatcgcttggacctggaggcggaggttgcagtgagctgagattgcaccactgcactccagcctgggcaacaaagcgaaactctgcctcaaaaaaaaaaaaaaaaaaagaaaacagagaggcctgcttataacaccatccttatcctgggctgttttcctttgtccttccagtccttgtctaataacaagaataactgaagcacattttcagtaaccgcttgctacgtgccagccgtccggtcaggactgatgttcacggcatggagacctgaggccacacggaggccggg

SEQ ID NO: 41417 - DNA, 1628 bp, Homo sapiens
gatgcatggcacacagccctggccctggtcctgtcatacagggatgcaaaaacagacgtgtacttgaggctggagggttcatacattctttaatgatttacctcttcattgcggacatttctaaacgtggctggcttttctctcccaaccgcacgtctgtggctctgcagatgcgtggctgcgcgtggtttggtgccggagctgtggctcctccgcagcaccagcagtttctgcgtcgctcgcgcgtcaccagcaaaggtcaccccagtggaaaaagcagatcacatcttagggctgttgtgaacatggtgttgacctcacatataccctgaaaggggctcagggccctcggggacatctgtgaagcacgctctgggcatgctgatctgttggagcgagcgctgtggcaatcccaggctggtcacgtcagtccctccctgctgatctgcgcactctgctgaaccccggccgcaccttggcttgcttttttctttttttcctcttgcagctgtaggagaagaaagggcttttgtttgtatttcagagacagcgtctcactctgtcgtccaggctagagtgcagtggcgcaatcatagctcgctgcagcctccaactcctgggctcaagcggtctccccacctcagcctcccaagttgctgggaccacaggcatgcaccaccacacccacttaattttcttatcttttgtagagacagggtcttgctatgttgcccaggctggtctgaaacccctgggctcaagagatcctccctcctccacctcccaaagtgctgaggttacaggtgtgagccaacacacccagcccgtacatggcctgcaccttttcagggtccacagttagaactacacactggcttctcttggaacacagccatcaggggcacagctcctctaccctgctttgccgacaagttaccagtgacctacaagttacaaggtgggaatcatctccatttgagttgcttggagtaggtctccttttttccagagccagtgggtgggagtgtctctcgtggagagagaagttcagggacagtgctgctgcggaaaggagaggccccgggctcaggccgggcatggtcacctgtgtgactctgtgcggtcacttcagccccccaccttcccgggcccggttcccgtctgagtcagtgctgtgacgtcatgaccctctgggatgatgatgatggtgaatcctaagtgactgagagcctggtgtgtgcccgcctggccctgtgctgagcagtgcacatgcagtattttatgtagtccatacagctttgagaatgttccagaagtagatagtggtgatggttattcaattttgtgaatatcctaaaagtcactttaaagagtgaactggccgggcgcggtggctcacactggtaatgccagcactgtgggaggccaaggcgggtggatcacttgaagccagttcgagatcagcctgggcaacatggtgaaaccccgtctctactaaaaatacaaaaatcagccaggcatggtgccatatgtctgtaatcccagctactcgggaggctgaggcaggagactggcttgaacccaggaggtgaaggttgcagtgagctgagatcacgcgactgcactcc

SEQ ID NO: 41418 - DNA, 1216 bp, Homo sapiens
acacgtgtggaacttacctatctctgccatatttggggagtccgttgtaagagagaatgggaattccagatcagagtccttaacgttccatgtgggtgacactgagtccttcctgaaaatgccccagacctgaactgatcattaatgtcagctgtcaggtttttctcagccacaggatttttttcattcattcctctgctccatccaaaaaatgtttcttgagccccgcctgcacccaagggggctcctacttaacctaagttttggagatctaggagtcttgtgcctggacagttagggaaggatgttcctggcagaggaaagggcagcaaggcgggaggaggagaatggaccttctggatggttctggatggttctgggtggttctggatggttctgggtggcctgcagggcagtgcagcagggagcatcctacccgccacgggggctctaagtcagctgagaggggggatgtcagcatcacaggtgggcagggtccatctcaggacggggctaggtgggtgcccgtgagctcaggacagtgggatctctttctctcgggaggttctgcacccactcttcgtgtcttcattggctttctctgaatacctgtaatagaaatcattttcagaagcaaaacatcgccgtggtttgctgacggaagcctgccttagtgagttagggaagcaggccagagcacacccctcagccggacggacgcagcctcctgcctgtggtcccggcctcaacccagagcctcacctgcagccgggggtgtcggtcactcccagccatctgtggttgctccagcctgggagggagaggggatgagggcaggggcatctcagcggctcagggcaaaactgcaggggtcatctcttcccgagggcggtgtctccaggagagccacctgccacgccttcaccctgcagggcgatggcacctccacagcctctttccaggatctgcctctgtgaccacacggggttgtcctgggcccgagccttttcccacagcgccgccttgtggacacctgtgcaggagccagcagcccgcggaggctacctgctccgggtgcacatcctgtaggggtgtgtgtggggggacctgaggaggggccccacagagctgcctgaccaggtgctgccctgggccctgcataatggcaggaggagggcccgcggtgctctcagcccccgagcagaagtcaccactg

SEQ ID NO: 41419 - DNA, 1352 bp, Homo sapiens
ctctgcataaagagggccctccctggagcacccccggggagctgggactctccagaaagccccgggtgagggctccgtcttgagagagagagaaatcccttctttgggcgattcagtgagttcaggaggaggaggaagcttttccttggctttgaaatcagtgtttttatggagacaaagaacagacctcagtgggaaaaatgaaaacgtaatggaacacggggaggtgtcggagaagaaaggattttccccttcgctttcagagccggcgggagtgcaggtctgttttgcttcagaagcctcacattctgctttgcccttgagtgacttcatgcgggatgaggaactgttgacccctctagagaggacaccccaagtccatcctgggctcctcctcacccctctgagaaagcccccctaaaaaaaggcttcagagtcaccggcatgccgcctcacgttgcaggacggaatcgcgcgctcctcacgctggagtaagttacgaaacatgatcgtcaggctctttgcaaacgcagagccccagaacgctggatggaggcctcctcggccctgcgggcggcctggctgcggtaggtctgctgcaaggagccaccacggggactgcgccacactcctgatgaaaacgtgtttacccacagcctcgcctcgagcctccttgacaataccgctgcttcaaagcaatattatttaatgagaatactttacattgctcacatgtgctgctatgaagacaggattagtctgtagacgggactcagctccagaggttcctgggtaatgtattgtggctcttggaaatgagggtagaatttgaaatataacaaatggtctctcgcccggttctgtcccttatttttagattgttttcctgcatcttacaatttccttttcttttcaaagttcctttctccaggcctgtttttcagtgctcaggacacggttttcatcacatacttactgtttttttggttgggttttgatacgaaaagctgctacgtttggtgaccagagggagggtttggaatctgtgctttgcaggggatctcggtgggtaccgcggcccctcgcagggtggcgagtggggtccgtgcctcgagaagggggcccttacccacaccgtgcggcttgaattctgtcggagttgaatctgtggaaaggattgtcccattagagctgctgcgtcctttcctctgtcctccctgtcacccaaaccccgaagtcacagctgcttagaagaatgggattttggggatacaaccacacacatttccctctggactgaaattttaaaaacagacccatttcactgacttctttttttttttttttttttt

SEQ ID NO: 41420 - DNA, 1044 bp, Homo sapiens
ctcttttctaaagagggattttccctgctccaagggttatcctttttttggttccgagcagcgagtgcttctgggtcctgaagtcctcttctttgtttagggagatccaggacgaggagctgaagaagttctgttcccggatctgtaaactgctgcaggcggaggacttggggccggacaccctcgactccctgcagaggctcttcctcatcatctcagccacgaagtacagccggaggtgagtgtggcgacggctcaggccggctcctcacacagcggccccaggagaacccagcccacgcccagcaggtcactgcagatgctccttgggggttgagtcatttgtccacttaaaccagtgctgaaggtccatcctcatgtaaaatgctctgtccactggcccaagggtgcccggccaggtgctctggggcaccgggtgctcctgccacggtcgtgacgtgttaccgcccaccacgggcatctcgccttccaggctggagaagacatgcgtagacctgctgcaggccaccctcggcctgcctgcatgccccgagcagctccaggtgctttgcgccgccatcctgcgagagatgtccccctctgacagcctcagcctggcctgggaccacacgcagaacagccggcagctgagcctggtggcctccgttctcttggcccaggtagcgcagcagtcaccaccccagttggcaccggatggctgcttcccaaggaacaggggagacaggaagcaggggcgccagagccggcaggtggctgcttgttgtagacgcatctcggtgctgagtgcctggcacacttgaggctggggcatgccctgttgactggaacggggtcccatgcccagcaggcccacgtggtatgttggtgctcaggagaggtggtggagtttggtttctcagacagagccttgagacagcgagtcagtggaggctgggcctccagaccttctttttggggtttttgttttgttttttagaaacagggtctcactctgctgtccagtgtagagtgccatggagtgat

SEQ ID NO: 41421 - DNA, 1126 bp, Homo sapiens
gagacagagtcttgctctgttacccaggctggatggaatacaatggcacaatctcagctcactgcaacctccgcctcccaggttcaagtgattctcctgactcagcctcctgagtagctgggattacaggcgcttgctaccattcccagctaatttttctatttttagtagagacggggtttcaccatgttggccaggatggtctcaaactcctgacctcaggtggtcaggccttggcctcccacagtgctgggattacaggcgtgagccaacgcgtctgtcccacccagttaatttttgtatttttagtagagatggggtttcaccatgttggtcaggctggtctcgaactcctgagctcaggtgatccacccacctcagtctcccaatatgcttgaattataggcatgagccgctgcgcctgtttcttttctttcttttttttttttttgaggcagagtcttgctctattgcccaggctggagtgcaatggcgcgatctcggctcactgcaagctccgcctcccaggttcacaccattctgcctcagcctcccaagtagctgggactacaggtgcccaccaccacgcccggctaattttttgcatttttagtagagacggggtttcaccgtgttagccaggatggtctcgatctcctgacctcgtgatctgcccgcctcggcctcccaaagtgctgggattacaggcgtgagccaccgtgcccggcctgtttctttactttcttaataaacttgctttcactttatggacttgccctgaattttcccttgctcgaggttcaagaaccttctcttggggtctggatcaggacccctttctgataacacttacatgaaatatccacaagaggtgtagacagaggcagaaagtgggtttgtggttgccagggcctaggggcagaagggaatggggagagcctgcttagtggccgtgttttccccgttggaggtgaccaaactagacagtggtgatggttgcataacactgtgaacgtgctgcttgccattgaattatacactttaaatagctaactctatgtgaattccactttaacttaaaaagtggtgacaactgaatatgtacaaagcgtaactgctatattaa

SEQ ID NO: 41422 - DNA, 1080 bp, Homo sapiens
tgagcacatttaaatcctgataaggaaaatctaacagggagaagctgaaggtaggaaagaaaagggatcctcaccagtggaaggattttgaactccagcatcctgttgaagggtggggtggatataggtgcacgcagagaagagtgtgggggaagcaggttaggggagagtaaagaggagcattgaccagagaaacaacatggaagatttgcctatagaatgggactcaccagcccattgtcgtgtgatttaacctgtacttattcaaggacagcttggacagttttgttttgtttgagacagggtctcctgtgttacccaggatggagtgcagtggcgcaatcatggctcactgcaaccctgcctcaggctcaagtgattgtcctatcttagcctccgagtacctgggaccacagctgtggaccaccacgcccagctatttttttgtatttttagtagagacggggtgtccccatgttgcccaggcaagccttgaacacctaagctcaagtgatccacccccgtcatcctcccacagtgctaggattacaggtgtgagccgctgcacccagccaacagtttttcttttccctagttagtctttaatctgtcagtaagtattttgcttccaccactgtaccagtttatgaaagtcagagaaaatgaaaataaagaaatgctgcctatttattttaccactgcctattccttttttttttttttttttttttttttttttgagacatagtctcactcttgcccaggctggagtgcagtggtgcaatcttggctcactgcaacctccgcctcccgggttgaagccattatcctgcctcagcttcctgagtagctgggattacaggcgtgtgccaccatgcccggctaatttttgtatttttagtatagacggggtttcaccatgttggccaggctgttctcgaactcctgatctcaaaggatccgtccgccttggcctcccaaagtgttgggattacaggcttgagccaccgcacccagccgccactaccagttgttagccatgctgggaagaaagctgaaactgtgttaaaatggcatttg

SEQ ID NO: 41423 - DNA, 1033 bp, Homo sapiens
ccatgtgcttttctgttcccataataccaaaaactggttttgttttttgtatttttttttttaattttgagagggagtctgcttcccaagctcaagcaattctcctgcctcagcctctcaagtagctgggtttaattacaggtgtgcgccatcacgcctgggggtttcaccatgttcaacaggttggtctcgaactcctgacctcagatgatgcaccctcctcggcctcccaaagtgctgggattacaggcatgagccacactgcgcctggccccaaaaacttgttttctgaagaaaaagtttgaatttaaaaatatgtgagaatgagcaagagaaaaggagaatcaaaataaaatgtattagtaaccagatagtaaatgttaagatcaagagattaccaagaacagacaagcccaccctgcctgcctgctcttcagtgtgttattgggtccttccaagggaagtgacagtacatgtctggtgaatgagcttgtgatgagtgaatgggattccctcccaataggcaactgagagcaaagttctgggtggagggtccttggtgcatcctccacttactcttcatgccaatgggtacctcaggcctgtctgtccaacctctggactttcttaactctgccccagtctccatccttaaccactcagggccagcctcttacatgggattccttcttccaatctaaccctcctccagcccctcccctgtgtggctggggtaaggcagagtctgatcccatctggcctggcctgtgcccagaagtgcccaagaggcaagtgtcctcttgcccacaggaccccaggagatgatgggcacactaaagtttgagaactactgcctcaggcaactttataacatgcctttccaattcaggtttggatccaaatcctcattccagtacttattagctgcttataattttttgtttgtttgttttaaagaggcagggtctggtcaggcttggtggcttatgcctgtaatcctagcagtctgggaggctgaggtgggcggatcact

SEQ ID NO: 41424 - DNA, 1051 bp, Homo sapiens
ttatgctttggaatattgattgaaagaatcaaaaggacataagaggttaaggcaggaaaggtggaacaagagctaaacaacaaagcctggaaaatagactaatatcttaaaaggctgatggattgaaagaaagattcgggtgaggggggacaactgaaggtatgaatcatgggtaaagaggagggtgtggtgatctttgccaagcaccagcactggcagtggcagtatgtggggcagggtctagcgctcatgttcacgacatagaggaggacctgggcctagagccactcagtatactggtggcagagctgggttaaactttggtctcctggccccaccttccagggctcttttctctattttgtgcacttggagaaggcagttaaaagatcaaagatgtggaaagcacatgtgaaaagttaagaggacacccacatagtaagaaactcagggccaggtgcagtggctcacacctgtaagtaatcccagcactttggagaccgaggtgggaggatcagttgagcccaggagttcaagactagccctggcaacatagtgagacctcattctacaaaaaataagaaagaaagaagccaggcgtggtggtgtgaacctatagtctcagctactcaggagactgaggagggaggattgcttgagcccaggctgcagtgagctatgatcatgccactgtgttccagcctagatgacagagtgagaccctgtctcaaaaaaaaaaaaaaaaaagaaaaaatcgaatttaggcttaccacttgaggtggacttgatactcctaaaaactgaggggtaaaaaagaggtgcaggttgaggtgccaggaacaaagaatccaagactgcagctttgaggctttcaagggaagagggtccatcatgaccaagaaaaaattttcagcacatgctatgcatgtaccagatgcaaggagtgctacaaaaagtctgaagatggcgacctccagggaattaagtcaccccagcaggaaggcagccattccaaagacatcccaacacagtgtgtaacagccacaggcag

SEQ ID NO: 41425 - DNA, 1209 bp, Homo sapiens
ttttgctgttagagctatagaaatcaacatgcttggcatattttttcttgtgtaacctaagctaaatgtttggcagtggaatcacttggtcaaggggtatgtctgtctgtctgcctgtctttgtttttttctttctctttctctctctttttctttctttttttttgagcacttggtcaaggggtatgtctgtctgcctgtctttgtttctttctttcctttctctttctctctctctctttctctttctttctttctttttttttgagacagagtgctgctctgtcacccaggctggagtgcagtggtgtgatctcggctcactgcaacttctgcctcccaggttcaagcaattctcctgcctcagcctcccgagtagctgggaatacaggtgcccgccaccacacccggctaatttttttgtatttttagtagagacggggtttcaccatgttggccaggctgctctcgaactcctgacctcaagttacctgcccgcctcagcctccgaaaagtgctgggattacaggagtgagccactgtgcctgtcttaattttttttttcattgtggcaaaacacacctaaaaattactatccgaatcatttgttcagtgtgcaggtgagtggttttaagtacattcgtattgttgtgcaaccctcaccaccagccatgtccagaactcttttcctcatctcggactgaaactgtatacccattcaacatgaactccccactctccccactgccctccgtgtccctcccgctagcaaacaccattgtattttctatctgtatgattttgactactatggctacttcgtagaagcagaatcatttgtaactttttgtgactggctgatttcacttagcataatgtcctcaaggttcatgcatgttacagcatgtatcagaaattccttccttttaaggctgaataatattatattcactgtatggaggtatgtattttaaatttgcagacagatattctgaaaatatccttctaaaaggtgataaccttcactcccaccacagcaagtaggtccaaccgcccttcccccaccctcaccaatcctgcctactatccagcctcttcatgttgccagtttactccatggaagaggaatctggttattgttctcctttgcatatataagtaagactggtcaccgtttcacagatttattggcgactttttttttttttt

SEQ ID NO: 41426 - DNA, 1449 bp, Homo sapiens
caaaaatcagccgggaatggccacacatgcctataatcccagctactcaggaggttaaggcaggagaatcacttgaaccccggatggaggttgcagtgagctgagatagcaccactgcattccagcctgggtgataagcaagactccatctcagaaaaaaaaaaaaaaaaaaaaaaaagagtgttatgtgtcgctgttgttactctttgctcaatattttttttgagcataccactttgtttattcattcttaaattgacagactttaagccagtttctagtttgagataattaaaaatcgagctgctatgaacattcatgtatatgtctcttagagaacatgtgtacctatttctgttgggtatattcctatgaatggggttgttgaattgtaagttatatgtaacttcaagtttggtaattacgataaaaattttttccaaagtgtaccactggtataaaaatagacagaccagtggaacagaataaagagcgcggaaataaagccaaatactacagccaacagatcatcgacaaggtaaacaaaaacttaaagtggggaaaggacaccctattcaacaaatgctgctgggataattggcaagccacacgtagaagaataaaactggatcctcatctctcaccttatacgaaaatcaactcaagatggatcagacacttaaatctaagacctgaaagcataaaaattctagaagataacatcggagaaacccttctaaactttggcctaggcaagatttcatgaccaagaactcaaaagcaaatgcaacaaaaagataagtagatgagagttaattaaactaaaaagcttctgcacagcaaaagaaataatcagcagagttaacagacaacccacagagtgggagaaaaatcttcacaatctatacgtccaacaaaggattaatatccagaatctataaagaactcaaacaaattagcaagaacaaaacaagcaattctatcaaaaagtgggctaagtacatgaatagacagttctcaaaagatgatatacaaatggccaacaagcatatggaaaaatgcttaacatcactaatgatcagggaaatgcaaatcaaaaccacaatgcgataccaccttactcctgcaagaatggccataatcagaaataaaaaaataatagttgttggtgtggatgtgttgaaaagggaacactttcacactgttagtgggaatgtaaactagtacaaccactgtggaaaacggtatgtggattccttaaagaactaaaaatagatctaccgtttgatccagcaatcccactactaggtatctacccagaggaaaacaagttcactcttggtcctttacattccgtggggagaagcagtagaaaattaccgggttattcaccccgagtctaagcagctgaataggaaaatagctttaatagccctgttaggacctagg

SEQ ID NO: 41427 - DNA, 1048 bp, Homo sapiens
gagaccaggcgttcgagaccagcctggtcaacctggagaaaccccgtctctactaaaaatacaaaaagcctggtgcggtggcacacctgttagtcctagctactcaagaggctgaagcataggaattgtgtgaacccaggaggcggaggttgcagtgagccgagattgggcccctccactccagcctgaggtacagcaacactctgtctcaatcaatcaatcaatcaatcaataactgtccaggtgtggtggcacagccctgtagtcagagctaatcaaggggctgaggtgggaggatcgcctgagcccaggatatggaggctgcagtgagctttgatctcaccactgcactccagcttgggggacagggcaagtctatctcaaaaaagtaaaataaattggatacattgatattttgctaggaccctgccttctacaggcatctagtctaatgggactgggagtaatcagggcagatgacctaatcccagtgtcacattataataggatgtaactggagagctatgggcatgcagaagttggaagatgagggaaggcatcacagaggctgtggggtgaactgacttcaaggaatgggtccttcccttcagaaccacatgtgtgtgggacacccagacagaaaacacaaacgcaaagtcgagtggagggcatttggaaggagcagtgaagccaagccaggaaacaccaagatggtgagccagtgtggttgtagagattgtagagagggtggaattggcactgttaccctggcctcgatagagaaagacatcagctaaggaggttgttcaggtgggcagtgaggttgttgtgctgtggaaagatgttcaggctgcactagggagccccctggcttggggagagactccaggagaccctggcagggagcatttgacagtggattcgaatgatgcaagggggacctgaactgtggcctctgtcgtgggaacccggaggaggacgatggcatttgcggttgatgtgggaaggagagagagagaagaaccagaaacgtctgcttgctggggga

SEQ ID NO: 41428 - DNA, 1048 bp, Homo sapiens; identical to SEQ ID NO: 41427

SEQ ID NO: 41429 - DNA, 1056 bp, Homo sapiens
tcggctgcagtgagccaaggttgagacactgccctccaacctgggcaacagagcgagactctgtctcacaaaaagaaaagaaaaagactgtgggagcatctggtgggagatgctggagggagagaggagaggaactgtgggtttggaagctgtgccctgctccaggcggtgcgttgaagcaggaacaccgttccgtagaaaacaaccttactttgtccgacaccctcagatctttgtcccagaccaggagtcttttaacgacaggatcctctgtgattagagagcagatgtcagcgtgagaagcaggacagggtttctgtgggagcagcagagcagcgaggagaagtgtgcttcccggggggtaagtctcaggattgtggccgcaggtgaggtggatgggagaggggagaatgactttcactgggcaagggacagaggctcctgctcggagagtcccctgagaagaggccgaaggaggccctgggtgtgagaatctatgggatgtagagctgggaataagccaggatgccctcccagcagacacggagaaccactgcagagtcataaaggaattcccatcatttcctcatgagacagtcacatcagggtgcgaccatggccttggtatcccccactatggatggagacacttaggtttagaaaagtcagtaagagacattaagtttcagagagcacagctgaagccactttctttgattttttattttgttttatttatttatttatttacttacttacttattgagatagagtcttgctctgtgggccaggctggaatgcagtggcacaatctcagctcactgcaacctcgacctcccaagttcaagcgattctcctgtctcagtcccctgagtagctgggattacaggcgtgtgctaccacgcccggctaatttttgtatttttagtagagatcaggttttactatgttggtcagactggtctctagctcctgacctcaggtgatccacctgcctcggcctcccaaagtgctgggattacaggtatgagctaccgcaactggccttgctttttc

SEQ ID NO: 41430 - DNA, 1056 bp, Homo sapiens; identical to SEQ ID NO: 41429

SEQ ID NO: 41431 - DNA, 1061 bp, Homo sapiens
atgttgcctgggctggtctcgaactcctggcctgaagcaatctgcctgccttggcctcccaaattgctgggattacagatgatgtgagccactgtgtccagccctcactgtacgggttttctaaaaaaaaaaagattaaatttgtcttatttgccacaaggtaaattaaccttttctcctctcctttttaaagagtatttccttgataaacgtggtaatataaataacttttgtgcctttgacatgtatctaaatcttttaaaaaggtgaatgaacttcttgccaacactacaacccaggaatttttttttttttttttttttttgagacggaatctcactctcacccaggctggagtgcagtggtgtgatctcggctcactgcaacctctacttcctgggttcaagcaattcccccgtctcaacctcctgagtagctgagactacagcgcctgccaccacgcctggctaatttttgtatttttagtagagacggagtttcaccttgttggtctggctcgtcttgaactcctgacctcaggtgatccacccacctcaggctcccaaagtgctgggattacccgcctgatccaccacgcccagccacaacccaggaatttttttcttaagagcctgagagtcttgtctttgaaatgtaaacctcgaggaagatagtgtccctatcttcctgttgcctagggagtttagcctaggcaccttgagctgttactacctgcttgtcaaggagatatgagaagttttgttttttcaccggatacaggtaattaactagcatgggtggccaccttgatttccaggtgaatttaggatgagtgtttaagaatgcatagcaggccaggtgcggtggctcacacctgtaatcccagcactctgggggaggccgagatgggcggatcacttgaagccacacagaaatcaaaagaaggagtttgagtccagcctggccaatatggcgaaactctgtctctactaaaatacaaatattagctgggcatgatggcacatgtctgtaattccagctactcgggaggcttaagtatg

SEQ ID NO: 41432 - DNA, 1061 bp, Homo sapiens; identical to SEQ ID NO: 41431

SEQ ID NO: 41433 - DNA, 1054 bp, Homo sapiens
tggcaccatcatggctcactgtagcctcaacttcccaggctcaagcaatcctcccatctcagcctcctgagtagctgggactacaggcatgcaccaccacacctggataatttttttttttgtagaggtgggggtctcgctgtgttgcccaggctgtccttcaactcctggcctcaagggatcctcccagctcaccctcccaaaatgctgggatcacaggcatgagccaccgcaatggcccatttcttcatgtcgttttccaactgttcagccaacgcttaactctgaaccaactgccaatctttgaatctgctagtgacctgaaagcctttccaggctgacccaatgtgtacctctcatgtattgatttatgtctttgcctgtaactgctgtctccctaagatgtataaaaccaagctgtaacccaaccactttgggctcacgttctcaggaccccctgaggctgtgtcaccagccatggtcactcaagtaggaggcccagaataaaactcttgacagactttgagtctttttggtcaacataacctaaccctaaacataatcctcctggggaaggtgagatcacaggtatctcttttcttcgttcgatctgtgtatttcctgatttctctacagtttttaggcattcgctgtgtgatctagaaaagctacagagtctcgctccgtcgccaggctggagtccaggggcgcgatctcggctcactgcaacctccacctcccgagttcaaactattctcctgcctcagcccccgagtagctgggattacaggcacacgccactactcccagctaatttttgtatttttggtagagaagggatttcaccatgttggccaggatggtctctatctcttgacctcgcgatccgcccgcctcggcctcccaaagtgctgggatttataggcgtgagccaccgcgcccagccacaaattctattttctttctcttccttggaaagcatcgctgggcatttatcctgtcctagtatttgagtgaaacttctcttagcatttcagcgcagtgaccacgatac

SEQ ID NO: 41434 - DNA, 1054 bp, Homo sapiens; identical to SEQ ID NO: 41433

SEQ ID NO: 41435 - DNA, 1084 bp, Homo sapiens
ttctttttttggaaacagagtctcactctgtcacccaggctgtcgtgtttacggctcactgcagcctcaaactcctgtgctcaagtgatcctcccacttcagcctcccaagtagctgggagtatagtcatgtgccacaatgcccagcgaattttttaatttttagtagagacaggttttgctatgttgcccaggctggtcttgaactcctgggctcaagtgatcctcttctttgacctcccagtgttggcattacaggcatgagtcaccacagctggcctagaatacttttctaaagataaatttctgttctctatttggttatgtaattcatgcaggaaagacagtttctaaaatgttgagtaggcttctaagcaggaaggtttttttgttttgttaccattatgagctcgtgggtttaaacagatagtaaatatttcagtacatcaaagttgtgattctttttgaaaattaaatggctccatctttggccagacaaaatccctttaagttggtttctgagtccttttgaaatatatttgatatatttgatagcaaatctatacatacaatatatatttgatagcattattttctgttcagcattttattttgaaatcatttcaaattttcagaaaaattgcacggattttacaaagaaatcccagctacttccttttgttcagatacttcattcttaacattttcccacattaatcatttatatgcatatatacatatatgtgtgtacatatttttatatattttttttctgaactgtttgagagtgggtatgatttgtcatgcctctttaccttataaagttttagattatatctcataaaatcaagaactttctattaaatacccatagcacagtaattgaattcaggaaatttatcattgatttaatacttttatctaaactgtagttcattttccagttttgccaatttcccaataatttcctttatagcaatttttaatttttggtagaagattcagtctaggactgtcaattgcctttagttttcatgctttttaaggctgtttaatacggatttgttcctcagtgccattataat

SEQ ID NO: 41436 - DNA, 1084 bp, Homo sapiens; identical to SEQ ID NO: 41435

SEQ ID NO: 41437 - DNA, 1084 bp, Homo sapiens; identical to SEQ ID NO: 41435

SEQ ID NO: 41438 - DNA, 1084 bp, Homo sapiens; identical to SEQ ID NO: 41435

SEQ ID NO: 41439 - DNA, 1031 bp, Homo sapiens
cttgtgtgtaattgaaatacatatgtcacatatatatcatacatactattgcatattagggtgcaatatttatatttgtgtatatacatgttattgatgttaatgaagtatccatcagtttctattttctttagtttgtttttttaaatcagctttttctgtcaagctttttcaggtatcttcacggatacaagatttttcttctttgctgtgttatagtggcttatcatattaatagatttccaaatattaaactagtctatattattggaataagtcccatttggctattgtatattatgtttttaatctggtactggattttgtttgattatgtttcattttgggtttttgtattgatgtaagtggtattggcatgtaattttatgttatttattggttgatcagtcttctaacccctactacctccttgccttctggactaacttaacccagaaggttattactctctctcggtgattttatcagctcctgtggcctgactgtggataagcttggatgttctgctttagtttctcagcccacagcctagcggccctgcctctgctatctcttgggatctacatggtcctagctgtatcactggatttgaaccccttgttgatatgttctttataaataataggataatgcagcctgcttactgggcacttcctttttctaaactacaagtttgggcagggcgtgctggctcaagcctgtaatcccaacactttgggaggccaaggcaggtggattgctggagcccaggagttttgcatttttctttttttttttttttttttttgagacaaggtctcactctgttgcctaggctggagtgcagtgttgcattcacagctcactgcagccttgacctcccaggctcaagtgatcctcctgccttagcctcccaagtagctagaactacaggcgtgtgccatgatgcccagccaattttttttttttaatttatttttagcagagatgaggtcttactatgttgcccaagctggtctcgaactcctgag

SEQ ID NO: 41440 - DNA, 1031 bp, Homo sapiens; identical to SEQ ID NO: 41439

SEQ ID NO: 41441 - DNA, 1031 bp, Homo sapiens; identical to SEQ ID NO: 41439

SEQ ID NO: 41442 - DNA, 1031 bp, Homo sapiens; identical to SEQ ID NO: 41439

SEQ ID NO: 41443 - DNA, 1020 bp, Homo sapiens
ttacaaaggaggagagggataggattccaggacaatctcaaaactattgctttttcctaaattcattgcaaccttaaaatcctagcaagttctttaatgtaaattaacaagctaattctagaattcatatgcatattcaaaagtcgaataattgtcaaggctatcctgtagaatggacagagaggattgaaatttctaaatatcaagacctgttataaagccatagaaataatgaaggtgttaatttggcacaaggatgaaaaaactgactagtggaacagcatacagattcaaaagtagacccacgtgtataccatcacctgagttttgagaaaggtgacattgaagtgtagtgggggaaagggtgttctttccagtaaatgtactttgccaataaaattttgtaatttgataaaaagttatttggaggtggattgcagatctgaatatgaaatgtgaaagctttacaaagaaatcttaggacagtttgtaatcttggagtaagcaaaggtttattgagacccaaaaagcattaacccataaaattagaacttaatattaaatttgagaacttctatttatcagaaagaccaccagtaagaaaatgaacaggaaatcatggggaggagaagatatttgcagttcatgtatgtgacaacagcaccgagtatagcagaagtgttggcaaactttataaagcaaggcaccagatggtgaaaattttcagctttgtcacaactgctcatctttgctattgtgtgaaagcatccatacaccatgcattaaaaaaaaaatgagcatggctgcttcccagtaaaaccattcacaatcccaggtggcagtctggatttggtctgcactcatagttttctggtccctgatctcgaatatgtaaagagcacctacaaatcaacaagggggaaactggaaaaggcaaaagactttagaggatatccactcactttagaggatatccagacggccaataagcatgaaaagatgtgttagctttattagtaa

SEQ ID NO: 41444 - DNA, 1090 bp, Homo sapiens
gcaccactgtgccccagcctgggtggcagagtgagaccctgtctcaaaaaaataaataaaaataaataaatcccactctgttgacttaaaaataaataaataaacattttttggcaataaagctatgtattagggaaaatctcctacttacctgttgctctgcctttcccattagtatgtctgccattttatggtcaggtcaattttgaaattgtttaaagccaaatctccaaaggggtgttgaacttgattgttgatgttgagacgaaaatatcaatcatatttatatttaataccattctttaaaaatactcatctaggccaggcacggtggtcacgcctgtaatcccagcactttgggaagccagggcaggtggatcaccaggtcaggagttcgagaccagcctggccaagatggtgaaactccatctctactaaaaatacaaaaattagccgggtgtgatggtggtcacctgtaattccagctgctcgggacgctgaggcaggagaatcacttgaaccgggaggctgaggttgcagtgagttgagatcacatcactgcactctagcctgggcaacagagcaagactccatctcaaaaaaaaaaacttatcttttgctgggcgtggtggcttacacctgtaatcccagcactttgggaggctgaggcaggtggatcacctgaggtcaagagttcgagaccagactgaccaacatggtgaaaccccatctctactaaatacaaaaaatttgctgggcacggtggtgcatgcctctaatcccagctacctggaactacctggaaggctgaggcaggagaatcgcttgaacccaggaggtggaggttccagtgagccgagattgtgccattgcactccagcctgggcgacagagcaaaactccatctaaaaaaaaagaaaaaccaacttatctttactgataaagtgtactcatactatggtatatatatctcaaaaaatatttggaatatttttgtttccctttcttaacggattggaatgcacagttttgtaaactgtggggttaaacttctagctgaggtatttaatatcctaaatcagcttccaaa

SEQ ID NO: 41445 - DNA, 1117 bp, Homo sapiens
aaaaaaaaaaaaaaaaaaaccataaaataaataaacttagcactacagtctggctgtttgatatggggtacaccaaaccctcaactcgaaagaacttgtcatcccttgttttaaggacacaggaaggtatacaatttaagaacaatttgtttttttaatcagaaaatgggagtgggggagtcctgcttaaaatagcaacccttagttatctggaaaatgttttcctgaacatcagtttcccgaaagttctgggttgctgagattttgttttagttttagcctagggatattactctattcttcttggttcttttattaattttcaaaatagttacaggtaataatacctaattatttcattgatacaacaattgatgtaactaattcagtatagtaaagaagcaaaaaatttttgcaaagaaaaattatatgagctggtagagttttgtttctgttctttttatccttctaagataaatcaatgtgattttacagattaatactgattatagcaactcttcttggaatacatttcttccacatacgtgtgaaagagtagttggaaatctcaagtttttaataaatcacatgatcattaaaatagccctgatcctatcttggggtacaaatacttagtgtgaaatgtgccccttccctgtttcagccttctgttttacctcctcattttcatgttctcccagatgttaaaagtgatcctggtatctgattcctctgtaccccggtgcttcctgcttgttcgctcatctttcttctgctgaaagctggacttgcttcttgttttgctttctttggtcaactgggttctggagaggcacttttctgatgaggaaaccccttctgtggtgtccccgaggcccctgctgggaggggctgctgagctgtgggctccttgagcctcctcgcagaagcgggtgatgagtatggactcataaacgcaaggccatgaaaccaatcctctgctttttccttgtaagccaacgacggggcctttgattccagactctaaggtagctttggagtccgtttcgtttccagcccactgctcagccatggcacagcacaggggtggagccacgggtagtaaaggcctgcagaa

SEQ ID NO: 41446 - DNA, 1098 bp, Homo sapiens
ggcaaaaccctgtctctactaaaaatacaaaaaaattagccaggcatggtggcgcacacctgtaatcccagctaatagggaggctgaggcacgagaatcacttgaacccaggaggcagaggttgcagtgagccaagattgtgccattgcactccagcctcggtgacagtgagactctgtcttaataaataataaaaaataaagagtggatgtttcctgaccaacatggtaaggtgggtgcatgaatgtctgtgttcttcttagtgaactttggcccttaaaaatagatgatgaaatggacaaagaatgttttgagggttaatactttaaactgatctattacattgttctattccaagaatattatctgcctttcctctttcacactttttttttttagtagataagagaatgtctctagaaaacaggttagctactaagtgaaatgtcaagattgttttctagcatttttctataggtggactcagaggaaagaatgtttcttcatgtctcagtatttagttcaggctcagtattgacgtctaccctcaaaacttttaacaatccatcataaaatcagatctttgctgtcactcactgtggctgttacagaaagaatgggccagagctggtcttagagaaaaacaagatggacagctacttgttgttcttttgtttacttagaaaagaaaattcacacacacacacaaaagcttggtctagcagtactggaagatagattttctaccatcaatgttgtaatttcaaacttgaaagttgcaggaactgccagataggctttgcacattgtttatgggcgcctcatatatgtatatatatggggacagagtctcgctctgtcacccaggctggagtacagtggcataatcatagctcactgtacccttgacctcctgggctcaagcgatcctccctcctcagcctcctgagtagctgggaccacaggcacatgccactacacctggctgatttttttttaatttttgtagaaacggggtcttactatgttgcccaggctggtcttgaactcctggcctcaagcagtcctcccacctcagcctcccaaagtgctgggatt

SEQ ID NO: 41447 - DNA, 1035 bp, Homo sapiens
agtgcaccgccatgctcagctaatttttcgatttttttgtagggacacgatcttgttatgttgtccaggctagtctcaaactcctgggctcaagtgatccacatcagcctcccagagtgctgagattacagacaaaccaccacacctggctttattttgtgtgtgtgtgtgcatttccaggtagacggcaggcatcagtacatttctcctcaatactgagtagagttcaatgtttgtttttttcttgtaagataaaatttacttacagtggaatgcatctatcttgagtgaacactatgtgagttttaacaaatgcctgcatctctgtgaactgaaaccctatcaaggtttaccatcactccagaaagttctctcatacttccttccagtctcagctcccttctgcccacattccccaagaggcaaccagtgttctggtttttttctactgtagattagttttgtcttttctagaacttgatatgaatggagcatctactcttttgatgacgtttcttttgctctgcattttttttagatttatccacatcttatgtctcatttgcccagtatgtgaatatatgacagttgttgatgtattcttttcatgacagttatctgggctctttgtagttcagctattatgaacaaagctaccatgaacattctcgtacaagtcttttaatggacagatattttcacttagataaatattgtagtggaattgttggctagatatgtgtttagttttgtaagaaacccccataaccttctcctaagtgactataccatttgtggttctgtcagtgctgtatgagagttctgattgctctatgtcctcactaactttttttttttttttttttttgagagagtctctgtcgcccaggctggagtgcagtggcacaatctcggctcactgcaacctccacctctggggttcaagcagttctcctccctcagcctcccaagtagctgggattacaggtgtgcaccaccacacctggctaatttttgtatttttggtagagacgg

SEQ ID NO: 41448 - DNA, 1294 bp, Homo sapiens
accttggtggggtccgaagcctcgtcagaccacaaggtcttgcccgtgtaccacacacaaatccaggcttttattttttttttttttccccccccgagatggagtcttgctccagagctggagtgcagtggtgcagtctcggctcactgcaacctccacctcctgggttcaagcgattcttctgcctcagcctcccgagtagttgggattacaggcatgcgccaccacacccagctaattttgtatttttagtagagacacagtttctccatgttggtcaggctggtctcaaactcctgacctctgatgatctgcccgcctcggcctcccaaagttctgggattacaggcgtgagccaccacgcccggcccaggcttttatttttaatagtttaaacttcagatgactcagaacaatagaatgatatgccacttttgccctgaagactgttagtgttgagagtaagtagtcatttaaaataggtttaaagagaagattgaacattaagtcaacaatagaacaggggagtgtttttctatgctcgtggcaaaaagtgtggagatgatgttcaaggggggccctgggggaccccagactccttggtggcccagggcagagctgtcctggagatagccgtgtggcgcatttgcagtctgctgtgaaagatgggaaattcctgttttaactcagctcaaattcttcttttctcttttccttccacaggggaccgtgattagggtattttccattccagaaggacaaaaactctttgagtttcggagaggagtaaagaggtaaagtacgtgaatgtccagaatggattctggaggttgtatttggatttcagttttatgttatctatgaacaaacaagtagaacccccaggagaattccacacgagcatttctagcccggctgggtcaccgggtaagatctgggcgtcggtcttgtcatgggaattgaagagcactttcagaaaagcaaattgggtttttgtttgcgatcccaccagctagcgtgagagttgtgaagagctcacgcaaccaggtgggccctccagtgcccggcagctcccagcctgctgtaagggacggggcggcgacgtcatgggtagcacaccctcccctttaaaggccacgctctgagaacctgttccagctctccagctccgcctccaccctcagcaaatggcattggccccttcttttaacccagaagccgcagcctggagttctcttgtcttcctccctccaggctgcaaagcttccctcatcggtgcttacatgcctcctgt

SEQ ID NO: 41449 - DNA, 1105 bp, Homo sapiens
tagagacggggggtttcaccatgttggccaggatggtctcgatatcttgacctcatgatccgcccaccttggcctcccaaagtgctgggattacaagcttgagccaccgtgcccggccctttgctctgttcttaaactttactgaggttgccgatttaccctctggtgtggaaagaatggctgtaacttaaattactgagttttcttttactcaccttaggactataaatccatcctacttcagctaaaagtggtttagtgaaatcctactccttttgtcatgtggaagcttgcagctgtgttaacgaattgttcttagtatttccttttgaacattttcctctctcaaggaaaatgtttgagaaggtggctagaggggaataaaacttaccagcaggcccaagtgtgcccgtgacaggaactcttctccgccacttgagttgaacccctggggcagctgctggctccggtggcccgccccaacctgtgcgtctccccaggtgcgtgagcatctgctccctggccttcagcatggacggcatgttcctctccgcctccagcaacactgagaccgtgcacatcttcaaactcgagactgtgaaagaaaagtgagttgcaaatatacgtttctttaaaaatgatgcaaaaccctttgtccccacttgctgccgggatgagaggtaagcacggacccgcccaccctctgacatcgttagccagtgaagaccccggagctggccatggagcgagcacctccgcatccaggctcggcagtgaggaggatgggccccagcagatgagcttctcccacaggcagcacgcagggtagacagagccctcgcgtagggcatggagggcccaggtggacatccttttgtcagtgaagatggcctctcctcaggttcccctcacgacaaaagcgtttgtgatcagacagcccactagggtgaatggctcgtctcttaccttcccacgggtaagcagagacatggacggcttccacaagaatttattatcgcaatgaatgtgtagcatgaggggggtcttatcttttaagaggggcttactctgttgcccaggctgcagtgcagtggtacagtcatta

SEQ ID NO: 41450 - DNA, 1088 bp, Homo sapiens
ttttaattgggaccatttttagccctcaccgggaggcttccgaaaaccccccaggcatctccctcggggcccacaggggtgacgtgtgcccaccctataccaggagctccctaccctcatctcggagcccccagcacccacaccagctgccccttctatgggtggggctttcagctctagaagtaaaagggagttgcccaaggcagacctgagctcagagcctgtgtccttgaggggcccttggtgggcagcaggtccccctcctcccacccagagccccccccttccatccggaagtgttgcctaccaccgaggctacaaaacccacatgccagtccctactcaatgcccctaggaccgaccgacccggcgtgcccgggaatgccccagttttctcactgaacaccttccatccaggcaccctctcatccctgggacggtgggtcacccagccacccacagataagcacggtagggggttggagggtgtcccccgaaaagacatgtccactggaacctcagataggctctcactgggaataacggactctgcagatggaattaaggtaaggctctcgagataagcgtgcctgattagagtgagccctaaatccaatgactcccgtccttaagagacacagagcgcactcccacgtaacgagtgcctgacggccgggacagagactgcagagaagcagcaacgggcccaggagcgccaagcgtggcccgcagccaccagaggctggagagaggcctgggaaggattctccgtgagagactagagaaggagccaaccctgcctgcaccttgatctgggacttctggcctccagagctgtaagacaataggtttctgctgctgaagccacccagcgtgtgggcatttgtaaccgcggcactagggaatgaacacagtaggtgggccaggcacagtgactcacacctgtaaccccagcactttgggaggccgagacaggaggatcacttgaagccaggagttcaagaccagcctaggcaacacggcgagaccccatttctacataatattgaaaaattagccaggtgtggtggtgcacacctgtagtccca

SEQ ID NO: 41451 - DNA, 1026 bp, Homo sapiens
gcagcctcagcctcctgcctcagcgatcctcctgcctcagcctcccaagtagctgggaccacaggtttgcaccaccactcccagctaattaaaaaaagtaatttgtagagacgggggtggggtgggggtcttgctatgttgcccaggctggtctcaaactcctagactcaaacaatcctcctgccttggcctcccaaagtgttgcgatcacaggcatgagcccctgtccctggcccctattatttctctaactggggaaagtcatgtgggaacagatgtagcttgccttggcctctgaccggccctgcctgcgttcctgggtgctctctgctgcttctcatgtgtgccactgtggggactcggccgcccaccccaccccgtggtgttaccttgcgtgtgtagttctgtgagctcagggctatggtctgccagaactagggggcgtggggccccagtaccagcccaaggcctcctctctgcaggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagtgagtgcctcgctcccacctgtcaccgcccccaccaccttgcctgggctaccccgcctgaccctgtcccgccatcccccaggaatgccagctgctactttgacatcgagtggcgtgaccggcgcatcacactgagggcgtccaatggcaagtttgtgacctccaagaagaatgggcagctggccgcctcggtggagacagcaggtaacactaaagccccagttccctggagccgtcctggagtcctggagggtctggccatgccgtggtcacttggtagccccagccaaggcctgctctgtgctgggcatccccccggactggccccgcactgtcctaccctggggactgctgtgtgaccccagctcctggccctccctctctggt

SEQ ID NO: 41452 - DNA, 1002 bp, Homo sapiens
tgatctgcccctctcggcctcccaaagtgctaggattataggcatcagtcagcgcgcccagccttgagtttctttttaagtctttccagctgccatcttaaaggatggtttgcaggggtggactagaatgggtgcgaggtggaataggctaggtgaagaatggtggcctggccacgtgtggtggctcacggctgtcttcccagcactttgggacctgaggtgggaggatggcttgaggacaggagtttgagaccagcctgagcaacatagcgcagttctttgtctctacaaaaaaatttaaaaattagccaggcttggtggcacacacttgtagtcccaggcactcaggagactaaggcaggaggatcacttgagcccaggaagtcaaggctgcagtgggccatgatcacacccctgcactccagcctgggcaatagagtgagaccctgtctccaggacaaaaaaaaaaagacaagaaaatgatttgtggaattgattacttggccccatggacgtgcttccaagctaaaataaagtgtttcaacctgtgttcccttttccctatttgtataaattactcagttacattctcattgctacttatttaagcaaagtattcttagtttgttaagaacaaagaactacaaattgtgttcattttctatccttccctgttgttaagactaaattacctgaaataggaaccatacaatttcagagtggcttttagccacaacttttatttgttgaagctttttttttttttttttttttttttgagacggtgtcttgctctgtcgcccaggctggagttcagtggtgcgatcttggctcactgcaacccccgcctcccgggttcaagcgattctcctgcctcagcctcctgagtagctgggactacaggcatgcactaccacacctggcttatttttgtatttttagtagaaacagggtttcaccatgttggccaggctggtctcaaactcttgaaatcaggtgatc

SEQ ID NO: 41453 - DNA, 1030 bp, Homo sapiens
tttttttttgagacgaagtctctctctgtcgcccaggctggagagcagtgttgcaatctcggctcactgcaacctccgcctcccgggttcacaccattctcctgcctcagcctcctgagtagctgggactacaggtgcctgccaccacacctggctaattttttgtatttttagtagagacagggtttcactgtgttagcctgaatagtctcgatctcctgaccttgtgatccgcccgcctcggcctcccaaagtgctgggattacaggcatgagccactgtgcccgacccaatctcagccttctgttagagcactgggggactgccaaagcctttgaaaaattagtcttgccattgatgattttcagctttcctaaataagttgtttcttgagcttcatcttgagttccattatcatacttagttattagtaatctgttgataatcttcaaaatttttaggtcataggtagtctcctcacaagtgtgtacagtggtacctgatagcctgagttcaaaacctgcttccttagtggtaaaatgggaatgacatcagcaccagccattagaattgcagccatttggcctagtaagggctccctacatgagatggtaaggacggcagtgatggtggcaatgaattagcatccatggcagatgttacaaggaatcaaatgtatctcattttttctattgattgtattatttattttttaaatgttcaaagtggatataaaagagtaattataatgaactctcatgtagccgtcaaccaactttgacatttatcaacttacgggcagtgataccagcacctccttatctccccacgacattatctcaaatccaatacttcatctttcacttgtattttagtgtatacatctaaagagttttttctaaaaatcaaaaatgtatttacatgaaacagtcattcagtgttcatatttctctggttgttgttttatgtatatataaaatatatatacataaaatacgtgtgtgtgtatatatgtatgtgtgtgtgtata

SEQ ID NO: 41454 - DNA, 1031 bp, Homo sapiens
gttgagtaggattccattttatggctagatcacaatttgtttctccatttgtctattgatgggcatctgggtcatttttcactttgtgccgttacaaattaagctgctatgaacattagcaaacaagcctttgttaggacatgttttcatttctcttaggtaaatatctaggagtaaaatggcttggtcctggggtgggtgtgtactttaacattttaagagacttccagactttccagaagggattgcagtgttttatagtcccaccactggtgaatgaatcttccatttgctccacatccttcccaatacttggtggggtcagtcttcttcagttttagccatctccataggtgtgtagtgtggtagtattttgttgtggttttaatttgtactttcataatgaataatgctgaacctcttttcttttttgttttgtttttgttttgaacatcttttcatgtggttatttgccatccgtatatttcctttgctaaaatgcctgttgaaatcttttgcccgtttgaaaactggtagttttcttattgttgagcttagagagttctttatatatcctcgatataagtcttttattatgtaggctgggatttgtcttttgattcttttcagtgtcttttaaagagtgcattttttgttttgggaaatttcatttctttttttttctttttattcgttgtgctgtaggtgttttaagaaatcttggctgggtatgtggctcatgcctgtaatcccagcactttgggagaacgaggcaggtagatcacttgagcccaggatttcaagactagcctgggcaacgtagggagaactcatctctatatataaaaaaaatcaaaaattaggccaggtgtggtggttcatgtgttttgggaggctgaggcgggtggctcacttgagttcagtagtttgagaccagtttgggcaacatggtgaaaccctgtctctataaaaaatacaaaaattatctgggcttggcggtgtgcgcctatagtcccagctacttgggagac

SEQ ID NO: 41455 - DNA, 1028 bp, Homo sapiens
tttaaagttttgtggccaactgcagtggctcatgtctgtaatctcagtgttttgggaggctgaggcaggaggactgtttgaacccaggagtttgagaccagcctgggcaacatgtcaagaccctgtctctccaaaaaaaaaaaaaattagctgcatctgggaactcatgcctatagtcctagttacttcggaggctgaggcaggaggattgcttgagcctgggagtttgaggctgccgtgagctatgattgcaccactgtattacagcctgagtgatagagtgagatgctgtctcaaaaaaaaagttttggaaccaggtaagtcctccaactttgttctttctccgagttatgctgtagcctgggcaacattgtgagacctcgtctttacaaaaaataaaaaaaattctctgggtgtggcggcaagcgctagtcctggctacttgggagactgaggtgagaggctcgcttcagctcaggaggtggtgactgcagtgagccattattgtgcaggtacgctgcagcctgggcagcagagtgagatcttacgtcaaccaaaataaaaaagttgttctggctcttcatggttgcttggccatttgtattttcaaatgaattttagaatcactttgtgaatttctacaaataatcttcctggtattttgattgggactgtgctgaatatttaaatcaatttgatgtgaattgacacctaaacagtattattttctgactcacaagcaaggtatacctattcatttaggccttgttttttgttgttgttgttgttttgtttttttttagtgacattcttgctctgttgcccaggctagagtacagtggtgcacagtcagagctcactgcagccttgacctccttggctcaagggatccccttgcctcagcctcatgaatagccaggactacaggcatgtgctacaacacctagctaattttttgtttttttgtagagacagtctcaccatgttgcccaggctggtcttgaactcctacgcttaagcggttctct

SEQ ID NO: 41456 - DNA, 1073 bp, Homo sapiens
atataaaatattaaaaaattgggctgggtgcggtggctcacgcctgtaatcccagcactttgggaggccaaggcgagcagatcacgagctcaggagatcgagaccatcctggctaacacggtgaaaccccgtctctactaaaaatacaaatattagccaggcgaggtggcgggcgcctgtagtcccagctactcgggaggctgaggcaggagaatggcataaaccccgggaggcagagcctgcagtgagccgagatcgcgccactgcactccagcctgggcgacagcgagactccatctcaaaaaataaaaaataaataaaaataaaatattaaaaaattagctaggcgtggtggtgttcttctatagtcttagctactcgggaggccgaggtaggagaatcacttgagccagggagttgaaggattatgccactgtactccaaccagggcaacgaaaggagaccctgtctcaaaaaaaaaaaaaaaaaaagccactccagttttctttttcgtatcgtttctctttttttttgaggtggagtctcactttgtcacctatgctggagtgcactggcatgatcttggctcactggaaactctgcctcctgggttcaactctgcctcctgcctcggtctcctaagtagctgggattacagacatgcgccgccgtgcccggctaacttttgtatttttagtagtgatggggtttcaccatgttggccaggctggtcttgaaatcttaacctcaggtcatctgcctgcctcagtctccctaagtgctgggattacaggcgtgagctaccatgcccagcccactccagttttcttatgattcatgttagcatgatatattttttccatctttttatctttaacttatttttgtctgtatatttaaagtagattcccttttttctttttttgagacggattctcgctctgtcacccaggctggagtgcagtggcgcgatctcggctcactgcaaccttcacttcccaggttcaagtgattcttctgcctcagcctcccatgtagctgggactacgggtgcaccaccacacccggctaat

SEQ ID NO: 41457 - DNA, 1290 bp, Homo sapiens
ttgctgggattttgataggaagtacactaaacttgtgtcttaatttggggggattaacatctttactatgtccctgaagtctgctttactctttattaatgtaaccattcctgctttttttgttgttgttggtttctttgtttttgagacagaatcttgttctgtgacccaggctttgtgcattggtgtgatcatagctcactgcatcctcaaaatcctcaaaatcctacatcatcaaaattttggtctcaagctatcctcctgcctcagccttcctgctagctttggactacaggcgtgtcccaccatgaccagctaatttttttatttttacttttgtagagatttggtctcgctgtgttacccaggctggtctcgaactcctagcctcaagtgatcctcctgccttggcctctgaaagtgttggaattacaggtgtgagccactgtgcctggccctgctttttttttttttttttcctccttgagatgaggtctcactctgtcacctggtctggagtgcagtggtgcgatcatggctcactgcaccctccaactcctgggctctaggaatcctccatctcagcctttggagcagttgggaccacaggcatgcaccaccatgcccagataaaattttttccctgctttgttttgattaatgcttgcatgacatatcttttttatccttttactttcagcctgcctgtgtcattacatttgaagtgagtttttctgtaaacagcgtatcgttgggttgtgctgttcaatccattttgtgagtctgtgtcttttaactctctgctgctctaggctgggtgtccttcaccctcatttatttagaacattgacttttaaggtgattattgatattttaagacttaaggcttattctgccatttaatgttttgttttttgttctgttcttttttatatgtctgtgttttcttgcttctctgtgggttatttgaatacttgaaagtgtttttcaaaattacatcattttgctttacttgagtctttctttcttttttgggggtgggtcgtggacagggtctctctgtcacctaggctggagtgtggttgcaccatctcagctcactacagcctcagtctcccaacctcaaatgatcctcctgcctcagccccgcaagtggcttggactacagctgtgcgcgaccatgcctggctaatttttgtagagacagggtttcaccatgttgcccaggctggtctcaaactcctgggctcaggccatccgcccacctcaggctcacacaatgctgggatt

SEQ ID NO: 41458 - DNA, 1046 bp, Homo sapiens
ctccagcctgggtggcagggcaagacccaaacacaagtgacggtgtgcggtgatgtggtgtttgtgcctcttctcttcccaggctgctcagagtgtcaacaaggcattggagcagtttgtgaagccggaacagcttgatggagaaaactcgtacaagtgcagcaagtacgttgggtggtgacttgattcttgatgccggcttctccagtggggatggccggcaggcttggtttgagagagtttggtgtgtctaggttgcttgagtttctgataccctctgggaagacactgcgtccctgtcgtccaaaggcgagagcccggagtgtcttgatgtgtgtgtttctgcaagatgcgcagctctgtgcctgtgaaagcctggggcatgacattattgggcagattcggtgggaggagagaggtaaaattgtctttgcaccccatggtagtgctgcttcaggtgtggctgggcacgcactgtctgccaaatagcattttcattgactttcttatgataagagggctgccgtcgggtggggagtcactttcttctgggatagggaggctccttctctcttagggtgggttcccagggtttgggatagcatttgctgaaaaactctaattttgatcattcattaatatgtttccacatgaagtcaagagtgcctattttaagaaagctcttttgtatgtttttaagtagatttccactttgtggtcaggtaatagaagtaatttttttattgtcaaatcttcaagaccagagggattttgcctttgttttaaattccacagacatttctaatatttatttttattccttttgtttctggttagggctctcttttcatataataattattattatttttaaattagatgaatttaagacatattttcacataattataccagtctgaacatgttcgtttttcagtttcttttgaattgagaggaagttgtgttaacctaattttaacattattggtggcttgcgtggcttggtttttcagaattgtcctaacttcctttcctttcatgctaat

SEQ ID NO: 41459 - DNA, 1427 bp, Homo sapiens
tgcagtagatgatgaaagaaaggttggtattatcaggaaatgttttcttaagcttttcctttctcttacacctgccatgcctccccaaattgggcatttaattcatctttaaactggttgttctgttagtcgctaacttagtaagtgcttttcttatagaaccccttctgactgagcaatatgcctccttgtattataaaatctttctgataatgcattagaaggtttttttgtcgattagtaaaagtgctttccatgttactttattcagagctaataagtgctttccttagttttctagtaactaggtgtaaaaatcatgtgttgcagctttatagtttttaaaatattttagataattcttaaactatgaaccttcttaacatcactgtcttgccagattaccgacactgtcacttgaccaatactgaccctctttacctcgcccacgcggacacacgcctcctgtagtcgctttgcctattgatgttcctttgggtctgtgaggttctgtaaactgtgctagtgctgacgatgttctgtacaacttaactcactggcgagaatacagcgtgggacccttcagccactacaacagaattttttaaattgacagttgcagaattgtggagtgtttttacattgatcttttgctaatgcaattagcattatgttttgcatgtatgacttaataaatccttgaatcatacgactggtaatactggtgtttttgagacttgatgaacaagttcctggtgtgtgtttgtttgccttgctttaaagtcctgggttgttggagacagtcattttcaatgcgtgtctccacacaggagggacagggagtgccacctccaggggagaactgggtgagcccaaatacggcaggagtggaggtgacattcatgtttggacctgtcgaacagtggcgaagctctgagggagaagcgcctatcggggtgtgtgtgcacatcctggcccagagctaggggctgaagatggagatgttgggaccctagactggccctggaagagtagaggttggtgaaccacatgcccttaagatcctttccagaggctgagtgcgtggcttacgcctctaagcccgacgctttgggaggctgacacaggaggagcgcttaagcccaggagttctagaccagcctggacaagaaagagacctacccaaaaaaaaaatgcaagagcctgaacttgtactacataaaggttcatgttagaattcgttttcttaatattcctttttattgctttgaagattgtttttgagtttttgttttttttttaagatggagttttgctcttgttgcccaggctgggagtgcaatggtgtgatctcggctcactgcaatctctgcctctcgggttcaagcgattctcctgcctcagactcccgagtagctgggattaca

SEQ ID NO: 41460 - DNA, 1042 bp, Homo sapiens
ccccctaccagggctccagcccccagggaaatctccgaccaggcccgcccaggaggtgccttggatgggggtggcttcgggaggccctaatggggagtggcggggagagacccaaggctaccgacttggcttatttcttcccaactagctgtttctcacaaagtctttattattattgtattttgagacggggtttcgctcttgtttcccaggctgtagtgcagtggcgcgatctcggcttactgcaccctccgcctcccggattcaagcaattctgcctcagcctccccagtagcttggattacaggcatgcgccatcacgcccagctaattttttttgtatttagtagagacggatttcaccatgttggtcaggctggtctcgaactcctgacctcaggtgttctacccgcctcggcctcccaaagtgctgggattataggcgtgagccaccgcgcccggcctcttttattgtttttagagatggggtccagctctatggcccaggctggaaggcagtggcacgatcacagctcactgcagcctcgacctcctgggctcaagccatccttccacctcagcctcccaagtagctgggaccacaggcgcgggccaccacgccccactgatttttaaatttttatgtagggacagtgatctcactgtgttgcccaggctggtctcgaactcttaacctcaagctatcctcctgcctgggcctcccaaagatttgggagcaggcctaagcaacttagtctgggccatttctcccaaagtcttacccattcatgctgggggtgctgaaaatcccctacttccaaatccttttccacaggtattctgcctttgactgcaactcttgtcgtcttatgtgggtgttgaattgatctgtctctgcagccagatccaggctcctggaagaaccatgtccggcagctactggtcatgccaggcacacactgctgcccaagaggagctgctgtttgaattatctgtgaatgttgggaagaggaatgccagagctgccggctgaaaattaccc

SEQ ID NO: 41461 - DNA, 1033 bp, Homo sapiens
ttccttttgtttcagatattttcctgtataattccagaatgtcttcagagagccgtgcatggattgcttcattaccttttccatacgaggtatttctctttcagagtttaaatattctcctcttttctgctttgattattaattgttgagatcctctagcttcaggaagctccttgtggtttccagcatggtgagggaaagaaggccggaaagaatcacgagtcctgagttgggagcctctactcgtagttaatctgccttttgagatggaggttttaacttgcctacttttaaaaagcgatatttacagattgtgaatttctgttaaatacatgcaaaatgtttcacatagttttctatgtaattcttactattatctcaagcccaaaggaagtggttggccgttggttactttctttagtatcatacaatttcttcaagaagaaacccccatgaacaagccatgcctgttttctttcagaaaccacaccttcattgtcctgcacctggtcttgcaagggatggtttatactgagtacacctgggaagtatttggctactgtcaggagctggagttgtccttgcattaccttcttctgccctatctgctgctaggtgtaaacctgttttttttcaccctgacttgtggaaccaatcctggtaagttgaggctcttagcatacagcatggtgacagctccactgtcttactaatagtgctgcaaacaaggagaggccccccctgaggactttgtaaaagatttgatgtgtagcattttcattacctttcagttttgagtgttttctaattttttttttcttcttcaacccatgggttatttaaaaccacttaaaatttttagtttatctttttaatgctttcacttcgttttgtcatatatagagcatgtgatcggtatggtactgttcctttttttgtttcttaagacggagtcacgctttgtcgcccaggctgcagtgcagtgaggcgatctcagctcgctgcaacctccgcctcccgggttcaagggatt

SEQ ID NO: 41462 - DNA, 1044 bp, Homo sapiens
tctccctcagcctcctgagtagtcgggaccacaggtttgcaacaccatgtctggctgattttttatattttttgtagagatggagtttcactgtgttgcccagtgtggttttgaactcctggactcaagcagtcctcccacctcggcctcctaaagtgtcggcattacaggtgtgagccattgcacccagcctgaaatgtgtgtttttaatttaggttaaaagctaaaggtgtggaccacctggacgtgtgcagtttgctaagagggaactattagtgatacccatttgcctgaggtgcaatggtccaagtggcaggcagcccagaaagcaagctctagtgtctgtgagatgtgacccactccctggacatatgacttgatttcttatcatccccatactttctttaattttttttacttttttggatatagaatcttgctctgttgcacaggctgctggaatacggtggtgcagtcataggtcactgtagcctcaaaactcttaggctcaagtgatactcccaccccagccttccaggttgctgggactgtaggcacacactaccaggcctggctgacaaaacctgcttttctgctgctgtttctgattcctcctcctctgcccttggctgttgctgctcacagggctgacaaatagtctctttctcttcctggtctgatagccataccagcactttgaaagccttcaacagcatctgtcatttttattcagtccagtattggtctcccaccagcctcctgactatttttgagccttctttttttttttctttttttgagacagagtctccctctgtcgcccaggctagaatgcagtggcatgatcttggctcactgcaacctccgccacctgggtttaaacaattctcgtgcctcagcctcctgagtagctagctgggactacaggcgcgcaccaccatgtctgactaatttttgtatttttagtagagatggggtttcaccatattggccaggctggtctcgaactcctgacctcctgatccacccatctcggcctcccaa

SEQ ID NO: 41463 - DNA, 1070 bp, Homo sapiens
ttcccttctttgtccaccgcttttatttaacattttaatgttttcttcagggaattaaaaagacagcaggatacaaatcctgtgtatcatccgagtcttataaccaggggtccacattagagccccccagaactaatcagcagtcccctgctggtcctgccctggagactcttgactccatcccttccaaggagctggtggccgcctctcctgacgcagatttggggagccctgacctcccggggcaggcctggcactgctgttggggaaggacagggggtcgcctggaatacctcctacatttcttttcttttcttttttgagacagagtctcgctctgtcacccaggctggagtgccgtggtgtgatctcggctcactgcaacctctgcctcccgggttcaagcgattctcctgcctcagcctcccggatagctgggattacagacaactgccaccacgcccagctaatttttgtatttttaatagagacgggttttcgccatgttggccaggctggcctcgaactcctgacctcaggtgatctgccttcctcggcatccaaaagtgctgggattacaggtgtgagccaccacgcctggcctacctcttagatttgtgacagtctctgtgttcaccgtgtttccaaatagactggaaacttcttgaagtgctttctatctccggcagggtgtgtacaggttcaaatcatcacatgaccgaaatttggcctctgcagtactctgcagtacctcctccttgggttcgttaatctcttgctaagttacttacccagggttatttaatagtagtaacagaaagaaagggggctcagaagaactttgggcaccgaatgcaccagccctccacataccctctgtttactgcctcagcccctcctgggggccctgggcccaagcctttgtactggggagcttgggggttcagtctgtgacagaccagccccttgatggagtatgggggagtagacagagagcaggcagggccgtggctgggaaaacgggttgttgtgggacccagttaggataatatgcagggacggagccttgg

SEQ ID NO: 41464 - DNA, 1049 bp, Homo sapiens
gggctggagtgcactggcgtgatctcagctcactgcaacctctgcctttcaggttcaagtgattccccagcctcagcctcccgagtagatgggactacaggcgcacaccaccacgcccgactaattttttgtattttagtagagataggatttcgtcatgttggccaggatggtctcaatctcctgacctcgtgatccatctgcctcggcctcccaaagtgctgggattataggcgtgagccaccgcgcccggccatcccttggttttattaaatcaatatattcttggaaaaatggccagaaagcaaacttttataaatcaaagcattgtcttccattacaaaatggaaaacatatgatgttatagggagaagagatgttgaaatcagagttgggaacggagaaagcctcctcaagtcacatgtagaaagaaggattgggattttccagtagcacaatagtaatactcaaaacgagaatctcatggtgtacacggtgcggaaagagaagcgtagtaacggagtggtgctgtttttgcagggcctcccaggtttatgcctcccaaagtgttgcgattacaagcatgagccaccacgcccagcctagttagtcctttgtattcctgaatgacaatctcaaacagtcccagtctccttggtatttttttgttactttgcaaaccaatcctaaccttcagagagagggaattttcaagcacctaccaggctccaggtactatgccagggctctccttgttgtactgtttaagcagatggtgtgggtatcactgagctattttgtagacaggactgtgagcctgcaggaggttgtatacctgccgactggtagagttaggttctgaactgagaacttcctgtctgaaacctagtggtctctctgacactttggtgattttgggaaactacttgtggtaacacctccgggcagctttatataaattctttattatttacagagaaggataatttcatttatttaaggtgtggctgtaaggtcggagttcagcatggggttgatggcttggccgt

SEQ ID NO: 41465 - DNA, 1052 bp, Homo sapiens
cgccatcgggggtctgctggcggagcccgcgccggccgcgctggcggaggaggagagcccgtggatctgctcggactgcggcaagacgtttgggcgccgggccgcgctggccaagcaccagcgctaccacgcgggcgagcggccgcatcgctgcgccgactgcggcaagagcttcgtgtacggctcgcacctggcgcgccaccggcgcacacacaccggcgagcggcccttcccgtgccccgagtgcggcgcgcggttcgcccgcggctcgcacttggcggcgcacgtgcgcggccacacgggcgagaagccgttcgtgtgcggcgtgtgcggtgcggggttcagccgtcgcgcgcacttgacggcgcacgggcgcgcgcacaccggggagcggccttacgcgtgtggagagtgcggccggcgcttcgggcagagcgcggcgctgacgcggcatcagtgggcgcacgccgaggagaagccgcaccgctgccccgactgcggcaagggcttcggccacagctcggacttcaagcggcatcggcgcacgcacacgggcgagaagcccttccgctgcgccgactgcggccgcggcttcgcgcagcgctccaacctggccaagcaccggcgcggccacacgggcgaacgccccttcccgtgccctgagtgcggcaagcgcttttcgcagcgctcggtgctggtcacgcaccagcgcacacatacgggcgagcggccctacgcctgcgccaactgcggccgccgcttctcgcagagctcgcacttgctcacccacatgaagacgcaccgcggagccaccgcagcgccgggctcgggttcggccccagcccccgcgcccaagcccgaggcggccgccaaggggccgtccagtgccggccccggtgagcgcggcagcgccctgctggagttcgcgggcggcacaagcttcggctccgagcaccaggccgcgttcgccgggccctcgggcgcctaccgggagggcgtcctgtgaggggcccggggccgacagcagcgcagcctgcagggccaccggcccc

SEQ ID NO: 41466 - DNA, 1023 bp, Homo sapiens
ttttagaagatttcttaagatttgattaaagacgctgatgtacaaactatagcaaggctgaaagaaaggtatgacaaaaatctttttacttcaaattcagtgggattaagtcattcttttaaaagaagaaaggtggggagcgggaaggagacttgttccataaaatgagaagttagccttttatcttaaaatctggttagagaggaactccaatgtgtacttaaattattttgcagctaattcaaatgtccaaggggaatatatatgccaaaatctgtaatatgtgagaataggaagagggagaaaaaaaatatataaagaaactggtgtttgtgatttagggaagcacataagaaggtgggggaaactgaaaggaaagtctaaataaattatctagcacctgtagtatgtgctgccttgcacattgaaggggcgtgttgggggcaacgagaggcaatattagggagattctggaatgggaaacctgtatattaaagcacatttaaacggctagatgttggataataggcagaatttgaaattaaatacagcttggcatagttatttgcattcttggtcattgtattttctagggctgcggtaacaaaatacgacaaactgggtgatttaaaacaacagatttattgtctcagttctggaggcaagatgtctgaaatcaagatgtaggtatggccatgctctctcaaggttcgaggggagaatctgttccatgcctcttagcttgttgtgttactgccaatccttagcattttttggcttgcagctatgtcactccagtctgtgactctgttatcacaacataatccctgtgtggctctgtcttcagatggtgtgctccacttcttgcaaggatactagtcgtattggattaagatccaccctaatcacctcatcttaacttgattacatctgcaaagaccctattttgaaataaggtcacgtgcagaggtactggaattaggacttcaacctatcttttgtggggacacagtttaacctgta

SEQ ID NO: 41467 - DNA, 1005 bp, Homo sapiens
ggtgagggggccgagcatgctagcccagaactctttctttctttctttctttcttgtaaagctaccagttcctttcccatgataacccattcatgagggctgaacccttagtacccagtcaccatttaaagactccagctctcaatactgccacagtggtgattaaggttcaacatgagttttggaggagacaaacattcagaccacagcaagtgcttactatgtgccaggtcctggagataaaacagtggataggcaaaaatctctgtcctcatggagcttacattctgaaacacgggttctaaaaatgtggtccctggatctgcagcatcatcatcacctgggaagttgttagaaattgaaattttcaggctccatcccagaactctttatttaactagccttccaaatgattctgatggagactcaggtttcagaaccactgatcaagatggaaaagagacagtaaacaagatgaataagtaaaataatatttgatattaataggtgctgtgggtaagcatagggtggccagtgaagactcctgaaaagtaaagacctgaaggagttggagagtgagccatatgagcacctgggtgcgtgttcttagcagagaacagttaagtgtgaagaccctggcacgtttgaggaatgacaagcagttagtattaggttcaatctatgaaattgctgctgtttgttcatttttgacctacaaaaacaccaaatactggggagaagagatcagaaagaaaggggtggagtaggatgcagattgtgggtagatccttgtaaggttttggctctctaagattaggaagacgggagggttttgagcaaatgagtgatgtgatctgatttcagttttaaaaggatcattgtggctattggtaaaaatgggccaaagaagcaaaggctaaaggaaggggaaagttggttagaatgttgttggagtagttaaaagacagagaggttgctcagaccagggtgatagcagtggagaag

SEQ ID NO: 41468 - DNA, 1238 bp, Homo sapiens
gggatttacagaggttggtgggaagcaagtgttgtagtcagagaagacagtaggaagaggagctgaccatattgggaacctttcagtaactgtagacagttcaggattgctgaagcagacataaattataaggcacagaatagcaaaagacgaggctggaaacctggacaggctctaggtcatagcctttatttatatatcatgttaataaaaaatgtttagtttttgtcttgtaggcagtggagttccgtgaaaggattcatggggtgacatggtcagcttttcattttagagagctcattctggtgacggggtatgagttaaagagggatagcacttgagtcagagaggttagatattgtaatagcctgtggggagagaggagagtctgaaataggataaatactagaaatggagaggagacaatggattagaataatatttaggaagtaatgttggcaagacttggtaattggatttggggtgaagataagggaagcattaagaatatctgtgtactttgtagtttagataatcctgtggctctgagtgaaataggaacccattggtgaataatttaggtaattaccagtaattaaggtaaaatgagcagaggaaagtaatgagtcactttggaggtgttgaattagagatgcctatggtccaggtggaagtatttagcaggcatttgtgtatgtgaatctgaaacttggagaagtctgaaaggatcaagagatcattttgtttgacaagtgtggagaaattagtggactttaatttttatcatattatttcactctgtagataaaaattgcctccctttatttaatttttatcagaaaagtaatgtgtgtacccgatgcaaaattaaaacatcaaaaggttataaaataaaaaaaaatttgtccttccttgctcatgccacccagtgctagttcccagagatagctcttgttaaatatcatatgtatatatatcttaacagattttaaaatatatacagaaacatttaaaaagccaagtgaaatcatactagaaaatatttcggtacattgtcttaaaaaataaaccttttatcttatacagttgttaaaatgaatgacattgtgttatggataaaataagtgaaggggtaaattaaagtgcagactaaccgataagcatgatctctgatgtaaattaaaagctgaacatacatatgtgatgatataggcattacccaacgatacgaaagcagt

SEQ ID NO: 41469 - DNA, 1076 bp, Homo sapiens
gtgaatcttttattttctttatctgtttttgtatttggttaactatcttttttattatttatgatactttttggttctttttgctgtacattaaaaaaatatatttcataaagaaatatgccctttaaccagcgacttcattgccagaagtttatccaatgaataaactcatagtgttttaatagtcacagcttctgagtgtgggagagatctcaattcgtaatatcaaaatgcaaaaatatattttcttccagttttgttttaattccattttctaaaatactgaaatcttagaaacatttgaaattgttactagaaagtaaggatccagctggttttgtttttttttccccaaaagattaattaattcaataccatttcttcaataagccacctttttcttgatttgaaatgctgtttattatgtattaaatttccacatgaatttttgttttccatagagtctttatttcaacctgatgaagtccctttataagattcatctggtagagaccaccagggacacatctgtaggctgacaaaggttaattagcttgctgcagtgaaggagacttgcacagcagaggaaatgtcagcatttctaaagaaggaaccagggttattataggattttggagaatggtggagtttggataaagtttaaacgcaacaatatttgataagcttaaagcacggcaagactgtgtgtcaagggttaataaacatcaggcctgggctgagaagctgactcaggattctgattccctggagactacaaaatcgcgatacatgtggaatgttgtgtctggaaaccccttatctgaagctctgagttgcaaagtgaggttgcttctgtttcataatgatctaccatcagtgcgagagtgggatgttccattctcactttataaaatttcaaataacatagtttctgacagtctgatgtagagaacagtttctcagcacattgtctttagtattaacaaatgcatttttttaaacagactgagagtttgttcagcataaataccaaattgttttcattaccttttttaaggtaatatatttttatatgt

SEQ ID NO: 41470 - DNA, 1028 bp, Homo sapiens
acagagatgttgctacccgatctttcctctggaagcttcgtctcagaggggcacccagctgtatgaggtgccagtcggcccctactgggaggtgtctcccagttaggctactgggaggtcagggccccacttgaggaggcagtctgtctgttctcagatctcaaactctgtgctgggaaaaccactgctctcatgaaagctgtcagacctggatgtttaagtctgcagaagttactgctgccttttgatcatactggtgaccagggaagcgggggaaagccggcagtaacaggcctcacccagctcccacaaagcccgaaaggccagtgccactcccaaggtgcctcttccagcagcactgagttaatttccaggcagctgctgagcagtattgagaagctgccccaggctatatgccctccccctcccccgaggaagtaagcagggctttcaggtttcacgcttccctacctgccgtggtttctttgctgctttctgcactgcctgtttgcctcctcccccgattctgtccaggaaacttcatgtttgtttgaaactgttacacagttcagctggaagtttccttctccttggggtctttccccaattccactggcagctctccccaagggcctctgtgagacaaagtcaggaatggcttccctggtgacagagagtgcccacagggctcttctgcttcttcctttatccctatatttctcacagctctctaaattaatctcagctccaggtgaggtcacatccttctctcgtgaattggccctttgggatccccagtgaggatgtgtgttcagaggcagacattccctttcacacattgggcactcagagttttttggctgtctcaggggaccagcagctgtaaactgcttcctttgaaaggtctatggattctctcggctttcctggtacgttcccgtggtagtagttcttcgagtaaaagttcacggtgtgagtctccacacactactcggtgtgtctgagtgggagctccaagttagttatgc

SEQ ID NO: 41471 - DNA, 1035 bp, Homo sapiens
tgtctttctaattatttatgtattctttaatttcttaaagcagtgttttgtagtttttgtcgtacagatctttcactgtcttggttaattcctaaggtttcttttttttgctgttgtaaatggaattattacttcaagaagtgttctagttagtgcgtaaaaatgtaactcatttttgtgttgactttgtatttgcttctttgctaaattaatttattagttctaacaggtttttttttttttttggaatctttagggttccctgcatataagatcatatcatttgtaagaagataattttactttttctttccagtttggttgtcttttgtttctttttctttcctaattgctctgggtagaacttccagtactatgttgaatagaagtgatgaaatcaggaattcttgccttgttgtagatcttagaggaaaagctttgagtcctttaccatttgatcttaaaggaaaagcttttagtcctttaccatgtgtctgatgttcactgtgggtttctcgtgagtgtttatatcatgaaagcatattgaattttgtcagatactttttctgcatcaattgagaggaccatgtagggtttttttttcctccttaattctgttaatgaggtgtattgccttgattgatttccatatgtacaactatccttgcattccaggataaatcccacttggtcatgatgtatataatcttttaatatgctgctgaattcagtttgctagtattttgttgagaatttttacatcactgttaataatggatattggtttgtagttttttttttctctttttaggttgctctcatttctatttctaaaaataattttaattgacacagtcattgtacatatttatggagtacatagtgatgttacagtacatataatgtatcagggtaattagcatatccatgatctcaaacacttctttgtgttgggaacattcagtatcctcctcctagctgtttgaaactatattattattgttaattatagtcatcctacagtactatagaata

SEQ ID NO: 41472 - DNA, 1029 bp, Homo sapiens
ggcggatcacgaggtcgggagatcgagaccatcccggctaaaacggtgaaaccccgtctctactaaaaacacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcaacagagcgagactccgtctcaaaaaaaaaaaaaaaagggaagaggaacaaacctaagctaacacgttagcatgcgtatccctcatgccatgtgatgctctgtgccacctcaagactcttcagaggagagtcctcaacagcaagaaggctcttaccagatgtgccccctttggccttggactttctagcctccgtaactgtaagaaataaatgctttctctttataaattacccagtttcagttgttctgttataaataccagaaaatggactaagacataatagcaaagtggttaagagtctgaattcctgattcagattgctagtgtgactctctgtgtctgaattcatctgtaaatgggaatactagtccgtactttatagtttgcagatgctcttagtacagggttcaaatgttaactgtaattacctctcctatttttgttattgctagagagaaacctgtaatgataatcacaaaatattaataattgttgtttctgggtagtaggacttgtgatgatttcttccttctaaatccttttttaacaatgaatagcataaagctgtccctttaaaaataaaattaaaatataaattttagttgtcccgggagttcttttgtatctgaaacctcagttgtcaagcttggaaatctgtacttttaaaatatcctcaagcgattctgattacacatcaggtttggaagcacttggcataaagaacttcccccacccaattcaaagaaatagtatttaagccctcataatgtgcagtgtggttaagctgtgtctttttccagtctagtctacctcaacactct

SEQ ID NO: 41473 - DNA, 1005 bp, Homo sapiens
aagattatgcatttctaacaggctcccaggtgatgctgctgcttttaatcagtaaactacagtttgagacgaatttagattataatgtcaactcttactagctccagtgatgtcctagataacactgacatgaaaccaataaatcagagtgtcagttcacattaggatgagtttgctttcctttggctaaatcactaatagagggataaatagggactttgaaattaggacagtgctttcttcagtataatttattaatatttggattttacatctatgtaaataaccttttaaaatgttttgtttaatagatgagaacacagacattgctgaaaacctctatcagaaagttagaattctttgctgggttatgaccggccctcaaaacctagagaaaaaggccaaacacgtcaaagctacttgggcccagcgttgtaacaaagtgttgtttatgagttcagaagaaaataaagacttccctgctgtgggactgaaaaccaaagaaggcagagatcaactatactggaaaacaattaaagcttttcagtatgttcatgaacattatttagaagatgctgattggtttttgaaagcagatgatgacacgtatgtcatactagacaatttgaggtggcttctttcaaaatacgaccctgaagaacccatttactttgggagaagatttaagccttatgtaaagcagggctacatgagtggaggagcaggatatgtactaagcaaagaagccttgaaaagatttgttgatgcatttaaaacagacaagtgtacacatagttcctccattgaagacttagcactggggagatgcatggaaattatgaatgtagaagcaggagattccagagataccattggaaaagaaacttttcatccctttgtgccagaacaccatttaattaaaggttatctacctagaacgttttggtactggaattacaactattatcctcctgtagaggtaagtttagaaattttattactatg

SEQ ID NO: 41474 - DNA, 1032 bp, Homo sapiens
agaatattgtttcatttaaaaatactttccacagtttcacttggtttcaccaatttcaattggttttaaatcattaggatgtctaagtaaactattgatttcttccacaggtctagtacattaggttcctctgctttaccttgccatctttaatgtttgtattcttttaaaattagctggtcctttataagtatgtaaatattgtagctagcaatgtgctgtttattaacaatacctgtttccactacttttttagggtcctggttgctgctctgatcttgcagtttcttttcactatgttgattctacaaccatgtatgagttagaatacctcgtttatcatcttcgtccatatggttatttatacagatatcaacctaccttacctgaacgtatactaaaggaaattagtcaagcaaacaaaaatgaagatacaaaagtgaagttaggaaatccttgaaagaaaatcatgaatgaacaaaggtaatatgtctagcactgcactgaaaaaggacttctgcatttctgacatagaacactggaatcccagtgaggaattctaagtgaacattccttatagaaacctttcacatgaatgactataaactgaagctttaaatgagctgtgaagtgtgttaaaatgtgttttgatacagtaatatataaatatgtctatatatatgaggaacttgtgttttttaaatggtggccaggtagaggaactagaaaagagattttgttgcctgttttctgaccatctgtgttattgtcactgagaaactaaaatagtaaatttactaaaactacactgcaccatgttagtaataaacagatctgccttaaagaaaagaaaattttagaaagaaatattgttgctcagtgttgttaatatagctcaagaattgagtttatatttgcagtatgctataaatgatacccccctaccacacccacacacacagtttttgtctaatgaaaatgttgctgtgattatttataattggtagtatttcttccagaagaagctaaaat

SEQ ID NO: 41475 - DNA, 1074 bp, Homo sapiens
aagtagcatggtgtcccactaggactggtctacttgccactttaacaagggatagtaatattattagattgtatgatatgcagcatacacccactcccattggggatgaaactgaacccacaataattgaaagaagtgtgcaaccttgtgacaattacattgcttcctttgcgtggcatccaacaagtcaaaatcgaatgatagttgtaactcccaaccgaacaatgtcagacttcactgtttttgaaaggatatctcttgcctggagcccaattacatctttaatgtgggcttgtggtcgtcatttatatgaatgtacggaagaagaaaatgataattctttagaaaaagatatagcaacgaagatgcgtcttcgggctttatcaaggtatggacttgatacagagcaggtgtggaggaaccacattttagctggaaatgaagatccacagctcaagtcactctggtatactctgcactatatccttttcattgtgaattttgtgaggtgaatcaggtagaaatgttcttgaagtttgccaaaaggtcagtctgtaaatatgctcaatgttttatatacaaatacaagttacataatactaacattataaagtaaaattgttctaaactttcgaacttgaaatactgctttgtagattgtgtaggaggaagaaaagtgtatctctgcaatagagtcgaaccaccttatttacactgatacttattatgaattggctccaaatcaaaataaatttagctttgaaatatattgtcatgcatcactagtatttcctatgcatttaaatacttatgaagcaatacacagaagatatggatcagaaatctccaggcaacaaaggatcattggtttatgcaggaattaaatcaattgtaaagtcatcgttgggtaagaaaattctatttcattttctccaatatgtttataacttttgtacttttattttgccccctgtcatttggcagaaattatctagttatttcaggatcatgtacataattttttttgttttctgattggatatttcattgtattgttgagttaaatgcatactt

SEQ ID NO: 41476 - DNA, 1060 bp, Homo sapiens
gaaaggtaagcagtgggctaactcaagaaagacttagaaatcatgttaagaatttagggagattcatcttgtaagacggggaaacagatggatttgtgacagatttgtgttttaaaaggatcaagattgatagtagggatatcagatagaagcctgctgcaaggaggcaagacgtgatgctatccttaccaaggttagtagcagaggagctagagaaatgtggatacattagagaataggagaaaatttaatgattaattagataaaggggtggagaagatggaaaagtcaaaggtagcacacatatatttagtttgggaaactagttaattttaagtatgttaattaggaataacacaggaagagtatttgggtttattttggagcaagttgaaatcaagatgcttaggtagagacgtccattgggcaataggatatcagttcaaagcccaggggaggaatataatgtatgtcagaaataaatgatatttgatagagtaaatggaattgtttggagtaagaaagagatggcttaaaggagactgaggcagattgtcgagagatgtaggagaaagatctatatgacaaaaaccgcaatcacttttgtaccaacctagtatacattcatgtggaagagaggtcagttgtccggtgctccatgcttcagatccagccaaataagaactaaaaaggactcactgaatttaggactaggagaaggtctttcactggcggtatggatagcaaattgcagttatattagaaattcagagtgggttgaggaaatgaagtaatcaattataaatactttttttgaaggaatttgactatataaaggaggacaaaaagatacgcagtaggaggagacaaatctggagccgggagctttgtgttgctttatttctgttttcaacatgggattaatttaagcatgtttaaatgctaattgaaggaagcccatagaggttaaagatgcagagagaagggagtgaagcgaagttcctagaaatgggagggaatgggatccagagcacaggtttctttagctttagatacaagg

SEQ ID NO: 41477 - DNA, 1032 bp, Homo sapiens
aggagttgtatgtctaatggaagaggcagatccaggcatagttttcagcagattcaaatctattaagcttaatatttacaactgctatagcatttgcataaaatgagtatcattttagcatctctgcaagccagaaaatgtctatttgattttctcattttggactttaaaaattattttccaattaaaaataatttgaggaaatagagatttccataacgtttttcaaaaatgtaattttcttactcatctactaatggcacagtgttttaaaatgctttgctaaaaaggcagctttaggattaaaggataatttatgtaatgttagaaacagcagcaataataattcagtagagactttcatcattcaatttatgaaaagcatattgccttaacataatttcttaactggaaatttagatgcaggaatcaaattagtctcttaaaatataaagtcacaaagacaagtctggaggagcatttgaagggattaatgtctcacagcttgaaacatatatgtaagaattcatgcaaactatttatcttacatctttttatttaaagaattttagctccatctacacataagaaagcctggagtttgaaataatagttgtccaaattcatgcttatccagatttatatcacattgcagccacatattttgctgatgatagttaaataagaagttgctactgtaaaatgtaaagctaagtatcctttttagcaccatgtattatttcatagtaaaaattggaatgttacaatattcctgtggtgttatgtcaaaaaaatattttcatcgtcaatttgaaaacttttattatgcattaagtaggtatacttaatatttgaacaactatggatgtgtatctttatggtacataaatgttcccaaaatagatgaagatgtgtatttatgaagcaaacatattcagcgatgtgacaaatgtgagagaagtatctcttgataaagtaatacttctttaaaaattaatatgttttatcatttcaaatcttctgatctttttc

SEQ ID NO: 41478 - DNA, 1012 bp, Homo sapiens
tttttagacggagtttttgctcttgttgcccaggctggagtgcagtggcatggtctctgttcactgcaatctccgcctcctgggttcaagtgattctcctgcctcagcctcccaagtagctgggattacaggcatgcaccaccacacctgcctaatttttgtattttggatagagacagggtttcaccatgttggccaggccggtctcaaactcctgacctcaggtgatccgcctgccttggcctcccaaacagctgggattataggcgtgagccactgcttccagccaaaattcattttctatgagtaatatacagttttcccttggtatctgtgggaaattggttccaagacccccgctcataccaaaatccattgacgctcaacgctctgatataaaagagcatagtttttgcatgtgacctacatacatcctcccatatactttaaatcatccctagattactaaaatacctaatgcaatgtaaatgctatgtaaacagttgttttactgtattgtttgaggaataatgacaagaaaagaagcctgtacatgtttagcacagatgcaattttttttttttttgagacagtgtctcactccatcacccaggctggtggcagtggcacaatcttgactcactccaacctctgcctcccgcgttcaagcaattctcatgcctcagagtcccaagtaattgggattacaggcgtgtgccaccattcccggctaattttttttttttgtatttttagtagaaatggggtttcaccatgttggccaggctggtcttgaacttctggccttgagtgatccacccctttcggcctcccaaagtgttgggattactggcctgagccaccacgcttggcaaccacaagcaatttttttttctgaataattttgatccactgttggttgaatccacccatgaggaactcatggatacggagggctgacagtttttgaaaccttagatgttttttgaaaaatcagtggaacaactgggaa

SEQ ID NO: 41479 - DNA, 1263 bp, Homo sapiens
ctagcctgtaggcatcttttcattgctaaagttgggttaaattttcaccacagaaattcaattatgacttatacctgttatgaaaatatgtaaatacatcaaatatattttaatgttttaggtccagatatatttaaatgttttttatcccctaaaggagtgcagtttctttctgctccttctaggtctccaaagttacaggaccttgaagcatgtagagctcagcatggtacaaacctgtatttttcaatttgtgctccatgtgacccttcctggaactgagcagaagtgttatgctgccaacattgaataatggtggtcttttcacagtttgtaggggaaaaaagctgatggaattttaggtttttcattccaaaattttccttaaattctagaaagagccaccattaattttcaagcaagtattaggcaggtaaaatgtatgtatgaggaaaaaatggttattcaaggaaaaaaacttgtaaacaactgataatatctacttttataactgttctttagatatttgtagtcgtcatcattattttatattcaattaaaataaaccaaacattaatagcaatttaaacttagaattactaaatacataatttcatctaaaatgatagtttgtatgatagaatttaaaatatcagtatttactactgtcctgcaaagagcattttgacttcaagccttgcatgacattcactatatgaagagattacatttcgaaggagaagatgggaactctgctgcttattttctttctcatcttacgcatttcagatcattttgctggggcatagattctctatccagtgactgaggaagtaaattggatttttatctctaaagttttcttagaaagagctttacattttagtgacccttttttgttctatgtatttaaagagactgacaaatccctaatttattctaatctttatcgaattaaaatttgatggtattgaagtgttttctgatacatggagttctttctcaggagggaaaaaggtggttcaccagctgccaaacaaaagtcatgaagattttttagttaaaattttatctggctagtagctcagtttagccttgactaatcttgtattaaaatactcatgcaaatgtggaaggaaaaattttataactgttccaaaacttaggaatgacagtttaatgctagaaactgaggtgaagttagattgagaaaaaactaagcttctacacatagtacagtatgttgataactgcagttattaa

SEQ ID NO: 41480 - DNA, 1047 bp, Homo sapiens
ctgagcttagccactggaactggccacaagacctgatttgggaagaggtaacctgttatatgaatttagttagtaaaattgtagaaattcagatgtcatttgatcccagggaagtgtatttctccccagctattaaccagtgtcaactgtctgaaatttattgatccgaaggctcttcctcatttgttgccagtagctctccctcatacagaacaaatgactcacatgctcaagctaaataaagcactccgtaaagatttttctgcctctagaactgctcaaagtcagctctcaatagtgggcactgattcttgccaactggtttacccttattaactctataggtagggccctgtgaaaccacactaacatgtagatgttctctctttttctttcttcttctttttttttttaaaggctgcccttttcagacattccttctgaaatctgttaagaataacataagactagtcacagatttattgatttttcctgggcatttgactatgtgaagtggaaccagctatgacctaagcttagcaagctcagtaaacaccctctctttgctccaaggtctgtataacttctgtcttagtacacatgccaagcagtcagcaggaacggtcttgtggtagatgagatgattttcagtcaggataagtcagattgttttgcttttctttttatttaaaaaattattttttcaccctttaaagtcttgatgatcataatccacttcttgatggaatgtgtacctgacactttgatacactttgcaacagtcctgattggctttctgaacagattccttattatctaggaatgatatcttctatctaattattttcccaaataactgcttagtgtttattgctttaatatcagaatcctctattctgccagacaagttgcagcatttaatttgttttcttctaaaacacctatgaaacagataaattatccattttatttcatttcctgtaagttattttcttaaaacaggtatcttatgggtacatactggaaactttaaaaaatggctaatgt

SEQ ID NO: 41481 - DNA, 1189 bp, Homo sapiens
aagcacgaatatgtacctgctaaagcccttggggtgggcacctaactttaaagatatttttatttttttaagctgatattatcacattcatgtgacattggcacccagtgtgtaatagagctgtggttattttaacataaaatgctttaaattatggatcatcaggtagtaaactggaggatatgagatttactgtattttttccttgtcattatgcctcttttcacatggtgcatgtactcttgggtatccatcttccaatttgagacgtataaatcagagtttttcagttgcttaaatgactctctgtttgagaccagaagtgttttcagaggaaaattttgatattccctcagctcaccttcatgagggctgtgaaataaaaactttggggagttgcctggattggattccttagcaagctgaccccactactcatttgattgttagaatgtgcatttcttttaattagaaatagagaatttctgcacttcacgttctggctagacaatatgttatctgaatcaaatacttactaaatgcccatgagttagacactgtgctgacaggcactaagaataaacaggtagttctatatctgatgtgatattatttattttgaattgctatatgcttcattagtgtttttggatgaaatttagtaagatatagacagggcagatttatttctgtgagaagattgcaaaatataacagttcccattcttgaagtaactagagaaaatttttttagtgctttttaaaataaggtttatataatggtgcgtttcctgctgcatctctgccatcaatttcaaccaaactggtagaagttttgattgagaagtagctgtaagttgactttcagtgtttttacagcttagccttttccttagaagtcacttctagaaccagatccacctgatttaacaaaatgtgtttgaggttgaatcattgcaggctttattctgtctaaatgtttttttcttttctttttttttgtagtatttcgtagaactggagatcctgtttaggcagttgattccacagttttgactatcaagtaacccagttgtaatgtgggtgctacagcctcagcttcttaaatttggtttggagcatcctttcaaccttctttctccagctcttaataattacctgctccacttctttaatgactatttagtggt

SEQ ID NO: 41482 - DNA, 1038 bp, Homo sapiens
gctcatgttatcaccctagtctgggtttgctggttagagcatgtatgattggaagagagagagagaagttcaggaaataccaacagagcatgggaactgtactaggttcagtgattccaaaaccaaaaatgaaacctatataacaatgctaacaatatatgtaatatttccagagtttccaaagcctcatttaaattgtgcctgaaaatgttagatatcattttttaaaattggaaaaaatgaggaatacaaaacttaagtaacccatccaaaggcacatactagtaggtaataatgaagataactaataataactcatttacataagaactctaagaacttagtactattatttctaactcacagatgggaaaacaaagtgtcgatgaggttgactaacttgcgtaagagtgcgtggttagtaagtgacagctgggattttaaactagattgtctgagtctgtgctcttaatccgtatgttctacatcctatctgttggttttgttattttttggatagagcatcttgacttacttagatttaaaataaaatccattgcagcacaaacatttgcaggggtggctaagatcctaacagaggcccagggagatgacagcaaatctttcctaatgccaggcttatattcttgtctcattcttgtctttgaagtcaaaacatttttagtcagtctctagaaacagaaacatgactgtgtcaggacactaattaattagcattgaggagttgttttctgattataaatatataactattgtactaccattccctggttggtaggattgctgtttgtgcacattatttgaggagatggaataaacaggcaaaatcagtttttacaaccctgtgtgaatactggtctgtacagcaaagattatattcattatggttataaactccttgtctgcctacaatattaatatggaatgaatgttatcaccaagttactgtaactcagaagacttcagaaaatatcctctaggtatcaaattaaatttgtaactacggtactttttgct

SEQ ID NO: 41483 - DNA, 1205 bp, Homo sapiens
cttgagaaacacccagactactgtagtattatggtactatagactactgagtattagtacagtactatagtgctgactagtaagcttcctaattgccaaacaaaagaaaaattttcactgtcatcaaaagaaataaactttcttcatggtaattataaaaagactttttgagaaaaaaaagcatcttcaatagtgattttgtagaagaagccaatttgtttttttgtgtatttttatttaaacatttttattaaaacaaggggcattttactgaagaattaagagccttcagtgaaggctaagtgcaggtgtgctgccttctagtaatccagactaggtggttagtatgagttatgggttgaattctgtccccccaaaaaggtatatttaagacttcacccccagtacctatgaatgtgaccttattttgaaatataatctgtttgcagatggaatcaagttaagatgaggtcatactcattggagtgggccctcctccttcactgactgatgtccttataagaagagggaaatttggacacagggagacacagaggagaaatggccatgtgagagaggcagagatcgaaatgatgccaccacaagccaagggacaccaaggattgcaagaaaccaccagagctaggaagaggcaaggaaggattctgccctagagacttcagagagagcttagccctactgacaacttgattgacgatttctagtctccagaaatgtgacagaataaatttctgttgtgttaagccaccacgtttgtaccattttgctatggcagctttaggaaactaatacagtatgtgaatctctttttctgtcatttggatttttgacaagtttcttttctcacatattccatatgtgtgcagaggttcatgagctctggacctgtcattgtggtcaaatttgaattctactttaaatgttaaggcacctgcgtgaaaaccacactactgctgcataattgtgagccgtaggggatactgccattaggagccatttttccttaaaaggaagctcatgcatttgaataagtagtaaatggtgatggcagagttatgtttcataaaatatggaggagacttttgtcatcagcaggaactgtcacttttatgatcttctactggaatgaaaactcacttccaccccaggaaagatctctgcagaggcagtgaatcaatctctgt

SEQ ID NO: 41484 - DNA, 1031 bp, Homo sapiens
aatttggtctccttgaagctgggtatattgtctttttgtgtatagtaacttaagaatgtggaatgtgggcagacagcataatctatggtagttaaacttttattagattgttgtgaagattaaatgagatagtacatgccagaggcctagcccagcacttgcatacactaagtcaataaatattagtcattattctgcagtggaaaatttagtgtcactaaaactttgtcctgctagtcaccttaaaacagacagcataacctagtttttcatgttatcaattgagaaaatggattctaaagtcaagctaactgaagaatgtcactttaatacataaacgggtatattttttttgaattgataaaagggtctgtagaatattaaacagtagttattaaaagaattaattccatttcttaaagaagtttagtgtgaccaaccactagtgtaggcattggaagaatttagtatattttgtaaaattttttccagcatgggatctgactctctgaacctgaaaatgaagcaaacaaaacagaggcttgttctgcctatgcccttagtgccaaaacataaatcattgctgtattcatcaagtcataaaatttaaatcatctctatttgagttggataacttgctgcggtatttgatactaaccactggttcaagcaggacctggtgatgtttaatggactattgttcaaagttgttggactaagttgttgcattaatataaaagttttgcaaaataacatggttgtaaaagaaatcttccactaagcaatgaatataaatgaactttatttgtccttgtaaccaaatactgttcaggaaaattttttgctttagctttacagctaatttgccctctttctgggatacttttagggctgtggctaccgagtgacatcatatgtaggcatttctgtatatgtttctcttgctttcctattttctgtaggacagagttgccagctgtcatcctctctgggagggaaccgatgctcaaaaaatggcactacctttcctc

SEQ ID NO: 41485 - DNA, 1029 bp, Homo sapiens
aaatatctttgcttcggttaagtagtaaggcaatatgaagttatacagtggatataagcaacttgttggaagacaaatttgtttagatgaagctgagactgtggaaggtgagagtagtgtgaacttgttcataggcagttctcaatacctaggccaattatgcagatagtgaaataacatcttaaggcagtgatgggagctggatcacttgaggtaagtttggactgtatgaggaactccattaggtaacagtgccggaattgattggaagcagtgtgttttaacaatgaggtcatatttttaatgttgtctatactggtccaattactctgccccttgtttacaatatgtgattcagtgcatatactcaagaaccattcttatgtcttggcaaggtaccctgccctttctctaagcaccctttttgatcttggcttctagaatttctttgactgctttacttctgatctccaaaactggcctgctgtttcttttgaagcacttccttccctgtatgtacctgctgtatcttagctctgatcatgtttgtacttcagctgtcactgcctactactggtgacacctctgctctgctctattcttaatatcattctttttttttttttaaaggacatagaaaatcaggtattgtcttgttgtctttaagtgttgacacacttaaattcttgaagtcctgtttttagtcttcccttcccaaatctgacaaatatatagctttctacttatgtcagtgaggacaacatctcactgatcaaaaatctcaagttccttcactcatatcttgcctctcatcagtttactctatgtatctgtctcttctgtgtctgtcctttttcttccagtagccaaatttttaacctcgccttgagatctttctttcaaaatactcctttggcttcgagtgcagtactccagtgcttaaaaacaataatatttaatcaatcataccatagcttcagaaaccattgatgacttgtaaaaagttctaattctgattaaattttgatt

SEQ ID NO: 41486 - DNA, 1088 bp, Homo sapiens
tgttctactcaaaattttggaaataattttttccctctatttagtatctgagttttttttgaatacttattaatttcttagtcaacaaagtagtccttgtatatataacaaatggtagaacagttctcctcagttacatatcgttgtaatagtggaataagaattgtaatcagaattagccttctggtcatttgtttgggatggatcttctgttagaatccagatatggcagatagaaccgaaatgtagcagtttccttcttttaatgttaacagtgattgtgctaacacataagattataatagagcagccttgtcaatagcagcaaaatttacttgtctgtttttctcccagagtacatgtgtagttaatcaatttttaaaaatatattttactacaagttattgcttattccaggcatgcccaatgacatgctatttattacttctttttgcagatccacagtttatattaggaaataaaacttctactgtttaaaattgaagttcatctgattaataaactgatattgcctcaggtttcaaactccgtagtgaataaaataggtcctcgtgtagtttagaaatagtataccagctgcaagtccagaaaatacttgctgttactcacataataaaagaactcccaaagccttataatttatatattcataactgcttcttgttgaatttcttcttctcaatcatacaggtgctgctttggtttaaaacttacagccctctttaggcaatctacagtttctccaaagtgtttaatttttttccttcttatattgtgagctggttaatgttgaagatagcacttcatttaaagttcaaacctgtgattgttttaaaaacttacctagtattcattttttcatttaaatatatatgtaatttcctacaaatgtgtacttgtttatctaagatttggacaattcattttaaaccatattattcatttattttgaaatattaagatcctgccatgttccaggcacagatccagatactgactgcacattggtgaactcagcaaaaatccttgcctttatggaaacttactgtctggtggaatttatattt

SEQ ID NO: 41487 - DNA, 1049 bp, Homo sapiens
caaaaaagaaagagagagagcttgagaatgtgaaagtgttgtgaggtagtatagttatggaactgtttgacccatttatgtcctttttttgggaactcttgacaaccaaggaaagagaatacaagaaatattaaattttactaacatagattctttgtgagtgctcttaaagctgtttgataatcccactacttatctctgtttgattcccaacccactgctttctcataacaccaatttcaactcttgtcatccttctcaagccccaggcccagttccttctattttagtctcagtagataagttcttccccaattttgccaggaaggttgagcaaagcccttgagtttccctggccaccatctcaaaatgtatttcttcacttaatttccatctcactttctgtctcttcctcgcaaaggtaacctgtatccttatcacattctcatcccatttcttctctaacctttcttcatcaattatttcatgtctttctcttgttcttttaatctcctctaccggtccttcctcatagccaagaaaccctctttaagttcactgtcatatgtgtttcttccattttcactgccaaaattttccaaagactgatttgagctcattctttcttcaccattcatgctttcttttggtccatttcagtatggcttctgtctgttcaaataagcacatgaaaagatgctcagcatcggtagttattagggaaatgtaaattaatactgcaatgagatactacttgatatggtttggctgtgtctctacccaaatctcatcttgaactgtaatccccataatcatatgtgtcctgggagggacccagtgggaggtaattgaatcatgggggcagtttccaccatgctgttctcatgatagtgagtgagttctcatgagatttgatggttttataagtgtctggcattttccctgctgtctctcattctctttcctgccaccctttgaagaggtgccttccgccatgattgtaagtttcaagccctccccagccatgcagaactgtgagtcaattaaac

SEQ ID NO: 41488 - DNA, 1754 bp, Homo sapiens
agggttaaggagttactaatacagaaagatggtgatacaggagagtatgagaattattgattaaattatagataaattatagactaaagcatagtaatatgagaatgtttcattttctgacgtatttaacttaattacctaatctcattagaagtgattaagatgaatactcagcttgtatctcaagatctttttaggtattgattatagcatctataagtccactgactttttggtttctacatgcattgcctggcagtatcagtcagttcacaattcaagttgaaattaaaattttctaacaataaatgagaaacaaaaagtaacatttattttaaaatattatgtcttttaaattttgaatattcagatttgaggattgaatactggcacctctctgtcacttatgttttgctaatgatcatctatgcttcagctcctcaaaatggcctgtcaggtgtcagtttagcatgcgagactttaagctgtcttttgtagtttcataagggccaaagagcttgttagcctggaatttagtgtattttggtactcatttgcttttagttattcttttcttgattttttttcaaactcttctcatgaggaaaatgtacaattcctaccaattagtcataagccagtttggatttaggaattgcatagtttattactttgaaatattattttattcaaatatttagcaaatagtaaagatgtgaatatttcactgaatgttgggtgatttggctgataattagatcctcagagaaaaactgaaactcctgaagtttgttgcagaatctgaaaagtaaccaggaaaacagtagtttaatatgttaagtactagttattaatgaaaattaagcgtgacttttttaggattcaattcctgtttttagtggtatagctttctggtattttgtagcttactgtgttcatgaacacaaaagaacaagtaacctcactagtggcttgagatctgactcgcaggaaaacattaggtagtaattaaaacaaagctttccccccacccccaagtttgtgaaattttaagcacactgcctaatgcagtcaccacttgccgcttgtggctattgagcacttgaaatgtgactagtctgtattcagatgtaaaatacatgctgggattcaaagacttagtatgaaaaaaaggattgtaaaatatctgaatattttatattagttacatgttgccatgataatgtttttgatatattggatttaaaaaagaatattaaaattaatttcacctgtttaactttcttaatgtggctatcaaaaaatttaaaattatatgtgtttcacctcactgatttattggacaatgccagtctaatagatttaaaaattcttaatatgtacagtaaatatcagatattaaaagcttatatgatttggtttttaacctctgaacagtcaattctttggaaatctgagaagcccaattattctttggtctcttcaagggctccaggttgaagcagctgttctttgaaattgccagtcctgattcagttgactaatagcaatcgatagatacggaaggctaagtactgctttgcggttgtgcagccaaatgagtgaactgtacctactgtttctctcctttctgcctcttcccctgatggcttttatgtggttgttagtattcagttgatgtttatggtaacataaatctaaattggttttcagagacccaattcatgttttactatatcccataaattatgtca

SEQ ID NO: 41489 - DNA, 1064 bp, Homo sapiens
ttcttctcaaggatgcatggaagatttatgaaaataagaagcatacaggaccatagagcaaatatcaataaatggtaaaagattattatcttacaatcaacattatccagtcaactaatacaattagtaaaaccacttttagcaataatctggcatttcttcattaaatacgtgattctttcatgatccagcaagttcattcctggtcatatgctctggatgaactcttgtacactgatagacatacaagaatgatcacagtgctattcatggtagaagaagctagaaacaacacaaatatccatcatccacagaatgaataaataaataatgtttattcacaaatgaaatactcttaaggatatgaaaatagatttaaaactgcttcacatagcagtatggatgaatcttaacatagttttaagagaataaagcaaaccacagaagaataaatacaattatgaaattcaaaacatgcaaagctatccgatatattatttagagagaaatatatagatatattgatctatatatttgtcatgtagctataaagaagagcaaaacaagaataaacgcaaaattcagattagcatttactttctagcaggggaggaaaaggaatagatgggagtgagagcagactccagagttcctggtaatgttctgttccttaaattgggtggtgaaacacagctgattgttgtattttattctttatgccttacacatattatagtatctcgtcattgtttaataaatgaaataaattacacagtggggatggagtaaggaagtatggaaacagcaagggtgggcactttttttgttttttgagactgggtcttgctctgtcatcacccgttctggaaggcaggtgcataatcatggctcactgctgcctcaatctcctgggctctgccagtcctcctgcctcagcctcccccaagctgggaccacagacacatgccatcatgccaggctaatttaaaaaaaaattatttgtacacatagggtccccctatgttgcccagacggatcttgaactccggggctcaagcccttct

SEQ ID NO: 41490 - DNA, 1140 bp, Homo sapiens
gatgaggctagctcagtgagaagatgggtctgtaggaaaaatctttccccaacaatttcatctacattgtggcaggaccccattaaacttcctttaggagatgtatttgtaaagctgttcatttggcaagtcaaggaataacttatctcatgcttgaggaaatggatgtagctggagtcacaaaccagtttatctctgcatttaataccatccatagtttatcatgttggtgataacgggcaaaatgggtttggtaaaatcttagaaaaacaaagaaacaaatgcaggaattgagggccaacatcctaattcctaacttatttagaagaaatgtgaatataaaatttatgaagagatttagattattcagtcattcagtaaacatgtattgattatctgttatgagccccacattgtgctggctgggaaggaaatgggaatgaaagctgtagtccctggctttgaacagcccgtaggtttgtgggggtgacagggaattctagtcgagtgtgatgtgtgctgtgagggaagtatgcataagctgttaagggaacacagggatggttacttggcccacgtttggggagttagttggggaagtctttctaaaagaggcttgtgtgacctggaagggcaaattgaaataggcaagatgaagggagtagaagagaggatgtcttaacttaggtttaagtaattcaatgagccaaggctcagaactaaagagaaagtgtgtgtacacacacatgcatgaatctacatacatgtctacttttgagggagtggaaagcagtaggcaccatgaaaaggtttggttaacagcggatagcttggtatggatgcagtaaagagtttaggaataagagtacaagaaattggaggggtaagcaaggccaggtcatgcttgtgtgtcgtgataaggagtttggtcttttttcaaaggcattgaggaatgttaagcaaggaagagaatgtgttttatatgctacaagtggtagggagagtgtagtgtagggtagtaaagctgtacatgggaaactcttgcagcattccaggaagaagaccttagtatcctgaatgaagagaatgacatgaacctgaagagaaatggatgaattaggggagatattaaaagcagaa

SEQ ID NO: 41491 - DNA, 1042 bp, Homo sapiens
gatgtaaacaaagccttcagtatttggagaaaacatctcctcatacttggaagccaagagcagagcagtaatccaaactagttgaagcttcctctgggaaactggctgaaccagtaaagatcaatccataatggcaacacacacatacagagtctcctgaagaagcctaaacttggagtggatttgcaccaaccagtctaccaggatggtatgcttatgtccatttacatctcatccacctaagacatgtgggtttatgaactgcaaaatctccagctgcctgaggtactgatagatacccttaaatagtcactgcagagctgagggttattccaatctttgttatcaatatcctcaattttgtagagcaaagcatcagaaaaagctcggcagatgttctcttctttcacggaggcatcctcaggtatgggagaaggaccctttggagccaacatttccatctgtactgtttcacagaagcagtaggtttcagttgtttgttgacatttgttgtttccctgggttgaactggcactttggtgttctgagctttcttagctacttgtgctgctctggctgtaactctatttccaatttattctaaaatggaatgcctaatagtcacatgactcttaggtttagaattaactcctgtctctctgtctctgcatatacccatttaccctattggttctgtctctttggagagtcctaatagaatacctgacaactaaatgcaatgtggatcttgggacagaaagaggacattagtagaaaaactggtgaaatttaaaaagagcctggaatttagttaatagtaatgtaccagtgttggtttcttagttgtaacaaatgtaccatagtaatgtaagatgttagcaatagaggaagttggttgagagctctagaacgctctgtattatctttgcaacctttccataaacctaaaattattcaaaaataaaaattttgttttaaaaaatagcatgtaccatacaatctctctctctgaaactgctcctaattgtctagctttctattt

SEQ ID NO: 41492 - DNA, 1033 bp, Homo sapiens
ggaagcttgtcagtgtgggcagacaccacgagcagaccaatttgacattgtgcttctcttttaacctcttgaaaattaatgaaagttatctgatgaagatccttacattaattgctcccgattaaggtttaaaaccttggtttactgtggggtaaatttatgtttttgatagtcatccaaaatctttgtacgctttcagtttcattacagaataaaaaacaaatttaccacaatggattattacattacatctggtatttattcctcccaagaagctatctgcttcggaaaagccaggggcgcccttcattaatatatctaactgatggtgtaatgacataaaattccttgttgacccctgctattcagtgttattgtcttggaacatagaacttgataatctcttttcactgcataactacaaatgttaggctgtaagagtattttactttgttcagtgcaggttccagacatttctcctgatcaccagaagttcttttgattaataaggctactggtcacgaaaactcagcttactaaaagagatccagtcttctggttctaactaaaacatcccaccggatgcaggtgtacttgcaaattaaagtttgcctcatgtgtcctgtgtctcaagtcatacagacggcccaggagggtggagcccctgcaacctgcctagcggggcgtttgcgtgtctgggggtgtcgggacacgcgcaggacacacacagtcccactttcctagtctcgcacttacctcaaggctgtcaacttttacgctcctccctgcgcgcacagcccccacctcacgctgccacccctcacgccccgccttcaaagtaggaggcaccattgtcattggacactgcttctctcactcctattccagaaccaatcactcgagttctagtggggagcgcctaagccaatggaaatgctcgctgcggcagctgccgggtcctgggcgctgggaggcggtgccgggggcggggtgcggctggggcgaattagttgccattcggagtgaggagtgg

SEQ ID NO: 41493 - DNA, 1036 bp, Homo sapiens
aggaacattccaaaataggaaaaaattacatgacaaattaaaccaaatttcttataacaataaatataagtgggataagctcaccttttacaaccagaaggctcgctacaatgtttttttcaaaaagtataaaaacatactttgttttatgatacacataaaaaaatcttttaggatgggcataccatgtaaattaacagaaagaaagcagaagggggtcataatattcagtatcataaaatttcaaaaataattaatgggacaaattataatatgatgcatataagctgtaatgttgatgtcaagaatctatatgtaccctttaccattatgtaatggccttctttgtctcttttgatctttgttggtttaaagtctgttttatcagagactaggattgcaatccctgcttttttttgctttccatttgcttggtatatcttcctccatccctttattttgagcctatgtgtgtctctgcatgtgagatgggtctcctgaatacagcacactaatgggtcttgaatcttaatccagtttgccagtctgtgtcttttaattggggcatttagcccatttacatttaaggttaatattgttatgtgtgaatttgatcctgacattatgatgatagctggttattttgcctgttatttgatgcagtttcttcctagcatcggtggtctttacaatttggcatatttttgcagtggctggtaccagttgttcctttccatgtttaatgcttccttcaggagctcttgtaaggcaggcctggtggtgacaacatctctcaacatttgcttatctgtaaagaattttatttctccttcacttatgaagcttagtttggctggatatgaaattctgggttgaaagttcttttctttaagaatgttgaatatcggcccccactctcttctggctgcaaatcaaaaccacaatgagatactatctcacaccagttagaatggcaatcattaaaaagtcagaaaacaacagatgctggagaggatgtggagaaacaagaatgctt

SEQ ID NO: 41494 - DNA, 1042 bp, Homo sapiens
accatgttggtcaggctggtctcaaattcctcaggtggacctcaggtgatccacccatctcggcctcccaaagtgctgagatgacagatgtgagccactgtacccggctgccttggcctctttcttgactctaatggtaatgtatctagtttactcactggacaaggtatactgacatttgctgtgaagcatgtgtgtttgttatacgtagagtacacatgcttattttactaatggtttttcttgttttaatcaggaataataatttatgtggaaaatgccatttcatcagtgaatatgtttgttaattctatatttgtttattattcagcaatgagttcttaattttttttcatgagccttagagtatttttacacttgcttcataaacaggttttgcaagatttccttcctctgtgctctagcataacacagtataaatatcatctgaattctgtcacttgggtctgaaaggattttacctaagtaacttacttactagcctagtatgtttttggattgtagcactttagaaaattttcttaatttcttccatggcacttggtctcttggttgatatcagggagagatttcaaaacttgtattctctgagaggtgagagatgggatggttagatcttaaataaaattacatatactgatacttccctttctccaggtgatggtattattatatttggtattttattgttttaaattaatttttaaaagttaaactgtgaaacatgagacatgccaaaagcacataaagcagtttctcttaatctcattagacttcagtctatggagttttatgatcctgcctctatgtcagcatctttccctagaaatctatttgtttttatttgtttttaagaaacagatccagactaagtagttagcatttggctttaggcaacattcaataaagttaactaactctgaactaaaacatatatattcttttctgttgacgtcatatttaaagtacctagccttttcctccattcctgaaaggagcttggttagggaggactttagtc

SEQ ID NO: 41495 - DNA, 1299 bp, Homo sapiens
aacatgacctcaccaaatgaaccaggcaccagggactaatcctagagaaacagagatatataacctttcagacaaagaattcaaagtagctatgttgaggaaactcacgcctgtaatcccagcaccttgggaagccaaggcgggcagatcccttgaggtcaggagtttgagaccagcctggccaacatggtgaaactctgtctctactaaaaatacaaaaattagctggttgtcgtggcacacacctgtagtcccagctactggggaggctgaggcgcaagaatcgcttgagcctgggaggtggaggttgcagtgagccaagatcgcaccactgtactcctgcctgggtaacagagtgaaaccctatctcaaaaataaaaggaagaaggcataccaccacaaaaaaatcaccaaaaggaagacaagaagggtagaaagaaggaaggaagagaaaaccagaaaacaaataataaaatggcaggagtaagttcctacttatccataataaaatggaatgtaaatggactaaactctccaaacaaaagacaacgagtggctgaatggatgaaaaaaaaaaaagagacccaatgatctattgcctacaagaaacacacttcacctataaagataaacatagacttaaactaaaaggatggaaagatattccatgccagtggaaaccaaaaaagagcaggagttgctatgcttatgtcaggcaaaatagatttggagacaaaaactgtaagaaaagacagggtcattgtataatgataaaagggtcaattcaacaagaggatgtaatgattgtaagtatatatgtactggagcacccaggtgtataaagcaaatattattagagctaaagaggaagatagaccccaatacaataatagctggagacttcaacaccctactttcagtattagacagatctcctagacagaaaatcagcaaggaaacattgggcttaatctgcactgtagaacaaatggacctaatagatatttacagaacatttcatccaacagcctcagaatacaaattttcctcctcagcacatggatcattctcaaagacagaccacatattaggtcacaaaacatgtcttaaaacattcagaaaaattgaaataatatcaggaatcctctctgaccacagtggaataaaactacaaatcaataacaaggggaattttggaaaccatacaagcacatggaagttaaacaatatgctcctaaatgaccaatgagtcaatgaagaaatgaagaaggaaattgaaaaacttcttgaaacaaatga

SEQ ID NO: 41496 - DNA, 1016 bp, Homo sapiens
taaattcagttaagttgcagaacacaaagtcaacatacaaaaatcagtagtgtttctatattctaaaagtgaacaatagaaaaagaaataaaaagtcatcccatttacaatagacacaaataaaattaaataccttggaattattcaaagaagtgaaagatctctacaatgaaaagtatgaaacactgatgaaagaaattgaagaggacaccaaaaaatggaaggatacttcatgttcattaatttgaagaatcaatattgttaaaatgtctattctacccaaagcaatcttagattcaatgcaattcctatcaaaataccaatgaaattcttcacagaaatgaaaaaaactaaaatttgtatggaatgacaaaagacccagaatagccaaagctgtcctaagcgaaaagaacaaaaccggaggaatgacatgacctgactttaaattctactgaagagctatagtaaccaaaacagcatggcactggcataaaaacagacccgtagaccaatggaacagaacagagaatccagaaacaaattcacacacctaaaatgagctcatttttgacaaaggtgctaagaacacacattgggaaaaagacttcaatccatggtgctggggaaactggatatgcctatgcagagaaagaaacctgactcctttttttcaccttatacaaaaataaaatcaagatggattaaagacttaaatctgagacctcaaactatgaaactactacaagaaaccattggggaaattctccaggacattggtcagggcaaacatttcttgactaataccacacaagcacaggccatcaaagcaaaaatggaaaaatgggatgacatcaagttagaaagcttctgcacagcaaacaatcaacagtgtgaagagacatcccacagaatgggagaaaatatttgcaaactacccacctaacaagggattaacaaacagaatatataaggagctcaaagaactccatattaataaacctaatagtatgattttt

SEQ ID NO: 41497 - DNA, 1047 bp, Homo sapiens
tttacccaacggttccagtgtagggtcatgagtggctgcagtgtatcctggaaggttagtgcacaggatgagaaccaaccctggacaggatgccattccttcacaaggcacacttacagatgcacccacactcgctcagactgggaccatttagatacggcaacatatttgggatgtgggaggaaaccagagtacccagaaaaaagccatgcagacgtggggagagattgcaaactccacacagtggccccagctggaattggttgttttcaatgaacaatatgatgaaaggacctattgtacagaaacctaggtaatcttcacgggaaagagaaccaaaagtattctgcaaatggcaggagattggaactgggctctctgtataaaagtagggaactgggaccgtgttttaggcagtgcaactatacctgaaatactatacccgaaataattccacctgacactgttggtattttcctgtgacccaatgaggcagttatgcaaaaataggaatgtaaccctataatatatgtagatgtggcacctgaattagagctctacttatgagggaccaaagttccagtcttctttatgttagacctactctggagctgtgtaactccagaggtgtgagtaaccatgcaaccacacagcaggcaggagttcgcagaggataaaacttccacataagatgaacctgcaaacaaatatcttaggaaacatgttgccataagagatatcggacatattaagtagcctcatttacatctgaggaaatgagagtaagaaccacaattccaaaaaaaaaaaaccttataaatgtttaagatgttcaaatgaagtcataattcactatgagaatagaagtaaataagaacaggtggaatgaaaaggggccacttgcaaatcttgtaacaaaatttgataaaattaaataaactgttggatggattaaagtcaagttggcataacggaagagagaattcatgaatcagaactatcagctgggaattgaaagttaggatgaatcaagtcacgtagaacata

SEQ ID NO: 41498 - DNA, 2573 bp, Homo sapiens
ttaatgcagggattcgttaatcttttatggttttttgcatctcagtttctttcaggtcagctctgattttatttttgttatttcttgtcttctgctagctttggagttagtttgctcttgtttctctagtccctctatatgtgatgttagtttgttatctgagatcggatttttatgtggacctttagagcttgtaaatttccctcttaacactgctttagctgtgtcccatagaatctagtatgttgtatctttagtcccatagtttcaaagaatttcttgatttctgccttaatttcatggtttacgcaaatgccattcaggagcaggttgtttaatttccatgtaattatatggttttcagcaattttcttagtattgatttcaatttttattgtactgtggtccaagagtgtggttggcatgatttcagtttttttgaatttgtagaggattgttttatgtccattcgtgtggttgtttttatattatgtgccatgtggtaatgagaagaatgtatattctattgttttgggttgaagagttctgtagatgtctattcagttcatttggtcaagtgttgagttcaggtcctgaacatctccattaattttctacctcagtgatctggctaatactggcagtcgggtgttgaagtctcccactattattttatggacatcgaagtctctttgtaggtctctgagaacttgttttatgaatctgggtgcccctgtgttgggtgcatatatatttaggatagttaggtcttcctgttgcattgaatcctttaccattatatactgaccttgtcttttttgatatttgttggtataaagtctgttttgtctgaaattagaatagcaatcttgctttttttcagtgttccatttggttggtagatttttctccatccctttattttgaccgcatgggtgtctttgcatgtgagcctggtctcttaaagacgcctactgtttagtcttgcttctttatgcagcttgccagtttgcaccttttaattaggacatttaatccatttacattcaaggttaatattgatatgtacatgatccttcattgtgttgttagctggttactttgcagacttaattgtgtagttgctttatagtgtcactgttctgtgtacttaattgtgtttttgtagtggctgataacgttctttcctttccagatttagcagtcctttcaggacctcttgtaaggcaggtctggtagtaatgaattctcttaccatttgcttgtctgaaaaggatcttatttgtcctgtgcttatgtagcttagtttgactagatagccacttctcgcttggaataggctccaatctcttttggcttgccagatttctgctgaaaggtcttctgttggcctcatggggttccctttgtaggtgggtgacctgcctattctctccagctgcctttaacattttttctttcattccaaccttggagaatctgatgattatgtatcttgggaatggtcctcttgtgtagtattttgcaggggttctctgcatttcctgaatttgaatgttggcctctttagtgtgggtggggaagttttcatggacggtatcctgaaatctggtttctaagttgcttgctttctcctcatcatttttagggatgccagtgcatcgtggatttagtctctttacatagtatttctcagaggctttgttcattcttttttattctttttaaaaaaaattttggctaggcacggtggctcatgcctataatcctagcactttgggaggccaaggcaggatcacctgaggtcagaagttcaagaccaacctggccaacgtggtgaaaccccatctctactaaaaatacaaaacattagccggtcatcgtggtgggcacctataatcccagctactcaggaggctgaggcaggagaatctcttgaacccaggaggcggaggttgcagtgagccgagattgtgccattgcactccatcctggcaacaagagcaaaactccatctcagaaaagaaaaaaaaaatttcgtcttagttcagagaaccagtcttcaagctctgagattctttcctcagcttggtctattctgctattaatatttgggattgcattatgaaagtctcatagtgtgtttttcaactctctgatcagtttggttccttcttacaatggccatttcatcaatcagctcctgtattattttatggtaatcattagattccttggattgggtttttgctttcttctgaatcttgatgaccttcatttctatattatgaattctttctgtcatttcagccattccaacctgtttaagaacctttgttgggtaactaatgtggtcagtgggaggaaagaagacgctgtggctttctgagttgccagagttcttgcactggttctttctcacctgtgtgggctgatgttccttcaaccatggtataatttgtacagtcggttgacttttcgggatgtttttagagtctgaggcattgtacaaggtttttatttgtagctgacttattgtccttagtttcacaggagggtttattaactaagta

SEQ ID NO: 41499 - DNA, 1016 bp, Homo sapiens
gcccagatcataagtgctcagccaaatgaatttttacatatgtgtgtgctcctgaaaccactacctacatcaagtatagatatagaagatttttattatcccacaaggctcccttgcgcctcttcccaaatagtatccttcctctctccacttgaaagtaaccactttgctgacttccatcactataatttaatttcccctgttactagacttcatagaaattgaataatgtggtatatattctttgtgtctgacttcttttacttatcattatacctaactcttctaagatattaaatggaagctactttggactttgtcctctgcttttctatgtgggtagatcttaacagttctcccctttcttgttgactctttcattactgaaggccttgtggacccccttccttcattaaggatatattgaatatagtaccaggtgtctttggcttcatgtgggaagtctccatttcttaaaatgtcagactaggaaattttcatttcactgaagcatcctgtgagaataaacacctttaatcacttcctcacaaccttttaatgtggatgtttcacaataaaacatcttgcttccagtaggagtgtttgttttgaaggtaaatggaaatgataaataatagtaacttgttttaggttgtgtaggtggtaaatggagaaaccagtctgtcttcattccaaactcatattctttgttattaagtacagttcaggttggccacttttgctacttaacacttgtaactggggtaaaaatgaaaagtagaaataatggtggcagtacagctagacagttaagtctggagttctgttttctttaatactgtggataattgagagatgctgaaccaaaaagaaaatgtattgagaggatggtaaatgagttccattttggttaactggttgtgagattgccttcagggcctcccagtgaatagtggtttctgtagttcacaggtcttcacttacatcataagtttcaaacagtgcatgttctttaa

SEQ ID NO: 41500 - DNA, 1037 bp, Homo sapiens
actgcactccagcctgggcgacagtgcgagactccgtcttaaaaaaaaaaaaaaaaaaaaaaggccactatttcataagagtccttgtaagctttgctaagagaaagaaaagccaaggaaagatcttttgtcagctaaaggataggaccagcttcacatttaagaactataactcacgttgacacagaagtagaggcagtaggagggcaagataagtagccatgttaatagtctagtcttgtgattttcaaacttgatttattccacacccttgtcagcaattttgaatctgtacccctaataaaagtttatatatttctaggtgatatatgtatataattcattctacaaactgttaaagtttacctgttttaaaagattaaaagtgtgtataaatgtagaaataaatatatttaattgctctattttttcctacatgtcagcagattgtttcatgcctcttaactgggagaccacaggtatagggcaaagatgaggagacatagcaaggtcagaggaactggaggaaaggggctgaagaagagtcaacagcatttggtggccaattagatgtatgaggtgagggaggaggaggagatcaggataacagcaaagttcttatgaagttccagcatgggagatgtggaaacgattaccatcattaataaggtagtaaatattggagatggaacagactttaaggtgactataatgattaaaattccatgttggtttctgcctaaagacattataataccattttcctttagcaagaatttttttaaaaagaggaaatgctaaattttatctaatgttgcactgacaacattgatagcattttgctttgccttctcttttgaacatagtaaatgcttagtaaatatttaagtgaatatttaaaattgtagtgaaatttttattagaagttccaatgttcttttttccctaaatgttagtaaagtttacttgtttttaaagataaaaggtaaatatgtataatgcactgattttttttccccacacgtcagcagattgtt

SEQ ID NO: 41501 - DNA, 1095 bp, Homo sapiens
tccattccaatctttacaacactgcccgacctatcactatatgatgcaaatcaaatttttccactctcctacttaaaatgttttaattgctttctcttgccactagagaaattccaaacattttttgaaaaaacacaggcccctttacatcctggctcccttccccccaaatcttactctcctccccaccctccgatagaactattccctctgcgcatgtcagaacgcttgagcttccctgaatatactatgcacttcaaggacttgagatgattctttccacttggaatgccctccccctcctttgtctgattgcctaacttagaatttacatcaagactctcctcaaatgttgcctcttcagtgaagtattcccaactcaacatctcgtctctatccctctccccatgggtcttgcactccagacctccccactgaagagttaactgctccatactggtggtgccactgcactcctgtactctccttcaaggagctaattacatctgtatctcctgcactagactgtaggtcccatgagtacagggaccctcaagttcatctttgcctccttagcaccaagcatggcccctggagcacagtagccattcagtacatatgtgctgggcaaggggcaataattatgttctaccacttaccaagcactttacatgtgtgaagcacttaacatcattatgtcatcgccacacattatgaaggggatatcaacccattttgcaagtgagaaacaaagtttagaaggacgaagtaatttacccaaagtcaacaactggtaaacacaagtttacttttgacttctgagctcctgtttttaactactctgctctactcttggatgaaaggagcttgattaatggggctgtttcaataaaaacaatctcccccaatcacaggcttaggtgctgggttaggcccaaatccactgccaatatagtgctactgtgcacaacaaaacctgcaattgctgattgatttcttccttgatagttgtcagggttcctatgactaaggagaggggcactatttataaatatcagcttcttggtttctggcttagaatgctctaccctggaa

SEQ ID NO: 41502 - DNA, 1033 bp, Homo sapiens
tcctactaccacttctactgggtgctgttgattcaattgggcatgttgataccctattcgtggtggtcattgcttctacctttttctgccttgcactagggaatcaacaagtgcttcaagatgccaaggcttttcttgaaaagagggcagtgaaattgcggaaatgccttgctcctcattttttgctattttctgttacatggttactaaagctatgtcaatatgcctaatgtcttaaggaagtttaaataaaataaattttaggttttacttatggttctttgtttctccaggaccctgggccagggaaagaaatgaatgaagatgccaccttatgcccagaacacatctctcattcaatgataaaggatttgtggttgggtcaacttttgtgatgctcaactctttccttcgtaaggacgggctctttctcaggaggcttttgtactcccaattaacgcactgctgtaagtttgccatatcattatgtaacacatacctggatgtgtttgaactctgtctcaggatgaagctatgatgtcccattgcaattgttttgaaatctgcttcctgtatccagagagaggggcattaagatcccagagatacgtagttaaacataacctgcatatcagctgctcttcattgcaaaatgtctgtgtttgcacataataccttaatgttttcagcttcagctcacttcaacatagacatttatgggatcttttcaaacctatccttctccatttattcacaccacaaaatctagtgatcggcatagaccctgataaaacttttgtagggagaatgaggatggggcttatattgcataatatattaatctaacttcagctatgttgtgataataaataaaccttcagatcttaatgactttgtataaacaataagtatttctctcccatgcagaatctgatgaagctctattttgtagctatgccatctggatcacatagcctccaaggccagcagagcagaggaagacaaagagcagagcaagatagaggtggaagtt

SEQ ID NO: 41503 - DNA, 1032 bp, Homo sapiens
aagtagatccaagacacttttgccccaagtggaaatcctctggtaagagatgagggaggagagtctggcttcatttcagtcttgtactacttttgaccttgggagagcttagttatgccttggggcaaaaaattaaatgttccattttgcagcagtatcatctttcacctttatgtggatttaaaaatgtaaataaaattgctttctgtaaatggtatacatgaaggtcatattcatattctccgcaagaattcaaaatgccatttgacccatcattggctcaatagataataatgtgttctattagtttctagtaatctactttttaagcattttatgacccaatattttaatgcctagttcctagtttgtgaaataagtcagaaataaaccttttagcacttcattgtagatttatttatagaatgtgtgctttcaactttgaactttaaaaaatgccaaatcttcccagaatatatttccttagttataaaattggtctggatgaacatctgcactgtggaagaatatgcatttgaaagattttgagggatctagcttttttttttttttcaactatcatctgtgttccttttgcttattttttcttatagatcccttaggaattagggtttaggaatcctgataacagagtgcagccaacagacttgggaagttaagtgactgttctgtctttcagagagcgggtgtctgaattatttttattgcaatttggataataagaccctgatagatccttgtatttaattgtcatgattttgatcgctaatgacttttgattgcttcttctggagacacctgtcagccgcttccgaagcacagatggctttatcagcagcagtaggagtttctttttcttactaaccttgagctgaacaaattattttgggaatatgaacataccaatgtcatcccaagtttttctgtctttggaacattattttgtttattgaataacgaattgagactgctctttttcaaaagcttttggattttgtttgatagtaaaaa

SEQ ID NO: 41504 - DNA, 1033 bp, Homo sapiens
gttatgtttactgctgaaatcccaactccaagtatagtgccttgaaggtactaggaactcatttaatatttgaggaatgaattaaggaagaagagacatggtggtaagagcatttaggacagagagcgaagcatatgtaagggccccaaggcaggtagaagcatggcagccaggggggactgagggaaagacattgttgcttttgaacacagtgaactaaaaaaaagtgtggaatactagaggcaaaaaaggtaggtaaagactggatcatacagttataaagattttcccctaaaaacaaatacaagctactgaagtattttaagttgagatggggttgaaggaccagatcaagtttatgttaaaaaaaaaaaaaaccactctggctgaagtatggatatcagatttgaggggaggacagtgtgaatgtgagtagatcaattaggagttcgttatagtagttgtgccaagagatggtgccagcttgggccactggcttcagtggataagaaaggagcggattgtttgagagcagtggttctcaactggagcagtatttgacaatgtttggaaatactttttgtcattacaattgttgggggaaaggggatgtctactggcatctattgagtagaggccagggatgctggaaaccatcctacaatgcgcagaacactctccaattatccagtcccaatgtcaatggtgttgagattgagaaactttgttttagaggtaaactcaagaactctcttcatgaggtacaaactcagaacttgctgttggagtagacatgggagttgagaaagtgggtatttcctataaaagaaaggaaatcagtatatcaaagagatatttgcactcctatgtttgttgcatcactgtttacaatagctaagatttggatgcaacctaagtgtccatcaacagatgaatgaataaagaaaatgtgatatatatatacaatggagtactattcagccataaaaaagaaggagatccagtcatatgcaacaacacaggtggaactgga

SEQ ID NO: 41505 - DNA, 2046 bp, Homo sapiens
atgtagaacagtccttgagtttctgtctcatagacatttttaaatatatagtccagttttttttattttggtttgtttttacagaatgttcctaatatgattagatttgggttatatgcttttggccggaataccacggaagttatatagtgttcttagtgcatcgtattaggaagcatatgatatttatttgtgcagttactggtgatattactattactttttttctcatttttattgcataagcctaccaatttagaatactggtgatattttgatcacttggttgagagggtgtctttctggtttatctgtggtaaagttattttttcttaccaattaattattattattattattattttttaatcagggctgtgactaccacaaaacagtatttctatggcctttctcttacctgcttttctggtattacagcccttgtcccaagtaattctgggagtctgctggacttgtgggactttgcatgatctgtgattctctagctaatgctctgatcttcatgtggagctgccctttttttgctgctaacactcactgtgggaatatctccagttactgttattcatttatatttttagtaatgtttgttgagtaccttctatgtgcttggtattctgtaaattttaggcatatgaaatagaatgtacacattgttgacctggtggaacttaatgtctggacagacaggcagtaaacaaaccaataaatatctcttagttggtggcccagattctgaagaaaaatgaagtaggacaaggagtataggaatgctgtgtgtgagggtggttgggtgagttgcagaagtttgtatttgtaaaaattgataaggggctgggtacggtggctcatgcctgtaaatcccagcactttgggaggccaaggcaagcggatcacctgaggtcaggagtttgatatcagcctggccaaaatggtgaaacgacgtctctgctaaaagtacaaaaattaatccggcatggtggcacgtgcctgtaatcccagctactctggaggctaaggcaggagatttgctggaacctaggaggtggaggctgcagtgagccaagattgcgccagtgcactttggcctgggtgacagagggtgactctgtctcaaaaaaaaaaaaaaaaaagttgttaagggaaatccactctgataagaggatatttgagcagtgacctgaaggaagtaaaggagcaagtcacttaaatatattgggaacgagcactgcaagtggagggagtagtgaatgtaaagatctcagccaagcacaatggcccacgcctgtaatcccagcactttgggaggccgaggcagtgaatcacttgaggtcagaagttcaaggccagcctgtccaacatggtgaaaccccatctctactaaaaatacaaaaaattagctgggcatggtggcatgtgcctgtagtcctagttactcaggagtctgaggcaggagaatggcttgaacccaggaggcagaggttgcagtgagctgaggtcgagccactgcactccagtctgggcaacagagtgagactccgtctcaaaaaaaaagatcttgaagtggtagcatgcttaagagtgtttgtataatggcacagaagtttgtatggctagaactgggtgagcaagctggttagtggtgggagtagagatgggagtaatccagctggggtcttgcagattccggtactgattttagattttattattgtgtccggaattggtgggttcttggtttcactaacttcaagaatgaagctgtggatcctcgcggtgagtgttaacagtttttaaaggcggcgtgtccggagtttgctccttctgatgttcggatgtgttcggagtttcttctttctggtgggttcgtggtctcgctggctcaggagtgaagctgcagaccttcgcggtgagtgttacagctcataaaggcagcgcgtacccgaagagtgagcagcagcaagatttattgcaaagagcgaaagaacaaagcttccacagtgtggaaggggacccgagcgggtt

SEQ ID NO: 41506 - DNA, 1031 bp, Homo sapiens
ctctctgagatcccataccctgaccatttgaatgacttgtctttttctccagtgtttgggggctttcatatatgcttttccttttacccagattcctcttgttccacaaatataacctaaatacataggtgttaagccagtgtttaccgtttgtcttcctgttatttggagatttgaaaaatcttacttttaattttatttttaaatattttattgtgtatatttcaggtatacaatatgttgttatgggatacatatagatagtaaaaaggttactgtagtgaaggaaatgaacatatccatcatctcacataattacccaatttttaaaaagtttaccaagtccatccttctgcagaaattacctatttttttgtttttgtgacaagaacagctaaaatttacatttaacatgaatcccatacacagtacaagtttattaccttgaattaattcattaaaatattcttaattataagtgacatatgagtagatatgtaaaaatagttatgctgtctgtctcaactctacttctctttgcatagggaatcactgttaacaatttggtatgtatctaccccatctgttgtaccttgtgtaccaggggttttttaactttattttattatgtagatatatgtcctctgtggaaaacatcagtagaaataagctaagaaaacatctcccagttgggcttggtggctcacgcttgtaatcccagcactctgggaggttgaggtgggtggatcgcttgagctcaggagtttgagaccagcctgggcaatgtggtgaaaccctgtctctacaaaatacagaaaaatcagccaggtgtggtggcttgcgcctgtagtcccaactacttgaggggctgaggcagaggatcgcttgagccagggagttcaaggctgcagtgaaccaagattgcaccactgcattccagtatgggctacagaggaagactttgtctcaaaaaaaaaaaaaaaaaaaaaaagaaaagaaaaagaaaacatctctcataatcataccaccta

SEQ ID NO: 41507 - DNA, 1115 bp, Homo sapiens
aaacttaggttgcttccaaatcttagctattgtaaacagtgctgcgacaaatataggagtgcagatatctctttaatgtactgatttcctttctttcggatgtatacccaacagtgcagttgctggattatatggcagctcaatttttaggaacctccaaagttttcttcatcatggttgtactaatatacatttcatgcaacagtgtacaagggttcccttttctccacattcttgccaacatttgttattgcctgtcttttggatataagctattttaactggggtgagatgatatttcatgatagttttgatttgcatttctctgatgatcaaggattttgagtcccttttcatatgcctgttttagcatatgagcttctttttatatgtctttttttgagaaatgtctattcaaatcttttgtctgtttttaatcagattattagattttttcctgtggagttatttgaactccttgtatattctggttatttatcccttgttagttgggtaatttgcaaatattttctcccattctgtgggttgtctcttcagtttgatgatgtattctttgcccagcttgttgtgatcctgctttttaaaaaaacctgatatgatatctttcgtctgtttttgcttcggttgcttgtgcttgtggagtttcgctcaagaaattttacccagagcaatgtcctggattccccaatgttttcttgtagtattttcatagtttgaggtcttagatttaagtctttaatccattttgatttgatttttgtatatggcaagagatggcgtctagtttccttcttctgcatatggatatgcagtttttccagcaccatttgttgaagaaactgtcttttcccatatatatgttcctggcacctttgttaggcactaagttcacttaggtgcgtggatttgtttctgagttctgtattttgttcctttgttctgtgtatttgttttatgacagtaccatgctgttttggctactgtaggtttgtggtataatttgaagtcaggtagtatgattcttttttgcttaggatagctttggctcttctgggtcttttgtggttccgtatacattttaggattattttttc

SEQ ID NO: 41508 - DNA, 1034 bp, Homo sapiens
gtctccttttttatttctaattttatttacttgtatcttctctcttttttcctcagcctggctaaaggtttgtcagtgttgtttaccttttcaaaatactaacattttgtttcattgatcttttgtatatgttttttatttcaattttatttatttctgctctgatctttattaatctactaattttgggtttggtttgctcttgctttcctagttctttaagatatgtcattggattgtttatttgaagttttttctcttttgatgtaggtacctatagctataaacctccctcttagtagggcttttgctgtatcccatagattttggtatgttgtgtttccattactattcgtcatactcttcttctttatgtcctttgttgggtgtcctcccagctgttctgaaatgaaatatggctttgaactaaattccttaatttttaaaaataagctttatgttgcaatagaaggcagcattgaaatctttatgtctcagttctttctttttttttttccaatcagacggggcctggctctgttccccaggctaaagtgcagtggcacgatattggctcactgtaacctctgcctcctgggctcaggtgatcctcccactgaagcttcctgagtagtgcaggttataggtgtgcgccaccacaccaggctaatgtttgtatttttctgtagagacgaggtttcaacctgttgcccaggctggtcttgagctcctgggctcaagcagtcctcccacctcagccttccaaactgttaggattactgtacctggccaattttttctttttttctggagagaacgtctggctttgtcaccctgactggagtgcagtggcatgatcttggctcattgtaaacccccgcctcctaggctcaagcagtcctcctacctcagcctcccaagtagctgggactacaggggcatgccacgacacctggctaaattttgtattttttgtagcgatggggtttcaccatgttgcgcaggctggtctcaaactcctgagcttaagtgat

SEQ ID NO: 41509 - DNA, 1029 bp, Homo sapiens
cactgcactccagcctgggtgacagtgtgagactccatcaaaaaaaaaaaaaaaaaagagagagaaattgccacagccactccaactttcagcaaccaccaccacccccatccgtcagtggccatccacatcaaagcaacatctttcaccagcaaaaagattatgacttgctgaaggctcaagtgatcattaacattttttagcaataaagtattcttaaattaatgtacttaacattttaaaaatacataatgttattatgcatttaatagactacagatagtataaacctaacttgaaaatacatggagaaactaaaaaattctcgtgatttgttttattgtgatactttattgaagtggtctggagctgaacttgggttatctctgatgtatgcttgtaaatttaacagaggttatttgagcattaacagatgtatttattgggcagcacttagaactagaaaaggctcagagatgcccacttcaatagtgtgagcagtgggcttctattggctgaatgtggaaccaaagtaaggaaattacttaattgactacagctgtgttgtttttctgtatgggtatgatttagtagaaagtgtccagttacgttatctgatgtctagttggctgttgtggttagttgaagcttgttttttttttttttttaaatttaatttattacaaggaatttttctaaattaaatttcaccttgtgtaaagttccatgtacagaaacaggtccaggctaatttcctcttgcttattttgctttaagaaaacatcactgggaaactgagttgaaaattaggtactctctggcttctctgcaaaatcagatacaatgttgtaaatcatgactgggacagccttctagacctcattgtctactcattttccaatctgaattatgttctcctgtgttctcagttgcttagttcactagcattttaaatgattcaggcgattgaggaagattctgttttctttgatagattgttttatagtctaaaaaggctgtcaggaatat

SEQ ID NO: 41510 - DNA, 1056 bp, Homo sapiens
ttaatatgcttggaacatttacattagcctacacttgaacacaatcatctgacacaaaactttattttataataaaatgttaactatctcatgtaatttattgaataccctactgaaagtggaaaacagaatggtcgtatgggtactgaaagtgtggattctgctgagcgtgtattgtttttgcaacattgtaaagttaaaaaattagaagtggaactgttgtaaactggggactgtctgtatatgtaaagtgcttagaatagtgactggcacatagtaagtcctcaaataattttaattatggttgtattattatttattatcattaaattagttgaattttgatttatttgaaccatataggtaattacgttttttcatataaactcttggctcgcctatgattattgtttgtattggtacataattggttcattatttgtatttagcattttaaatatttagtggacactttgtatgagaatgcagtctttagtctggaaataagtttgctttgagaatttttctgttactttgttgtaggagtgtagcttttgtgaagaccctcgctttgctagaactggggtttgcattagctgtgatgcagggatgtgcagagcctatttccatgtgacctgtgctcaaaaggaaggtctgctttcagaggcagcggcggaagaggtaggtttatttaaacccatagttggtgaacatgttcacaagatatcttttgactctatgtcctataataagtgtaaataataaaagaaattttaacatttattcttaaagttcttgccaagatcactgttctaaaactttaagagtaaatgcctatgagttttgtcagttttaaagctagtcagacgttcagaaaacataatttttatagtgagatctgacagataaaatgaaagataatccaagttgtcttaaagcattaaaatgtcggcatttcagccccatgaattatagttaaaaaaaaatagcatattttatacgagaagctgaaactgtatttgggtaaccttgctctatttttctttaaataaaatc

SEQ ID NO: 41511 - DNA, 1051 bp, Homo sapiens
catttactaactgcttctcatcattcatttttgtcttatatttttctggcatcttttaggtctccttcacccatttatgttgactattactgcttctcaaggcatttgtatttaaggcccttgcctcagctctgctaagtcagaatttgcagagttgggctctagttacctctatttagaaatctccttaaatgaatctgatgacagtcaggtaatggttaaggaagatggatcttacatactggacataggtcttggttcagcaacttaacctctctggctttcagttttctatccataaaattgatattaaaatggtagaacccacctcatgtggtagtggtgaaggttaaagagatagtatatacaaaagcgcatgtgcttatttcatggtagatattcagaaacatgtttttccctttctgtcttccactgggagtaggatcttgaaagctccatttctccaagcaggttgaagggatattccatgtcaaccaatgcattaattaggacattattttgactggtttaacaaaaccaagtaacgagttgcttaaacgaagaagttgaattcactctaatatacaattccaggcggattggatactgaggggagtttggttccagggatcagttcccttctttcttcttgcttcaccttcctttagtctattgcactctcctacacagtcaaagatggtttatcaccatcttgactggattcttcctcattggaagtagcaaagaggaggttaagagtaggcagcttcctttcaagggcatggtctgggcatttcatacaacttattggccagaacttaatcacatggccacatctagctgtggggaggctggatcagatagtttctagcagggtagccatatgcccagtaaaaactcataggggtctagtactaatgggaagaatggatattgtaagacaattagtagtttctgccatagtaagtattggtgtttttcttaagtcagagtcttggtccaaatgcttaactcacctatgcaagcatgaatcctatctctaatgactcaa

SEQ ID NO: 41512 - DNA, 1048 bp, Homo sapiens
tctcactatgttgtgagcagtcatcctgcctcagtctcctgaagtgctgggattatgggagtgagccactgcagctggcaaaaccacctttttaatcagtgttgaatctcatgttggttcacttaaacatatagcattgttaaatgtgttcttatacttacaggatacattaaattgccttaaatattatattcatagtagtcactcttagaggagtatttctgaatgttttttcattatgtaccctataatcacattacctgtgtatatttttatatattattcttatatacctggattttgtatttataaaaactatagctaaagccagaagataataataaatgcatgacttaaatttttcccctttatgtaggcagtgctcggaatgtgaccaggcagggagcagtgacatggaagcagatatggccatggaaaccctaccagatggaaccaaacgatcaaggaggcagattaaggaaccagtgaaatttgttccacaggatgtgccaccagaacccaagaagattccgataagaaacacggtagtttattttttatttatcataagcatcatacaattctgaggccaaaatttaagagagtgagaaagacacagggcaaacatatactcagaagtcaaagaaaaagacatctattggttattcttaacaattttttttctatattatgaaatataccacatgcttacctgagtgtttgtagtttatattttgttggaggcataatataaggaacacaccagagcatccatcacccaccttgaaagacagaccattcccaaagctttagaagtttcccgtaaacccctcgacaagctcatctttatctgtctagcccagaggccacctctttactcagctttacttttctcattcacttctttttctttatagaagagatttacactctaaatttctgtacttataaataatacatggtttatttttgtaggttttgaatttcatatgaatggaatcaaatgtttttctctggtaatttgatattttgaccaaaattatgttga

SEQ ID NO: 41513 - DNA, 1049 bp, Homo sapiens
gtgcccacagttcagtattacttgagataaaagagaactctttaacattaaaggatccttctatttttttctcacctttactggtctgctttttttatcctagaattataaggaagctttaaaatttgctaatataatcccattcctttcatcttgttctttgtctctagttttcttgtttaaaagttttagacttcttacagattttggtcagtgaaacaccagggaaagagtccatgaccagtaatttcaggaaatgcagtgtgattattttcttacttgtagaaattccaatgcatgttgaagctccaaaaaaaaaaaatcctaatatttagaaacaggattacttttatctattctttttcttaacttgtttttatcaaaaaagcattttttaagacactttttttttggtagcatagagtactgtgtggtgctaagtttggaaatgatgctccggagaccatggattacttgcattaggaccatcttgggtatttgttgaaatgtagactttggacccaccctagagctagtatagactttggacccattctggaattaatcaattagaatttaggggtttgactaagcagatttcttaggtgctacgcttatactaaataaaagttgaaaataactactaatggtgattacctttcctttttccctctcatcttttctgcctgccttccaacaatccattcagaaaaccagacaattggtgcgaggtatcatactaaactgttcaaggaatgtaggaatgagagatacagaagggagtgatcagtcattttggtcttgatcttaccatttatgctgagttcctgttgttaccttaagtttttacttatttctatttgagttgtatttatcttttttaatcaataggtggtatggtgaaaaatgaggtgttctaattgtgtttcttagaacagtgttaattatgagagaccaggcatacaacagcttactaacttgtataaataccttttgcaatatataactaatttttctctcccattgttacatttttaaactattgctcc

SEQ ID NO: 41514 - DNA, 1032 bp, Homo sapiens
tgccaaaggacttgttgggacctctctttccattgtttttacacacacgcatgcatcatctactctctttgaagttctgagatctttcttcctgacttacaaattctggttgtgttttatatattttcttttttgcaaaataaatgcaataaataggcaaaatactttttagcagctttgactgaaaaccatattgtttttcaggatgcattatttcttttagatcattattttagaaggagatttaaacacatctaatcgtttttccatcgcacttaacaatgtgagccactagccagttctaagtggcagtctttatttgagagataatcaaatatcctagagcctacttttattacatttatgttttaactaattttacgcatatacaaagtacctatttaataatgtttaagcttaagtcttgagaatctgaaaatatgaaatatgtttcatataaatattttttagatgttagtttaggaaaaatgttgaagcatttggattcagttctactgaagtgactaaaggttactgtacattatgttcatatttattttacttattcttatactaactgtttgaattactacagttctgggaaagaagagttatttgtgggggctttacataccagagttttctattatcagactcaaggtgacctctgaggtacgagtcagattataaaacctctatctgtcatagattcttagaagaaaccctggcaaacagtttttgtagtgaactagaactcactttggctacttggaagagatctactctgtgggtgtccttagctcaagtaatcttattcagaaccctgagactcctgttttgctttttgcctcttggaaatccatcacttttatttattcccaggagtatgaaataaagataagaataggtggagctttcaagactttccttattttgtatataccattatctctgagaaggtttttatagcagcacttacttgtcatgtagaatacatattttattatatatcattagacccatagttatttc

SEQ ID NO: 41515 - DNA, 1098 bp, Homo sapiens
ttaccagctgtgtgacatcagcaagtcatttctctggattgctttttcagagctctaagataatattattttatatttttataataagtttatttttgtagatggaaattgtttatgtgtcttgtgttattttaaattattacatgaatatatcagcgattaccatttggtaataaatgtacttaaagtgactattttagataattacaaatacacctaatatatgagaagaaatttataaatatagagagaaatggagctataccattgtgtgattgaatcactaattggcattataccatatgatgctaattgcaatctggtatgaagagagtttcaattgatggagtcataccagatatttgaagatttaagttattatcaaaatggtaaataaacatccttaaaagaattgaaaacatgaacttgcagcattaaaatacatacttgaaaaattcaaaactacatgatacatttgctagttcattacctaaaagatgagttggatgaagaaaaatgtgaaaatgtatggaagtcttttgcacattctgtttagaagtttgtagagctcaaatgagtaatttgaatattttccacttgatattggttactaatttggagcatcttattgaaatgccctgtaggccaggtgcagtggttcacacctgtaatctgagtactttgggaggccaaggcaggtggatcgctttaggtcaggagttcgagaccagcctggccaacatggcaacccgttctctagtaaaaatgaaaagattagccaggtgtggtggtgcacacctgtaaacccagctacttgcaaggctgaggtgtgagaatcgcttgaacctgggaggcggaaactacagtgagctgagattgctgccactgcactccagtctgagcaacagagggagagtctgtctaaaaaaagaaaaaagccctgtaaatatacattatgcaaattagataatagagtaccaaattagggaaaaataatttaaactttttgtcaaatttttattttattttatttttttgagacaaagtctcgtcctgttgctcaggcttggaatgcagtgacttgatcatgtctcactg

SEQ ID NO: 41516 - DNA, 1035 bp, Homo sapiens
tatggtccttaccaaattgggaatgaattttgtaaggggacagaaaataaagcattaaagggcaagagtggcacagaaggaaaagagatgaatgtagaaattactagccataagttttcagttagaacttgaataagtgttgttaaggacctttctacactggtgtccttaaacttatgtgtatttgacctacttaggattcttgttaaaagatagcttctaattcagtgtgtcggagtcagcctgagattctgcatttctaatagacactcaggtgatgccagtgcttatgggtcatgattgacaccttgagaagcaagtctcagtattgttctttggaagtcagaattgtagatgcaggatctgcatttaaaggcctttcctggatatagtcttcagttttctgcctaattacttccataatataattaaaacagactgattggcaatataaatgtaaacagattcatagtttataaatttactttttttgaatgactaatttagttgactcttggttatctaggaacagattaaatggtaagtagttagccatggtattaaataacagtgtacttgatatgaagaattgaaattaatgtaagaaaatattaatatatttatactataatgtaattctgtttagaattatttggtacctactctagcttgggaatgttccttgatctcagctgtcaaagtaatttttggaagcagtgcctgcattctcttccagtctctagggaacagtggtctgcatatggggctgtgctgtgattggtggatatttctaacatattggctgcaaatactaatgtagttacagttcttttaaacgtttgtatgcgttctttcaaatggtaaatgtattctgaaatataggatgtgaattttagctaaattagtttaaaatgtcattttatgtggcattttaattagttttatgttaactaggattttggatatgtgagaacttttccttctacttttttttggctgcttaagaattatttctttacataaacatgtatgcac

SEQ ID NO: 41517 - DNA, 1031 bp, Homo sapiens
gtttttaaatacttacttccaaatgatttaatctattttggtcattaaaatatgtcttaatttctcaaagaaaggcatgaagtcttaaattttatgagttttttatgctatcaatgagaaagataaagtaaaaattacagtagaaaaagacaaagtccttcaacaaagttaagaaagtttataataattggctaatttttttgaggtagttcatgtagagtgtgttgggagctatcctgaaggttaagtttattaaaatttagggtaaagtagtaagtagttccaagttcaggagatacacctgaataattctgaccacagtataaattttgcaatatgtcgaaaatgaaatcccaagcataagcgtaacataatggagtaaatgaaacaataaaaataaagaaaaaaaataacaatcttatataatgaacaaaaatttaattcaggaaaattcccttggggttgagggtggagttgaggactatgattttgaaacagtagttaaaaacttatagagctggtgatccttttattaattatttgaacctgtatgagtatctactgtgtcttactaattttttttttttaatatgagattgattgaggcctttttgctgtaggacttagaggtttttattaggttttttgttttgcttttgtcatatattggaaattaggaacctgagaaatacaatttttattttaaaaatcagtttatgatagatttccaacccatcatattttagtcgtttaataaaaaaagtgccatcttctaattttgataagatttttgaatagtattactctatgttatttatttctttagtttctgttatgaaatttttatttctaattgcattattacaatatgccaatgtctggaattttgtgaaagtcttctggaaggtaaagatatttttattactctaaaataatggatatgcaaagtccccttccttcgttttgccttattaagaagataatatcgtaaattgtctgcaaagttttaaagaggtaatgtagaggaaatt

SEQ ID NO: 41518 - DNA, 1108 bp, Homo sapiens
aatttatgatcatggtatatctctccatttattcagatactcagatagtctttattttttctcactgatgtagtttcgactttaggaatcttgcatgtcttttattacatgcatttttaagaatgtaatgtttttgatgctattgtataggttatctttaaagttctctgttttctgttagagtttagagctgccaggtggtcagttaggaaaacaagcaaagttcaaagtaacaaaactttattttcttattctggtagcatcaggaagaagccagtcaggaaaggttgctggctcctgagtattacattgtttcccactgaacagcagtgggcaagagtcaggaagataagtgcagatacacccccaaccccaaccagcaccccacaccacacatacccttgtacttagaggagaaatttagtcttactgctaaaggattcccaaacaaaggttcctgctgttttatggacccaggggcttctggaagggagatggggaaggggtaggaggtagaaaagtactgagtccgcatggagaagtgccttcaagtctccttaataaggaggacgataaggcacaggtatttgaacagtgtttgctgggctcttccatcccctctgtcccagggaggcttcaaaatcaaccttgcaaatctgggataaacccttctggtctgatgtattgcctcttttatgtattttttttaattttatttgctaatattttgataagggttatacattctctgtgaacgtattccctccctccctccctccctcccttctttccttcccctcccctcctctcctctcccctccctttccgtcccctccctttcccttccttccttccttccttctttcttgtctttcctttttttttggttggttggttgttgcccaggcttggtctcaaactcctgggcttaagtgatcctcctgagtagctggaattaccaccgtggcttggtattaccaccacaccaccatgcccagctgttctattatttatttatttatttttttctggtagaagtatcacattttattagataatactggccttctgaatggagttggaaaaagtgttcccttattctttgttt

SEQ ID NO: 41519 - DNA, 1031 bp, Homo sapiens
aggctggagtgcagtggcgtgatctcagctcactgcaacctctacctccggggttcaagcaattctcctgcctcagcctcctgagtagctgagattacaggtgcacaccaccacacccgactaatttttgtatttttggtagagatggggttttgcaatgttgtccaggctcatctctaactcctgttctcaagcaatccgcctgccttggcctcccaaagtgctgggattacaggcatgagtcactgtgcctagctttcaaatatggttttttttttttttggcaaaattacacctttttcagataattctaagatatgttagtatctcaatggtatattaatataatactaatatatatgttgtacttatgttgtatgtgcacatattaaaatgccatgtgtcatgtttaattcatatatactacatttaatactatctatatttatgaaagttgcttcttaggaaattcatagtatgttaccatctacacttttactcttttggtcgttagtaatgttcattatggtcatctatttactaaatgcttttgtagtccctttgtcttgtcttaaagatcaacacatattattgctctaattataaattgaagaaacctctgaatatataggcataattatgtaaaaatgttagaaacgtaagcatttgaattaaccagtagtgcaaagaaaaaaaaaaagccagattcagccgggcgcagtggggctcatgcctgaatctcagcactttgggaggctgaggtgggcagatcacaaggtcaagagatgaagaccatcctggccaacgtggtaaaaccccgtctctactacaaatacaaaaattagccgggtgtggtggcacgcgcctgtagtcccagctactcaggaggctgaggcaggagaatcacttgaacccaggaggcaaaggttgtagtgagcccagatcgcgccactgcactccggcctggcaacagagcgagactctgtcttaaaaaaaaaaaaaaaaaaaaaagacagattcaagcacactgt

SEQ ID NO: 41520 - DNA, 1065 bp, Homo sapiens
actgcaggtgtgtgcctggctaatttttgtgtttttttaagagacagggtctcactatattgtccaggctagtcttcaactcctaggttcagtccttccaccttggcctcccaaagtcctgggatttgctactgataagtacagttttttttaaccctagtttttatcagtagcaaaacataatagtttaaaaaaaaaactgtggttaaatgcttgaattctggagcctagttatttgggttcagattttcacccagcatttattagttgtaacttgtctagttacataatctttgtgctttagtttcctcatctgtaaaccgaggataataatcttttttacctctagaattgctgtgaggattaaatgaataaaaatatgtagtgcttattctccttcatcaactctctcctggaccgttgcaataaccatcaccttctctagtttgagtacctctagtctgtatccagttgtcttactaaaacatgaatttgttactattgtactcaaatttgtccagaggcttcccatttcttgcaaggtaaatctagactgtatagcatggcttataaggccctccaaacccagcctcagtctgtctttttgttttcatttccagctgttcacagctccaggtgacctaaatttagatcatcgcaggtcattttttctttctaaaactaacctgttgcttttatgccatcttgcttttattatactttatgttataccttctctctgaaataacctcgtctttttctctgggatgagggcttctcaatcacttatacttagtccatatgtcttggtcagtgtatgattcttagtgtataagcaccattttttaataattaaattaattttaatattccaggtccgaagccaatgcttatcacatagtatgcccccagtacataaccaaattgaaaaaacaatctgtggattttaattagtggtacttatttaatattttaaaagttataattgtcagatattaatgggatcttggcttagttatgttatttttatatacaaaacattgaaattttggttagattggaatg

SEQ ID NO: 41521 - DNA, 1095 bp, Homo sapiens
tgatcattgactcttagggcttttagggaggagatacagttgtcttggccaaaatggtattataaaatgttgaagccaggtgctgataaactcagaattattaaaagctctttttgtaaagtaacacaccagttaaagggtgtttttttccccctaatagtgacccttgaatcagattggcatggcaacgttctagattgctctgaaatagcactttgtctgttgtctccctgagacagtgatctgttttcactatagtcagaaagtgtgatacagtcctgccaagcaaaactagctttcaggctttagattctaaacttctaatttcccttaggactttctctttaactcatgggttatttagaagtgtattttatttccaaatattcggaggattttccatatatatttctgctaatgatttctggtttaattgcatctttaatatctccgtcatcccagagtttgttctgctgattgctttgtttcttgacagtggattttctttttcattttatgtgcctcataacttttgattgaatgttggacatcatgagttgaacagtagaatacttacgcctgaaaagggcacacctgttctttttcaaggctgttagtatgggggagttgagtcagtttaatctggagttgagctgggcttatattttcttgttgctctgcttacctcagtgtaccacaaggcttcagatttctttggatttctttactatttcctgtgtttctggttgaggttgtaatgccagagtgcttttcgtcatttgtactcccctgttaaatttcacctttctctgtatgcctgtgctactgaagaagccccattgcactgtctttcctcttacttagcagtagactgtcacatattactcagtgcttgctggtctggtggtattagccaaaggagttcttaattttcctcattcaaactcagccttcagcctccaaagaatcacaagcttggttcttgagtgtaggcctttttcattgttctctgccctttttcctatggcagctttattctggcttgtgtctttggcacatcttgtgagggagtttccttctgactctcaggggtag

SEQ ID NO: 41522 - DNA, 1036 bp, Homo sapiens
ttttctagcactagagttgttctgcactccttggttcatgacccccaacttcttgcagctatagtcacatctatttatctctctgattctgactcctcctacttctctcttacaagagctctttcctgtgattatatcaggcccctcttctcaaaattcttaatcatatttgcaaaatcccttttaccatacaagataacatattcacagattcagggcattagaacatggactcttttgtattgttattcagcctaccacagggttcctggaaaaaagtttgtgaatgaaggtaaccgtccctggggctgtggctcccaaggcttctgtactctgatattagccaacatttcacctttagcaaacctttaaaatttataactgaattcttactcatgtagtgttgagcagctcttcctctcatgctctgccacaggtgatccagagcttggatcccatccttcttttatggggtctatctttcttgtatttcaggccacttggttgccctctgacatcagctctctcatggcttgaaaagttataattttgtagtttatctttttttttcttgctaggatagaaggagtgttatttccagttgttgttgttgttattgtttttccattctagccagaggcagttcaaagaaacttcagaaactttactgagcctgagggaacacaagtcaactgccagtaatcactaccttcagctttatagtaatagcagtagtaataaactagaacaaattgtagtgatagtaagagtggttgagttgaactcatagtgaaggtaagtaagcacttaccacaaccatatgccaagcattattttaattattttatacacttatttaatccttaaactctataaggtggttactgtttttatttacatttataagtgagaaaactgaggcaagtggagattaagtcattttctcaaggtgtcaggctgatactgacagagctgggattttagtccaggaactacttctccagaatctgtacttttaagcatgaggctgtgctgc

SEQ ID NO: 41523 - DNA, 1749 bp, Homo sapiens
gctaacttttaaaggtttattttaaataaggaataaagaggtcttccttaatcacatggttttcccagtcatgcaaagttcattttggttcttttattctttttcggtgtctgagtatatgcatgcatggatatttgcatgtaaacttcaagtgggattaaaaccatttagggccatccatgtattttgtaaagaagatcatcctgcataattactctttatcagtaactatcatcaaaaaaattttcacagtaggatattcttatcctaaagtttttgaatgctcatacagacctgacaatttcacttataggagaaagggaattttgtaaagaagatcatcctccacaattattcctcatcagtaactagcatcaaatatatttttactttaggatgttcttatcgtaaagtttttgaatgctaatacagacctgacagttccacttacaggagaaagggaactggatgccattttccagttcatttacgggtatttcatatcgtatgttgctttaacctgggacagaacccagcagccttttaacactattaaaagctctatttggttgttgccaattataaagcagatgtgaaaagaaaaagaaaaagataaagcagatttgaaaagtagacctttaagaactgtttggatatatcgagtttttatagccattcaaaaagaactcaagataatcttcccacaggacagtcatggtgattaataaggaactacataggaagtaaagttgtttcttgagtttaccaatttctgttggtgtttttctggaattttgacttatcactatatactggaaaaaaaaactcatcttcaaatgatttcagccaattcagtacatttaatcttagtacctgtttacttcattgatagtattttgccccaacaatagtagactagaactttttttttttttttttttttttgagacggagttttgctcttgttgccccggctggagtgcaatggcacgatctcggctcactgcaacctctgcctcccaggttcaggtgattctcgtgcctcagcctcccaagtagctgggattacaggcatgcaccaccatgcccggctaattttatatttgtagtagagatggggtttcaccatgttggtccggctggtctcgaactcccgatctcaggtgatccgcctgcctcagcctcccgaagtgctgggattacaggcgcgagccaccgtgcccagccaggactagaactttttaacgtattttattcatattgccacaatggagaattattatgacacctaaaatagataatattttatcaataaaagctaatgttgatagatttaaggtgactaatctatcataggtattgatatcagagtctcctcagttttctaaattatgactagggatcaccattaggcgtagtagtaggcctttatcatttgaaatcacaatttaatttcttggtgaattaggattcaagggtaggaggaatttgagatattgagctcttcaaaaatttacctgacttttgaacttcatcagcagtatccccaccatgttgttatgcagctattgtttgaatactttcccttaccacagttaatgctagaggcagagttcaggctagttcagtcctcatctgaaagtttgccttcccttcacattctcaaagttcattgttgatacccatttatctaactcagcatcttgtttaatatcattgtattacataagaatcaataaagtgcacact

SEQ ID NO: 41524 - DNA, 1499 bp, Homo sapiens
acatttaaatttaaaggaaggggtgtgtgtatgtgtgtgtgtagataggagggagtgtatttgaagctatatattacctgatttttctgtaaatctatcatattcctttaaaaaagtcttttttaaaaagttaaaggactgtgagtagaaaaattaatatttttcttttaaaatcttttgttaattataaaaatttatatacaaaaatataaaaagtaattttaaatcacctataatcttacactatctcaatgtatttacttctattcagacattttgatgattctgttcaaaacatttaaaaaactttagccatgtatataatttgaaagctgaaaatatcagaatattttgggaacagttttctattaaaacatttcttgatccattcttttcctttcccattcctatggcttccttgagacctttcgcagtgtctagcctctgttttctgccatgttattctgttcaccttagcttctttgctgttttctcttgccgcctttctctgttcctcacttctgattatctctcccttggatccctctctgtctgccttgcctctcctcatttttattgctagtgtataattgggttctacagctctactatgtctcacttcccccaaccttctggctcgtttcctcacctgataaaatggccagaacttgaactccagttcttgtggaaagtgcaccattgtcctcactaatatccagagcagggcatatgttgtcttccttctttaatccccactgcacccggctgttctttacttctttctctaaataccattattccaaggctgtcttggacatttactgaacaatttagggtaacagaggccttacacacagaacagtgtaagatttaaaattaaatgctttgtattcttgttcataaaagttacttggccatccttgccactaagaatgtttcctttttgccttagaccaggttttataaaaagcagtgatcagtgacttaagataaatgtctttagacttaaaatgatgcttcattgtatgtcacgaagagattagattctaaggaaggaattagaaaattaagtaaattttgtgctataatttttaaaagttcatttcaaaaatgcttttctattagtaaaaatcagggaagagaggtttaatttaaaaaatattcatatttggataatgagtgtagcccagctgccactgaatttttcttattaaggtggtattctgatgaaatttaaattaaaaaatgtttacttggtatattttttctataattaagttgatttgctgatcttgttagacacatggaatggctaacctgtctaacacatttagtatttattgtatcacattctttgacttaaaatctgtattataacatcagacctttaagtgtctttgtattattcataaatattttttgtttatgttataaatgtttggattttaaaatttttaacacatttttaatagatgcagtatagtcaggtaatttgtatt

SEQ ID NO: 41525 - DNA, 1087 bp, Homo sapiens
ttgattgataaaggaatgtgcttttaacatctccttaaaaggtcccttagatttcctctagataaaagaattagtaatttcatctgcaacacatacaattttttttaattttataaaatttagttaaatgtttgttttacactgactatggaaacagcactattttagatacagaaagaaatcaataaacatagcctgtgttcacaattcactcatccttttgttataaaaagacttgaaattagggttatgttttaacatgaaaacaaaatttagccttagcttttatccatcttaactttagaaattatatttatgcattgtttatagatcattgtcattcgttgttgcttaagtgttcatctgattttatatttatgatgttaaaaatagactgctgaccaataaataataaaatatttacactccattctatttccctgtattcacatcctattaatgaaaaccactggttttaaacaaagttacttatttcataaaactcaccactattttacttgattctcaatatgagaatatttcatgactatttcaccaaaatttattcaaggaattcagaaggactctccagcagagcagaatatttacatcattaaatttttaaaaaaatttaaaaatggcaattgaaacttgtttaagagactcaacttggagtttcctgacatacgaaggcagaatcattttttctacctgtctgaatcagcactttgtaagtttacataaaattaaggattgtgatttctaagataggcatgctttgcaaatatttctctataaaagtggaagcctctttcccatagtgctcactttaaggctttctgtaggcctgccgataagattcactgctgttcaggtacataagatgtaatgtaattggatgcacatgctgggctttgtaaataaaatgagattgacacccagcaattatctcatttatctgatttacattgtaaaatcaggatctacactattgattagagcataattagttaattatgaacagggaaatacaaagttacatggagcttgagctcagcaggttgtactgctgaaaaatttccaaggg

SEQ ID NO: 41526 - DNA, 1030 bp, Homo sapiens
gtgataatactctgattttcaaatgttaagaaatgttttttaaaagtaacctgaagagtaattttctgtttcattttctgccttcacacacatcaaatgaaaatctttcctgtctcagagtttcacactaaacaggggaaggtcaagtctaactttttcatgcagaaaaatgtccatttgttataatttcttggtagcaatgaaagctatctttataattaatgtatttttaaaccatggcattcatggctccctaaatttttttaaagtatatgctatcctatcagattttctaaatgtactgtagttagtacttttaatattgatggtaattcatatttcactttaaatataggattatggtcctatgtgaatcatgcactaatatatttattttataagtagagagaatgatatttagaaactaaaggtttgttttgtttaagccatatttaagccactgactctgcctggtatgaataataggaaaagatctaactcatacggaaacttgttttttactgacgacatattttagtaacaagtgaagaaatatccaagaaatttttcttagactataaaggcatatttttttctttgtcaaggtcattaaaactgtaaacttgaaactgaaatgaaaatacaaagtaaatccagtaaaatgtaaacgtaacaaaccactgaagacagttgtaagacaatttataagtccactttgtcaaggtgtatgcagtttctgataacaaaagtttcatcatccctaaagaatgactttttaacaggtaaatatcagcaacacaccctttttattatatacatgtgggatcttttaaggatggatatgttggaaaatctgggctagcactttcacattccttgttgagtctggaagttaaggtttttaacttttagagcatattgtataaacacatttagaatttcaaagcatgattatgtgccatcaatatgccttacagcatttatgcaaaagaaaaccttacacttaagtaaggaaatgtttactaattct

SEQ ID NO: 41527 - DNA, 1047 bp, Homo sapiens
ggtataatggtaataccaacttacattcctactaacagtgtacatgagttccccttttctccaccccctcaccaacatttgttatcttttgactttttgataattagccatcctaatgagtatgagatggtatctcatagtggtttggatttgcatctccctaatgattagtgatgttgagcaccttttcatatacctattgatgatgtttacctgttctttggagaaatgtctattcaagtctgaaatttaaaacataataccatttgatttggcaccagaaaacccatgaaattcttaggtatgaatctaacaaaatatacacaaaacctgtatgagagaaactacaaaattctaataaaagaaataaagaactaaataaatagaaagctattccatgttcattgacaggagaaataaatattttcaagatgtcagttcttttcaacttaaactatagattcagtgcaatcccaatcgaactctcagcaagttattttgtggattttgacaaactgattctcaagtttatatggaaaggtagaaaacccagaatagccaacataatattaaaggagaacaaagtcagaggactgacactacccaactttaaaacttactataaagctacagtaatcaagacagtgttgtatttgtaaaagacaaataggtcaatgaaacagaatagagagcccagagatagacccacataagtatagttaactgatacttgacaatgcagcaaaggcaattcagtaaagaaaatatagtcttttcagttaatatatttttaatgcaaaatggttgggcattagattgagaccatatcataaagggtggtaaatattatgtcatgagtttatagccactgaaaatctatttggagcccattagaggaagttagggatcagaagaggacaggaaaagctaatctccagagtgcttcccctagcaagacactcttttttcaaaatagaacatgcaatatggagtttagggcagtgtccttactgcacttttcatctgctcacagttctgctaattata

SEQ ID NO: 41528 - DNA, 1068 bp, Homo sapiens
agaccaagaaattctgtagtttcaaaaagacttgtctagatatttagttagacattaagaccaaacatttgtggtctaattatgatgtctgtggtcaacatggtcataattattttaattacttaaaaaaaattatgaactagcacatgcttattatagaaaacttggagaacaattaatatgtaaagataaaaaatattcaagaaataaccactactaacatttcgttaggaccttaatatataagacatatgctacgcattttcagtggggacaaacattggttcttatgggggcaaaaatgcaaaattaaagtggtttgtgactccacggcttaaacccttcccaagaaaattttattcttaagatttaatctctcaggttttcttgggtatcacacaagcattactgacattgagttcatggaaaatacagaaaatatatacaaaattaatgccacagaacatgacaaatggctgtgaggggaggacttttgatcaattgcttgatcttaaacttactttagaagaggtggccagtgcctgccaattggctgccatgtggatacttcttatgcttgatcttaagtgcttttgtgtgtgacagctctacacaattccctagttaagagttacttctcaccaaccaaaggtttaaaaagttaaagttcaccaagaatgatttttaagacatttatttaatttttttcatttactttagctggaactgcagttttaatagttttgaatggtttttttaaaacttgatttaactttattattaatatagttctaaagttaaacattaatcacttttacattttaacttaaaaattcttttttttttttttttttttttgagacggagttttgctcttgttgcccaggctagagtgcaatggcacaatctcggctccctgtacccaggttcaagcgattctcctacctcagcctcccgattaggtgggattacaggcacctgccaccacgcctggctaatttttgtattttcagtagagacggggttttgccatgttgtccaggctggtctcgaactcctgacctcagg

SEQ ID NO: 41529 - DNA, 1082 bp, Homo sapiens
gagattgtataatttaaatttagagcaactggccaaattcttttagatcttgtttctgtcagggttatctctgtaattaagaaatccggagttcagaaggattgttaatgaattgtctgaagatatgtaataagtaggagcaggcccagatgaggactttgactttctgtctccaagtctaatggtctttcccctgtatagtatagaatctggtgctcattttctgattaaatctcttacagtgcctacacaattcccaaaaagtatatatatctcacagtatgattatgctagttgggtttattgtttgttatatgcagaaaaagtaaaaatgttttctcattgttttgatataaattattttaaaatgttcctggcattgtgttatataatagcctaagttgcatcaggagtataatttggtagctgtttcccacagggaagttttatcttatttacagatttcattccttgaaattattaatagtttcgtgttgcatcagtgacagtatgtaaatctctacgtgattattggtatttttgggtttcactttttaaagctagtctgaacgtgtgtctaacagctgtaagtttttcatacttacataactttattattgatatagatttttttattcctacttgatactgcctttttcttactgtcttatctgtcacaattgaaaatactgcttctgtgagagaaaaatactagcatatcttcctcaaattatcaaaatatgagaagtatttacctagaaaatttcaaatggccatattttgaatatctagaaatcagaaaaataagcaaatagcttcaatgcttatttttagattggggttttttaaatttcttaggggtttttgttgttgttagttttgctgctgcatatgcttctcagtaaaagcaaatagttttattgagctttctccaaaatgtagacaacaatgttaaatgtattatcaatgaaaaattatgaaccacaaacacatattatcccaacatataaaattacagattttttattttctcagtaaactcaggtatcttcacatttaaagctggtagaaatacatgatgc

SEQ ID NO: 41530 - DNA, 1050 bp, Homo sapiens
ggttcaggtggcagaggaactcacctggtttgaaaggtcccagcaaaatattcctgatatttttaaaatgtggtagaagtttttccttcatttcagtactattataggtgtatgtcctcacttgctctctttttctctcttttttaaaattccattggccatttcagtgaggctctaggaggaaaaacagttcttcctagaatgtgcatatatccttcatatctgaaaaactcacatttttaaaaaagtcactgtgctataattattgttgctaaaacttatatagactgaaaatgagcaaatctccaaattcattaggcagttacttcactataagcagaatagaattgagcattttcttaattcttataatataaaggtgctgattcactttttataattatgaaagcatttttccagttttaacactaccattgccctaaagcagcaattcaatagcaactttatttaaaaattatattaatatacttcatcgaactatttaaagaactacttttctgatcaaataactatgctttgtttgtaccacaaggaaatatactaatgagcataaaaagtaacatgcattatagatacatggaatattattatcttattttattaaaacagtaaattaacatcatagatgcctaaaccttttaattttttgctcttttacttctatcgtatacgttatacattaccatatgttatacttgttggattagcatcagcaagtaaactgaggaaaatgtaaaagcataatttatattctcattaatttttttaaagcaatggcagataactcttgaatatgttgagcctaaatttatcacaaactattaattaaattacattattatatttaaatgtcttgttggaaaatctgtggtcaagacattctattttttgacagtttctagtgctgtaaacagtgaaaatgtcagaattcctccaatagaatatttcacatatatttatatacattacaaatatattcacattacttacaaattaaaaaattatattttgaaatacaatttttatatg

SEQ ID NO: 41531 - DNA, 1043 bp, Homo sapiens
aggatccttactatctatctgtaggtacctatcttcactacagcagtatgtcattaatgattaaaaactgtcgtaaagttaagcctagaaagaggaaagaatagacttgattgtgctttctgtgggccaggatttgtgctaggctcctcatattttattttatttaataattttagtcgtcaaaaatagttactgccattttatagatgagaaaactaggttctaaaagtttaagtgatttcttcaaagtatttttgggtagtgtaggtatcaaagttaggatttgaatctgggtttgccagtcactgacaacaaagcccaaatttcctccactacacaattgcatagaagaaacagaacaaatatgaagtatgtcagaagtaaccaaccatgagcactgtgtaatgctagaaccagaaaagcagaattcccaacctttctgtgttattttccactactttgctctttctcactgggctttggctgacttacccttcccactgttccctttacttagaatattcttccctccattgtttgcttgaccaactctttcttatccttcatgtctcattgcattagtcattttttggagagtaggggactttgctgaaatttttagatccttctactaaaagtcacatagcactatgtttttcttccattgaatgtgtcataattgcaatgatacagttacttgagtgatcaattgttttagtcagattgtaaactccataaggcagggacagtgtctgtcttatatacaatgttttttttttgtttttttttagcaactagcacagtgcctgacacatagctagctagttgatgttcaatcaggaaggaatgaatagatggcttatatagcttgctggagatctgttttcaagtaagatattttaaaattttattttataaaataattttgtccttatgttttatagcctatattatgaaatattgggaaaaactttatacttatgtagtagctaataggtaatagaaaccattggctaaatgaatgcattttcagacaagcttta

SEQ ID NO: 41532 - DNA, 1039 bp, Homo sapiens
gcgcacttctttaggatatatgtttcttatgtctctcctttgagcatattttagagccctttagatagcatctagtttattttttaaagtactcaaatgaagctacttagaagaattgaatacactcaattttattatgacaaaagatgtgctgtgacaccacttctacctttctcagaccctagttctctcaacttcctgggatatatgggttatggcagtcaggttgtgaagatttttgttaaaagaacatttcaacaaagaccttgattctacaggtctctctcactattgcttctatagtcaccacagaaggaataacaaggctaatactgtttggataaatgtgtatatggaacagattaatctgaatttggcaaaagttcagaggctatgaagaacaagatttggggagaaaatctgttttgaaagctaaattaacctattttgtttattttgcaactataaatagtagtattaatttttttcctggacttttatggttttatttgctctggatattttatttactaaaaaggaatctttccagatggtctcataaattatcaatatgttccagaaatttcaacatatcagaaattaaaaatatatctcctaagtataaattagttcaaccattgtgaaagacagtgtggcaattccttaaagaccaagaggcagaaataccatttgacccagcaatcccatcactgggtatatagtcaaaagattataaatccttcttttataaagatacatacatgcatatgttcactgcagcattatttacaatagcaaagacatggaatcaacccaaatacccatcaatgatggactggataaagaaaatgttccacagtatgtgtgtatacatacacacacacacacacacacatacacacacacacacacacacacacacacacacacacacacacacacacacagtggaatactatgcagccataaaaaggaacgagatcatgtcctttccctgggcatggatgaagctggaagctgttattctcagcaaactaac

SEQ ID NO: 41533 - DNA, 1030 bp, Homo sapiens
aaattgtttgtgatatatcataggggacgtcagaaggaaataatcccctgtgtgctgcttgtaagctactttaggaacagtggcaataagtagaaataataaagatactttatgctgttctcattatcttcttggtgaaagttgatgtgtgaccctggagatacccagagggaagaaggtcaaagtataaagtatactttgtgtacctttttaagatgcttaaaatgtatcttaaaatgctgtgggtttgaattgaagtttacatttgcgttggcctttgagtatgatggttttattttcacaaggatagtagctatttaagaataaaataattattgtagttgaagggattaatgcaccaggctcagggggtaggggagtactgttttagcagtctggttacatttttgaggtatgaccagtaaacttttttggccgcctggatacagattatggaaagtaggaaatcaaggatgactccagagtttttttgggggggtttgtttgagcaactgaaagaatgtagtagcaatttattaaaattgaaaaaaaaaagattatttgagtgtatatgtcacaggagagttcaggagctcaagtttagacatggatatttggagatgcctatttgacgtggaagtggatatgttcattaggcagttagttatcataagggtcaggaattcaattgcagcgcccagcctcaagttaccaatgtatagatgacacttaaagctcagctggatgacagcagcaagctagtcagtgcagatggcaaaaatgagaccctagcgaatcctgagacactgtagcatatcaaggtcagtgaaagaattaacaaaggaccctgagaaagaaaagttagaatgagaggaggaaatcattgtgtgtggtatcatggaagataagtgaagaaagtgtaccaaggaggaaagagtgaccaactgtcatatgctactgatagattgggtagtgtgaagactgagaactggccattggatttggttatatggaggccacagaagagttt

SEQ ID NO: 41534 - DNA, 1024 bp, Homo sapiens
caacaacaaattgtgtaaaggatttgagagaaaatgtctaaaagtcacataaagaaaactaaacatgtatgtaattggagcatctgaagaagaaaaccaaaggaatagaactggacaaatgcaaaacattaaatcaagaacacagggacctgcatattgaaaagacaccacaatcctgaaaaaaatcaacccaggttagtgaaattcttgaactttaagaaaacaacaaaactcctaaatacctaggcaaaaggatcaattaatttataaatgttagaaaatcagattgacatgctgcttcttgactacagtgcctcaaacggataagcaatggtgtgacatatttaaatcaggaaaataaaacaaaccaaggattttataaacagtctgaccttttattacaaaatgtatagacagatatgaatatgaaggaaattaggattaatccctttataacctaaaagtgggagaactttttaaactatgattttgaatgcagaaaagataaatttgacagatgaacttttacaggatgaagacaaaaccttaactgaagtcaaaatacaaatagcaaactaagtagtaaagtttacaaatcatatcacagacagagggccaatatccttactctataaagagcttcagaatttgagaagaaaaaggccaacctccaaagcaaaatagaagctatgaacagctagttcacaaaaaagaaatgcaaatgacctttaaacatttgaaaagatgtccaatcttgctcataatagaaatgcaaattaaagctacacttagatgccatttctatcacagtggcaaaaatccaaaatgttgacaacatactttgttggcagtagtgactgaaaacaagtatattcattccttgctagtgaatgaaaatttggcattatttgccaaattacatctgcatttactttttggctcagaaatcctactttgaaaaatttattctcaggatagttgtcaaatatagtaaatggtatttgcgcaaattatttattgtgcc

SEQ ID NO: 41535 - DNA, 1028 bp, Homo sapiens
aaaaacagattgaaagtatttctttttaatatggtttcaatttaatttaaaaacaatgcaacaaagccattcttatgtacacacatagccattaaagatgttcctagcacaaagattctcaaatgttcctagttcattccacccttaatatctggtaattttttcatggtgactctaggaaaataggaatacctcattcgtttattaagtagttaggcccaaatttagtagtagcagtttgtgtagtgtctgactgatatttctgtgttcccctaaaaatttaaaaacactataacactcctgtgggttcacggtatcatgattgggaaccacggtcctagcagcattaagagtgtgtgtgtattgtaggggagaaaaaatagttttactctacttattttaggttcagtgctcgagacccctgtatcaaacgaaagactaacaagcaaaaagcatacacatttatttaatatcagttttccgtgacaagggaaccttcagaaggaaatgaaaactcaataaacagttttaaacttgagtgtttttccatagtaggtttgatgaagagtggaaagtcatggagaaatatgataggacaaaggggatatgagctacatgtaatgagctgggagaaacttgtcaaggcttatttgttcagattactctctgtgactctgtgtccttggagataaggatattcctttcctccaggaatagggaagcacctctcacataaggatcttatgcactgcttcaagggaaggtcagaacatgcttcctaggttttatgatctgcttcaggggagaagggaggcggaacttcacagagaccttcctgcttatgctattttctcaaattccttcagcttaaaatattcaatatgccaaggtgccatattttggggtagtgtgtcctgatgtgtgtgtctctctctcctgaactctcttatctatccatccagccatccttccacatccacacacacacacacatataaatcagtctcctgcatttttatttgctaagt

SEQ ID NO: 41536 - DNA, 1033 bp, Homo sapiens
taacatttttgggagagcaaaaagaagcaccctacacttactcaattcagtgtaagctgtggatttattacgtttgatggaaagagatttagaatgagaattgggtctgtcccttattagctgtgaggttgtcattaccttctgtaaattatatttagcttaatttcctgattttcaaagtcaggatgacacctatctcacagggtagttttcgattacaatgtattacctaccaattttaaattgcaggtactctgagcttcactagttaagtgaaagtcgtgcctacaaaacatgtctgagttcttaaatcatctttaagttcccttctaactgtgccattatatgattctctcatgcaggtgcttctcctttctttccttctctgatgggtacccttttcctaacacttaagtctcatccaagtacatattgataatctctcttctatttctactcaaatactgctgtgtgcactagatattttaccatttctcaaagggccctgtgctctataccagtacacctcagacgatctgtggagaagaacatgttggcttttgcctctgacacagcatcgaacaatacttgtatgaaatacaacaaaatttaatttctagaaaagaaaaactaaaacaagaagacattcaaattatgtccttaaattgtatattgttagatatagcagacatgaaataattctatcaaattgttgtaaacattttaaagtgcttatgctaaatttatgtaattatctcatactcgcagttcacaaactggcactgttttatgggccataatttaaataatgctgctctagggactagaccagctgtcctcaaaccagtagcattagcatcacctgggaacttgctggaaatgcaaatttgtaggccctgtcccagaacttttgagttagaaactcagggcctaattcccatcccagctgcctgtgtttaacaaatcttccaggtgtttctgttgcaggctaatgattgagaaacatggctctttctctgctatttgctaactc

SEQ ID NO: 41537 - DNA, 1069 bp, Homo sapiens
aaaaaaaagacactatgaagtgttggtgaggatgtagagaaactggaactcttataagtttctgctgggaacataatatagtacaatcactttgaaacaaaggtttgagattttcttacatagtgaaacataaacctaccatatgactcacaaatttcactctttggtttttacttaagataaatgttaacatatgttcacaccaaatacacagaaattcacagtaactttatttgtaatagttccaactgggaacaacctatatgtctctcaatgggtgaatggataaataatggaatgccaaatagtaataaaaagaaaaactactcttatgaagaacatcatagatgaatcttaaaaatactatgttacatgaaagagtacatgcacagagtatatgcaaagaatagtacaaaaacatacatactctatggtttaatttagataagtttctagaacaaattaaactgtatgctagaaactagaactgtgattacctagagctgaaaataggagtggggtcacgagaaagaggcacaagaaaacttcttgggttggtagaaacattctataccttaacaagggtaaatccatttatcaaaactcattaatctgtgcacttataatcccagtatgtaaattaaacctcaatgtacttcccccaaaaaaggaacagaaatacaatgtaagaaaaaaaggtaaagtcaaaggaacattttgaatatttttttctgtatgtgttgattaggttttagtaatggcaaacgcacacttttgaaatcgtgacttctgtaacttgtttgttgatattgatatgtaaaatcaaatagcatttttgacacctaaaagagtaattacaactttaatacagattttaaggttgtgctatgatttatatggatgttagattttttatctcctaccttctacttttgttttttatgtcttctcattctgcaggaattatatgaaataagaatgctgaggaaaactaaatgacaatttttttcttcccatttaatgccctcatctcttcctgtgatgttaagtacaaagtatttgatcatat

SEQ ID NO: 41538 - DNA, 1051 bp, Homo sapiens
ggaataaaaaagactgctatgaacaattatacaccaacaattggataatctaaactaaatggataaatgcctaaaaacatccagcctaccaagaataactcgtaagtaaatagaaaatctgaatagaacaataatgaataggagattgattcataaatcaaaaccttccaataaaacaacaactacaacaacccggggttagatgtcttcactgatgaattttaccaaacattacaaaaataattagcactaatccttcttcatctctttcaacatatacaaaaagaaagaatactttcaaacttattttatgaggccagcgttaccctactaccaagtcagacaatgacactacaagaaaagagaactacaagccaatatcccaatgaaaatacatttaaacatactcaacaaaatattaatactaacagccctaattctgaattgcacagcaaattaaaaatatcacacaccatgataaagtgggatttatctctgggatgaaaggatggctgaacatatgcaagtcaattaatgtatacaccacattaacagaatgagaaggaaaaaaaatcacataatctcaatagatgcagaaaaagcatttgataaaatttgacgccatttcacaatagaaaacaaaaaccctcaacaaactaaacatagaaggaactcaattcaacgtaggaggggccacctatgaaaagcccacagctaacattataggctaagattataaacaagagaagggtacctactctgtcaatttctatccaaaatagtattgcagtcttagccagggtaattaggcaagaaaaaaaagaaagacatccaaattgaaaggaagaagtaaacttatctgtttgtagattacatgattaaatatgtagaaaaccctaaagactccaccaaaaaactgttagaactaataaattcagcaaaggtacagaataaactatcaatatataaaaattgattatgtttttctacactaacaatgaactatctgtaaatgaaataatctcatttaaaataatctcgagaagaataa

SEQ ID NO: 41539 - DNA, 1031 bp, Homo sapiens
aaagttatattttaatagaaacaatacatttaatataaatcttttaaattgttaattgtcttacaaaatgttatattactttccactgaaaatattaaacattatttattatatccatctgaaattttgagcaatatacaaatgattgaaattccttactctgttttgattttatttttattttaaatacttatttttaagtgagattcagttctagaactgtttttgacttgatgtgactatgcttggcttaccagatgccatttttcatatttccaatatgaaattacttatcatcaaaaaatttttattaaaagggacatatagtttgcagaaaggaaatgtaagactttaacattaaaccaatgttaattatcaaactaactgggacacatatatttaaatttacaagtaaataacaaacagtgaccattttagttagcccagatgaaaagtttaattgttttagggaaatcagtaacttgagaatgaacagaaatactatatattttcaaatactttgagctcttcaagagaccacaaatgaatgcattatcactttaattgtgagaagatatggctttaatttggtaaaatactttataagttgggaaatgctggaatctaagctgaaagactgtggatgaactttcaaagtaaatgccatattcgataaggcactacaagatgaatttttcagtcattagtgcagttgaacagtgactgagagaaaaacagtgaattaagaagagatctataggtttaaaatggggtattaaagttccttactattgctttacatatttaggtgctgcagtacaataattgtacatatacatgtgtgtatgtttattcccaacattttacatatgtgtgtttatatataattgcacatatatatgtgcaattatataagatatatataattgcacatatatataccattattacaacttacaatgaattgaaccttttatcatcatatagtgattgtctttgcctcttgtaacagattttcagtgcaaatctgt

SEQ ID NO: 41540 - DNA, 1088 bp, Homo sapiens
ggctagtgttttgttctgtaatattatctcaaaccttgtacattttctgttgtgttcactattccaggatatcttctgtgacccctccatatatgttgattgttattcaagacaaccaaactcttgttttggtacttgctgcacagtagttaaataatcccttttgaaacagcttcccagaaaaaggacatgacattatttacctccttaacctcgatgcttggaacagtggatgctaagtaaatatgtggtgaactaaaattagcatatataaccaaagacagactcactgagttttggccatataattggatcagcttctgtagtgtatatattgtgtattttcagtactataatatggagagttggtcctttccaaagtgtgattggtgtgccagaatttaaaagtattcccttgattagaaaatgtgtttagtttctgtaaccaaaacataggaacccacttctcagcatgactataggtttttcaaatgtgaataagtcattatcctgtatctagaatattgaatttctttatcttcccctcctggggcaacagttgatgtaattattcacgatggaaaaatgcatcctcctcagcagatttgcagaaactcttactttggtcacacctgtctgggaagagtggtatcctgctgaatcagtcaatttcactgttattctcagctttgagtggcttaattgtcaaggtattctagggcacctttacagcagggttgacaactttttgtctgattttcaaggacaggttgaaaagaaacagtgagcctctgtttgtctcaatatcattgttttgcacagggatatgcagctttaatttcacatatttggaaaatctaggtgacattttagaaatacgggattataattaccagtgagtttctctcttgtcttaggcagacaataaatacactgaaaactttgtgacattttatagccagtgaaaggctatttcttcttatgtcattgatgaaccagggtaacttaactgtatttttttaaatgaagcacagattatatgaaaattaaaattaatttacattgttttgtatagttatagtctataa

SEQ ID NO: 41541 - DNA, 1043 bp, Homo sapiens
ccagttcttagccaaatgtccctgattcctttaaatgtttaagtcactgtctacttcaggagtatacattgcatcaggctgttatgtccctcagccctctttaatctagagtaatcttttctatgataccaatttgctgaataaatattaacagttgtcctgtacaatgtgccacattcgagaatcaatagattactttctgatgatcttcctatatgcctgttatgtcctggatgttagagataaagtgttcattcaattgaagatcaacagttttggcaagaatttatcagagctaatgtttaaaattttgtatggcatcgtatcaggagacatataacgtttgggtcctgcgattaggtacttactggttaggatagcaacagactaatcttttttatgtaaagttgcacttttcctcttgtaatcagaaaataatctgtgtggtgtcatgatgccactttggcactataggaatgtcccattctctttcattcttttatcactgttagcatatttattagcttgacattcttctgtaaactagaacatttgctcattagttgcagctatttatttactgtgaaatgtaattcttatagcaaatttacattgattataattcattatattaattcaactaatctgttatattttatttctatttattgatttctatgactttgttgcctcttttatgttgatttttattttttaatcttaactcccgccatatatttttttaatgtatatattctgttatttcagtaattggttagcctttaattttaccaactgtctttaactcaagaaagtctaaagttattacaaccctctccccaaaagttcaagtacctcagaccactttaacagcatcaccttgtctctcaatttacctgctatgatcatctgatgtttttatctgccttctgctgttgtaaaatcctacagataagtaaccattgtcattattattttatgcagcaatggtatgtttagattacagactttcatatttctttactcaacatttctatttggat

SEQ ID NO: 41542 - DNA, 1028 bp, Homo sapiens
atattctgatagatacagtactttcacagagtcttgtgtctgagagtatggaaaggccaatgaggagacagtgagctatcaaacatctgtcataaatatatatctaagtaacttttaagttgcctgatacttgaatacatcaagggaaagatagcattttagggtcaattaaacaaaagtatgtgtactgtaatagtttgacacaaagaagaatggatagagaaagaaaaacagtcaaagtggtaagctttatcaaaatagagtttttgaccttgtacggataaagaaagagagtttagaaatatgaattggcttacccatgcaagttaaaaaaataaataaattaggcagagagagtggaagaggaaaaatgaatacagacatctgtaacttttgtacatgaaaagcagcatgtacaatgaaaaaaatagaaggaaataaaagcagaattgattccccaaattttctttacaagaagagcaataaaattttaaggatattttactaaacatactctaaacttaatttccaattcttgaagtcatatgtttaaagtttaaggaatcttcctatattagtaatgcttctccagagagaaacaaccaatagcagataatagatacatgaatggatacacatacatacagacagacagacagatagacagacagaaagacagaagatagatagagagattaatagatagatagagatttattaaggaagttggctcacatgatatatggaggctgagaagtcccatgacaggctggagaaccaggaaaggtgttagcatggctcagtccaagtctaaatgcctcagaacaagggaaactgatggtttagccttcagtctcagactgaaggcttgagaaactggggagccaccagtaaacgcagagtccaaaggccaaagaatctggattctgatgtccaagggcaaatgaagaaggatgtcccagctagaggacagagagaaatagaaagagggagagagaaatttgtcatttctttgcctttttgttcta

SEQ ID NO: 41543 - DNA, 1047 bp, Homo sapiens
tatttttaaaaaaatttatgtgaagatgcttggaggctatgtaagtatcctgttgatcatcaagcactccccagcgcgcgcgcgcacacacacacacacacacacacacacacacacacacacacaagtaggtttagcatacattgattactcttgcatgaatcagttttttatttaattgttgcaaaatggtgattttctaattcaatgtttcattctctgtttattagttgacattctactgaaggaaaatctttcacttacttccctttccttgtgtactgaaaaatttgttttctttaaaatgaagctaaaagttatgagcatggacctatgggtttgtatttttttgaatgggttattagctattatccttagttatttgggtcctcaaattgccctgggctaggccagtggaattgtcctcaagatggctcttatgttgttttgatctagcttgatttttttttagacacttttgaatttgccaacacaagacatcccaggatcatagtgaatctcccctgctccagccttggagtcagccatttatccaagaaactttggtttctctcagtagggaatgatagttagatcctgtggcacatatctttttatgcaaaaatgttattattgctcgtgactctttgagaattggtttgaacttcaaaagaggttaaaacgttttcacttaagtatatacaattttctaattatagaaaggatatgcatttattttacagaaaatatagacaagtataggtaagaagaataagaggtgccttgaacccactactcatgttgaccaccattggacgtaaatgtattttacatagccaagatcacatcatgtatatagaatattgcattttgctgtatctacatagcatgtcattgttttctcaaagtcatagaaattaacatttttaagtcacacattgtatattaaaatttctcttttctttcttgtttttgtttccattgatgcaatatcctaaagtagaaaaagtttgtctgctggtgttgagcttctttttctgctctctt

SEQ ID NO: 41544 - DNA, 1063 bp, Homo sapiens
tctactaaaaataccaaattagctgggcatagtggtgggtgcctgtaatcccagctactcagggggctgaggcaggagaatctcttgaatccaggaagtggaggttgcagtgagccgagatcacaccattgcgatcttcaaaaggaacattatatttaatattttatcaaaaattatgagttcctatttacatacacctttaacaatgttagctacctaatttcatcagttctctagatctctgtcaattaggtaagggatgagtattttcattttaaaactttaatagtggagttgaatatttcctaatatattattgacttctagtatttcgttaattatgatatatttttatcagagtgatcttcagcgagttttggttcttgccaaagtcacatgactgtagtagtcacttatatggacccttttcagactgagtgacctctaggcagcactgttggcccttttgtcattcttgaactcttttattttcttcccttacacgagaccacttagacctccttctacctctctgcatgccacttcttacattactcctggcttccatcgttaaccacctccccatataaaattatctgtataatttgtgttgagtttcttaaagtttcctttaccatgatcagcagatttatctctgtagcccagatttctttttttttttttttttggcagttgcaagatttaatggagtgaaaacagagctcccatacaaagggaggggacccaaagagggtagccattgctggcttgaatgcctgggtttatatcccagtcattatccttcccactgtgctctcaggcaatagatgattggctatttctttgcctcctgtttttgcctaattagcattttagtgagctctctttactacctgattggtcgggtgtgagctaagttgcaaaccccatgtttaaaggtggatgtggtcaccttcccagctaggcttagggattcttagtcaccctaggaaatccagctagtcctgtctcttagtaccccctctcaacaggaaaacctaagtgctgttggcgaggttggcca

SEQ ID NO: 41545 - DNA, 1974 bp, Homo sapiens
tgccccaaaaccttgattgactgggcagctagcggggagatgggagccctccatctgcctgttactttctgaccccatttccatgtaatgtaggtggtgctttatgtcaaagaagaaatgaagaggaatgatcttccagaaacagcagtgattggtcttctgtggacatgtataatgaacgctgttgagtggaacaagaaggaagaacttgttgcagagcaggctctgaagcacctgaaggtaacagcccttagcaaggaactgacccagccaagggcaaactgcagctttttttgtttgtttgtttgtttgtttgagagtgcagtggcacgatctgcgctcactgcaactttgaactcctgggctcaagccaccctccctcctcagcctcccaggtagctaggactacaggcgcgtgccaccacgtctggctaatttcttcattttttggtagagatgtagtctcgctgtgttgcccaggctggtcttgaactcctgcattcaagctatcctcctgccttggcctcccaaagtgttggattgcaggcatgagccaccacgccgggcccaaatttgtcttaattgagagtatgacaaatgggttccaactacaattaccctagactcagactaaacatatacttcctaatttttttccaagtttgcacccagcgttcatgagaacatagcagtgagtaaactgtccatgttactttgatcagggaaggccctttggaagagataagtattgaattgagtaagtctcagaaaaacaatggctatgcctcagtgtcagaaagtcaaggatatttctaaatgaatgctttttatcccagcagctcatcaagattccttccctgtacccactaagagaccaaatatgagaatctgcctatattaaagataattgctggcctgctatgtctaagggatatttcgaaaatgaggtcatatcctcatagaatatccattgtattattggactgtggctctgccattgaaaaaatgtgaatcttcttcccagttccctcacaggtcgactatactgctttgttcctactgttctgttcccctcaccccattgggcacaatatgatgataaaaggtgtcaatcctgaaagtcagtcttttctaagcaaccctccaggttactgttatagttccagcagtgtcggctctgtacctcccacgcaagtgacggcttttactctccacttctgttctagcaatatgctcccctgctggccgtgttcagctcccaaggccagtcagagctgatcctcctccagaaggttcaggaatactgctacgacaacatccatttcatgaaagcctttcagaagattgtggttctcttttataaaggtatccatccacgtgccactgctgtgcttctgtgttttgctgaagctctttgagaggcagagcaggcaatgaggcagaggaggtcatggggctctgtttagagagggacagcaagatgctaatttgtgaaagttttattgaggcaaccataccatgtagagagaggaggcatacacgccatatatgcgttgccttggaaaccctgcttaggcccctgggcacttctcattggtagatgaactggtaattgtttcttggggttggtggaaaaaaaatgtaattatataaaattgagcctgtttttgaattgtaaggattagctctaataacaatgattatcaaaatagtatatatattatgttcagactcttttaggtaccataaatctgactttaaaattactgaagtaattagcctttttactttgtattttagttacttggcccagccattctcctgttttccaagggaatggctatttttaggttttcacatttactgtcttttcattgtatttataaggattaggttgctatgacaactggcactaaaatatgaatgctaaaggttttaaccgatcccaatctgtatacctacagcatacagaaa

SEQ ID NO: 41546 - DNA, 1024 bp, Homo sapiens
agaaaaaagtggtgatgggtcattttgcaaagactctctgtattaaaatctagatttgcatatttttaaggtagtaagaaacagtaaatccattgctaactttcaagcatcacattattgacttttaaaaataattttctcttcttttttccctgaagataagtcccatagactcagcatggtctaaaatgtgtaaaactaccttgtcaagtactgttattatctctatcatgggttttcttgtttgcagaaattttttaggttaaattctatcctgcatgcaaatttttctaaaaggagttttttattctagttctaaaaaagggtgagtgcccttctcagcatatattcccagcattcttagggtaaattatttttgacttgtgtccctatgtgacattcctaataaaaaaatttctgaatttcaagagtttcaagtgacatagtttcagactaagtttctaaataactaacatgatctaaaatttagcagttctcaagccacttttacagtattgtctcttcgatcctcatgaatacattagaactctacaaattgagaaatatttattttttctcatcaagttaacaaatttattccttaaacgtgtgttgaatcgatactatagggcaggtctttcattaaatgctggaaatgagatgaacaaaatatagtccctgacttcctgaatttcaggatgtagaagaaaacaaagaattacactcaccatgtcaattgctgaaataagcctcacacagagggtgtcagaagggataggaccacagagggagggcacctaacttgttaaaggtaatttggagggggagaagtgaaggctctcaaggtacatgtatctcaccagacattatgaagaagttggccagatagaaggggaaaacatatattccagtctctatgtgccatcatacaatgtcttcctttcttactgtcttttactgttattctatattcctaataggcatttatgaaatatcccaccaaaaatggtttctcagttttaat

SEQ ID NO: 41547 - DNA, 1063 bp, Homo sapiens
aactgacctcaagtgatccacccgcttcggcctcccaaagtgttgggattacaggcgtgagccaccgcgcccagcccccttttatctttttagtcagtttaaaatattttgttttagtctccttcagttagttctgtcatctcaagttcttgggagcttttatccttcttttgttatatttgtcatatctctctcatggtaaatttttttcttagtcattttgtgattttttgattggcagcaatgtttttatttttttctttgggaatcctgtaagggctgggatttggaagggtccctcctgagcaaattttggatatgcgtttatgagcttttctcccccaaatgccgtcacctcttgtaatcagcttttatttgaattgtttgtcttgaggattcctgcatgcctgaggcagtgtactcttagactgcaagcatgggcatgataggctcttgtttgataggctcgtgtttctctttcttgaaaactttttgaagagactgaaaagtctttgctctctttctggataggttgttgtggtttttctctaacccctgacactgaaaatacagctttttggagatcccagttatgcaagggtctcagttccacttcctagctctgctatgaaacctaaatcctttcccgttagggactgttctgatccaggaactccttccccacctgctcatgggaccccacagcaccagctgtatgcttacagttctagctttcgattctcctttcatttctgacctgtaggaatttcccatagtttttctgtgctcacttacgtatttaaataaaatgttacagtcttttcagtgttttaaaatatttgtagctgaaaggattctgtggtagctcagttgcccatgttccaagaaccctctgtggtgggctaaataaccacacactccaaaaagtcgttcatatcctaatccttgaaacctacaaacacgttactttacataactaaaaggactttgaagatgtgattaaatgaagaatcttgagatggggagattattctggattatctgggtgagctttatggaatca

SEQ ID NO: 41548 - DNA, 1050 bp, Homo sapiens
ttatgttaagggaaatccaaattcccaattttttttggtctttttaggaaagattgttgtggtaaaaagtgttagtataaaaatgataatttacttgtagtcttttatgattacaccaatgtattctagaaatagttatgtcttaggaaattgtggtttaatttttgacttttacaggtaagtgcaaaggagaagtggtttcatgaaatgttctaatgtataataacatttaccttcagcctccatcagaatggaacgagttttgagtaatcaggaagtatatctatatgatcttgatattgttttataataatttgaagtctaaaagactgcatttttaaacaagttagtattaatgcgttggcccacgtagcaaaaagatatttgattatcttaaaaattgttaaataccgttttcatgaaatttctcagtattgtaacagcaacttgtcaaacctaagcatatttgaatatgatctcccataatttgaaattgaaatcgtattgtgtggctctgtatattctgttaaaaaattaaaggacagaaacctttctttgtgtatgcatgtttgaattaaaagaaagtaatggaagaattgatcgatgaattaagtgaggtggaattcttttctttctgctttagcttctctctgttggacttagagctgggtattgctattttagtgtataatcaagctgtggaaataaatttccagcattaatgtctattggtagtcatcctcaaatcctttcttgaaatgtttcagtggctaatattatctccatggtgagaaaaagtttttctaaaaagagaagccattaatatttatttgggaaaaatatatacgttctttcccattacgaaaaattattaatttcttgttttacattctaggtagcatgtggtattttattgtcttactaggtttttagaccgagagagggtaaatggttgatctgtagagttttagagcattttgtaggtttgtcacttccgtgactttgcaacactagctaattttccaaggaaacagaattgtgccattttca

SEQ ID NO: 41549 - DNA, 1070 bp, Homo sapiens
gttgcgcaaaaaacaaattttaaaagaagaaaagaatgcttatctttctttactcagtaaggaggttcatgaatatacatattgcatataattgctttttaagaagtactacttgtaaactcaagtaatctatatgtgtgtatgaaatcaatgggtttaaaaagtacgcttccctgaggcttggcctactcttattaactctaatctaaaagtctgaaagatcctaccaagaaaactttgtatacttatgtattgtaagattataccaatgaacaataatttcttcatcccctataatatacctgattttctattttatcatgttgttttccatgatggtaaaatacattctcctttcattcaggattcatgggtactgcatcttgtgtaaagcctgatggttctactagaaggttgagctgtttctctactgatttcacattattttattaggttatttagtaaggagttatttcccaccagtgatatatcgtaccactagactgtgaatttcttttatccagtctatctttggatccacaatatcaaagttagtatctggcagagtgaaaattaatcattgaataattgggaaagattaaatgctagaaaataatttaggttttattttgatctcagaaattgagagcttgatctgaatagaaatgttgctattttaggaaaacaaatgggaaggaggacaaggaagaggtgaaggatctagtgcagtaattctaaactagtattgacaatattagcaaataaaaatacaggtcacccagtttactttaaaatatcacataaataaccaatacattttagtgtgtttcaaatattaaacaggatatgcttatattttgaaaatgttgtttatcccttatttaaatttaactggatgtcctgtactttatgtggcaacgctggactttatctaattaatcccttttgaatgtacaacttttttgactgttatctctttgaaatgcaaatgaaaactctgaaagcctgcattaaaatgctttgcacatagaattgtgcatactatttcaggtagttgatgttggtaactt

SEQ ID NO: 41550 - DNA, 1051 bp, Homo sapiens
caccaaataaagtatttgttgaatttgatttacccatggcattatccatcttaaatggtgatttaactgttatcttttttcctaattcacattttaaaacatgaaactctaattacaatattcatgataactttcatagctaaaactatataaacctaggttcttttaaaattttaatttatggaacccctgcagatttaaacatgaataaatacaaagaatagtagcgcattcttattgaatgaatatacaaatcctggctctcatatttaatattgtgacctctttggttcaggaatttaatctctcttttcctcagatatcccaatttacagtataagatttattagattatatgaataaattaatatgatagaactttatataggatacttttatctctgcttttgtttgctttgacaactattttgaagaacacagtgacaaatatctgagattcaaacaatctaaactcattgtatcatatattatgtattttgctgctttcctgtctcttttaaatttactgatttaatggatttctctttgatcattacctagtcttgcatggttctagaatccttgcttatttggccatgaacaggtcattagtcatcattttttttctttttagggagactaccgtgggctaacattaaaatcaccaactttcagcaattttccttttttagaaaattttcaaatacagacatttaaaaatctgtagttaagtcttaagatatttcgtgagggtttgtgatctggttaatggaaatgtacaccttcatgttatagtgttttataaaacatattcatatataatattaattatattaaaatctgaagaaatttttatttggtaatatttgtatattatttttaaatcttgctcttacagccttttgacttttcaatcaatgaattttaatgagtaactcaaattcgtttatttgcttatggctggagatttagattttagagtcattttatcgtcagaataacattttaagccattaaagtgaataaaatattccagggggagaacatgtag

SEQ ID NO: 41551 - DNA, 1031 bp, Homo sapiens
ttcagcaggtaagtatatattatttatatcatttatattattatatcatttactttttatatatatttaggacacagttggccatttgtatgtataaagtatcaatatatgctgtagaatacagtatgtatttgtagctaataattttttctaatattaataatttactgcactataattcctttaaacctttatgtgattcatggttactgtgtttcttctttcgcttatcaagaatcttatatataagaaactttcaggcacgtagggtctaggggagaagatacaaaattatttgctatcaaataacttatggatagcagaggatatatgacaactatgaaatgaatgagatgctgttaaaaagtacaagtaaaatcctatgatttatacctttaattctgatttatttggattatggaagttaccctaaatcaaatggtatgtaagctgacctaaataatgtgtaacaggtgggtggtcaagaaaacataggaatattgaagtactgtaagcattagactggaagtcattgaaggaaacagacgtgtctgacttgtttgatgttattgaatgaacagtgaatagatggaattataaatatttgatatattggaagggcaagaacatcttttatggtttgagaacagattgtaacatttgaatgcttgctattctcatatatctggttctcaaattgtactgtgcacaagaatcacctgaagaccttgataaaacttggtcatccctgtgagccccattgtcagatattctgaatcagtagttcacagtggggcccatgaatttgcatttctattaagctcacaaggctgctggtcttaataacagttatatagactagagcttcaactatattatatacccagtggaaaccactgaagggttttgttacagggggtgtgtatatttcaacttgtgtttcagatgcaacttttggaaattgtgtaatggttggcatcaagatgatttaatactagaagattaggttcctaggaagatttaagtgtaga

SEQ ID NO: 41552 - DNA, 1050 bp, Homo sapiens
cgatagcatgctgtacaggtttgtagcctaggaacaaaaggctatactgtatagcttagatgcgtagtaagctataccatctaggtttgtgaacctaccctctgatgttcacaggataatgaaattgcctaaggacacatttcacagaacatgccccttttgttaaatgacatgtgagtgtatgtctgaggtggaatatctgtgtgcaggagggccttttcctccttgtgctgctattattttgatgtcagaaccatcccttggactggttgatattgttttaagcaattaaatatatcatgttcatgtttaagtgcctttgttttccctgtcttctaaatttcttccatatctttactcagtagggctctgcattctttatatgttttcatgatgattcattttagtgtcttaataaaattatattttgcctctatagaaaagattatgaactatgcagtatgctatgagctgtgatatagttcatgtatgcttgaaaatgaatgtttactttaggactttatcaccattcaggatatattgattgcctggtgtgcaaggagctgtgtgaggtgaaaatgatagggtaatggcaagcttggaaaatgatataggttttcatgttatgaccattaggaacaaggagtggttcacttatccctttagaatatttttcatattactctttgagatagatttaatgggcgtcccatggagagaggagtgaaggaaactaacagttctcagcttcaggaatatttatggaattatcaagaaccctagaggcagccataatggagccttttaaaaaggcactattttatattgttaattttaatgaacttttttgttgttgttgcttttttaaggcaatgaatttccaagggaagttaaagtatcttcatggacagaaaaagaaagggaaagatggatcaatacttccacctcagttggctttgtttgcgatagctactccacttcagccaccatccatacttgaaatccggaccaaaaattttatctttagaaccaaacacaaactagacttca

SEQ ID NO: 41553 - DNA, 1028 bp, Homo sapiens
cgtttgcttgtctttctgttttagtccttttttcccctaataaaccatttaaacttggattatctatatcattattatcatttttagagacaaggtcttgctctgtcacacaggctataatgcagcagtgtgatcatagctcactgcagccttgaactcctgggctcagctgatcctcctgcctcagcttcccaaggagctgggactacaggcatataccaccacacctggctaattttttattagattttttcttttttagagatggaatcttgctttgttgaccaggctggtcttgaacttctggcctcaagtgatcctctggagtaactgagattataggagtggaccactgcacccagcctatattatcattgttaataccaccatcatcattttcatttctggtgtttatgctttgccagcccatatttgatgttgtgtactaacgtctactgatagtctaaacacatttcaaatttattataatctgaaaaatgtctgaatattctttttctccaattgttttctttgcttatcttgcccttttaccctttctggtccagaagaatgaactagcaccatatgcatttaaacattacaactcagtccttacataagatgtaatcccatcatgacaagtttcactgctgttgccaaatccgtgaaatcgatactacaggactgtcatttagaaagacaggaattgcttcctgcaaatggctgagatctttatgcaatttgtagttctgctggagcaagacttctaagttattgtacatatattgaacctcagtattgggtatattcaattctcctttaattcttataacagtattgaatctagtagtatgtaatggttatagaggctatctatgcaaataagttgaaatcagctctgctgactagcagaaatactttagaattttccactcattttctgtttactgctagagatttaattgttgtcttatgtggcagaatttgaatgcacagacttcagcatggaagcttgccttttgttcatt

SEQ ID NO: 41554 - DNA, 1050 bp, Homo sapiens
ttgattatataaggctcttgctgcttatgatagatggttgctcctcacatatcattgcataattaaccttttctcccaggctcttaatgtccaagaaaatgttctcttcataccagtaatgtagttccactggaaagtgttctgggtgagctggggatttttcctttggagctggaatttgccctagtaattctgccttctttggaattctgtgagttctgtgagagggcagataatcatagtggtgtatgaccaagcactcaccttttatctttaactctcagaagaaattgtttttcagaaagaaatgtcaaaatgacattattcatgagaaaaactagtcatgagttttggactctctaggaatgtaaacatgtttaataaaagctggtgacagtttttcggtctgctgttactggaaagcctgcttgatttccttccctgtgtttttctggtcttgagatctccagtgctttctgaagatccaggaatgccgtacaaatgggaaaagccagactgttatcttgaacctctgtttttgaaatctctgtctgataaggaaaaaaatattgcaagtcattgtagttacttgtttggtttgtcactggaattccaaatatttgcttggtggttcatggacatgtaaattttgggatatgttactattgtttagggtatactgtctgtaaaataagttattaacccagtgactgttaactagatcttccaaaagccctgtctcctatcattttatgtgtattgaaaaattattataattagagatttttttaaactcttagaaaatgaaagtatacagctatgaaaattctgtttgggtaattttttaaaaaatttattttcagttcagaggtacatgtgcagatttgttatacaggtaaactgtgtgtcacagggctttggtgtacagattatttcatcatgtttggataatttttatgttattttttaatgcatttttatccttttgtctgtattattgtgcttccttttttattaaagaagagttggatgtatcttactttggcttta

SEQ ID NO: 41555 - DNA, 1048 bp, Homo sapiens
ttggcaccaaaagggggcactgctctcttgtgacataaaatgtagtccccgaatagtggggcttttgaaggttagtgactccaaaggaaatagtagatgaaaggaaaacgtatttacttcatctcatgggggtctttcttgccttggtcttcctgaagaaaagataagcattgggctgaaaatgtttgttatatacccttgggcaccattggcatattccaagctgtttttgtcaatcatataaatacatatttagacaatttctgaaacatttctcataaagaaagaagtcattcatctggtatatcatattcatatgcatgatggctttctagagttgtgtcatttcttcactatggcttctctcgtctcgcacctcttcagaaggcacccttcctttcttttttcagtaaataccacaattttatttttaggtgtatgcagcatgaaatgtatgtgtgtatgtgtgtgcctgcgtgtctgtgtgtgtgtgtgtgtgtgtgtgagagagagagagagagagacagagagagtttgagagatagaacagagagattgattaattggttgattgattagttggttagttggagcttttcccagaaagttttccaactgttcttattggcatatttgaaagtttaacaaaatctcattaaagttcatggatttcactgaaatctcttatttttattagataatcagtaatattataagtatacataatctgccatcccaatattttcaaattttagttctttttctatcgtattggtaagaatgttacagtttcttcctaatgttggtgataggcatctgtacatctggttttgttggaaacaactctgctaaatgtttaataaggtgctcattgtaagttaaagatagggaatctttattatattatagaactaccctggcctatgcacatgtattgagatgactgcatgttatttagcatgcagggataggttctgttttaacatattttgacctattgatgtcgtaacttcattagtagattacctagtattaaaccattctggga

SEQ ID NO: 41556 - DNA, 1043 bp, Homo sapiens
gcactctctgggcagaggaaacagctacagcaaaggttggaagtctgcttggcatttttactttagtaaaatacacataacaaagtttacaattttaaccatttttagtgtacgattcattggcatttcgtaaattcacagtgtgcagacatgactactgcctagttccagaacatttttatcaccccaaaggagaacccatattcactaaatagtcacccccccattcccaccttcctcagactcccggaaattcctaatcttctttctacttctgtggatgtctttggcattttggggaggtgaagaggctcatgtgggctggagtctagtaagtgaaggggagtttcgtaggggagaaagtcagtgaagtaatgggggctgagccggatccctggtaagccactgtaagaactatgacttttactctgaacaaaatggagaacattccagagttttataccgaggggcaaaactctatgcaagagtaggtcgtatgtgtgagacagggtgagaggcagattgactaggaggttatcagtgtaatccaggtgagaggagataatggctcagaacagggtagcaagagtgagagtgctagaaggaattgaattttagtaagattttgaatctaggaccaagagaatttgctgtaggcttggatttgggatgagacagaaaggagttaaggattctccagttgttctaacgtgagcaactggaaggatgtagttgccattaactgagacagggaagctatggctggagcaggcttgcaggggaatatagggaatgctgttttgggcaggttgagtttgagatgtctggtcatctgaataaaggtgtcaagcagttagtgggatatgtctgtctggagttctagaaagagttctgttgtggagaaaaaacaacttgggagtcattagcatagagatggtatttaaagctatgagaatgggggaaatcgctgagggattgagtgtgaactgataatgagaagaggccacgtggtgagcactggggcatattctcctttagtggtg

SEQ ID NO: 41557 - DNA, 1050 bp, Homo sapiens
aaattctgaggatggcaacaaatggatggtgaggaccttccctaagctattttttttctatactatagtaatggctgtcatttattgagcatttacaatgcacctggcactgtgctatgtggttttcttatttaatcctccctatatccctatataatacttaatattaatatcttcattttatagaaaaggaaactaaggtgcagagaagctaagctacttacccagctcataagggacagccaggattttgttccaagtctgtctgacttcttagagcgtttgtccacaagaaataggtttgttcaaacatgtgcactcgaaatgcatccgtggttttgctcttaggcttcctgaagatgaaagtcgtcagtattcctataaagcaagctgaatggaaaaccttttctctagtaatagttttcccacagtgtattttcagaatgcctaattacaagctggaaatttgtcataaattttgacaaatacagaggcgggtggggatggtgtggagttaccgctgtaaaaagtaaatattgaactgacaggtaaaaaaaaagaaatgctcttttagtaaattaaccatgcttcagtggtggattttgtttttaaggccatttgtctctcttgagtttttgtagaggagggtgaaatatatctaagtcagtttttgagaacatggagtgctgttgtaaaacaaatgataaacattgatgcgctgcagaaataaaaattggctgaatcttctgggaggtgctgaagagaactgggacatgcacagtcagacattttagaaacctggaattgacttgaagtgctttatcttttacattacgggtacaactgcaaaaatagaactgaatgtgtgaatgaagagagaggttaatttcacaactttggagttttttttcccctccaatagagtaatggtgttttaaatttttttttttcttcactcaaggggacatggtctaaaatttagagctaaaaatgcaaacatcagacataaatgattgacttgccttttatcaggcaatctgatacaatttg

SEQ ID NO: 41558 - DNA, 1027 bp, Homo sapiens
tagagatcagtgaatctcagaaactagatcacctaccatgcaatcacaaaatatgccatattctacactgttgatattaaattaatatttaaggtccatacatcactttttaatgggggcagagtgcgtaagccatttttacgtattccaagacttaagaatatgtcttgtgatttctctaagagaaattctccagcagatcagaaggatagaaccctcagtggaaaatgtatgaaaatgatccatgctgccctggacgttcacatatgcccccacccccacctctgctgtccccaactagtgaatccttcctaacacatccagatgccatggtccctgattttattggaatagggtaaaaagtttaagaactggaaattctaaattgtgtttctttataggataagaaatcagttttttgctcacacactcttccttcagggcaggaagaccttctctgacccaccaatctgggtagcacctttccctcctggttattctcttttccagaattctgtatatttcctccatagcccactttttataattgtaatgtttgtgtttgtttttactggcacactgtgtatctttttccatcttcactcttgatgataagtgccacaatagcaaaaatcgtataccctccaccaaccagtgcatgtagatatcctaggccggtgcctgacacatagcaggttctcaataaacagtcatcaaatatgaaaatacatgaataatattaggtttgagtaaaagaaaaagaaatattgttagtttccccactttctcgactaattctgaaaaaggaaaatgaaaacatgttctggaatagtttgcttccactgaagctagaaatccacattcacatttgctggtcctttcaccttcttccactgtaccaacccatatgtgtccaaagaaacataactcaaagctaaataaagcatgactccccttttatcatcaggttttctggtctgtaagtcaaccagagaagtagtaatctagaactgtttgaatgacacat

SEQ ID NO: 41559 - DNA, 1025 bp, Homo sapiens
gagctatggcacagggattaaaaaaaatgttttgcacctggctcctctatattaggtgtggaatggcagtcaagccgttgagctgctgtggatttcaattaatgcatttctaaaatactttccagaaattcaagatggtgattatttaaatagttgaaaaatactacatctcaatttggcctatctttttgtgttgaagatagaggatgtaatcttttttcatgttcagtagactgtgagctaatagttttgttaggggctgagaaatcaacatacaccttacggcactggagaagcagaaacctggcttaatttcagaagtgcaggaatctttgacagaaatattctactgtgaggaaataaatttacacaaggatcccttctcagagtatttactaaagtctgaaaagccttaatttattttatgccaaaatttatgtttatgtcatgccaaatatagttgctgatattgttaggtattaatttgtgtgccaaaagatactctttatactgtattctctgatcacaatgtaataaagcagaaattagtaagaaaaaacagtaatacaaaataaacaacgatttggaaggaacaagccattaaaaactactgagtcagaggcagtttttaaacagagctcaactagagatagaaatagagaatgttaaaacagtctttaccattggatggggtgaagttggagagaggaaatggggagatttaggccaaagaatacaaaatagcacatgtgttggattactaattaagagatctcatgtacaacatgaggattaaagttaataaaattgtacagtattagggatttttgttaagtagattttagctgctcttgtcacacacaaatagtaactatgtgagatgatagctatgttcatctgcttcactatatagccattttactatctctctatatcccatgtcatcaggatataaacctcaaatacacaccatgaaatgtgtttttaaaacacttgcaatcataggttatttagaaaatagtaac

SEQ ID NO: 41560 - DNA, 1044 bp, Homo sapiens
agtatacatctttaaattgtaatctatcttcaagtgatattatagcatttcatgtatatcacgggaattttaccaaaagtgtgtttccatttctccctcctattgtgctgtcattgtcatagattttactttatattagttataaatcccatgctgaatttttatgagttttgtttaaacattcaagtatctttagatatttaaataattaaaaatgtttattttttcatatggttaccttctcctgtgccttttattctttgtataaatcaattttcccatttggcatcagtttccttctgcttgaaggacttccttaaacatttgttgaagtccaagtctgctggtgatgaattctttcagtttttgtatgtttgaagaagtcttttccattttctgtaagatattttggctgggtatagaatcccaagttgacttttttttttcttttagtattttgaaaatgttggctccactatcttcttggttacaatgtttctgacataaaatatctgccatccttatcttttttcttttgtacttaaagtgtgtgttttcccccctgactacttttaagattttcccctacctccatgactcttttggagaaatttgatgataatgtgccttggagtagttttattcatgttttgtgtgtgtgtgtgtgtgtttgtgtgtgcacacacacatgtgcctggtggttgttgagctttttgattctgtggatttatattttccatcaaaatttgaaaatttttttgccagtatttcttcaaattatcttctactctttgggggcttcaaatatatgtaacttaaaatgctcccacatgttgacaattctctcttcttttttaaaaaatttaattctcttttttctgagtgtttcatattttggtagtttctgttgctgtatcttcaggtatgctaatctttttttcctgcgatatctaattggctgttagtctcatccaaagtgttttttatctgacaggttatagtttcatctctagaacttctattttgttctttctaatgtctttt

SEQ ID NO: 41561 - DNA, 1021 bp, Homo sapiens
tgagatgtcaggtgaattgcactgattggcattgatggatggacttgttgaaatattgcagagtttccgtaggggcgtagaggaaaatggctgtttagaggtttgggtctcctaagcactgaaactgtcatcacataaacagaaccacttctgcaggtctgaggtgtcatcgtgcattttctggctaatctatccattcatctcaatagtccagaactcgcgcatcatgtcactctttgcctttgttctgcactttgatctttcagaatgtctgtcagaagaaaagtgtttatattgaattatgtgtggaaaggggtaggctgcatacttcagaatcttggcatgaaatttgctaaacaaaccttgccagttgctccgcagcaataatcgaagtatggatttcaatttaacgatatgtaggtgcacacttttccccttcaaaaacaactttaatgtggatgtttgggtgtaggagattttattttgttttgtttttcctgtagaaagtatgtagcacctttattgttaactgttaaaattaatgttaagaaggaagataaatgaatttttcaaaatcaacttttttccactaaaattctggttaaatgcattaactaaatgtatgccttggctgaaatatctttttgtgtgtatattttatctcactgattctaacattctagtataagatagtctattttggtatccattatatctattataatacatgtattagaacacattaggaattccacagcaaaagcaaaagcaaacaaaaataggaactaattacattgaaaagtactatacagacacaatagcagaaacaatgggtgaattattagtttctgcattctgtcacagctatccattctcttttctcatacctttttaatatgtttgaaataaaaaataattatgagatcaaggtttttttccttcatagttgtctaaaatgattaaggacatcaatttccactgatatgatgctgtgggcaagaaaatgtataatggttcaatt

SEQ ID NO: 41562 - DNA, 1053 bp, Homo sapiens
aataatgtccacttagcatttctacaaggggccttaaatatttagaaagaggctatcctttacaattataccttgtttgttaaagggacactcaaaggttggggctgtcttaatcttattactaaaattctgtaggtgtcacatttattttaacaaattaaaatagaggctggaaaagttagggttattgcaggtggtgtgattggaaatattaagagggagcatcgtctagaatccttagagatattgctcagcatcattttcctacaatgccataaaatattattcttaaaaattgtcagaggaaacaaatgttacacttcctaggagtgcttctgaattttgactcttaaacagaatcccctgtggagttcttaaaaagtacacatattgggaccctgttttggaaattctgattcagtggtccaaggggactgggcctgggtgtgtatgcatgtgtgttatgtgtggttttgtgtgtgtgtgtatctgtgtgtggaaagtttcacaagttattttaaagtatatcttgaggatcaagggctagtacaatagactacatttcatttctgttgaaattcattatttaagaactgtactctggagatttaccatgtcaggctgtaacaaggctattgctttcaagatggcaaggtaaagtcttagccgaactgttgtatggaggagcgtgtcatttctgataccaaaggacactatgcaggccaatcagcaacacaattacctatgtatttattaaatagtttcatattttagtttgaaatttttcatttaacataatttaacaaaataagacaaaacttccactgagttaaatacacaagtattcagacatttaatagtattctgactcaatatgatggtcaatgtgatttaccaaaaaatttcagtaaaaatgataatatcgtaattttacaaggtggatttaaattgatacttgcactgtttgactttctaccaaaataggagtacctggtaaaatgctgtggtgtatggagacagttatgagaaactggagggaggatgatagttgag

SEQ ID NO: 41563 - DNA, 1044 bp, Homo sapiens
tagaatatatctatactttagaatagaaacatatgtctagacatggaaagatgtccaagacatgttgctaagtgaaaagacagtgatatgctgtgtgtgcgtgtgtgtgtgtgtgtgtgtgtgtgtgtgtaacattatataatgtgtctgtgtgtgtgtgtggtgcatgtgtgtaaatgttcagaaaaagggatctggaaagatatacagaaaagtgttaataattgttaattctataatcctgtgagagggactttccctttttattctataaatgtatgaattattttcattttatgggactaaacttttaataatatttttaaaaccaacagaaattataaattatctttgcctgcattacagtgatgatgctaacagttaagggcatcagagaagtgaaaattattttcgaacactgcatagtacaaaacaatgtgtgtgcatactgtggatatgacatcatccttagtatttgtacttccatataatgtatattagatgtaactttggatgagtgtgagtaccctccacttaagcagttaatttatcttacattatctttatttatcagatctggtggctttgaataatgctaaatttcgcttctgatcatcccagagaatcaaaatgaaaaggttgccacatgtaggagttttcagtctgtttcattctctctctctttctctgtgactacaaagtgtttccctattctgcttttttcttcatctcttttctcattgtctctaattctaaaaacggttttctataaatactggaagcgcattgtaatttgacttcccaatagcaatgataaactttgaaatgcttaatattgtttaaatcaagacaacaaatgaaaccctgtctggctatcagtcttgttacagtctctcacttaggtaaagactcaagaacttttgcccatctcacgtctgcttcatcaggttcccaacatcctgtgcaccgataatgctaatatgcccaccatcaccttccccgattcattactcgaaggaaccctgggaaatttttggctcaaaa

SEQ ID NO: 41564 - DNA, 1030 bp, Homo sapiens
gattcgcaagttcctcgttcacaagagatttttcaaattgttttttattttctaaattgaatatgcagtgatgtgccatgcagaactctggttccaagttaaaaatgtccaattcaaatagctgcagggtatttattggctcacataaacgatggccctggaagtagaaccagctttatatatagctatactcgggagtcacacatagttttatccaccttcagttttgctacaaattgtgttgtcctcaaactcaggttttctggtatagaaagatggcagtggagctcaagtgcctaccttttctgagaccttagtctagtagatttccattcccaggattccttggagatacttgttgaatctcagagattttgattaactcagcatgtccatttcttaacccttgctaatgagaaagaagagaataaagcttttttcatttcatatcccagaaaatgtgcatgcagttctgctcccatttttcctacagtatttcaagtgaaccactcagtgacaatcccatcaacttatactgccttactcttttaatttaatatgaaatagaactgtcattaactgaaagggaaattgcttcagtgaatatatttgtgaagaaataaaattgcttcagtgaatatatttgtgaagaaataaaattcatgagatattataaatttgatttgccttcaaaattttaatttaacttttaaaattagttacaaaatatagttttaaaaataatctaattattcataaacttttaattgagagtttctttctgattagttgctgtctgcccctgtgcagctgacccattatatttacaaattggttgatctctgcatataggccataatagttttataaactgtaggttataaacgtctgctctaattaattttctttcatatcaactgaatttgatgttgttgaggcattagtgagttttttaaaaatagtttacatagagcttcattttgttgattagtcaaaagtattgttaaactggcttcatggtgtttgaaat

SEQ ID NO: 41565 - DNA, 1034 bp, Homo sapiens
tgtattccattcatcctgttctgttccattctatgcaataaatatttaatgagtgtttagtatgtggcaggtgttagtctatgtggcttggcatgtaccagtcaacacaacagataaaaaaattgctgctcttctaaagcttacattacaagaggaggagacagaaacaaaacagacttaattcgtaagtaaattttagaagttagtgagtgctatggaataaagaaagagttaagtaggtgggggatatcaggtgggaatggagggaaagttacaattttcaaacagggtaaggtgtgagaaactgtaaggaattttgccataaattgatctgagcgatgcattttctgatcactaagaatagcaaggccaaaggcactaggatgtgagatgcctggaatgtttaagaaacagcagggagatcagagtggctggagtagagtggtgagaggagagtaggtgcaggtgaggtcagataggaaagaaagatctgactacaaagggcttttgaaggtgttggtttttactctgagcaaaatagtcagccatggcagggctttcagcagaagaccacatgatctcaattatagtttaggaccctagcaatcctgttgagaaagacattggcttattctatactcttagctgtgaaggtagagagaattattattcatattattaacaacaaccacatacatcaaaaaaccctcaggatattttgaagatagagtcaaagggatttcctgatgaatttaatacagattgtgagagaatggaaggggtaaaacatgattccaaggatttgggcatgagcatctggaaggttagtgttgccaacaaccaatatggagaagatggcatatggagcaggtttgagggggaatgtcaggagatctttttttagatatggtaactttgatatatcttttagacatacaagtagacattgcttgtaggcaggtgggtatatgagtctggagttcatgaaagagatccagggcagagatacatatctgagagttgccaacacatag

SEQ ID NO: 41566 - DNA, 1066 bp, Homo sapiens
gaaaataactcttaaattcacatggaaaattaactttgtagttcccaaactggaatctgcaaatttaagttagttacttatagtaatagagcattagatgcaatttggaaaaatacagaaaagtaaagggagaatcattcatatttccgtctaaaatacagccatcttctgttctctacatcaccagtcattgctattagaatttaaaaactaatatgatttaaaaaccgtggtagaatatgtgctcgataagggctggaatttttgtctttctttaaaataccaaaccccaacatctagaatgaagcctgggactttaagaggcttgataaatctattttgactacattgcttatatatatatatattttttaaatggttatcatagtgtaaatatcacttttttcacttaatgtgacaacttttttaatgttcccacaaacattatttttaatgaatgcgtagcttttctaccaaatggatgcgacatattttgctgagacatttccttgtagttggtgatttcaataacaatactagaactctagtaaataatacgacattgaactgtttttttccctattcagtattgtctcctggagatataatcctagagttggcaaacctgaatcaaatggtagaaatatgtaacacttcttgatacgtattaccaaattggttttgcataagttttgtaccaattgacagctccacttgccataaataatcgtctctttggtcatacgcttagcctatacaatggggcattgtacacatatatgtatacacgtgggtcatatatatgataataatcaatgatgctctattttgattcataatttgcaattctttactagtgaaggtgattttcagttgttgcattcttttatttgttttgatctagatgttttagtatttttattttctaatgtttagtagaaattgtgtgccattttatttttatatttgtttctaatatgtttgttttgttagctacttactattgatggtttattttaatatataagaaatttccatttcatataataaaaaagcaaaaacaaac

SEQ ID NO: 41567 - DNA, 1058 bp, Homo sapiens
ataccacttaattttttcccctactgaatcattcatacttagtttagtgattctgttgggagcaaagagcaaaaccagcagctttcttatcaccatgagaaatggatctggaggggttatttggtgtcctcttcagaaacaagctatttgattaagtagctgggtttccaagatgtgcatgctcctgaagaaaagaaatgtgctcttctgtggtcaaaaaaaattgtggaggttgacccatcatctgttagaaatgcacttgcagttgttttttccagaaatgctcatgactcccagccccaccaagccacccacagacatttgcttgctctcacatttgttttgagaataataacattttataatgcttttgttggattacacattatgtggaatttgcgttgcctttttgtgactaatattgaataactttgcttcgcttaattcataagtaagaaccataagcaacatacagtgctgaaatgtttaactcgtttattcaagtgccaacacaaagtaattacaaaacaattctgggacgcaaaaccaagctactgttgtcccttcagggtcttctcggcagttccaatgagaaaagtggagagcaagtttagtgcagaatcttatgatgccaagaagcagggattccagcatatcttcttgcacacataggtgactgtaaaatacctctttgttttaaatcaaatctaagtaaggaaatacattcatctgtggtgaaacactttggaatgtgcaggttttctgatatcaagactgcaaagcgctgaaaactgcaagttaatggaaattcaattagacatttgttttatagagtagtctaactagatggcagcacgtaacagtgtactgttttgcttagtttgcaaaaaaaaattttatgtgtttgtgccttagaatctaaccacaaaacagagagaaactcaaacagggaaccctgtgaattgtctctaaaggatatggcagtcttggaaagaagtacaagtgatctagatttgatgagtaaaccaggctacattgtcattgttctaaaagatatt

SEQ ID NO: 41568 - DNA, 1052 bp, Homo sapiens
gaaaaagaaacagtggaggcttaaaagagcttgtttctttggagtttaattcttttaaaagtttctttgtttgtgaagttattcaattatttaaaggaaaacatgcttctctggggcttctttggttatctattgttactttggcagactgaaggttttgcacatccttcttcttcctagtcaggtgtggatctccaaaacagattcatatttgagaggggtgttgaagctctttgttgtttccaattttatgggtcatactcataaaggacaaagtcaagtgatgacaacaggggcacatttatttatttatctatttatttcttcaacttaaatggaggataggacaaatatgttactaaatactttctgcacatccactgctgaaaagctacctaaatatctgagaaagggataaatcttggcagttatacatttactttgtgggaaactaccttgttttcaaccttcttgcctcctgttgtaccagtgctccaactctttctgaaagcttaagttagccaaattatggactgacttacaactctgaaaagtttcaaacaaataaacacttaaaaactttgggtgaagtaaaaggcgagagtctagctattactaagattttttgttcaggtaccaagacctgtcagctagttgtctggtctatggtgttcccacaccacagtccatttccttctaggatgttagtccctccgtctgcatttctgaagactaaaatgtcagtttctcatttgtagttttaactgcctgctttatggtaattggatctgcctatttccagcctcttcatctggctcttggcttcagactgtcgggatttcattacttatatatgctttagcttatactgactaaaaattgctgcatctttcttcagactctacatcactccccgctctaaaccttgctgagcttttctcagtacctgacacctactttgcacttttaaacaaagtcctgatattttaaaaataacataaatgggaaataatggttcctgaaataaattatagtctttagcatttacttac

SEQ ID NO: 41569 - DNA, 1102 bp, Homo sapiens
ctggcttttacccataatcgccacctactggccattcccttgaactgcacatcccagtatataacccgtggagagaagggcataggtctatagaagcaaagcccaaagaccctatccaacatcctctatagtcacaacccctggagtaatgggaggaagggaaggagaaataaatacaataatatagggaaagaagaaagaagagaaatcctacccacatgaaaataattacaaaaattaaaagtgccatcttcttcagatgagaaggaaccatcataaaaattcttgagaaatccgaatgtactgacactaccagaggatcacagtagctctccaacaatggttcctaaccaaaatggaaactgagaaatgaaagataaagaattcaaagcatggattgcaaagaagctgaatgagatccaagattgaaaatcatcatcaacaacaacaacaacaagtgatctaaagcaatccaggaaatgaagaaagagataaacatcttaaaaagaaatcaatcagagcttctggaattgaaaaactgacttaaggaatttcaaaatagaatggaatgctatagcaatagactggacaaagcagagaagtaatttcagaacttgaagaacaagtctttcaaattaaccctgtcagataaaagtaagaaaaaagaattttaaagaatgaataaagttttcaacaaatatggacttatgtaaactatcaaacctataatttattggcattcctgagagagaagcaaaaaaagcaaatgacctggaaaacacatttgtcagagtaattcaagaaaaattccctaatcttgcttgagagagatacatgcagatacaagacatccagggaacacccgcaagaccctatacaaaataaacatcaccaaggcatatcattaccagactctccatgggcaacactaaagaaaaaaatcaaaggcatttaaaggaaaaggtcgtatcacttacaaagggaaccccatcaagagtagacttccaaatagaaaccttacaagtaaggagagattgaggacctatttttagcattttaaagaaaaaaaaattccaatcaagatcttcatatcccaccaact

SEQ ID NO: 41570 - DNA, 1063 bp, Homo sapiens
cgtcgctctggaggacctggtagaggaagtcgatgtacctggccgccagcttgagggtctgaatcttgctcagcttgtccgagggcagcgtggggatgatcttccgcagcgcggcgaacgcctcgttcagcgactgggtgcgctggcgctcccgcacgttggccatgacccgctgcgtctgcagctcctcgtaagactgcggactcccgccgccgctgctgctgccgccgccgccgcccgcgccgccgccgccgccacagcccgcagacttcttgccgcgcttgccctgggccgggctgcccggctcgtcgccgcctccgacgcccccacccgcggctccgccgggccccgcgccgccgcccgcgctgcgcctgctgctgcgccgcttgcgtcccccgcgcttgccgctcggcggctgctgccggtctggctcttcctcgctgttgctcaggctgtcgtcggccggcgagactggcgagctggacacgtcctgcatcatctctcgagcggcgacgcgtggcctcgcgggcccggggcagaggagaagagcggggcgcctcagcccgccagcttcccccgcgcgcggcgccggcccgggcgatgcggcccgcggaggagagagcaggaggacggacgggagggacctccgcggggagggcgcgcgggggaggcggggagggaggcgggagggggaggggacggtgtggatggccccgaggtccaaaaagaaagcgcccaacggctggacgcacaccccgccaggcctcctggaaacggtgccggtgctgcagagcccgcgaggtgtctgggagttgggcgagagctgcagacttggaggctcttatacctccgtgcaggcggaaagtttgggggcagcagtgtcattggcctgacgtgaggaggagggacttttcgaagttttataggaaagtttccgctttccagtccccctcccccgtcccacctcccttcctcggggtctaacaattcgtcctcccaaaccattcaaaaacgacctggcccgggcggccggcccctccacccgcctcctagccgccctccc

SEQ ID NO: 41571 - DNA, 1023 bp, Homo sapiens
caactagaaagttttaagtccatgtgcagcttttaaaaacgattgttccatcttttggggcatcgaaagactacaaagtacctgatttcagcttgctgaatgatctgcttcaaattgtaaacactatgagaacatttttttttttttgagacggaatctcactgtgtcgcccaggctggagtacagtggcaccatcttggctcactgtaacctccgcctcccaggttcaagcgattctcctgcctcagcctcccgagtagctgggactacaggcgcgtgccaccacacctggctaatttttttttttttttttttttttttggattttttagtagagacggggtttcactgtgttagccaggctggtctaaatctcctgacctcatgatccacctgccttggcctcccaaagtgctgggattacaggcgtgagccactgcgcctggcctgagaacattttaatagtaattttataggagaactaatttgaatgcttctcatattctcaaaaagagtggcctggaaaggatttctgcaaacaatatttagtaggaattgttttaattgaaagcaaaattgcatgtagaaatcacctgtgccagactcaaagtagcctggctctgcttgtgtaatgcctttcaaatggggtaaaattatggtttgcaaaagtgacacaataaaattcaactttgataaaaatttttatagaatggaatattctcattaaattagatgttgtaggtaagtcatacttaagcagaaagctttttgttgccattattattgaaaaacttacaaaaatcaatgcatacccttcttcagtaaatagggtatcgtgattacaactgatgtcatatttgccaggagccacaaactcaaacatctgcagggccaggtaagaaagataagcaagtgacataggtcaaggaaagcacatccaagagcatatcttgcctttaggaaaggcctccaaatctctcttattaagcagtcatttgttaaaaactgtcttttcttgagcag

SEQ ID NO: 41572 - DNA, 1044 bp, Homo sapiens
ggtgatgtatggctgtgcatggaattgtaaagtaatctgaaaaatgtcagcaaagtgtcaagtagagacctgtcttcctggtgacctttgtttggtcaaatacctaattgtttggcttttagctttgtgtaatctgtgaagtaggataggagatactaggaaattctttcaatattgtattttctagaaaaaataatacaacaaagacgtattgataatctaccacactatctacgttgaggtatctggaaccacagtggtatgaattgcactatctccctaatctttacactaattctggctaaaagacagcatcagctcaaattttcctgatcagttttttagcaggctttggctgccaaaatctcttctgtgttttaagtctgaagcaattacagttgaatattttgttgttgttcactatgaggagtatatcggttttaggtcacaggaatgatctagtagagatgtatttttctagtacacttgatagtaccttgaatatgtacagtacatgtaggcccattttatggacctctgaggcacagttttttcctttttaagttattagatatttctgtgatttatttgatgcactcagatacaaattcatgctataataagttaaattgtaacataatatctaccttaatcaaatatttatagtttaggccaggagcctggcaaagtaaagatgacacagatgaaatgcttgataagtaaataaatatgagaagagatatatattaaaacacctgtgaagtgaatcccctgtgaagaaaagaaggtctctaacaatataaacctgtatcaggaaaccctgtgattctgattctgtgcacagaaggatacatggaattctcagaccttttctagttgcaaccttttaattgtttgactttatattctgtcctctcaaattctccttagactgtgacgtgttaatgctctcttttatattttctaattaaattccatacacattaatttgagaactgttggagagtattgtgaaatcattgagctaatgggtcacatcacgtg

SEQ ID NO: 41573 - DNA, 1056 bp, Homo sapiens
cttgatgtctgcaagtcaatacagttaatctaggcctagtttgcagattttaccccattgcctagcttagtaggtgcttgacaaatgctctttgaactaaggtataaaagatgatggagaaaatagcactttgtaattaggagtaatgccttggaatggttttaatgaagctaatgaaacaactttgttttcattaatttcttttggctttgcatttgtaagacactaagagtgggccgggtgcagtggcacacgcctgtaatcccagtactttgggaggtcaaggcaggtggatcacctgaggttgggagttcgacaccagcctgaccaacatggagaaaccctgtctctactaaaaatacagaattagctgggcgtggtggcacatgcccgtagtcccagctactcaggaggctgaggcaggagaatcacttgaacccaggaggtggaggttgttgcagtgagccgagatcgcgccattgcacttcagcctgggcaacaagaacgaaactccatctcaaaaaaaaaagaaagaaaaaaaagacacaaagagtgagacaccaggaacttttctgtcttgacaagggggagaaggagcaataagtacccatatcgcccttttataaatgagccctgaaagttcagatcttttactttgtgtccccattcatctgtaagtactttcttggtcggttcatgttgttccccaggagaatggtattgtttaatttgtggggaaaattttgctcgaaatttttatgagaagccttgaaaaattagtagctttgacggaatgtaattgctagctcaaggacaatgagctaaaactctccaccatccactattctcattttactcttcaggagattaagggaagtctagatgacatgaacagaaaaaagtaaaatcatacaaggtaaatctaatgaaaccagtacttgaagctggggagcttcatacttcgttttatgaaatgagaatgttagcaacaacctagggggatcctcttcccattaacaacgtgttcagtataatgtgtttctgtgctttggtctc

SEQ ID NO: 41574 - DNA, 1035 bp, Homo sapiens
gatcctcccacctcagcctctcaaagtgctgggattataggtgtgagccacagtgcccagccccagaattttcttatataaatgttttaattagtatgtgaaacatcaaaactgttgccctttgtgtccactgttggccagaatggaccaagttatctacaacttgtctgttccattgactacactaaaaactctggacaagtttacttatttgttttcttaagtatctaaatgaggacaatgaaaagcaaactatagcaggcaattgagaaatgaagtgaaaacttgaatttgaataacagtgtatcatatgtgttcatttcatagagatctttttccctcctttgtctcccaggtttaaccctgcgggcactgcatagcaggtgcaggtagcaaacaatctaagagaaacctcttgtatctaaccagaaaagcaagaaaaggggccttttgctccaaaaccagttccatttgcagattacactgaaatagtagcagcttaggcaccaaaaaatctctagaaaatacccatatctctggctaggggaactagaaaatagagtctgttttccaagaaatctgaggtaaatcaacatcatttttctgtcttgccacttctactctgaaggtggtcccagtcgtggtgtaagtgcagaacattatgggagcccccagtaacttggcttttctagccggaggaactagaaggtgagacaactggaggttggaaaggcataggggaaattttgagagcgatataaaagatgcttcctaattctgtgtgtagatcaaaagaagtcctgggttcaaccttgcactgggctcaaccttgagcattgcatgcacagcacagacacaaagaaccacagcaaaggcctcaagaactaaacatcttaaaaaccaccatccaattcccagcatgtgctgagcagagacaaaaagcataacaaagcctttgaaaagtgaattaatgttggaactgctgctcaaagagggcaagatggaacttttagtctgaacctaaacgggttgagt

SEQ ID NO: 41575 - DNA, 1027 bp, Homo sapiens
tgctataaaaactataaaaaagaactaaatagaaattttagatttagaaaaatacaatattaaaagtaagtttatcagatgctcagtagctaagtggagataatagaggaaagagtcagtgagattgaagatagaccactggaaattataaaatctgaagaattgaaaggaagaagattggggagtcagaaaaaactggattgcagggatctgtgggacaataataaaaggtcttaaatttgtgtcattggtctcccagaaggaaaggaaaaatactgctgtaagacaaaatttgaagaaataatggctgggacttcccatgttaggtataataggttcaggaagttcgttgaatcccaagcagaaactaaaagaaaacaatatcatattgtaatcaatctgctgtaaatcaaagataaaaaatcttgaaagaagccagaagagaaggacacattatataccggggaacaaaaattcaaattatggcggatttcttcttagaaactatggaggacagagaaagaaaagaactatcaactatcaactcaccattttatgtccaaggaaaatatcctcaaaacagtatagtaacaagagcaaagtaaagatacttccaaaggaaaactaagagaatttgctgctatcagatctgcctcaatagaaatgccaaggaagttcttcaaggtaaaattaattataccagagagaaatttgaaattgaataatgaaggaagggcaaaaaataaaaataaatcgtcttttctgttttctcagccacttgccaaaagaaatgctaaatacctgggtaaatagagcagactgtttttcctctgctgaaattctttaacatatgtctatttacagttaaaaaaaattaacattgtcttgtagatagtcattgtatgttgatgtaatacatatggccaatataacagaaagggagggtaaggaagccaatagttaaaaagctgctttgttttactctgataatatagaagttgttatatatattttgaaaagttagata

SEQ ID NO: 41576 - DNA, 1015 bp, Homo sapiens
aaactcagatgcattatgctaagtgaaagatttcagaatcaaaagactgcataatatatgatatcatttatgtgatattctggaaaaatcaaaactataaggacagagaacagatttgtgttttctagggcataagcaaggaggagggagagttcaactacaaagagacactacaaaggaatttttggaagtgatagcaactcttctgtgtgtttattttggtggcgattatgtgactgaatgcatttgtcaaaactcatagaactctataccaaaaaaatgaattttactgtatataaattaaaacataaatgttaaaaaagtggagacaaactcattttgagagactacagtgtaaaaagggagagagatttactattttatattttaagaattcagaacagttttctgttaagcctcatgtgcatgcctcagtatcaggcaaacacttctgttaactctgccaaggataataggatttagagccaaagggactcctgaaaattattttgtgcaaccccatcatttcataaataagtaaactgaaggctcaagaggctaattgtcttccaaggctctaaatgtagttactcttgctgctttctagattttctctttgtctttgtctttcagcagtttgattataatgtgactcgatgtgactctctgcatttaacctactcggagttcattgagcttcttggatatgcagattattatttatttatttttttttcaaattggggaagtttttacctatttttcaaatattctttctttaaacaccttggaactaatgagtctctcagcctgtgctgaaaggttctgtgtgcatgttgcagcttgccttcagcactcagccagtcatttgacatctctgccttagccttcactttctgcttacctagagcctcaggattaggcacagattagttagggccttctcatgctattctgagcaggctcacagcactaaacgtgtgtgaccttctaaacatgtatgaccttctagatt

SEQ ID NO: 41577 - DNA, 1050 bp, Homo sapiens
tttgtttttagttataagattttttttttggtgtataatgaactggtataattggcatgcctttaaaaggtgatatttccacaccagtaatgctgtgaaattagcattataaaagaacaaagaaaactgtatactcgctgcatactagggaagagccgtagaaggaccttgtttatagggcaggcaagatgccaggttttgtttcttctgctagcaatacagctacaagttggatatagtaaatcctgcttgttaacaagaaaactacttgaactaattatcttgctcttgttttagattccaagagatgcaaaccataaacttgtttttatttccaagaagattactgaaagcattggagtaaatgacttttctcaagtggttttatttggagagttacctgcgttgtctcttggacatgtatctgctttccttgatgaggtactggtctgtctttaatatttaaagctttcacttatctccatgacatttgaaattatttaggacaactccgataattaaaaaaagaagagctaggaggggaagggaaggggatgggggtggttaaaaaaaaaaaaaaaaaaaaaagcttgtagaagccaggagtctctagccaggtggatggagtcataacatctagactgttcctgaaaggagctcatgcttactgatgctaatattcaacaggtggcaattgcagggatcattctctccctttcttccttccaacacaatagaagcaaataaaaagcaacttgaataggttcttgcaccttagcagcaggttttaagcttcacattcagagtagagacaaatttacactttgaaaatgagtattatcagttcctttttatacttgttagaaactaacagttaaagactaagattcactcatggcagataatgggaaaaggtgatgaaagtgttagaaatggttcttaaactttctttttctcctcttaaaatagagaaatagtcttcaaccaatgttactgacactttaatgtgcataagaactgcctggggattttgtgaaagaggttggttca

SEQ ID NO: 41578 - DNA, 1048 bp, Homo sapiens
tttttttgattacctcttccacagtggaaccatgagtttcatttttatttatgcttttcttcctctctccctacaaagaccttctgagcctcccttagtaatttcttaattggtttctcattccatccattaatcctttgtaatttttttttaatgtcaggccagctctttcttacaaagttaaccttcaaaaggccttgccctactgggtcctctggatctaatctggagtattttcttaactagtctctgaccctgtgcaggaatgcggaggaagtttcctcttttggtttttgttgaatctccaatgcctttgagaccttttgtgtcccagtagtggactttttgatcctttttattattagttccctgaggttctgcatttgtgtctgttctctgggattttttttttttttttttttttaggggaagtctcactctgttgcgcaagctggagtgcagtggtgcaatcttggctcactgcaacctccacctcccaggtttaagtgattctcctgccgcagcctcctgagtagctgagattacaggtgcgtaccaccatgcccagctaatttttgtattttttagtagagatgaggttttgccatgttggctaggctggtcttgaggccctgacctcaggtgatctacccatctcggcctcccagcatgctgggattataggcatgagccctgcacctggccccttgggatcattattatctcgtttgggattgacatttggaaatttttgttcagctggcaagacgtcttgcccagcaggttgttacctctcccagatggttatggcccctctcctaatcattcccctttcttttcctgtgaaaaggatacttgtgatagatatcatttcagcccaggtataaaaactggattctaggaattggttcagctggtttgctaaacccaggggatgttttagaagtggtttcatttccttcttgaaattcctaacttcagtacttgtaagaggagcatttacaaagccagtctctccctgtctatgggagcttccctaagagggaat

SEQ ID NO: 41579 - DNA, 1052 bp, Homo sapiens
atgtaaactctgatagagggtatggataatatgtttgatcctttctagggcttaagccaagaccctatcaagcaagtaagtgggagattgtgcttataaacagctcttttgaagtaagacagatgttctccttgcttctcagaatattttaggccaaagcattttgtgggcataaattagcctaatatcagtgtcaatgctgtatttcagcttactcgtgaagacctggtctttgtgctgtaagcaattaagaaagacagaattcttaagtgtatttcaaggaaatgtaaaaacaaagtgttcaatgcacacttatgtatatatattatgatgtttataacaaaagtgtgaaaacacacatgggaaagattgaaacttactttggggtagtggttttctgggcaggcagaaagagaaatgtgtctatgtgtgttactacttatttctgaaataaaataacagtatctgagaaaaacaaaacaaaaaaaacactggccattatatataaaacagacctaagaagactctgaaaggtgaaaagaaaaaggcagagtggctaaggatattgggactcaagaaacaacaacgtgatgatgagttccctggattttcctgttgcctgaagtaatccagacttggagctgaaaacactggcaaccaggaaatgccagtgggcacagaccagaaagaagcccagtaaaagcctgatctctccctagccaaaggctcaagaaggagagagcttaacacaaaagaagatttgtaagccatcaactgtccactctagccaaacaccatggaagaaactgtgtcccacccctccccttgccaggaagagctgagtggggagcctagacttacaccctttctgtctgaaaatgctccaactcccacccttgctggggtgatgtcagagatgaccacatagggagccatgattttcatccctgctggccaggaatgaacttcattctctgtggtgtccggagaccatgtgggaatcctggatttccttcttcacccagcctgatgttggagcaaacctgatggag

SEQ ID NO: 41580 - DNA, 1067 bp, Homo sapiens
tttactgaacaaatataagatgagatcctactgtcataagcttggcgggggtgtggcatcatcttacagcttctgtgtagattgccttccatggtgacttgtacaaagtggcgtttaataagtacttgaggctaggtggagtgactggtagttcaagtaatgaaataacatgctgatgagggtaaactgctgcaagtgtaatggcagaggaaaaaattacaaggctgtgtacttagaaaaatattgcatccatagggatagaatgatgagctcagaccatttactgttggtccctgggaaaaaaatatttatagatggttctctgaagacgactattccagtacctgctattgtcacagacatggccaggaagggcaccggaactgagcgctattctactctaatataaaagtatagtactttaaaatctgaagtgctggtgctcaccaaaaaccaaaaccaaatactactgaatggctctctaaaatttacatgaaggtaaaccgaagtgtgtaaaaaaaattgtctagaaaggacttcagctttgaaaagtattaaaatgtgaagtgtatatggtttaggtggccacagatttttaaaaatctttgaaagaggcgcacctaggaaaaatataaatatgtactacaccgaacaatggcaatggtgttatgaaaaactgtattatgcaatgaaagagaagtggagcaaaattaaggcaaaccttgcagatctcagatgtgatatttagaaagagaagcatgtggtgggaattactctttagtcttgaagtcaatgtgaaagaaaacatctctactcttcataaaatagcttttagttttactgtgaacaaagaagcaagaggttgaaatgacctttactctcctcctggagggtggtttttatacattttgcatgacaaacaattacaataatgtatactgcctaaaacattgagacttttcctactactttttggctttacaacctcgcctcagagtattttctctatgtattttctcttgaaaacttggagttaaggaccgctaagctggtgggcaagatgtgat

SEQ ID NO: 41581 - DNA, 1064 bp, Homo sapiens
gcttaataactaacatattataaagcccacacagaatgatcagataacaaaatgacataactttcaatggcgtattagctgatgagaagctacacactgaagcacaaacccgaatgctagactgcctggtttcaaatcccagctccgccactagctgttacgaatttgggaaaatcattccctccttgtaactcagtttcctcacctggagtgtgtaataataacagcacttttaaagcccttaacacatagttcctgggacatagcactatagaaacattggttatatacaaataaatgttttggttacatcattttgcttgcaaggaaagagctattttatgctagcacacagaagaatccacattgggtagtaaacaagacaagagactaatgggaatccaaaatcagactcactggataactaagctttgtgaacaccggcagtgaaggtaagtttgaaatctagggggctccattgactgagcaagaggagtttgtgagactcgactcctgctttgctggtcatgtgatcctgttcagtctgtgtgtctgctttctcctgtcccactatcagttgacttcctctgcttgctagtagtttctgctcactgataattttagccagcatggattcagccaggccctgactctgagaaagaatcttattagctcaaagcattgatttgagccaggacagtcatccacctgtggagtggttgtccttgtaacagtcaccactgtagccccaggacactgttgggggtggctgggtcgtgtggatgtaccagcggccataggcatgcagtcatggtgactggcacatctggtataattattcatgctgtgacctagagggccttaatatggatatatggatatttatatctaaagaatacatatgtaggagggaagaacaataacaagtatgtgaatcttgtttctattcttatatctgcaaagcatcttctaaaatgttacctggaacccaacaggaaataatattagctgtgaacggaaattgcagacagacagtggttcctttctgctgagaaagggaaatt

SEQ ID NO: 41582 - DNA, 1471 bp, Homo sapiens
tgtttttacatgagttctcataaaactgtgagtttctaagttttggcttttttttttttttcagtgactttgcagggttattgcttctctttgtctaaagcttagtttgaaagcaatggcagaaatatttctcaggatattgtgtctgtttctccaccttctctttcacacactcggtagataaaaatcaagttgtgaagatctgtatatgctggcttttgtatttggtatgtggagcacataaaaaccctttgtcctacttggcaagaagaaggttactcaagctgaatgctttattgtaatctcccaaatcctgtggatagcgcttaaagattaaataagttttcgtaggttatactatcatttttttttctgacttttagaaaaaaaatgatcatttacttgattttttttaagttgtatttttaatttgagaggatttcacatgaactgtaatgtttgtgttttcagccagtgcacaaagactctattagccttttcatggcacatgttcacaccactgtaaatgaaatgagtaccagatattaccagaatgagagaagacacaactataccaccccaaagagttttctagaacaaatatcactgtttaagaacctgttgaagaagaagcaaaatgaggtatccgagaaaaaagaacgcctggtgaacggcatccaaaagctaaaaaccacagcctctcaggtatgaccaggatgtgttattactgagtaatatttatgctgtttaacagaaaaatatatttccttttgaagcactactaaatccatttctataagatgccagctggtgaaatttacagtttcatgacaccaagaatacactgctactgctttcaaaagcctacaatgggattggccgactcacagctggattagggtgaaacgttctcttcctggcctgactcagtgtaaggtagtgtgggatattgaagggagcagacacagcggattgcctctcttgtctctgacttcttcagtgcacggtacttgtcgtcaaggttcttatcatcctaggatggaccagtatcttttttggtctcagattctcaacctccagtgagggcatcattttctggctaatgactgtggcgagatcccaaggtagagctgttcctcccttagtgacttgtctgctcctcttacacatctgtgtcctcagtcctgaggcccctgctccctcgaagggcgatgcctctaacttgcaggagtaaatcaggagagaatcatcacaggatgttaatcatgtgtgggtctgtacacatattatcattatttcgttgttaaaaaaggatttcatgaagtagttgttactactatagttttatatatgaggcgtaaagagtttaaggccagagagccagtgaggttgggttttagacccaggtctgtgttgctctgatgcccatgagttgtccatggcactgtgctgcctctctgtggctggaaag

SEQ ID NO: 41583 - DNA, 1020 bp, Homo sapiens
ataaattagacatgtatctgccattcagattattgccaatatcctttaagctacctttgtgctcccctccttgacaattctgcctccacttccaaaggtagccaatgttcacatattggaatgatgtatcagttccataaagtctaacagacaggacatagtaaatattatttacttaatatttttaataacatacataaaatatatttttaattcagtaaataaatatgtatttagtcaagtttctagaatgtgacaggcatatgaagatcaaagatctgtcccattaaaagataaataaaagatctaaatagacatttctccaaagaactacaaatagtcaataagcacatgaaaatatgctcaacatcattagtcatcgggaacatgcaaatcaaagacataggaaggtgaagattctgaatgttgcttatcacttcattgttttatttaaaataatgttttaacacgtgtgtgtattctgaaacaacatattcttttggagctttataaaaataccattatggtgtatatagtttaaaaggacttgattttttccctcaatcatatgtttctaagatttaatctacattgctccttctggctctagttcttgcaaattcgttactataatattgtttttgaaacagagtcttgctctgtcatccaggctggagtgcagtggcgggatcttggctcattgcaacctccacctcccaggttcaagtgattctcctgcctcagcctcccgagtagctggaattacaggcgcctgccaccaggcctggctaatttttttatttttagtagaaacaggtttcgccatgttgaccaggctggtctcgaactcctgaccttaaatgatctgcccaccttggcttcctaaagtgctgagattacaggcatgagccaccacaccgggtctattactgtgatattcaatgatatgactgactattcctcaatttatttagcgttcttattgaaggccattttggttatttttagatgttttgctat

SEQ ID NO: 41584 - DNA, 1050 bp, Homo sapiens
ttgtgaaaactgagcaagtgcccagaactagaaacttcccagccccctgaactcagcctcagggtaagcgagtttaatagtgcttcctttgattttcaaatctgtggaaggtttgtttcagtttttcccagacaaatattgttgggatagtgtttcttttcaaaaatggataggattcaatgctcatcagtgggaagatagtgactcctgaccattttcctcctagctggaaactacagaagactcccaagtatcaggaaatttggagaatttgtacaggaattatattcagagatagcaatttatttactcatcaaagagagctattggatagccaccataaagaccactcattaaaaaacaaaattgcatgatattcttaacattgtctttcactttttttaaccaggcttggtggagtttcaagatgctgatgaacttaaggtatgggccgagtggaaagaatttggtttaagttattaatagttgaattgaaattgtggccaaggatgagaactctaatctgattttatgtgcttctgctgtgatggattaaaggatttacctgaggccaaattggtatgcaggaatttattaaatggaatcataccccccccccttttaaaattacgcttttggtaaaagggaaaaagctcttggtaaatggataatactactaagccaagagaaagacaggattttgagtgaaaacataaatttagatgtcacaacattactaaagcaacagtgtgtaagatactggacgattttatttacttacttgcacagtttttgtaaacagtctagacagtactgtattttgctatttagtaatacctactgtgatacttcttttacaggtctggcgcttgaaagaatcagtgaagcttttcaagtagaggaggtatatttgaatatgtaacctttagtatctacagaatagaggttgcttttttttttttttttttgtccctttcacagtggtagcaaggttgaattttgagatggccccaatcatctataggaatattatttgacagttttggagac

SEQ ID NO: 41585 - DNA, 1060 bp, Homo sapiens
tggaattaataggggtgagccaccatgcccgcccagtatattctttttttttttttttttttttgagacggagttttgctcttgttgcccaggctggagtgcagtggcatgatctcagctcaccacaacctccacctcctgggttcaatcaattctacctcagcctcccgagtagctggaattacaggcatgtgccaccacacccagctaattttgtatttttagtagggatggcgtttctccatgttggtcaggctggtctagaactcctgacctcaggtgatcagcctgcctcagcctcccaaagggctgggattacaggcgtcagccactatacccagcagtatattcttaaatattactgttgagccatatatacgacaatggtggactttgaatgtccgcacatctgtagtaaaatgcaatgctaccttcattttttgttggtatgctaaagaaattttaagtatctcacttttaaaaaaataggtttgtgtattttatgtgcttacacatttttccatagtactgtagatcattttagtgatgaaatttgatacttttgacagaaaaacaggtcagtgagttccttgggatcaaaaaggggttgattacaagggcaggaaggaattgttagtgtgattctacagttctgcatcttgattatggtatgactgtgcgtttgtcaaaccttaacaggatgaattttgctgaatgtaaaatcatacttcaataaacatgactttaaaaacttaaccctccttggcatttcagtggtgtttccagtgaaatctatggcaagatggtttggggtcactatctacatgaactgccaagttggaaaatcaaaaatacatcaaaatcactcttgggacataagtcacggaagtgactcatgcacacaataaatacccaagaagcaggaccagacggcagttgtgtattggcacgctcatcagtgctgcaaaaattccccttctggatggcaacaacaatgctgtatccacagcagcattttaaatctcacctctgatgtatccattgttgtgggcatgagatg

SEQ ID NO: 41586 - DNA, 1103 bp, Homo sapiens
tgttcgaaaggcttacttttattttgtactagaaaagattgtctttccaaaatttacctcgtattcataaactggaaagttctgatggcaatattttgttacaaaattgtcattaatcacaatccaggattatgccaccatgactagaaggccccctaatggagtttatctgcactgcaaggggccagttgtctcagaatcatcctccgttgacatctccatctccaggacagctccacactaatctgtttcaaagacaaaatccagtctaatcagtttgatgtatgtttctgggaatagagccgaatgttgtagctgatggaatggagtctcataccattgattttgcagctggacaagtgccctgccatgttactgccactctttaaggcagaatagagcacattgtatcatttataggcctctcacagtgagaaatatgtggaactttggaaatcagaatctaaaactgcagtccaatggggtagccactattcacatgtgctattgagtacctaaaatgtggctagaccaagttgacatgtgctgaagggtgaaaaacaccaggagtgaagaattaacttgaaaaaaatgtaaactatctcaattttatattgattacaaattaaatgatgttttgaatatattgagttaaatgaaatacattttttaatgatacatgatgcgtattatatttctgttggacagtactggtctaaaacagttgattcactatccagtagagagaaaggtattgctgttttaccatatgtgaccttcagggaaaagaagaataaaattagcacttgaaaatggaaaaacttacagataagcagctattatttgaagggcagaaggtgcaggggtactcagcactacttagaagatttgacataaattctatactcaagttgctagtacttctggagattttaaatgaaagacttcagagtgtatttagtaaacactctgctatgcccactctacaagcatctgtgtgttcattaatcaagagcaggccaggtgcagtggttctcacagtggctcccacccagcactttgggaggccaaggcgggtagattgcttgaactcaggagtttca

SEQ ID NO: 41587 - DNA, 1047 bp, Homo sapiens
gtctggttccgtgtccccacccaaatttcatcttgaattataatccgaattgtaatccccatgtgttggaggggggatctcatgggaagtgattagatcatgggggcagtttcccccatgctattctcatgatagtgagttctcacgagatctgatggttttataagtgtctggcatttcccctgctggcactcattctctttcctgccgtcctgtgaagaggtgccttccaccatgattgtaagtttcctgaggcttctccagccatgcagaactgggagtcaagtaaacctcttttctttataaattacccagtcttggatatgtctttcttagcatgagaatggactaaaacaaggtccataggttgttcagggagcactgcacaccatccacagcccctcactccacttctgaaacattttcctaaagaagctgagtcacagtgagggcaaaggaccagaggccagcagggcagcagcgtaggctaagaatgaatgtgaatagaaatcagaggaccttggtgagaattctggctctggcattgactagcactgttgccttggttgcctttttgttgctcatctgtgaaatatgaatatttcaagtgctatctcattggaagattctatgatagtactatagaactgtacatggtagtaactgtcataatttgtggccttatatttatctttttgaatcaccatcaccaccatcatcatcagatgcactctaacttcacttggaggtatttatttatgcccccacttcattacaaaaatgtttaagacatgtttaagacaaagagaaaagattgagcttccaatctagttccatttctagatgtttcctcttcctttcctggtttagcagaggaaaaactggcctccttgtttccccattccccccccacccccccccctttcaaccacatgaagaggctgtatttgattacacttcagaagcagcctccgaacctactgtgtaggcatcaaataggacagaagtgagctgtggcaatgaccatgtcctcacatgacaacatct

SEQ ID NO: 41588 - DNA, 1057 bp, Homo sapiens
ttggataattcctagcttagttttcaccacctgtcaattctctgctgcccagaaagagtccatcaatcgagcttccacaaatgctaaaggaaccggtggcagctgatggaatcgggcaaagatcatgtaaaaaattaaacccagtaccagcctggccaacatggtgaaacccctctctaccaaaaaaatacaaaaattagccgagtgcaggcgtggtggcacacacctgtagtcccagctactccggaggccgaggcgggaaaatcgtttgaaccgggaggcggaggttgcagtgagccgagatcttgccactgcactccagctgcatgagacagtgagaccctgtcttggaaaaaacaaaaaaaaacagtagtttgaggaacagaaaaccaagctaaacagccaaaatgaatggctcctgtaaggcaaatttaatgtgagaaatagaagggaacaaattaaccgggcatggttgtgcgcgcctgcagtccaagctactccagaggctgaagcgggaaaatcgcttgaaccgggaggcggaggttgcagtgagtgagccgagattgcgccactgcactctaggctggactacagagtgagactctgtctcaagaaaaaaaaaaaaagcaaacttaaaaatacgatgtgtaaaaatatggttttacagttttttgacattcaattgaattgaaaaatagaatcgatactcttaaaactcaaaccgaagaagatcaaacaggaagttgcctcatgatacgaaacaaaaatgcaaaggaagccactagtgagaagataaaagaaagggaaggaagatacaggaactgcagtgtgaggtaggagttccagaaggaacagatggagaaagcaataatcaaataagactacgacttctttgggtttaaaaaaaaaaaaaaaaaaaaaaaaaaaaagaactttaactttcggactaagttatactgagtattaaacctgatcaatgaactaagatattcctccctcagatatattctagtgatatttttcaccttcaaagatcaaaagagagcttacatttggg

SEQ ID NO: 41589 - DNA, 1050 bp, Homo sapiens
aatcctttgtcagatgagtagtttgcagatattttctcccattctataggttgtctcttcactttgttgattgcatcctttactgtgcagaagctttttaacttgatgtgactccatttgtccatctttgttttggttgcctctgcttgtggggtattgctcaagaaatctttgcccagatcagtgtcctggagatttctccccagtgttttcttgttatttcatagtttgaggtcttagatttaagtctttaattcatttttatttgagttttcatatgatgagagataggggtctaatttcattcttctgtatatggatatccagttttcccagcaccacttattgaagagactgtcttttcctcagtgtgtattcttggcacctttgttgaaaatgagttcactgtaggtgtgttgatttgtttctgggtcctctattctgttccattggtctatgtgtctgtttttatgccagtacatgctgtttcgattactatagctctgtagtataatttgaagttgggtaatgtgatttctccagtttcattctttttgcttagggtagctttggctattctgggtcttttgtggttccatataaattttaggattgttttttctacttctgtgaagaatgtcattggtattttgatagggattacattgaatctgtagattgctatgggaagtatggacattttagcaatattgattcttccaatccataaacatggaatattttcccactttttggtgtcttcttcaatttcttttatcagtgttttatagttttcattatagagatctttcacttctctggttaattcctagttatttatgtatgtgtggctattgtaaatggggctacttattttattttatttattttatttttatatttttttgagacagagccttgctctgtcacccaagctggaatgcagtggtgtgaccttggctcactgcagtctccacctcttgggttcaagcgattctcccacctcagcctcccgagtagctgggactacagatacatgccaccacacct

SEQ ID NO: 41590 - DNA, 1657 bp, Homo sapiens
aagcccttaatcagcttaagtattagtacttgagtattaatccattccaaattgaacctaatgcctgttgccctaaagcagtggttcttaaaatgtggattcctgaatatagttgtcagataaaatatgggacatccggttaaatttaaatttcagataaacagtgtttttagtatgtgtacatgccatgtaatatttggggcacatttatactaaaaaaagtatttattgtatatctgaaattcaaatttaactgggcatcctgtatttttatttgctaagtctggcaactttatccctgaggcccttttaggagttgcctgagttcaaaaatattttctgataatactaagtgattaattgccatttttcactgtgttgacatttgcactgttggtgcagcagcattgaggagtagaactacttgtatcttagcaagaatcaaggcagaggcaataaattactagtagatgtcacaataaaaaaatgtttaatgccatttgaacttaagaacttcctttatgaagagataaaaattattaattttgttaacccttgaccctgagtacgcacctttttagtattctgtgtgacaaaatgggaagcacacaaaaagtgtgtctgccccatgcccaagtgtgatgaacaatcttgtgtaattgttcaagttggactgagctagccacttttttcaaagacaatatttatttgaaaggaatgacaactatggttatttagaagaaaacagttgatagtgtttattgccaatgaaaaaaattaaaactttcaagcaaaaattgaaattacggaaaactttgtcatcgtgagcatgatggcttctcagtacttaaaatctcttctgattaaatggatggcaacattcacaaatgtgagggccacacgcagcagctcatgcctgtcatcccagtgctttgggaggctgcggtgggagaatggcttgaagccaggggtttgagaccacctggacaatatagcaagaccttgtctctacaaaaaatacaaaaattagcctgagtatgatggcatatgccaagactcttagctactctggaggctgaggtggggggatcacttgagttcaagagttcaaagttatggtgagctctgatggtgccaccacactccagcctgggtgacagagcgagaccctgtctctttaaaaaatttttttggctgtgcacggtggctcacacctgtaatcccagcactttgggaggccgaggtgggtggatcatgaggtcaggagatggagaccatcctggctaacacgatgaaaccccatctctactaaaaaatacaaaaaattagccagacatggtggtatgcgcccgtagtcctagctacttgggaggctgaggcaggagaatggcatgaacctgggaggcggagcttgcagtgagccaagattgtgccactgcactccagcctgggtgacagagtgagactctgtctcaaaaaaaaaaaaaaaaatttttttgatgttgtataataacgtgccaatgtttagaagttctgcataactcagtgaactggcatttttcaaatgacttatatgtgatattacaaaattatgcatggctgaaagtccattctacatgcatgataaaccagtgaatgttaatataatgccacaaaa

SEQ ID NO: 41591 - DNA, 1033 bp, Homo sapiens
tctggttgagcacagctggaaggaataggcaattaggggaacaatatttctttagatagagtggttatctattcctgggagacagtattggaaatgagtcctgaataaagagagggtatcagttatgggaagatttggggaaaacattcctggcagtaggactagctattgcaaaggccctgaggtaagaacaaggttggcagtgtttacagactagtggggcctgaattactggaggagagtaaacaagggaaagtaatatgacagtaaggccagagagatagccaggggccagatcatgttgggcctaattgcactgggcaggcagccatgaagaactttaagcaaaagagggacgtgatctgattagaaaaagctaactcagcatgctgtgtgaggggggagaaaggtctgttgggagccgtggcaaaagtagagatagggagacaagttagaagacattgctgcttgtgactagagttcatagcagtgaagacagaattggtcatatttgggttctctgttggagcttgaactggcaggatgctgattaactagatatagggaaagagaaatccaaggtgattcctagggttttttggcctgagaggtcagtaaagatggggaagacaagtcattagaaggaatccagggaaacatttagtctttcctttactctgaagcaggtgtccttggagttaataataactggattacaaggaattctttgtagaaaatatcttgaacattttttgcctttcttagtaagtttgcccaattataaaagttacagcttttgggccagatgtggtggctcatgcttgtaatcctagcactttgggaggctgaggcaggtggatcacttgagcccaagaatttgagaccaacctgggcaacttggcgaaaccctgtctctaccagggtgtggtggcacattcctatagtcccagctactcaggaggttgagatgggaggatcactggagcctaggaagtcaaggcggcagtgagccactgcactccagcctgggtga

SEQ ID NO: 41592 - DNA, 1034 bp, Homo sapiens
ctactgtggaggctgaggcaggagaattgcctgaacccaggaggccgaggttgcagtaagccgagatgatgccactgcactccagcctgggcaacagagcaagacttcatctcaaaaaaaaaaaaaaaaagaaaaagaaaatcataaggataagaaaatatattgaccattcacatagtggaagtggatcatcataaaagtcttcatccttattgtctttatgttgagtagcagagggataggtgggtgtggtcttgctgtctcaggagtggcagaggcggaagaaaatccctgtacaagtggcccctgtacaagtggaccctgtacagctgtgtgtacagttgacctttgaacagaactgcaagggtccacttgtacagggatgtataagttgttctatgtgtgtatatatgtatacctatgtgtccggaattggtgggttcttggtctcactgacttcaagaatgaagccacggaccctcgcggtgagtgttacagttcttaaagacatcgtgtccggagtttgttccttctgatgttcagatgtgttcggagtttattccttctggtggggtccgtggtctcgctggctcaggagtgaagctgtggaccttcgcggtgagtgttacggctcttaaggcggcccgtctggagttgtttgttcctcccagtgggttcgtggtctcgctggcttcaggagtgaggctgaagaccttcgcggtgagtgttacagctcataaaggcaatgtggacccaaagagtgagcaacagcaagatttattgcaaacagcaaaagaacgaagcttccacagtgtggaagaggagctgagcgggttgccactgctggctggggcagcctgcttttattctcttatctggccccacccacatcgtgctgattggttcattttacagagagccaagtggtctgttttgacagggtgctgattggtgcgtttacaatccctgagctagacacaaaggttctccaagtccccactagattagctagatacagagtgtggacacaaagg

SEQ ID NO: 41593 - DNA, 1101 bp, Homo sapiens
agtgtggggcccaccaagcccacgcccactcggaactccagctggccagcaagggccctgggtagctctggttgccactcgcgcctctccctccacacctccctgcaagctgagggagccagctcaggccttggccagcccagaaaggggctcccacagtgcagcggtgggctgaaggtctcctcaagtgccaccaaagtgggagcccaggtagaggaggtacccagagcgagtgaggaatgtgagggctgccagcaagctgtcacctctcacctatacatatatacgtatacatatatatgattaggatcataatctagtttttctttgttttttgttttgttttgtttttttgagacagagtttcgctctttgttgcccaggctggagtgcagtggcgccatctcagctcactacagcctcggctggccttccgggttcaagcgattctccagtctcagtctcccgagtagctcggattataggcatatgccaccacgccgagctaattttggtatttttagtagaaacagggtttcgccgtgttggcccggctggtcttgaacttctggcctcaggtgatccaccggccttggtctcccaaagtgctgggactacaggcgtgagccaccgcgcccggctgtaatccagttttttttgtttttgcttttgtttttgtttttgttttgagacggagtctcgctttgttgcccaggctggagtgcagtggcgcagtcttggctcactgcaacctctgcctcccaagttcaagcaattctcctgcctcagcctcccgagtagctgggattacaggctcatgccaccacacccggctaattttttgtatttttagtagagagggggtttcaccatgttagccaggatggtctcaatttcctgacctcgtgatccatccgcctcagcctcccaaagtgctgcaactacaggcgtgagccaccgtgcccggccctagttttatattctaatttttgctttcagtttgtctctggtactaaaaatattagaatgaacacccttatacatagcaacctttgtttacatatataactatttcccaaggttaaatcctataaattgtat

SEQ ID NO: 41594 - DNA, 1025 bp, Homo sapiens
atttgattttttttgtgtgtgaattgcctgttcattatctttgcccaaattcatttacttttctcatttatttgtaagagctatttgtacattagggcattagttcttctcttgtcatatatgttaaaattgcaattttcctagtgtaccatttgccttgtaattttgcttagtatagtttctggcagaatttttaaaataaaagtttgaatataaatgtagtcaaatctttctcctgtgtttgttgttcattctacgccacttatctttagaaaatcttccccatttaaagatcagaataaccaactatattttactgtaattttacactttattaaacattaagtagagtgtaggctttaagtttcttcctcatggttatgaaaattttctaatcaacattagatattttcttgtttagcacctctagctttactatcaaaattattggcatttattttaaagattccgattgattcctcacttcaggttttacagacatttcaccagaggaattgaggcttgaataccataacttcttaaccagcaataacttacagagttatgtaagtttgtttcctattaatctactgcaataacagatgagctcttaattactgctttctttatcgtggcttgtgttttggcaaaaccgatgaggtctatgatcttttttcaggagtaggctatttttcttttctatattattttcattgaatttggttggttattaaaatgataatatatttttactttaataattaggaatattactatttttattataaattacccaacagtcaatcccagaaatgaaacccttttatcatttgacagatatttattgaacatctgttaggtaccaatccagtgatgaatgctagaaaaacaaagttaaataagatacagtctgtaatacagattaacatcctcatatatcaaatatcaaaaaaaattaaaaatcttgactagaataagttgagtacctgaaggaagcagtttaaatgctgtatttttctgtttct

SEQ ID NO: 41595 - DNA, 1157 bp, Homo sapiens
atgcacatttagaatgtaatgtatcgttttgcgactgaagaacacagtatgttccttgtcttaaacagaaatgcctttggaagatatatacccacctgtctccaaagatctatggtcccgactgtggcaagttcattatctttgtaaataaagttatgatgtttctacacccattaaaaagttcttaagaattttattttaaaataagatattcacatttataattttaatatttccaatttctcagatggtttctactctgtataaggatatgagagtaatgtctccctacacttagtgaatggttgacagtcccaacaccccacccctttcttaaatatgtgcttcctgaataactagactcttgtgcaagctaatttctttcatcttttagttcttgtaatgctatttgaatttagtgggacctcttggaagtagtctgtccttgtgtgagaggtggcccaccatcaccatggatgagagctgatggagaaaggataactgagtccaaagaactgtggaacttccctcagggctggaaggtccctgctccttgctaactgcccagggccccttccataggttagaatgtgggacaacccacccatagctgacttaacatgtatcaggagttcatgccttctttatactgaatggtaacccattgtatggatataatttgtttatcatctgcctgttaatgaatattacactgagggagagaaaccagaccaaaaaaaaaaaaatagtgtagaccatgtgattccatttgtatgaaactctggaaaagacaagtctcatttgtagtgatagaaagcagacagagtggttgccagggaccaggagcaagaatgcttttgagggctgggtgcagtggctcacgcctgtaatcccagcacttcgggaggctgaggcaggcggatcacaaggtcaggagtttaagaccagcctgaccaacatggtgaaacccggtctctactaaaaatacaaaaattagccaggcatggtggcacacgcctgtaatcctaactactcaggaggctgaggcaggagaatcacttgaacccaggagaggttgcagtctcaaaaacaaaagcattctttttttttttttttttttttttttgaggcagagtctcactctgtcacccaggctg

SEQ ID NO: 41596 - DNA, 1024 bp, Homo sapiens
gatcacctggattttcaggacttccagcttccttggcaacaggtcctgtcagagctccagtggccccagcctttggaggtggcagttctgtggctggttttggtagtccgggctcacattctcacactgctttttctaagccatccagtgacacttttggaaatagcagcatatccacttctctgtcagcctcaagcagcatcattgcaacagataatgtgttattcacacccagagataaactaacagtagaagaactggaacaatttcaatccaagaaatttactctgggaaaaattccattaaagcctccacctctggaacttctaaatgtttaaaagggcaattttaaatacaaaaaagaatgatgtttaaaattgctttgagtgattcatacagagatgtatatatgcatacatgtatatattcataaggaatataagcttccatcaatagtgattttaaatttgatttttttcttaactctaaatatttaagtaaaaagtaacaaaaactctgcaagcaagggaatttttttgtactgtaattttgaatggaactgaaaaattatgcacgaataaagtacttttctcatgccataccactttactgtctcacaatttaaagttttaaacttttttttttaggaaggagataatttctgtaattattagggggaacatgctcaaatatttaacctacttttagagtaaacattagtagcatgacttcatgttcaggattctctcaaagagataaatcagtttgtaaagagtgacaagcttttagttttagaaccataggggcatttcccccccgataagtttggttccctctcaactttggcggtctcgtggaccaccatttgagttttcttcaacaatcttaggctgctttttattttggcctcacttttatagaattctatttattcatcacattagtctgtcaaatggatgagttgtaagagaaacaaattgtgatctcatgtgaataaataatgtgtgtagtggggtcaggattc

SEQ ID NO: 41597 - DNA, 1024 bp, Homo sapiens
gataatctcataaatattttttacctaactacatatatatatatatatatatatatatatatatatatatatatatatatatatggctgagcacagtggctcacacctataatcccagcactttgggaggctgaggcaggcagactgcttaagctcagcagtttgagaccagcctgggcaacatgatgaaaccccgtctctacaaaaaatacaaaaattagccaggcctgatggtacatgcctgtagtcccagctactcaggaggctggggtgggaggatcacttcagccctggaggtcaaggctgcagtgagccgagatggtgccactgcactccagcctaggaaacagagccagattctgtctcaaaaaaaaaaaaagatatatatatatatatctttcaaatatctgtatatacacacaatcacatcatatgtgaaacttcaaataaaagtttaatgtgtaaatgtatataatcagatcaatctaaaagaagagattttctataagcgattgtcctggactctttgagtaatcagtatcatattaaaaataaaggcagggggtggaattctaggtcacagtttagtaaactttttccataaagggctgggtactaaatctcttaggctttatgggccacacagtctcgatcgcaactgctcaactctctcattgtagcgtgaaaacaaccatagacattacataaataaaagagcctggctgtgttccagcaaaaatgtatttacaaaaacaggtggtaggccagatttggcccatgggacatagtttgcctgttttacactaatggagacaaaatggacacagcaaccaaacgcaatttgagaatctacattggatcctagcttgaggaaaaaacagtgatgaaagatattcgtgggacaactggggaaacttgagtacacactggataccagatgatattatagaattgttaattttcttaaggaatggtaaaggtattgtggggattaacatttagtctaggttcttcatttcctgga

SEQ ID NO: 41598 - DNA, 1044 bp, Homo sapiens
tcctttggagtcggctttagaacttgggcgagcttttaaatttacagcctgtaatactccaagctgaagatcagaatatctaaatctttacgggaaaaaaaattagattttcataggtaacagttgttaataacccggtggttttatatgaaaactggaaggttcaaaataataattactcaaaaatgtagctctttcagtgactgatcttaggccacagtaattctcctaggcctcagtttcttcatctctcaactgaaggttgtggaccagatactgcctaagagcccttccagctcacaattctgtgacccgttatgactgagattcaatttaatatgctccaggatatcacctcctacccattttgtggtgctgtttttctttgcacagcatttctgtgattgtggtgtattgctccttttaagtattagtagaaagtcatttgtcactggtgtctggttctacttgcatatggttaatagcgaaggatgtatagtggctctgcgtaatctgagcaccctgaccataaaagttgagcggtgctatgatactactgcccaggttcaccttccaggaggcctttaccctgctatctgtaaaaacactttggatctaaacaccctcatggaggaacagtcagctgccggcatctctgggtgcatacacgtctatctgcttggccatcctgatacaaacaactatttgtgcatttcagatcatactggtcccaagtttgacatcgatatgatggtttcacttctgaggcaagaaaatgcaagagacatttgtgtgatccaggttcctccagaaatgagatatacagattactttgtgattgttagtggaacttctacccgacacttacatgccatggccttctacgttgtgaaaatggtaggatgctttcttttctcttttggaccattaactgagtggaatagtgacagtgcatcaggccaaggagcaacacttagagggtaaacccatcatacaaagttacagaagaagcccaaattttcagaatttgcatgaattcatttt

SEQ ID NO: 41599 - DNA, 1914 bp, Homo sapiens
tatctgttttaacaaaagaactgagcacatttataggatgacggggtcccattaacatgtcataaaggcagatgagatgaaatcagtggcactgaaacaacctggctttataaacagaaggtagtatctgcagcccctaaaggtgaaggaaagctgggatgaacacaagtgatggatgtaggtgggtaccaaatgctgactgagcttagctttttcagcctcagaggcaccttggtgaatgaatggggtgaccctctcagaagggctggggcaggagaattcaggagagaggtgaaagtgaataagatttagagggagaaatagtttccctaagttattcatcacagggcaaagtatagcaatgagaaatgagtaagaaagattaaaaaaaacaaacaaacaaacaaaaaaaaaagaccttcagcaagaacaggcttcccccatcccctctccctttaataaaccacctggctttttgcagtacaaacacctgaaatgtaaacgtgaccctcatgttaagatagaagggaaggacactgatgactggctgtgcgtggattttggtaagttattctggcgtattttacaggtaactgttggtactacgctaatcttgaattgttttcagttgcaaaaggattgagatcaaattgatgaatgtatttccaggtaagatttttgaagtgtgtttaaggtaacaaaagtttttttagttataatccaggtggtcttattcacatgtagaattttcacctaaccaaaccaaagtaccctagatgatgccctcctggaggaagatatatactacatggtgtgtatctactagccacacagatcaggaaggtggtggacaacaggataacatagtagaggcgggagagattccttagtagtggtagaggaaggtttgggggctgtggtgcataaatgagatgaggatgaggttattccaggcacaaaaaaggacaagagcagaagactagaattttgaaaagatctaacaactttgggtattaatgtgtacatagtttcaaagcacctcccaacaagataatatttacaaaggggaaacataactgtatgtcaagaactgaggagtctgagattttattctgcttgtaagctaatacattgtcccgccagttttcatggacactggtaaaagacaagactattagagggttagagacaaagaacagtttattactcacagcagtagccagcatccattttgcactggtttcctgagctctggattccatagggcaacatgggccagatgacaccagcacacacagttgtaaaactggaactcagatgagggtgtctaggttttttataactggcaggaagcaggcctacttttgctctgatggtttctcacttttgtcgctattaacgttttggaccaggtaattttgcatgtgggggaggggtgtctcttgtgcacggtacgatgtttagcagtatcctcccttctccaattgtgacaatcaaaaatgactctaaacattaccattattacctaattgagaaatgctgctgtaagcaaagctgccctttgccctggagggaggcagtatctttctgttaagaatattcacgatacaaacattcttggatagtcaaaacaaaaggcagtcagtgtttttgcacaaaagatgtgcagaagtgtgttacccatggagaattgtcaccgaagagaatcctgacaccattagtctctttgataaagttactatcaccagcaatgttatatattgacatatgcctcctgtaggtacactgagaaaggcatagcatcacttctgtggtatttttgctgggatggagtccacagtgatgctaatctgggaaccacacttgagaaccactgctttattcctagagttagccagtgtgtgttgtaaggta

SEQ ID NO: 41600 - DNA, 1029 bp, Homo sapiens
ctccacctcccagagtgctgggattacaggggtgagccaccgcgcttggcctaaattttttattacacagtatcaatgtattttattcctttgagatgatctctaatatcagtatatttaggtctctcctgttgagctggtcagataccctggagaagcacttcctgtctgttgctggagagtataggcctgtaagtgttctgggatctgagcgagagaaaaaggctgggcaaggaagagtgatctcagcactcactaccttcatttactcttccagtttccagtgtaaacccaggccctcaactgctctatccccttaagaaaatacatctcagatcttctgcagtgggggaggttttggagtggtgcacagaatttaaggatgaattgcttcatagaaaatagttaatgcatgctgggcttaatacctacctaggtgatgggttgacaggtgcagcaaatcaccatggcgcaggtttacctatgtaacaaacctgcacatctgaagaaacaggagtgtggcgtgaccatagggaagcaaaagaacacaaggaagtatgcaaccatgaagcgcatgcttaaactcagagatcagaggcttaaagaaaaggatagattaaaacctacaaagaaagaagaaaaggatcccagcgcattaaaggaaagagaagttccccaacacccttcctgcctatttttccaatgtaatgcacagctgggcccaccttactacatccttgttgataccaactttatttattttttcttttttttaagaaaaatatatttttattatactttaagttctagggtacacgtgcacaatgtgcaggtttgttacatatgtatatatgtaccatgttggtgtgctgcacccattaacttgtcatttacattaggtatatctcctaatgctatccctcccccctccccccaccccacaataggccctggtgtgtgatgttccccttcctgtgtcctagtgttctcattgttcagttctcacctatgagtgagaacatgcggtgt

SEQ ID NO: 41601 - DNA, 1045 bp, Homo sapiens
ctgttcatatccttcacccacttgttgatggggttgtttttttcttgtaaatttgtttgagttctttgtggattctggatattagccctttgtcagatgagtagattgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatctaagtctttaatccatcttgaattaatttttgtataaagtgtaaggaagggatccagtttcagctttctacatatggctagccagttttcccagcaccatttattaaatagggaatcctttccccattgcttgtttttgtcaggtttgtcaaagatcaggtagttgtagatgtgtggtattatttctgagggctctgttctgttctattggtatgtatctctgttttggtaccagtcccatgctgttttggttactgtagccttgtagtatagtttgaagtcaggtagtgtgatgcctccagctttgttcttttggcttaggactgacttggcaatgcgggctcttttttggttccatatgaactttaaagtagttttttccaattctgtgaagaaagtcattggtagcttgatggggatggcattcaatctataaattaccttggccagtatggccattttcacgatattgattcttcctatccatgagcatggaatgttcttccatttgtttgtatcctcttttatttcgttgagcagtggtttgtagttctccttgaagaggtccttcacatcccttgtaagttggattcctaagtattttattctctttgaagcaattgtgaatgggagttcactcatgatttggctctctgtttgtgtgttattggtgtataagaatgcttgtgatttttgcacattgatattgtatcctga

SEQ ID NO: 41602 - DNA, 1043 bp, Homo sapiens
tacccatgattgttttgtagtgttaccttctgccagacagcctgccttggttctgtttttccacgaggtgaccttggacttggcctctggtaaatcactacattctccctctcttccacagttaaagggatgatagtagcttcctgctgtgccttataatcactgattatgtttagcatagttagaatctttttatacccaatatctttagcatacttaatagcatcatatacccttcttttgatttttgtgtgctatgaaataatcaggctaggtctatgtttttatgtgattcttttcccttcttaaactatttgatcttctcccagaataaggaagttaaagtagaaacagagcaaccttaaagtggtttattttctaaattggatccttcatttctatctcagtgatgatgccacctaccaaacatgtgaattagaccttcagcaaatgttcatttcaaacatttgtcgagtgtctactgtgtgatgaagcaccaagctgggtgagctgagagtaaaaggatagataggataggatctctgtttccaagttgcttttaggggttcaaggtctaagatagggaaggggttcttactgctagcaccttcagtgacagagctttatgggggaaagtattatggatgcacatataatattaatacaagcatagaattcccttaaagatgtcatctcatgacatgtaaacataaaattgtattgtgaatatagagaaaggaggatgtttggtgtatttgaaagaactccaagaaataagagttttgttctgatattcaatgaagtgattttatgtcatggagaaagatagatataatctcttagtctctttttttgtaatattaaaacagttgattttagaaaatttaaaagctctgtatttaataataatttagaacattgtaaagttatcatatagttgtttctcatttatcctgactttttctttaattgccaatttctaaccctgactgaaataagtgattagactgcacctttataattctcacacctcagtttaatgt

SEQ ID NO: 41603 - DNA, 1051 bp, Homo sapiens
atatctaaatttttctaaatatagaaaaggtacagtaaaaatatggcataaaaaataaaatgggccgtgtgcagtggcttatgcctgtaatcccagcatttgggaggctgaggcaggcagatcgcttgagcccaggagtttgagaccagcctaggcaacatggcgaaaccctgtctctacaaaaatacaaaaaattagctgggcctggtattgtgtgtgtgcctgtaatcccagctacttggtgagggctgaggtgagaggatcacctgagctttggatgcagaggttgcaatgagctgtgatggcaccattgccctccagcctgggtgacagagtaacaccctgcctcaaagtaaataaataaaatgttacacttttatagggcagctctgttacaatcttatgtggccaccattgtatatgcagtccattgttgaccaaaatgccttatgtaacacatgatttcatagggaaagaaagcctcttccttttggtcaatgaaagaaggtggagtgaagaaaggtgagagtaaggagaggaaatataagatgtttttgttctgatttcaggtatagaggaacctagggacagagggactccagatttttagccatgtggatacctagaccgaggaaacctcttgctggaatttggttcctttttgatgtggaaggagcccataattcccagctctctgggggtgtgggaaggcagctgacctgtgagtcagtgggccagtcatgcatctatcatagcagggggcagagctggaggtgggttccctaagctcggggactcaatagaggaagtgacaggtattgagggagtctgtacttatagtcggagcaagcatgaggctaccaggccctatcaagctgagagaccaacttattaaatacaagttgagcatttgagatcagtagcacatgcagccgccagagggcagcacaaggacgtgcgtgggccagagccccttctcccatgttcccacatgccccatggaagccactggggccaggagcggggagagactgagcaatcgtcccacact

SEQ ID NO: 41604 - DNA, 1217 bp, Homo sapiens
cagttgtttggccaaagtggctgtgggccgagcacaggctgccgcgggggcgttcgctgctgagatcgtgctcgcggattctcggtacgtttgtctgaaaccaaataggtgctggggcttttttattttggctgggtggagggtcagcaggggagtcgattgaggtatccgaccgtgtggtgacaggatgtggattggttggtagatgtttttttgcagaaggactttttaacactttactgggagtttattctcaatcctaccagtttctgggattgcagctcgagattacatttgttaaacttccatcagttgggtgtgcatctgtgtagggggtgggggtgaagcgagggagagaattgaagactgccggggaagctcagaaaattctccgcattacttataaacagccgggtaaggtcaggctagccacgttttattctttcctacgcctttggagagtgttggaattttactttgtgcttcaagtatattacaagtggtcttgtagtgtagctgagaacgtttggggtgcgttaaaatgcgtttcaattggagtatgatttagcagccatttcttcccgtgaaattttgcaaatcatttgtaaacttatgttggtcgaatataccaggcgaagtaacatttttagtaatgcggtatatagtttccgtatataggtatagcaacggacctcaagtaatattgcttattgtaggcatctactgtgcaatgatagggtagtgggtagtaggcctgattatagttatgtcttctgaggccttgttaacagtaaacaaagaacttttgtgggttgtgtcattttgaggtcatttgtaccttaaatctatcatatatttaaataggtgtttaaatgcgtgtttgcacgatgtgttactctttaaggtccatgtttccttcattctggactacggttacataatacacaaatggtaacacttttaattgctcaattttgtcctatggagactgcacaccatctttatgaaagaggtgtgtatgtgtccttactgatgccaccgaattcttgacatctggaatgtcaaaatgaattattttgcattctaggttaaatcaacactggaaaaattaaggtgtttaagcaagtctagtagctctatataagacagaatctttttttttctttaggccaactgttggatttttaaaaatgaatcatatttttaaacatttgagg

SEQ ID NO: 41605 - DNA, 1034 bp, Homo sapiens
tattaatttgtcatttatccctgcattatatactgttaaaaacattggaaggacgaaggacgttaactggaatgacgatggatgagtgtgggtactgtcatataggggaggggaaagagcagaggaacttttaaattattaaattattattattaaattagaggaactgagaaaataaagatactaatagtaaggaatatgttatttttaatttaaaaaatttttttagacagcatatccctctgtcacccagtcgagtacagtggcctgattgtagctcactgcaaccttaaatttctgggctctagtgatcctcccaagtaggtgagactacaggtccacaccactatgcccagctaattttttttttttttttttaatgtttttagagtccaggtctcactgtgttgcccagcctggtctcagaactcctggtctcaagccatcctcccttcttggcctcccatagtgctgggattacaggcatgagccaccatgctaagttttgtggggaagtgtggaaagtacgtggcttgattcttatcagaaagtttcactttacttttgtctgagtcttcctctctgacatcttcttttcaatttcataaaagaacactatagcaaatacatcttacaaccatgaccatactgtctctagaaagccagaatattatgaaacatttagtaggtgagcaagaaaagtggagtgattctgatgccagaaatagcaccgagctaatacagtttgatctatttgttatttagaatacaccagtgattctctaagggtgcagttttgccccctaagggacatttggtaatatttgaagccatctttggttgtcacacctggggtggggtgctactgacatctagtgggtagaggccagggttgttactaagcaattcattgggacagaccccacaacaaagaattatctggcgccaactgacagcagtgcgaagattgaaaaaccctggaatgtagagtaggcaggttcttccctggacatgtttggagacataggtcaatt

SEQ ID NO: 41606 - DNA, 1046 bp, Homo sapiens
ccagatatcatcctaccaacagcttacaataccatatagattcttactctttgtttcattgtgttcttatcttaagggtatatcttagacatttcaattagacaaatatttctaaatatttctacccatcttcatttagggttgcttttttctgctaagtttatttttctgttttaccagtttatctcttgaggcatcactctatttttaaataattgagggcctctgatgatgtatttaggtattctcttttacagcattttcatgtgcttcaagtcccaggtctgggttgagctagttcttgagtccagatttttttcatatactgtttgaacctcttctgattttttagtatataaaaagtttgaacaacaagacccttaagggaaaaactatcttggagttcttttagaatgattttattcttgcttacagataaagattgccatacgtataacagctacatacaaaaagactttataatggtttatagcactaaatggaaaacactgaaattctagaatgaaacaaggtttgcaagaacttctatttggctttattgttttggttaagcagagcaaaataattcatcataatatgaagataaaagttgaatgaatgtatcataattgagaaaggggtgtgtttttagaaaaacagtttattttgtccttatcccacctccatttgatgttgatgtaaacatattggccatttaatataaaatataattccagtctgcctatgtataacaactacactgtacaataaaaagagatggaaagcaaaagtatttctttactgtagtggtcaggatatgatttgtagatccaaattttgtgtgtgtgtgtgtgtttggaaaatttgggaggcaaagttctcaagtaagtgcagatcttcttttagtagatacttcctgtctgctttgtatacacatcaattatatcttcatcttccattttcacctgtacaggtgtttcattaattggcctcccatcacatccaaaaccaagttgcctcattgatagatcagttgttaacaatag

SEQ ID NO: 41607 - DNA, 1047 bp, Homo sapiens
tggtggcttagcgtagggggatagcagtgaatgggcaagggagtcagatggcttttcttcagtcacctccattgtgaccgaattgaagaaccagtttatcattggatctgttatgaattctaggtatttttgtaagtatatatataaagtattattttgaaaacagaccctatcaatgaaatttattctaaaattacatagttttgggattcaaattagaacatttgataaaatatctcagtgattctataatatttcacatttatgaatgtttattaggtgtgtaaaacattttcaaacaattttgattcattatactacatattttcttgtaaaataatgaagttttgacttgctttgttaattagtggttgggtgaataaaaatttactcaaagcaggactactacattgtgagagtaaattggcaacagtgctatttatttgagctctgtttaaaaaggaaaaaaaggactctccgtatatctagctttctcctgtgtgagcactacactttaacaaggatatttctggacatagtaggaagcatggactgtggtggggagagattggggattagtataccagttaagaggcttttaaagtagtctaggcaagagaatattagaaactctaaaccagacagtgaaatttttagagtggaattgtggtgaagattactttgagacttttatgaagtagaatgaaaagatttgaagaagaattagatgtctggaggttagggagaagaaaaaaattggatgattctgagattataagcatcagagaatgggtagttggtgatgtcgtaatataaatgagaggtagaatctgtagtcgcagtaggcttggttagagtcagtgagtagttttcaaaatggtaaattaaaggcaccatctttgggactccctggggaaaaacgtaaagaaggcagttgaagaaaggtgagtgctgtaactaatacttggaaattatcatcatatagaaactagatgaagcctcagaaataaatgagatcactcaagaaaagaatgaaaacctgagaga

SEQ ID NO: 41608 - DNA, 1056 bp, Homo sapiens
tgagcaagtctgaaaattatttttaactatcctcacacttgattgatggtttggcagggtaaagaattcctgggggaaatgtttttaaaggcatcattgcatcatcttctacctttagatgtcatcattgagccattcagaatcattcctgattcttgacacgtgatttttttcttttttctcagtattctgatatttcacaacaaaatatcttaatatgagtccattttcatctgttttgctgggtgctcagtgtactccagcaacttacatctttcatttctggaaaatgttaaatatttcattattgtttttctcccctccattttgtctctcctttctttccaaaacccatctggtttagatgccctctaatcaggttctctaattttcttctgtttttctactcctgtgcttttctactttttgtggtatttcctcacatttaccttccatgatttccattgaattttttctttctgcttttgtatttttattttctaagagctcttttgtttcctctgtaactatcttattctagtttcatgagtatgatattcttctttttctttgataatttttataactgtttcttttttcaacctgagtagtttttacctatttgtttattttaatctctttcatttactaggcttttctcagctatccagtatcccaagattcttagctcattaagagtgggggactaaaaacctgatgctctgatttcatgttgaatgtcactgtagctagtttgtagctgggttatttgggggtaatacctgatcttcatgtctgtgtctttcttgttgactggtcatattctgtagactatgaagaagacttcacatctgcctggaaagtaaagaccaagctgaaggcttcagatagtcaggagggagaatcaggtggaggggtttgtatcagcatttaataatcctgtcttctatattatttcattgtctttggtcgagaggtacctcttatcttactctctccagaaaataagcccctagttttcagttctgtgtagtggaggaaggtgggtgatatggt

SEQ ID NO: 41609 - DNA, 2184 bp, Homo sapiens
tgaagtaatagtggccccaaaccatctcaaagttttactaaattctggtagaaaataaaacttaaaaagaatttcagtaagatgaaataagcacactataccctaacttggcagagacagtgagctctggtcctttcagcttctgataagggcattcctgccaagatgggggctccaccctcatgacctagtctaaccctaatcacctccccaaagactccacctccaaataccatcccactgggaattagggttttagcatatgaatctgggagggacacaaacgcctaggccatagcactgatcaagcttcggttatcaccaactgagctggggccctggggaggtacatggggacagccccaggcaagaaggccacagagtcacactgttcttacctcaagctctagcagttttgccagaataaatgtgcctcatttttataacggcctttgggcaattttcagcacccttaaaagactgcctttgatgatgctgtccagttttatatttgcttttttgcagaggggaactgccaatctcttcatgccaatattatcagaaattgagtaatgtttgtaataaaagattttcaacattttactattactaaactttcatagtcacaactttgttatcaagtgaaagaaatcattgtgatatgggcaatattgtttctaatgatgaaattcattaggatgttcactgcagcatttcttgaagacatgggaaaaatagaaacaactgccatgttcctcagacgctaaataaactacactcatcctatgaatctgcaacaactaaaagaataacatggtttcatatgtactaatgtgaaatgttctccaaaatacatttttctgtgggaaaataagtttcatatatcactgatatagtaagatattacttatataaatacagtaacacattatgttttagatatttatataagtatagaaatgaagcatatatcttcatattttctacagatacaaatatgtaaatatgtaagaataggtctataaagacataaagaataggtctataaagacataaagaataggtctataaacacataaaaacaaagtataacatgcattacccctagggaaagagcagagatggaaagctggccaagttaaaaaggctcttgtctctatccagtaatacctgaaattttttacaaaattaatttatgtatacctgtgtaataaaacaataatttaacaaatggattgcccaagctatcagctatgtatatggaaagtcaacatcatgaggattcctagaagtttctatacaaattcacagagattaaagaaaaccatttgatgaaataaaattaagcacccttatataaaagattttattaggtgaaacatgcttggcatcatttctcaagtcatggatttgtcaacccaaagatgatctccttatatagaacatttcatcttttaaaatcccatgacttatatgttagtttgtgctttttatcatggatttctttcctagtagtaagccatttcagtatgtgtcacattcaataatatcttttaataactttaacaggtgcatttcaagttacaagatttctttatgcctacagttaagaattactatgaatgaaacttattaacaattactcttaattctttaaatcgtcatcttatgaatcaagtattttctgctagaaatactttaccctaattacaaccttcatagattgtaaaaaggaaacagactccaagacactgtggcaataaatggaaataatttgtcttccacagttcttttaagaagaaaatgattttataggtgataggagagggccttgagatactatgtcaaagtgaatttaagtactatctttatattttgagctctggcttttcatattctagcatttgttgttgagattagtttttcactgacactttgaaaaattagtcagaaagagatggttgatgagttgcagaatatagataaaatagaatagcatttatgtttttagtaaagtaggcatttaattaggtttttttttgtttcattttgtttttttgagatggggtcttgctatgttgcccagactggttttgaatttgggcttaagcaatcctcctgcctcagcctcccaaagttctaggattataggaatgagccactgctcctggcctatttactttt

SEQ ID NO: 41610 - DNA, 1050 bp, Homo sapiens
aagtaatgatgtcccagatgtggcctagttgttggggatgcaaagatgatttctgcactcataaaacttagagtttagaaaggaagttgcacattaaataccaaaaaatttaattatataggtttatcagaattatgaagtatagagtactatgaaagtatgtcttaggagaagttatcctaattagggcagttagggacattgatattttgcccttaaagaatgagtgtgaattaggtatgcaaagatggttgtgtataggtggtggtaagtgcagggagggttttgcatcagggctggggtaatactggtatgtttaaagctgtgggagtggtgcaaattgaatctagcaatatattaaaatgcttataagccataaaatcacattttaattcctcataagttatatgtagataccaggctgttggggtagtctgggtacgatatgataatggcaaggactcattagggggtgatggaaagaaactgatagattctagattctagaaatatttacgaggtagaatttactgcttctttgctgtgtctgtttctactcctaccacttttaagctttgaaatacttttgaatatttttgtacagtgtttctctttagctattccctttgttcatgtggttttttgccttaatactttgctgctgttttaatagagattgtgaagaaaaagaatataaactcaggtagtcaatctaacatattttactgaaccctaggcccactgatttgaaatgtcacctttattgtatattgtttcatttaactactctgaagatttgtctgttcctatgataatactgcactatttgaatatacagtgtttttacagttgatagcaggtacctccttgacatttatgctttcctaaaaaatcatgttggctagttttacgtactttctttttcaggtaaattttaggataaatttacccaaaatgcttttgggatttctattaggatttattcatttttttttaaagaataatttggagagaattggcatttttacgttattggatcttcttacctca

SEQ ID NO: 41611 - DNA, 1044 bp, Homo sapiens
gataattgacattttcttagaaaatcacctacttgactagatttttaaaataaagttgttcattgtattcttaaaagagatttaaaaatctctatacctacagttattttctcatctcgtttctaatgttatttgtgtcttgcctttttttaattaattgacacattaataattgtacatatttatggggtacttagtgatgttttagtacatacaatgtttagtgatcagatcaggataattagcatatccattgtctcaaacatttttcatttatttgtgttgggagcattcgaatatcctctcttcagccgcttgaaaatgtatactgttgtcaactatggtcaccttatggtgctataaaacactagaacttattcctcatatctagctgtaattttgtgtcctttatcacatctcttcctaccccttctttccccctattcttccctgcctctagtaacctctgttctactttctacttctgtaagatcaacttttttagcttccatgtaagagtgagaacttgtgatgtttaactttctgttcctgatttatttcacttgatatcctccagttccatccaggttgctgcacatgacaggattttattcctttttatggctgaatagtattccattatgtatatataccacatttgctttattcatttatctgttattggacactttgattgattctgtatgatgactattatgaatagtgctgcagtaaacatgggggtggcacagatatctcattaatacactgatttcctgtactttgaataaattcccagtagtggcattgctggatgatgtggtagttctatttgtagattttaaggaatctccctactgtcctccattgtggctgtactagtttacatttccaccaatagtgtaaaagagttcctttttctccaaatccttggttaaatttattcttagggttttttttcagttattataaatataatagctttcttgatttttaatgtgtgttgtttgtgtatagatatactactgatttttgtgtatttgt

SEQ ID NO: 41612 - DNA, 1583 bp, Homo sapiens
tttaaaaatcaaaataatatcaagtatcttatctgaccacaatgaaataaaactagaaaccagtaacaagagaaacataaaactgtacaaaaacatggaatttcaaccacatgatcctgaatgaccaatgaatgaagaaatttaaaaggaaatttaaaaattccttgaaacaaataaaaatagaaacacaatatatcaaaacctgtgagatacagcaaaagcagtagtaagatactagtttatagcagtaaatgcctgcatcaaaaaaggagaaagatttcaaataacctaatgatgcatctgaaggaactagaaaaacaagaacaaaccaaactcaaaggtagtgaaaggaagaaaataataaggatcagagcagaaagtaaagactaaaataatacaaagtcaacaaaagaagttggttttttaaaaagataaaatcaacaagaaaaaaagagcaaatccaaataaaatcagaaacaaaacatgtcataactgatattacagaaacacaaggatcattgaagactattaggaacaactatatgtcaatacatttgaaaatctagagaaaatagataataaattcctggacatataaaacctaccaagattgagtccagatgagatagaagacctgaacagaccaacaatgtatgatacgactgaatcagtaataaaaaaaaagactcccaacaaaggaaagtccaggactggatggcttcaccactaaattatcttctcaaactattccaaaaattggaggggagggaattcttctaaactcattctacaaggccaaaataaccctgataccaaaaccagacaaggacatcacacaaaaagaaaactacagaccaatatccctactgaacataaatgcaaaaatcctcaacaatattatcaaaccaaatccaacaacacatcaaaaagatcatacaacatgatcaagtgggattacagggatgcagcaatggttcaatatacacaaatcaataaatgtgactcatgaacagaatgaaaaataaaaaccacataatcatctcaatagatgcagaaaaagcgttttgtaaaattcaacattccttcctgataaaaactcaataaattaggtagagaagaaatgtaccttaacaaaataatggccatatatggcaaacccacagctaatatcccattgaaagctgaaaagctttgagcttttcctgtaaggactggaacaagacaagagcatccactctcaccagtcttattcagcacagtactggaaattccagcaagagtgacagaaaggagaaagaaataaaagccatccaaattggaaagggagaaatcaaattgttactgtttacatatggcatgatcttacaataaagaaaagcctaaaagactctacaaaaaaaactcttagaaatggtaaattcagtaaggtttcagaatacaaaataaatacacaaaaatcagtagtatttctatatacaaacaacacacattaaaaatcaagaaagccattatatttacaataactgaaaaaacttttaaagtctgttttatctgaaatgaaataagtgtagcttttggttttc

SEQ ID NO: 41613 - DNA, 1034 bp, Homo sapiens
aggtattgctaatttgttactattgctaacagtattttggttatgttgtttaaaaggagtgctgatctttgagacatatacattgaaataggatttctggaatttgcttcaaagttatataaggtagaaagtatataggagtgtgaaacaagattggccatgagttgctaattgttggagctgatcattgtgtggtttattatattattctgttttcttcacatatgtttgaagttttccataataaaagctaaaaataaaaacaaatgtacaatgtcaaaagaaagaaaaataaataatgggaagtactgctaaccacatttatagccacaggacaaaagtacttttaaaaattgattctattgttccctgcccacttaaaggtaacttgttgaccttaagcaaaattactaagtagcttagtttatattctttacttcttatgtcatctttcttcatgttaatccaatacttgttttccttctcctttgtcaagtgcacattgtcctcttgttcgcttctttaccttcaaaaattgtcagtcatccatgaaacccccatggatgaacctgtccaagttaacatacaagagaatgctttgtgagggagatcagggatagaagacaggaaataggtctgatagagtattagaaaaatatttgaatatttagaaaaatactggtaaaaatgtgagaagcttgttggaacatttggaaaaaacttaagagttccatatgaaaaacactattgattttgtttttaaaaattgagagtctgaagatagggaaagtaaaagctgaaacctctagtattctaacagaaaatagataatgtccaaaatgggtcagtcacaaagtagcaatattagcatattatccagaaagaagagaaactacgaacagatctgattagaagaaacaattaaattcctagtaattacttctgggagtaggataagttgggagaagggtaagcagcatggaacagaaaactgtattttataagccatttagtactacaatctgacttttaac

SEQ ID NO: 41614 - DNA, 1050 bp, Homo sapiens
actggtgggagtaaaaatttactgattttatgccattgatgttggtctttcagaggattatcttgttcattattcttaacagttgcaatggttggatgacttttgagcaggtaaggtgctactgtactcttttgatgataaaaatgaaataaagcaaagagttatccaataatatgcaacattcaggcagattcttaataaggaaaaacaatggtagttcagtattcctataatataggttaaaaaaaatcccaggaataggggaggaattccgcttccaagaaagaaatagtaagtcacagcagcctagcactctcagtataacaaatagaaggaaaaaagaggcacacattgctagatatgcagagaggcagaaatatctggccactaatcatgagaaaaacaacagaggcagtcccataaatggttcttttattagcatttatacacaaggatttgaaaataacttattaatgtacttttagtagaagaaaagggaaaaaaacatgtaaaatatttttagaaaatcagaataaaaaataatcaaatgaacattttaggatcaaaaatacagtatctgaaattagttcactgatagaagactagacacaacagaagagggaataagtgaatttaaagataggttattagaaaatactcaagcaaaaactaatagagaagaaagaatgaaaaaaagataacaatatgtgaaacatactcaaaatatctaatatatgtagtttgtattccagaaagaaaggagagagggaagaagaaatataggtaaaccctatacttttgcatttcactttattcccctttgcagttactgcctttttaataatcaaaatgggcaaaataaccagctagcattataatgacgggatcagattcacacataatattaaccttagatgtaaatggctaaatgccccaattaaaagacatagaccagcaaattggataaagaatcaagacccaccagtctgctgtattcaggagacacatctcatgtgcagtgacacacataggctcaaaataaatggatgg

SEQ ID NO: 41615 - DNA, 1024 bp, Homo sapiens
agatagctagaagagaagattgtgaatgttggcatcccaacgaaataaatatttaaaataatggatatggtaattaccccatttgatcattatactatgtatatacatgcattgaaacgtcacattgtacaccataaatatgtacaatatgtatcaattagaaatataaaattaaatttttaaagataggttcctaaatttttctttctgtgaatttctttgctgaaactcttcacccagttctcttaatgagttgttgatctttttcttattgatttgtagaagtccttcgtaagtagggaaattagctttctgtcttgaatatgatttgtgttttgaccctagtttgtcatttgtattttgactttgtcgatttttgatgagaaatttaaaacgttcattaagttaattttattgggccttttttgaaataatgtatgtatctttcagattttgtgttatagttagaaagatccttcccactcaaaggttataaaaaggttattgtgtatttcctctgaatactattaaagccaagcttttaaaatgttgttttttcttttaaaaatttaacagattcccttttctggttttttgacatctgtgtggttctcctgattctacagatatatctaagagaagctcagcagtgctatttagaagtttcctgagtaccttgatatgtaacttatctaatctcggaatttgtattttggttaactaggcaatttctgatatgttctttactcactagagaattccattctgatttacttacacttactcatctttttttttttttttttttcagagcaaagctcatcctttttgatataatgtatgcagaaacaaaatagaaattgagttctccattctctctgtctcatttctactttctgctcaaaaattcttttttatttttgagtattagtgagcctgtgttgatcttgagttttaggtctctagaataaaagaagagggtggtgcttgatcacagccaaacttatttcccatttacttagct

SEQ ID NO: 41616 - DNA, 1026 bp, Homo sapiens
tggcattttctagtctaattttttttttttttttttttttttgagacggagtctctgtcacccacgctggagtgcagtggcatgatcttggctcactgcagcctccgcctcctgggttcaagcaattctcctgcctcagccttctgggtaactgggattacaggcgtccaccaccatgcctgcctaatttttgtattcttagtagagatggggtttcaccatgttgggcaggctggtctcgaactcctgagctcaagtgatctgcccatcttggcctcccaaagtgctgggattacagacatgagccactgtagtttaatttttttaatctaaatctcataaaacttcttcctctatttcaattacttttggtcttttgatatttttctttttgtttagtaagagttttttcttctttctcggtatttcatatgacttttagaatttcttcttttaaggtctttctttaaaatcttgcttaatatatagctttcttttccacttaagaacttattttactcctgtgaattacctagaaaaaatagatttaagcaagaaaaattgtcttttaaaaattagaatgttttatttggactctgaaggatccactctatggtaaaaataacatctaaagtatgatagtttaggtatctgaaaaagtttagttgatactgttaccacttgaaatgtggatttttctttagcaatccttgaaatggatcttaaaatataagatttgctatcttacatggttttgtttatgaattaaattttgataattacgcttttcctgtcttcagaattgtatagcaaccatttatcagaaaagcaaggaatgcttaaaagttggagccgcttagtgttcattctcaatttgaacttaacactcggctttactcctactatgaaaggatgattagaattactttcggccgagggcggtggctcatgcctgtaatcccagcactttgggaggccgaggcgggtggatcacgaggtcaggagatcaagaccatcctggctaac

SEQ ID NO: 41617 - DNA, 1382 bp, Homo sapiens
tttgtcaatattggcttttgttgtgattgcttttgatgtctttgttgtgaaatctttgaccattcctatggccaggatggtattgcgcaggttgtcttctggggtttttacatttaaatctttaatccatctcaagttgatttttgtgtactatataaagaaggggctgagcttcaatcttctgcatatggctagctggttatcccagcaccatttattgaatagggagtcttttccccgttgtttgtttttgtcagctttgtcaaagatcagatagtcatagatgtgcagccttatttctaagctctcttttctgttccactggtctatgtgcctgtttttgtaccagtatcatgctgttttggttactgtagccttgtagtatagtttgaagttgggtaatgtgatgcccccagctttgttctttttgcttaagattgccttggctattcgggcccttttttggttccatatgaattttaaaatatttttttctagttctgtgaagaatgtcattggtagtttgataggaatagcattgactctgtaaattgctttgggcagtgtagccattttaataatattggttcttcctatccatgagcacgggatgtttctccatttgtttgtgtcttctctgatttctttgagcagtgttttgtaattctcattgtagaaatctttcacctccctggttagctatgttcctaggtaatttattctttttgtggcaattgtgaatgggattgcctttctgatttggctcttcctttggctgttgttggtgtatatgaatgctagtgatttttgtacattgattttgtatcctgcaaaatttgtatcattcggaaggatacaaaggactttgtatccttggctgaagttatcagctggaggagcttttgggctgagactatggggttttctatatatagaattacgtcatctgcaaacagaaatagtttgtcttcctctcatcctatctggatgccctgtatttgtttctcttgcctgattgctctggctgggacttctaatactatgttgaatagaagtggtgagagaagtcatccttgtcttgtgctggttttcaaggggagtgcttccagcttttgcccattcagtataatgttggctgtgggtttgtcatagatggctcttattattttgaggtatgttcctttaatacctagttaattgataatttttaacatgaagggttgttgaattttattggaagccttttctgctctattgaggtaattatgtagtttttgtctttagttctgtttatgtgatgaatcacatttattgatttgcaaatgttgaacagaccttgcattctggggatgaagcctacttgatcatggtggattagcttt

SEQ ID NO: 41618 - DNA, 1118 bp, Homo sapiens
tcttcagggtaatgaacatgctgctggacaactggcactctggaagagcctggtcagctctgtctgtaactgtgctcttcaacagcaccatctcctctcaaagtattttctttcacttgtgattgcttgtttgatccattggttatttgggagtatattgcttattttccatatatttttgaatttctaaaattttctgttataaaattaaggtgatttaactttctttatatattacaaaatgatcctaagataaaatagaaaaacattgttattttagggagatgggctatgttatgcatcctgttttcaatttaacattgacatcttgacatcttgagcttagttaacaaatgaagtattactttgttgattgtgtcttcattatttgaagagcagctaaaattgagaattttgcctatcataaaaaattacttctaaaaaatcacattatgtagttgcgcagtatagaagtctaaggaatcagttgtagtcaaaccttcatgttctaatttctctgttctagaaatggaaagcagtttaaatatgtggcaacgtagattgttttttgaagtgttagtagagaataggattgtagttaaaattcacttgtaaactaaagaacatttctctaagaattaagattccctcagcatggaggtagaggtaatacatgtgcatatacatatttatttcaagcagcgcattcccctatatggtttcactgtaggacttcaccgaaaaaacattaatttttaaaattaatgttcacaatgttgaaccaagtcctattatgcatttatttggggagttacaagttgccttagaagtttttttatttttttatttttttaaggtttttttttttcccctcttattattatacttttaagttttagggtacatgtgcacaatgtgcaggttagttacatatgtatacatgtgccatggtggtgtgctgcacccattaactcgtcatctagcattaggtatatctcccagtgctatccctcccccctccccccaccccacaacagtccccagagtgtgatgttccccttcctgtgtccatgtgttctcattgttcagttcccacctatgagtgagaatatgcggtg

SEQ ID NO: 41619 - DNA, 1025 bp, Homo sapiens
atcctgaagttttatgtacatagatagcagttcattttttaaatgttcgagttgccatatattatgtatgtgtgtgtgtgtgtgtatatatatatatatatatatatatatatatatatatatacagctatgtgtataatatgtaaaattctcccaaaatgtatgaatataaaactgaatgtattcattcatgtaattataactagcattctaaaatttttaattactcccatttctttgacattctgaaactttttttagattgttttaaaacgctctggttccaccttgaagctgataatctttctgaaaaatatatgagaaactcagaaagtagtcattattataataaatttaattttcttagggaaaaagggcagggttctggatggaaacccctttggaaattcttatttaaacttttgaatgaatctttaatatgattcaggctgagattatgatacctgcccttgtcttatttcaagaggtttgctgtgagaattcatgtaataacatctgtaatgtatttggaatttttgggagaaattcattcttttaaataatgggattattgtatatagtacaaatgaatactcacaaaatttaagaatacatttgactaataattgagcatcttgtcagtttttatgcaagcatatattgtatacctgaggaagatgacagttctataatttttttaaggtaaggttatttttaaattgcatttttgttctaacgttttgcaatttatattctttttaaaatatttcccataattcatcatgctagcttctgtgttcttggaatagtttttgaaaaatgcagagattcgaacatgagtccttaatatactaaacagtgaaagaatgatgatatctcatttctaaagtaagcatggttcacaccactttggcaatacactgcagtactttttaaaaaatattctctagtgataaaagtaaagacagggtactggccaagatcctaattctgacttctgactgtgtgatcttcgatgaaattta

SEQ ID NO: 41620 - DNA, 1078 bp, Homo sapiens
cagcaacaagtgcaatttctccatgttatgttgagctctgttggagcctatggtgagtatttgatgtgaaaaccttgctgtgggaattttttattcttccttttccccccacgccagttcgttttggtaagtcttttatttgaacacaagacgcatgcttttttaaacctctagtttttgaagtaactgtagaagagaatctttaaaaaaaaaaatggagggcagaatgcttgttagcaatctgaaaatcaaagctgaacaagctgcttaaagtttctgattaagaagtttaaaaagaaaaattaattgctactgctttccaggtaattgtattattagtttctgtataaaagaaacattattgctgttgtataaataaaattttcctgtggtacaattaagtattgatttttcagaaactgtccctataaatcttttcacatatttccatgtgctgtccaaaacaaaaattattgaaatgtctaatctgtgagattatatactcctggtaaaatatttttgtatatataaagaaatatttactattggaaaaaagtgtttcatttataggtagaactaaggtttagagataataatggaggatatctgattagcgttgataattttttttaactgtttgcattttttaacttttaggtttgggggcacatgtgaaggttttgttacataggtaaacacgtgtcacaggggtttattgtacatattatttcatcatccagatactgaacctggtacccaatagttatctcttctgctcctccccctcctcccaccccccactccagtagaccccagtgtctgttgtttccttctttgtgtttataagatactatcatttagctcccacttagaagtgagaacatgcagtatttggttttctgttcctgtgttaatttgttaaggataatggcctccatctccatccatattcctgcaaaagacatgatctcattcttttttatggctgcatggtattccatggtgtatgtatatatctcatattttctttatccaatctgtcattgatgggcatttaggttgatttgtgtctgctatt

SEQ ID NO: 41621 - DNA, 1069 bp, Homo sapiens
ttaaaatgtccatactactcaaagtaatctatactttgtagagattcaatgcaatccctacaaaataccaatgatgttcttcacagcaatagaaaaaaaactaccctaaaatttatgtggaaccacaaaagatgcagaatagccaaagctaccttgagcaaaaggaacaaggctggatgaatcacattacctgactttcaaattatactgcagagctatagtcattaaaacagtatggtaatggcatataaacaaaaatacagaccaatggaatgggatggagaatccggaaacaaatccatacatttatgttgaactcattttcaataaaggtgccaagagcatacattggggaaaggatagcctcttcaataaatggtgctgagaaaactgtatatccctatgcagaagaatgaaactagaccctatctctcaccatatacaaaaaccaaatcaaaatggattaaacacttaaatctaagacctcaaactatgaaactactataagaaaacacgagggaaactctctaggacattgaactgggcaaaggtttcttgagtaacatcccacagacacgaaccactaaagcaaaaatggacaaatggaatcatatcaagttaaagacttctgcacagcaatgaaacaacaaaatgaagagacaactcacagaatgggataaaatatttttacactacccatgtgacaagagattaataaccagaatataaaaggggctcaaacaactgtagggaaaaaaatctaataatcctgttaaaaatgggcaaaagatctaaatagacatttctcaaaagacgacatacaaatgtcagacaggcatatgaaaatgtgctcaacatcattgatcatcagggaaatgcaaatcaaaactacaatgagttatcacctcaccctggttaaaatggcttttatccaaaagacaggcaataaaaactgctgataagaatgtggaaaaaaagggaatgcctgtacactgttggtgggaatgtaatgcaaattactacactatgaagaacagtttggagattcctcaaaaaactaaaaatagag

SEQ ID NO: 41622 - DNA, 1462 bp, Homo sapiens
caatcccaatacgtatagaaaggtgcacagaaaggactaatgaataaagttagcgcctgtttaaccactatccaggtggatcaatagaccattttaaatgtgtacttttccagggtgaagactgaaagggactagacaaagaagacaactaaacagagagagaacagcagcccctattctggatgcaccgcgagaggacagccttccttggccacctaggcctgtctgggggcatcttgtctacccacccaccagtcttggaaaacaatcccctggcccttattaccatctccagtcaaattattcccttcccatatttatgattctctctctgacctctacccagtcattcaattcctcatcatataattccttatctctgacttcctgataaggtcagtggacatgccctttttaaaatgataaatgtctgatctcatatctgaactgtcagccttctcacatctccaggtttctactattctcttttgtaatccaaacaaaaaccaccctaaaaatagtctctgtgtggtggctcacatttgtaatcccagcaatttaggaggctgaggcaggaggatcccttgaggtcagaagttcaagaccaacctgggcaacaccagctaccctagaggctgaggtgagaggatcacctgaacccaggagtataaggttacaagtgagcaatgatcatgccactgcacgccagcctgggtgacagagcaacaccttatctctaagaaaatataaaaataataacaaataaaaataatgattttaaaaatagtctctatcatcaccatttggtaaggagacattaagagtccactaggaacctcacacttggccttttccattgtcctgacccaaggctctcctgggctcccggctgcccttcacaggggattcaaacccaccggcagtctgaaaggcttctttccatccactcactgccccaacacccatacttcacctacacttcttccactgcaatcaagaaaacccactcctcaaccagggttaatcagaagtaatcaccattcaatcacctttgaaatttataaaacagagaatcatctcctgtaccaccagcccaaaaataagaatggtgtaaaaatttatcctattcatggactttttttgttaatatctcatggaaaacaaacattttgggcaatgccttgggaagaagggcagagcagagataaagaggttaggattctatccctactctaatattactaaccgggagaatttgggtaacattcatttccctgaacctcagactttcatgagcaatttggagataattaatgatagctacctgacgggttctgctgcgggtttatatatggaaagcatgtaaggtagagtctcacacatagcaaaggctcaatctctccactgtgtttaggccacagaaatatcattttctaataaacaggacagtcctaggttctac

SEQ ID NO: 41623 - DNA, 1032 bp, Homo sapiens
gccccatttcgagacaaagcgcatttccccctcccctcccccacccgcgttccggcggaggcgccccctcccccagccgccacgcggggctgggtcgagacttgggcctcccggagggcggcgcgtggtcccgcgtccgcgaggcctggcggcgcgcggccggctgtcccgaggctgcggcgaccgcccagttaacgtggccgccgcgggggtaggcgcgtgcggtgtggcgcagtgcccttgagcccccgtgccgcggcctttgtttctccccgcggatgcgctgaccacgaggcccgcgctcccgggtgggggcgggcacccgcgcttaggcctctggacgccgggcttcagcggcgggggtcgggagcgggtgtttgcaagaggtgattcttttttcaaagtgtcacgaaacggggttgaagcatcttaagttttttccttttgttatttaattaccgattggaaagagggagggtttctgagcagaaaccaagttgggattgcagaacagagaagattcacagtgctttaccgttgtgagttgtttgggtaatcgtgcctggttttaaaccgaaaggattgtcctttaaaaatggaacatggactttattataaatgggacttagattggaaaagacattggtcccctattttaagccatgtgaagctgttttaggtaccaggatccccagtaaagtctttctagactcacatggttaggacacgtacttaagtacatcataagcaatgtaggtaggagcgcagatctactctggatttgtattcacgtttgaaatgtgcgctctctacttgggggttggaatccaaacagaatttgtatttagttaccttttttgtgtcatgcaaacttaccttaactgtcatgcatttttctagtaatagctcttcaagtctgcaataaaaaatggcctccaacaaaactacattggtaagttaatgaaaacctaaaatatgtaaggatttaactcaagttttttttccccacagtataactttgcatctctgtgg

SEQ ID NO: 41624 - DNA, 1026 bp, Homo sapiens
ttctcagcccataggatcttctgattaaccatttcagggttttttttcccccatttttaatcctctcataaaaattttccccatttttagtcctctcataggaaatcttgagccattggaaagagctggttcacgttggtttcctgcttctcttaaatagtgtcataccaaagaaaatgcctgtttaaagtgaatttggttaccagtatagactttctcttgagaaaccaggaaggaaggatttttttcaccttagggaattaaaataaatttgtaatgttggtctcttgaagtgatagctttatagttttgttctaagtggtaggaaatattatctacagagattatggaaaaataatcttgtcctttaattgaacctcctagtggtctctatagttgaccctgcagttggtatcaggattttgaaccatgttttcattctgcatttatcttttctctgtatcattgatgcttttgacattaatatttgaattgagaagggggctggggcttttaccatctgggggtggatacaaggtctgtcataggttcacctaagacctgtcactactacttgcttctctgtatcaccctttaggtacttcctgcatagttgtttgttgcagtgttgttaaaatgagtgaaaattagtaaacttggtcttttaagactacagggccgggcgcagtggctcacgcctgtaatgccagcactttgggaggcccaggctggtgaatcacttcaggtcaggagtttgagaccagcctggtcaacatggtgaaaccctgtttctaataaaaacacaaaaaaaattagcccggcatggtggcatccgcctataatcccagctactctggaggctgaggcatgagaactgcttgaacctggggaggcggaggttgcagtgagctgagatcacgccactgcactccagcctgggcgacaagagtgtgagaccctgtctcaaaaaaaaagactggaaaaaaataactgtttccagatagtgtttttttattgtattatttt

SEQ ID NO: 41625 - DNA, 1966 bp, Homo sapiens
cggttgacatgaacaacttcgacttgtaactgaatttttctttttcttaaaacaggaaagattcagatgaggcagacttggtgctggcgaaagaggcaaatatgaagtgtcctcaaattgtaattgctttttatgaagagagactaacttggcattcttgtccagaagatgaagctcaataattgttcacattgttcttttatatatatttatatatatatataaaaattgggtcttagattttgatttactagtgtgacaaaataactacatcctaatgaaaatcaagtttgatatgtttgttttgaaagtagcgttggaagagttgttgggggttttttgcatccatagcactggttactttgaacaaataaataaaagctttctgtagttgcttcctttatcagaaaagaacatttgataccatggtatatcatttcctcttcattaaagaacagcttttctaaatgttgggggaaatgtccatagtcattactcagtcaaaacttgtgttctcatgagcctaaggaccattctagatttattacgtgttttttgtgtgtgtgtgtgtgtgtgtgtgtgtgtgtatccataaaatgcatatgtaaatttttttttgtttttaagcattcacccaaacaaaaaaatcacaggtaaacccatgtttctgagatgccattattccaagcaaaataagagataatcccttcaagttaaattgaaaattttcctgaaaccatacatttcaagtgaaataagtaattctagataggacaatttaaattggataattttaaagtgtctataattgcagtggtttatttgcaaaattcctaaaaggaaaaattttatcactgccatcacagcaggtttcctcatccagatgaggaaactagacaaatgctagtgtgttttaactagctaaacaaaactaagttaaatgaacatttaaaagtttccctagcgggccattccttagcaaaatgttggaatccctgttgctacattgactaaaaggtcatgatgaatggaatatgtaagacttggctcatagaaacctaatcagatggttagaggtgttggcagtttaggacctgctgtcataaatgtgtgaacaaccttttgtaacctaacctattgacctgcatgttttttctttaccccaattcattacatggaggctcaatcttgagtttgctttactggttcagcaaaagccaggaagaacaactttgtagtaatcaaaatgttatccaactgtatattgtttactttattgtaaatactggtgaacagtggttaataaatagttttatattcctttatgcaattattagacttttttctttatttgatatgcctttacagtagaaatagaaatgcccacactcattggattatctttgtttataagttagatgataccagtaaggcattacagtacatatcctagatcttttgagcttacgagttttaaacttgaatatgtatttccacaggaatgtttccacagttgggaaataaaagtttcatgtgatgcctagggtcaattgtctcattaaaatgaggttttaaattctggtttgttgtaactgtcttctaaagaatgtaaagtattctgatagggctcagtgtgatgatagacacattttaattgatttccaaaatccatacagaaaaaggtaaataactgatgtttattaagtacctccttatatatatatatatatacccaccactgctctcagcggtgggttcacagatgatagagaaccttctattcatattagtagttggtggccctacattcaattttactaagggcatttctgaaaacaatatattgtcctttggccatgcatggtggcacacacctgtaatcccaaaatttggggaggccaacgcaggaagattacttgaatcccagaagtttgagatcagcccgggcaacagtgagacccccacc

SEQ ID NO: 41626 - DNA, 1077 bp, Homo sapiens
tgggcatggtggtgcatgcctgtaatctcagccactcgggaggctgaggcaggagaattgcttaaacctgggaggcagaggttgcagtgagcagagattatgccactgcactctagcctgggcaacagagcgagactctgtctcaaaaataaataaaaataaaacaaagtgccaaaataataatttttttttttttggcttaggggagtagggactgtgtcttgctgtgttgcccaggctggtctcagactcctggcctcaagggatcctcctgccttggctcccaaagggtttaggattacaggcatgagccactacatctagccctaaatcttttatttttaaagataataagtctgttatcctgaaataaaataatacttaagacctgtggaaaaaaataacaaaatgatttgaagtattaacagggccctcctgcctagagcctcccagctgaactgcctagggaggggtggtctctgctagagtggaagacctggtcctctgaatttccaggtgagtgttcccagttgccttttctgctacttattttaaaaggtttatcccagcctccatctctgaaggcaggatgtatgcagcaagagtattgcttaattcagaagggtgatttaccctggatttcgtggtctttaagtgctttaaaagaattaggccgagcaccgtgtctctcactgtaatctcagcattttgggatgctaaggtgggtgaatcactggagctcaggagttcgagaccagcctggccaacatggcgaaaccccatctctactaaaaatacaaaaattagccaggtgtggtggcgagcacctgtagtcccagctactcgggaggctgcgatgggagaatcacttgagcctgggaggtggaggtggcagtgagccgagattgtaccactgcactccaacctgggtgacagagtgatactctgtctccaaaaaaaaaaaaaaaaaaaaaaaaagccatcatctctcagtttagttgtgttttctgagtatagcttaaaactagttatgttacttcatcattggtattcattggtgttttctcagcatcacta

SEQ ID NO: 41627 - DNA, 1045 bp, Homo sapiens
gatatgcaaatattttctcattctgtgggttgtctctgatggtggcatttgaagcacaaaagttttacatttttatgaagcctaatttacctatttttttgttgttgttgctcatgcttttggtgccatatcaaagaatcctttgccaaatccaaggccatagagactaactgctgtgttttcgtctatgagttttatagttttttgctcttacaaaatggtatttgatccattttcagtcaatatttgtatgtggtataaggtaggagctcaacttcattcttttgcgtgtggctatctacttgtcccagcaccatttgttgaaaggatgattctttccccattgagtggtttcggtgcccttgttggggaaatcaattgactagacagaaataaacctatgggtttatttctcaattctgttcctttgatctgtttgtttgtacttgtgccaataccacaatgccttgagtgctgttgctttgtagtaagttgaaattgggaagtgggaatcctcctgctttattcttctttttcaggattgttttggctatttggagtctcttgcaattcctatgaattttaaaatcagcttgtcagtttgtacaaagaagacatctgggattctgatagtgatcgtgcttgaatccatagatcactttgggcagtgttgccattttaagatgttaaattgtcttccagttcatgaacatggtatgtttttctgtttattttgatctcttaattttttccaacaatgttttgtggttttcagagtatacattttgtacttcttttgttaaatgtaatcctaggtattttattcttttttttttttttttttttgagacagagtctggctctgtcgcccaggctggagtgcagtggcgtgatctccgctcactgcaagctccacctcccgggttcacaccattctcctgcctcagcctctgagtagctgggactacaggtgcccgccaccgcacccggctaatttttttgtatttttagtagagatggggtttcaccatgttagctaggatgg

SEQ ID NO: 41628 - DNA, 1031 bp, Homo sapiens
ctgcaggccatctgccggcgccctgagacccaggagcctccgcgctcccgcgtgggcctcacagggccggtccacagctccaacatagtagctgaactcccttcgttgcgttcctctttttctggaggggaatgttagaagagagagagagcttccttttataaccttcctcattctgctgcacgtctagagtgggtgtgggggctggcaggtgggaggggcggtggacaaatggctgatggtggacgggacactttaccccaacgacacctcctcccctttccaactggctgtgtagttgcttatgagaaccttcaagtccttccctagagagacacatgcaaatctgagcctcatcccaggccaggggtcctgttcctcatcaccctacttccctgaggctgctgaggtcgttaaattgttgtttactattaggtttcacgtcaaccctgggcttgtagagagaaaaagccaaacggagaccaagaattgatgcagtcttgggtaggagaaatcgagagcttgtccaggaagctttgctgtataaattataagcaatgctgtataaattttactccaaccatgtgtacaatgttggaatcagatgaaatttatagtgaatgaatgtatgtgggtttggggtttccactcctcttcagcctttcctcccgttagaacaaggaaggttttttttttttcaaggaaggtacatttcaaatatgttagtcaccctttcagtcttctgtattctgttctccacgtaccgaagttcccccaaacctgtcctctcaagagaaaaaacccatgctgactctggactccctcagtaacaatgaaacattctccccaaacatttcctttcagaatagtatttgtgactttgatccatcccaagcatggttaagagggagcacgggcaggaaaggcccactttctggggttgggcagccacccctgccccagtttcggctcctgggaatcctccgactggagaaggggaaaggcaaggcagtcctcctggaggcggcttc

SEQ ID NO: 41629 - DNA, 1069 bp, Homo sapiens
ccttcctcttgtctcaactgcaagaggcatgccttcctcttatactaatcctcctcagcacagaccctttacggatgtcgggctgggggatggtcaggtctttcccttcccacgaggccatatttcagactatcacatggggagaaaccttggacaatacctggctttcctaggcagaggtccctgcaggcttccacagtttttgtgtccctgggtacttgagattagggagtggtgatgactcttaaggagcatgctgccttcaagcatctgtttaacagagcacatcttgcacaacccttaatccgtttaaccgtgagtttgacacagcacatgtttcagagagcacggggttggtggtaaggtcatagattaacagaatctcaaggcagaataatttttcttagtacagaacaaaatggagtctcctatgtctacttctttctacacagacacagtaacagtctgatctctcttgcttttccccacacatacccggcaaatttttgtatttttagtagagacgaggtttctccatgttggtcaggctagtgtcgaactcctgacctcttgatccgcctgcctcggccttccaaagtgctgggattacaggtgtgagccaccgcacccagcccatcacgttcttaaattgtagaccgctgtttatagttctcactgcagccatgtttgtagaattaaccagcaaataccttttccataacaaaagtaaaattttggaattcaaagtttcaacctttttaataatgttaaaataatcatgaaagatcctaatgatgctccttgtatacttcttttggggactttgttgtattcttttggaatggatatgttaaatctgggctttatgcatttctgtctttttaaagcttattttgtcccaaataaacctttagaagaagataaaaatgtcctctaccctaatatgtgtgggccaatatcatagcattttagaaaccaacttataaaaatctaaaaagtaaataaaagtggtgcgggtgatacctgggcggaatgtcttggcactcaggtgtaaaggattctggaaata

SEQ ID NO: 41630 - DNA, 1028 bp, Homo sapiens
tccgtaaagagatgaatagtgtcaaatgttttttaccttgacacagaacaaagtaaattgtaagatttgtcccagcatgcagatacaccagaaactaaatttcatgaaacacttacccttaatatactccagtactttctcttctatataattacaaaataaatgccagtcatgaaccactaaattggttttatcacttcttactgggtttgtaacctgtagtttcaaccattcctttggaggctaaaggtgactaaggttcgtccagcttcagtattctgttgtctacaatcaggccaatcagaatcatagaacatggataatctaaccttgtggctgatgcataaatttttgtaatattcctagcaaatggatatctagtacctgttttaaacatctccaattttcaatatttaacatggtatttagtccatctggaaaatacagattgaggtatgtatatattcatgttgtaagtagaaaatgtgttagcattaggtgagacatgggtggtctgtttgtgcatatataaacatcttggtgctaaaggtctttttacaaaatttgccaattggctgcaggcaagacttgccaaagatgagagattagtgaatttagtggatttagggggaggcagatgtctaagtaaaacaaataaaacacttacattggaggtataaattaagttttttgaattttgatatatgtgaaaattcttcagaggtgaatttgtaatgcatgtctaatattttaaatattaattttctttagtctataactccctcagttgttggatctgctagacattcagtatgtgccacctttgaaaataatactctgtggtcaataaaaaataaataacaagtatttaaaaactcactgtgtttagtgaaattaaattttaatcaaaacacatttttatatttgatcatatggatagttagattatccttgagaaattggatagcaaattgcattttaatatagtagaaactctactattcaatttatgtagatttttatagcat

SEQ ID NO: 41631 - DNA, 1030 bp, Homo sapiens
tattcccacccccactcccagtcctcagtagacttttatattggttcttcccttgctcctcctccagcctctttcccattgtaaagtatatacttgcctgtcctaaatgagtgggttttgccctagtgaagatacaaggggaaaggatattctgggaatataagcttaaacctaagagaagaaaaaatttaactttgagtaggaaggaagaatctagttttgataatttgcgaaaggaggaaggacatatcccagattcttgtcaagaacagtgtggggaatgagacatggcaagtattgttaaattgaaataacatgaattttataataggaagtttaataattttgtttgttaacttcctcttaggatattaccttccaaatgatgatggagaattttatcagttctgttacgttacccataagggtgaaattcgtggagcaagtacacctttccagtttcgagcttcttctccagttgaagagctgcttactatggaagatgaaggaaattctgacatgttagtggtgaccacaaaagcaggccttcttgaggttggtgttcacagtgagatagtgattcattgataattttaagaacagagctcatgttggttggcattttaagaattttaaggttatgtgagagttgccacaaaaatcgaatgctttggctgggcgcagtggctcacgcctgtaatcccggcactctgggaggccgaggcaggcagatcacgatgtcaggatatcgagaccatcctggctaacacggtgtaactctgtctctactaagaatacaaaaaattagacgggcgtggtggcaggcacctgtagtcccagctactcgggaggctgaagcaggagaatggcatgaacccgggaggcagagcttgcagtgagccaagatcgtgccactgcactccagcctgggcgacagagcgagactccgtatcaaaaaaaaaaaaaaaaaaaaaaaaaaaaaaaaaaaaaaaaaaaaaatcgaatgctttttaactaaaataataaattt

SEQ ID NO: 41632 - DNA, 1098 bp, Homo sapiens
agaacaggtcagttcctattaaccttctgccacagctgcttttatgtttgtaagatggttaaaatacttttagacttttggtaccaggcttgttgaggtagtccctgacaactatttccagatgttttacatctaattgtagaatacttgattttttttgtttagaaatacaattagaaatgataaacgctgaataaaggaaaaatgggatacataaattaaaattacttttcaaaaaagcataatttggtgaaataagatgtagtattagacaaaattttgaaatttttaatgggtgaaatgctatgttatcctaagaaacaaactagttaaaattggcagaatttcttgagctaagaaaaagagagacaggtacaatgaagcagaaaacattgtggcttcattagtgatagaaatagacttgtaagaagccaaaaacagtgaaaaaacagttatctagtcattgacttgtttatttaatattttcacaagaaaagcagtttgttctgaaacttacacagactgtgatcttatatattacagtctcatgtacagtagagccggttgggcatatttatgcccatttacagtattgagctattgtttcctgagggtggggtctgttctgttatccttttgtccaacaaggcctccagcaattgcttaataattgctaaatgaaccgctagtgcagtgattctcaaacatttgtatactccagtggagtggttatatattgcacacctgggcagagatgttatacaagtaagtcttaaattctgaaaagattttccttgctttgttctatttgtttgaggattgctcttttgagttagagggtaaacataatgtcaagtactatgtacatttacaaatctccttataaatgtgaagtcttcaattctgtcttttctatcgttagcctttttagttaaaaatatgcaagtatttcccagttttactcctggggaacacttagtgtcctgcagcagactataggagtaggattttccatttggttaaggaactacttttttcatttgaacctttgaagcaggtataccaagtattaaaatatagtaaaatctcataatatgt

SEQ ID NO: 41633 - DNA, 1040 bp, Homo sapiens
gattgcacagttagtaagtgatagaggctagcagtatggctccagtccgtgcttttaaccactgctgtatacttctgagggccaaagatgtgagctgatctaattgattatttttcaaaacagctttattgagatgtcatttgtgtatcataaagttcaccagtttatacaattcaatggattttaatgtatttacaaaatcatgcaaccattaccatagtctaatttaggaacaaattcatccccaaaagaaagcttttacttacttgtggttactctaccgtttaccttctgattgcttcccccagtcccagacagccactaattgaaatttctgtatctatggatttgtgtattttggacatttcacatgaatggaatcatataatatgtggcctttgtgactggcttatttcacttagcataatgttttcaaggttcatccatgttgtaatatatattgttaattcactccttttattgccaaataatctattgtactgatgagtattttttgaaaccccatctttacatttatcaaagacttctgtgaaaattagcagtttgtgtgtttcattgtgttcttgtttgtattttggagtgctagatacgtattggaaattgaaagagttaaaactgaggctcagagaaccagtgattttgaatcttgtttttcaaataggagtaaaaagagctgtgcctctgttaagtttttcagttaatttagcttataatttttttggagcctaaactatgaattgagtttttttcatataattgtattttcaacttgaataataagatggatgtgatgtacttcaaggcatttttgaactatatttgagaatattaaagtaatattgccaaaacaatgtaatggaggatgttacaaactgttaaatgtattcatactgttttgattcttaagtttcacaaactgggtaggagacatcaccaggtatttgggaagtatcataggtatgggagtgagagaatgtgcaagatctcttctctggttagtgtggacctcttaagctatc

SEQ ID NO: 41634 - DNA, 1052 bp, Homo sapiens
ctctccataactcagggagaccactggattctgcctgagtttgcctctttgccctgtggccttaaaagtctctctagacagtaataagctggagcagttatagaggtgacctctgttgtttcttttctttcagggatcactgaccttttatcctgatgtccagtggcttgagagctgttcttcattcagttttttagttttcaggtggtagagttcatttggttcttgttactttatcttggcacgattttagttgcatctaattgtgtgttttagagtcgctatcaggagaaatgtttatttagaggagccaagatattctttctcaagtgatttgaattatctggtattctaggtacccaggtttaaaagcctgtatggtttttctgcacgtatttggcattctgttcttagttttctattccatggtactcaaagtagctggttcagaaactttgttactggtctgtgttggaatgaaaaatgtacactgcaatgtatgtaaatgcattactttcttcactgagaaagtattgctatgaaaagctgttaggtgaacccaacagtgtggttagtgatgtagttgatttatattttgtacaagtgtcttgtcttgatatagcctggtaactgtcggtggtctagtactgttcgcctagtcacactcttgagtagctgcttgtactttatattacgtagtttaacaaacgtggacttttatttaatatgctttttattgtactcaagaatatagataggttctgtaagattgtatccaggattattcagttgcagatataaaagaaagcaagcatccaaaagccaacctatattaacttcagttaccttgatttttaaaaaacttatacaattggccaggtgcggtggctcacgcctgtaatcccagcactttgggaggctgaggtgggtggatcacaaggtcaagagatcgagaccatcctggccaacatggtgaaacctcgtctctactaaaaatacaaaaattagctgagtgtggtggcacgcacctgtagtcctgctactcgggaggc

SEQ ID NO: 41635 - DNA, 1532 bp, Homo sapiens
cgtacgagacagaacgatggcagacctgcatactgcacgcttggaaaacgagaaagtgaaaaagcagttagctgatgcagtggcagaacttaaactaaatgctatgaaaaaagatcaggtaaaacaagttaattttgaatttgcattttgatttaagaaaccactataatctcacaaagtagtaaattgtgttaagataagacaggtcagatttctgccttattttaaatttaaaattttcattccttttgtttagtcattgtgacttcttggcttacagttaatgtgtgctgtaaggaaaacttctgtaagcagaattcttaatggttggtgaaagctgccctattgattaaatatattgatgtcagatatgtattgttttgtttggaatttcttactagctgtataaaacagtattatggttgtttaagggagtaataattgctcttcaggaggtggattatttttctctagttttttaaatgaaccttagtcctaagaatgtaaaactggacttaacaagagaccctatgttgctctgtagccaaaatcccaaaataaaaaagtggccggggacagttgctcacacctataacctcagcactttggggggctgaggtgggaagatcgcttgatcccaggaattcaagaccagcccgggcaacatagtgagacctcatctctacaaaaattttcaaaaattacccaggtgtggtggtgtgcagctgtagtcccagctagtccaaaggctgagacaagaggattgcttgagccaggaggtcaaggctgcagtgagccataattgggccactgtgtttcagcctgggtgacagagcaagactctgtctcaaaaacaaaaaaaagaaaaaaagtaagattgaagttggggttactattaacattaggaggtatcagatttttatttttttcttcaaatgtttgtttctttctaggacaagactgatacactggaacacgaactaagaagagaagttgaagatctgaaactccgtcttcagatggctgcagaccattataaagaaaaatttaaggaatgccaaaggctccaaaaacaaataaacaaactttcagatcaatcagtaagtatcattaaatttacacatagtaaaatgtgttgttagtatttttgttcgaaaatcaaatttgtaatattccaaatatcaaccttttaaatattatttatctctgcttgatttcaagtcattggccaaatattgtaataactcttctttaaaaaagtctggaattttaatttactggacagccaacaaaggaagcaagggcagtagcaaggaaaaaacagaaaaaagtcttcttttctagataatttccctcttaagttcttgataaatatctgtcactcaaaactcaatacttattattgactcttgtgaccatgacatctatcctcattggagttcaccattaatcatccctaggtcttagatggtgtctcagttgtaattggcaagttcttcatactcatattatgaagattcctattcctatta

SEQ ID NO: 41636 - DNA, 1615 bp, Homo sapiens
ttaatatgcacacctcgagtaactttattttgcagtcagaagatttttcacattagaaagtaattcttatgtatattcagaattaaaaaaaattcttgttgttacaacaacaaaaatcacttgcaaatgaagtgttttagtaagtaattttagtaagaatatggaaagcaaatttgagttgacctgttctttctttctgtttctctgccctgggagtgattaatagccacaggccccagcacttttgagtcagggttgaggtgacctacctactctttcagcctaccctagtgcctacacctgccatatctcctctcttctgcaccagaaactgtggtcaattgtcagatcaaaaaccttttgtgactcccgtttacctaatgattgtaataactttaacatcataattatgacagcagcaaacatttctatacccctctttgccattaatgctgaactctttagatagagtcacttatttgttcttcatagcagtcctatgaggtaggaattgttactgttacaactttatagtggaggaaaccaagagacagattaaatagcatgccccaaatcacttagctgctgtgggtagagacaggattgaatctcatgagattggctatagaagttgtggtcttagccacctgtcaaatggactaaaccagaggttttcatactttcttagttctagtaacccctaggccaaaagaaatacagtaagtcctcacttaatgtcatatataataagttactggaaattgtgactttaaacgaaatgatgtgtaacaaaaccagttttttccctcatcaacgttgtaatgaaccgatgaaagaatgatgttatttctttcaacctgctgtaagtcctttcacttaaagttgcagtttctaagaactgctccatgatgttaagtaaggacttgctgaccgttaagtatttgtcttctaacaaatttagtgaccattaaaaaaaaaagaaaaaactacacataaattgaaagaaaattaatgtgtttatttcattcctaaataagtagttactaatgggatgtgtgtgactattggccactgtacaactcctcaagccttagaatcagattggacaagccaccttcatttcctgtttctcattgattttcacaatgtggcacttgctttatatcacagcaactgccaaaaccagcatctcgaagataagatggcattgaaaggaatgtgtagcacatttaaagttgaatctgtgagcgatctccagtgactgtagttgttcacgtggtatatgacaaatgcagatgctcctcaacttacgatggggttacatcctgataaacccatcataagttaaatatgtgtttttgacttgaaggatattttcagcttacagtgggttcattggaacgtaaccccatcataagttgaggaaggtactgaatgtgtattgcttttgtaccatcttaaagttcaaaaattgtaagtctaaccattgtatgttggagaccaactctaatgaatatttctgtgtacttctgcatatataatatccttagaaaattaaaattatcccacagtaaccctcggaatttactgtggtgccctaggtactttcatacct

SEQ ID NO: 41637 - DNA, 1055 bp, Homo sapiens
cggctgcgcttggggatatgctgttagttcatgacatgagagcagctaacggctgctgagagataaaaaggaaataggcaatttagatgatgtgcctggtttcagtgttaaatgagcctgtgtgtttggctgttgatgtagcacgtacagatctctaaaaactgctgggatgcagccatgggaatccaaatcagtgttttctttgtgatgaaaactagatgcacaaatttttagaagtctcacttgacaacctctgaaatatttaactttggattttgttcctctatagcagagttttgaggcttgtagtttagtgcattgctttgctttaacacgtgttaatccagttggacttgcttccccaagaatatgcatatacaaactcacacatactttattagtttttcattatgatttctgtatatcatgcaatggatgtatcttgtcagagagactgtctttcttgtaattaagcttacagttattaaatgagaacgtttgggacaataatgcagtctgacagtattgaaagtagggccaggcacagcggctcacgcctgaaatcccggcactttgagagaccaaggaggacggatcacttgaggccaggagtttgagatcagcctggctaacatggtgaaaccctgtctctactaaaaaatacaaaaattagctgggcatggtggtgcacacctataatcccagctactcaggaggctgaggcataagaattgcttgaacccaggaggcaggggttgcagtcagccgagatcgcgccactgcactccagcctgggtgacagagtgatgactccatctcaaaaaaaaaaaaagcaaaaaactggtcacccagtctgcagaatgataaagtcagtaaaagttacctacgtatataggtttgaaaaggtctactgttctcagcttcatttacacatacaggtatggtaaatggtatgtgtaaatggtatgtctctattcctctgaatactgctttttatttcaagaacaccacagtgttagtttatagtgaaatactctgcaaagtttcaaacatgt

SEQ ID NO: 41638 - DNA, 1048 bp, Homo sapiens
tactttaaatttcatatggaaccaaaaaagggcccatatagccaagacaatcctaagcaaaaagaacaaagctggaggcatcatcctacctgacttcaaactatactacaagggtacagtaaccaaaacagcatggtacggatgccaaaacagatatatagaccagtggaaagaacagaggcctcagaaataatgccacacatctacaaccatctgatctttgacaaacctgataaaaataagcaatggggaaaggattccctatttaataaatgctgttgggaaaactggctagccatatgcagaaaactgaaactggaccccttcttacaccttatacaaaaattaactgaacatggattaaagacttaaacataaaacataaaaccataaaaaccctagaagaaaacctaggcaataccattcaggacataggcatgggaaaagacttcatgactaaaacaccaaaagcaatggcaacaaaagccaaaatagacaaatgggatctaattaaactaaagagctttgcacagcaaaagaaactatcatcagagtgaacaggaaacctacagaatgggagaaaatttttgcaatctatccatctgacaaagggctaatatccagaatctgcaaagaacttaaatttacaagaaaaaaacaaacaaccccatcaaaaagtgggcaaaggatatgaacacacttctcaaaagaagacatttatgcggccagcaaacatatgaaaaaaagctcatcatcactgatcattagagaaatgtaaatcaaaaccacaatgagataccatctcactccagttaaaatgggaatcattaaaaagtcaggaaacaacagatgctggagaggatgtggagaaacaggaaggcttttacactgttggtgggagtgtaaattatttcaaccattgtggaagacagtgtggtgattcctcaaggatctagaaccagaaataccattcgacccagcaatcccattactgggtatatactcaaaggattataaatcattctactataaagacacatgcacatgt

SEQ ID NO: 41639 - DNA, 1051 bp, Homo sapiens
gcgggctacttgtatatttcgttgtcagtctgcagaatgtgtttgatttttatttttccctccttctctgacatgtgtcaaggaataaagactggatacaggtccattacgtcattctgcaggccagtaagtgtttgattaacggcttgagctcctcaagggttcaggagcttagaatgctgacaaagcaactctgctttgcatccccctaccctccccacaacacactcgtgcaatcgccggctccctgggcatctttattgccctctcttcccagcccctccctctccaccactcccccgtctacaccgttatcactctagccccgcccccgcctttttacagctttccctggggcgagcacggtccctggagtgtgggtaaaagcttctggggtctgaggggaccactgtacctgatcagcgcgcaatccgcccttttgtattatttaagaaaggcaccagtaagccttctcctctagggcgaaaatgcttagtcctgatagaaaaggcaaatcaggaaatgtttgcaagcgttatgataatactctgtcctcgtggtggtgacttaggaaagcaatacacccactgcaaacaaagtatttcactttacgtagtgcctgccctttagcagaagagggatgctgacaaaatcaggtttagctgaaaggatcaagactaaacgtttcatttccaaagtgagggaatgtgagtcgttgaacctaaacttccatacaataaattgctgcgtgcgttagtttctagctcttaaccttaagtttctatgttgaaagaggaagtcgaatacgtaagtcattgaactgagtcagaacctccgtatctggcagttgaaataaagaccctgtgtatgacttgttgcaagggatcaaagtaaaaagaaccctcggtgtggggggtgggggggtgggggcgtgagggaggtgtgcagcagaaattaaatttaaaaaagtattaacagagttttggatagagggagagaggggattggagtggtccctgatttggagttggtgaaaactaaataaagaaaa

SEQ ID NO: 41640 - DNA, 1076 bp, Homo sapiens
ctcagaaaggaggaggcccaggcttgtgcataatatcaaggaacattctgtggacaagaggatactatttctgacttattctctgtgcttcggggaaaaacagagaaaattgcaggaaggagatggtttgctgtgtggagagatggagtgtgctgtgtttgctcttttggctccaaagagggaagaattttggaacaagtagacctatacatcaatggaaaggactgtctcagaaattagtgacctccctggcatggggtgtcagaattattataggaagagtttctagaagcagtaagaaggagggctggaccagttgctcctggctttttttggattatgaacactttaaacaattaggtaaaagctatgagccagttttcataaaaataacatataggcaaatattcatgagaaggttcatggacccagaagccatggactccagaatgaaaaaatgtctgggctcaataatgatgcttaacaatgctatggttatatggacacataaacttaaaattgctgcggttgaatgaatatgatcagtttcatgtggttcatcctacatgtgttggtgcatacattacatgtattaagctgtgaaagtaaccagagctaatgaacttccggtgaagtgtataatccggaatggaaattcacattcattggattctcatttatgtttctctatgagagtaactgcctgtttgcccaatagcccatacctagacaaccactgattaataacaccttacattgtttaggagtttcaaagtaatttaatagaaattatcttattagggtgatataacaactcagtgaaatatgaaggatagatattatccttcccattttagtggatgcagaaactaagaatcccagggcttaagtggtatgtgcagtcccagctaaagtaagtgccagacatataactggaattcaggtatccttccctcccttcttccttttctcctgcttctctttgtccatcctctctgcctccatgctagccacatacacttatggaaccaagtgtgctctttgttactaagaagcagcaacaaccacaaataaac

SEQ ID NO: 41641 - DNA, 1675 bp, Homo sapiens
tatgtagtgtcttaagtgtttactgggcagagcatgtgagagacaaagcacaagaatcctgcccaaagaccttactacctagggtcacattgattgttatgtaacagactttcacccaagagtagatattgcttaactcattcatttctctagagctagagtttagggtttcctttaacatgtagatgaccttaacatactgatttgtatttttacttacaatagatattcacactgaagaatatgttgcatactccaaaaacgggcagggtatgagatgggaatgagagtgtggactgagttgctgtcaaaggggggtgtcggggccactgaggatgggctagagatcactgatccccaacttgaccatatagggcctctcggtttttccttacttttatatttgaaagattttttttctacctgataagtattgattaattcatttttctttttaaattaatggcattcataattgtcaatcagaaattgtgataaacatgagatgtctgatgttaccatactgaatcaaaataattgcagccaacagtaaagaaagttgccattttacttgacatgtgaagctttcttgtgtgtgaataactaaatgtttacatacacgttaaccttttggaaatactgaaaattgaactgatctctgttattacattcacagacttcctaggaatccagagacccccaagtggggagcaactggatttagcaattgccgtaagttcccatctgcttctaacattctgtgatttgtgaacacagcattacaactaataaaatcgaccagttacaaatgttgcttccaacagcaagttttgaaatacaggtccaacatttttgtgggaaaggagcaaacagagatacttctaaaacttggagagcagggtaaagactgggaatagctgcacttcactatgtcccatgattttccttggtgaacaaccaaaattagtgatgtccactctgttgtccttgaccacagacagatctacttgtgatttaagaaaaaccccaaccccaaaccgaaccaaaccaaaacaacagacccttcatgtgatgctttatgtctacatcctgaatagaccttacaccatcctctgtatcgtaagctctatactgcaggcagaatgaaaaaccagacctgactatatcaaccctctgttggttcttcactgcccatagggtaaaatttaacctccttggcttgatgtacaaggtttgcattatataactatcatctgcacctgattcctctccatgtatactttgtgaacctgctagactgaattttccatcatccttgcaaactaccagacctttcttaaatctctgcctttgcacatgccattctgctaactggaatattctctctgctcaatctttgttggataaatccctataatagccagttaagacaatagcacttattatgtactaggcattcatttaatccttacaatgaggtggttgccattatcagccccagtttgcagaggaggaacctggcccagagatgtttggtagacttcccaaggtcacagagccaataaatgaggaagctaggatttgaacctgtgcagtctatcactcaggacctgtattcttaatctctgtgccacactgcctatctcctaagatggcactttcaaaggtgaaggaa

SEQ ID NO: 41642 - DNA, 1543 bp, Homo sapiens
cctttggtatactgatttcctttccttttgatatgtttctcaaaatcctccagcagtggaattgatggattatatggtagttttttttgtttgttttttgagaaactttcatactgttttctataatggctgtactaattcacattcccatcaatagtgtataagagttcccttttcccgcatccacactgtcagcatgtgttaactttttgtcttttcgataatagccattctaactggggtgagatgatatctcgttgtggttttgatttgcattttcctttatgagttttaaccactaagttgtatagtaaatggttaaagtcacattaatcactgtaatgttgtgactcaatatcagagtttatcttgagtcagtatcactcatcattgagtctcttaatattgttaagatcacttagtcacattttctattacattctctttttgaataattagggtaaatgcatatgtaaaatatgtcattcaaatatacagacattcaaagatcattccttacgtaggacagtaatagaagctaattttaattgaacacctactttggaccagacactgcagagctctctatatgccttatttcgtttaatcttcagaacaactctataaggtaaagtcaagaactgtgaagagctgagatttccccctacttgcaacctaattagtctactagtttcatggatgctggcagtagctatgagactcctgggtcagacacaaagttctttattactcatggccagcaagcagcatcagcctcatgttcatatcacttcctcttgttcctagctcctatgagagtgatgtggagtgacccaggtggctgctgaacatgcagggagtttacattatggctgaagaactctgggcttagaaatctcattctcttttaatgttgggggaagcagccttgcctgacctttgctcccaagggagatatctttattacactggacagtaagcaaacctgccatctgctccagagggacacactaagtctgtcttctaactctgctgtgcaaacatatttgaaaaaattccagaaccaaggccatctgtacctctgctgctaggacatacatagtccatagaggactgtctcccaacacttagtcgctctattttacaggcaggaaaactggatttagagaggtggaatcattcattcattccagaaatatgtattgaatacctgtatgtgttaaggttccttagctaaaaattggaggagggggagtcaacacaggctctaggccactaacttgtccccttacccacttaacccctctcctcctcagccactgtctcatcttgcctccccaccttatggctaattatataaaatgataattcacttacgatgatgatgactctttgggacacatgtttctcctgccatcaaattcttcctctgcagcttgacccagccccagatacccaaatgccataggtcatttacctgagatgtggaagcggtattggtagatcctgatacaagtcagaatggtgttttgaggtggaattt

SEQ ID NO: 41643 - DNA, 1030 bp, Homo sapiens
ttaaatggtaatccagaaagtaagtttactgatattgtttggctgtgtccccacccaaatctcatcttgagttgtagctcccataatccccatatgtggtgggagggagctggtagggggtaattgaatcatgaggttgggcgtttcccatgctgttcttgtgatagtgaataagtctcacgagaactgatggttttacaaaagggcagttcccctgcacatactctcttgtaagacgttcctttgctcctccttcactttctgccatgattgtaaagcctccccagccacgtggaactgcgagtcaattaaacctgtttttctttataaattactcagtctcaggtatgtctttattagcagtgtgagaaccgactaatacatttatactcagactttctttgatggagccagcctccttgaaagcagttatttttagatgttccaacagccatctatcttacaaaaggattttctcttcagataggctctgcctatcaggttctacagtaggctgcagaaagaggaaattactttgtttttgcactttaacagcaaagtcaagtggaggaagaaactaagaatccttggaccttggagcagggttttactgaagagtgaaagtgggtcccgggagccaatattcttctttttctttttttttttttatttgagacggaatctcgctctgttgcccaggctggagtgcagtggcgcgatctcggctcactgcaagctccgcctcccaggttcacgccattctcctgcctcagcctcccgagtagctgggactacaggcgcccgccaccacgcctggctaattttttgtatttttagttgagatggggtttcactgtgttagccaggatgatctcgatcttctgacctcatgatccgcctgcctcagcctcccaaagtgctgggattacaggcgtgagccactgcgcccggcctattcttctaacatacttgagagggtgagggaatgattgcagctttgctgagggtatccaaggcctgttcatggtag

SEQ ID NO: 41644 - DNA, 1027 bp, Homo sapiens
ggccaggcagtgttagagatgatttagtctaaccttttcattttacaaacatagaagccgagcccagaggggttaaatgacttgcttttgttcacactgctgggagcagcaccacggctgggatgcaggccgttgtgacttctgctttgaggttctttctattctctgctcacacacctagacttgatgaggtagaaatgaaactctggcttcttaatcaattcataagcattacctactcctcttaccttttttaaaatggcatttgcctcctctttattttgttcaagtttcttcttcttctcctcttccatgtaatatgtgtgcatggaagcaaagtatatcatatgccaaagaacttaagttaaatattatcatttcccctgaccactcactaaaggcaatcttctctaaattgttttttgtttggttttgtttttgtttttggaagttactgctaaactcaataacatgcttctgtctttgtttctttatttgttagctgttgtaacatctcttaagtctctgccttgaaagatgcagattcagctcagttgtcctgtgcctcctctacctctgccttctctcattactttattccattattgctttcgctattggctgtacacttaaaccttccctttgtggcccatcaactttccatcgttttgcgtaagatggagttctaagctctcttaggatccttttcttgccctcctctcttctacatttccacctttggcatctgcatagttacttccacattgttaagtgattttcctctgtattttgtcctgcaacctcaatgatatcttctgtgcttttggttaactctaacagtgaaaaatgagtaaattgcattcataattatgactatgcaattcgtgtttgttgcttgaccaaatcatgtgttaggatccttctctgggggacctgaggtcgtaactcaagggcctctcaaagaagaatattcctaacgtcaatgtcgaattggttaactttttaaaaaacttcattggttgcttaa

SEQ ID NO: 41645 - DNA, 1050 bp, Homo sapiens
gggaacctggctctttgtgcctcaagtcaaggtaatttgggcaaaacatattactgatttttcagttgctgtaacagatgtaaatgatgtaacaagtatgccagcactggctgtgatctggaaaactttaaaggggtctgtgctgtgtgtctatggagtgggtgtgaggtgcgcaaagggaagtagaagtaaaattatgattcagagggagggtctctgcttggtaattctcctcctggaagaactcccccttaatttgtgcattcattgcaataacttgactggaaagtaactattctatactagtggctggcatctaagattcctcagatctaaagttatcccagctatgttaggctttctgcaagtctttctgtggtttgggcataaacaagtaaggcccaggttattcaggtattttacaatgaatctggattctagccacttttctggggtgccattctgtccctttgccaaactgtgtgtgtgtgtgtgtgtgtgtgtgtgtgtgtgtgtgtgtgtttgtctatatctatatgtactttttttttcctggaaaattattcttgagtgaagctggtttgtgaggttgtagcttacaaatagcgtgttttgaatctgcctagaggtttcatggtacatagtacatgtatgtgtatgtgtgtgcatgtgcaaatacatatgctgtggaggtgggacaagggaacaaaaggttgcatgtgcacagaagtatggcggtcctacaggagcatccctatgtgggtaccattgtctagagagtgttgctaaattgatctctccatcctgggtcctgggaacttaaatgtaaaggtgggttggctttatatgcaattcacttgccttactttaaaagtgatccctgagctcacattcttgaataagctccatatggtttcccaagcagatactgcattttaaagtatattcacattgaacatatacatattgacaacaatggaagttgcgggaaggtgtcactctgcatggtactaactttagctgccagctccctttaccgagggagaaagg

SEQ ID NO: 41646 - DNA, 1037 bp, Homo sapiens
tgctgtgagccatgattgtgccactgcactccagcctgggtgacagagcgagaccctgtctcaaaacaacaacaacaacaaaacccacacagagacatttagtttatacatataaaattgacttatcttctcatatgattttaaatgtatgtttcctctacatgaatggcacttgagagttaagcaggtgagtgcaaggcacgtgcctagcaggcgtgtcttgcttatgacaaaacacttggcatccctgatccttgcccactaaaggcccataacacccctccaatcatggtaagaaacaaaatgaaacaccccaacaatttccccaaggcccttgaagcagggcctgccctactatgtgctgctgttctagatatatctggtatttaacatcaccgatgaaattgctggaggtgcaagctgcccccaagggcattgcgatgaaacaaaataaaatctttgtaaatgaaaatgctgccctctttactttgttggtgtgtgagacaggttttgtaaacctttttgctggaagaggctctggtccaaacaaattcctaactgaaagagactcctctccaattctttttttttttttgagatggagtctcgctctgtcgcccaggctggagtgcagtggcatgatctcggctcactgtaagctccgcctcctggattcatgccattctcctgcctcagcctcctgagtagctgggactacaggcactcgccaccacacctggctaattttttgtatttttagaagagacggggcttcatcgtgttagccaggatggtctcgatctcctgacctcgtggtctgcctgcctcggcctcccaaagtgctgggtttacaggcatgagccaccacgcgcggctccaattcttattcctgtgtaagtttcctcataacttctgttggaagtcattcctgtccaacatgccctcctcttccaaagctgccacagttgtaggtaaaatggcccagctgttcttcctggggcaccagattggcctgagtgtggctccagaggcacctg

SEQ ID NO: 41647 - DNA, 1025 bp, Homo sapiens
tgaagttgtgattttacagtggcctcagcacaccacctcatttgtcctcaaatggagcttcccctgtaattgtgcggagtggatctgagcacctccctgacgtgcatgaacacggtacctctactgacttctgttctgtttatcaaataatgaacagagttttttaaaacagcttttgacaaaagaagtagaagggggcaaagccacatgtgaaacctacttcaagtcatcagttacacgtttaatcttgaggcattaaaaatcattcacttatcagtgggcacatgtcaattcccagacacatttggaaatgcttacagtgtggaagccccgagccgaactgcaggagctgtggagatggatggacagactgggatagcttcctacctgttggaggaatcagacaaacagagcagttcatgatgatttgggagtggaacaagggtgaaggtgggaggctcagaaatttcctcatggtagcatttgaaccaagcctttaagtagaacaagattttgctaaacatagaaggcagaaagggcactgctgactagctatttgaagaaaatagcgactagctattcgaacaaaaatgctgtttgtaaattaaatcctctaagtatgtggtagactctcaggtagtggcaagagattcagaatcacagataggtatgagcctggcagaggatacaaatcaaagctgcagagtggagcacctggaccttccggctcaggagtgaatactgcgctttggggctttgatgcttcatggaggaatgcggggttaaagtagtggggggtgggtgaaacactgcaaagccagtattttaggaagatcccccaggggacagtgtaaaggaggaatgagagaggggagaaagcaggaaggagattgataacagtctactgtccatggctctggccaagagggttgggtgagaggcctatttgtgcttgtgcccgacactggtggatgtgggtagagatctgcatgcatttcactccttggtaaggatggacaatggac

SEQ ID NO: 41648 - DNA, 1397 bp, Homo sapiens
ctctaagtctcagattcgtcattggccaaataagggaaaaaagtacaaccatcacatagatcattctaagaacaaaattaaattagtgtttggaaaatggctttgtaaagtgttaaaactctacaaaggttaactaatggctatttttttttcccatatggaaaaagccactgaatgaataatctttcgcatgagtgtccatttatgtcagcctgctaacgtcatacagtgtggctttgaagtgtagaaggtgtgactgtcaggttttaaaagggaagcagagagactatttctcttgcctctctgcaatgtagcaagcacagctgcaaaagtagtgatttcacaggatctgtagcacctcactggggcagaaacagtcaaaataaggacaactgagaagccagactcaggtaaattgaagaaatgaaataaaaacagacctgaagggcataataacaccttcatttagaaaaagtgttatgttataagtaagtacttatgtttctcttgcggtctttctagtaaattccatccagtttttacccaatcgcttttatcctaaacatatgactggagttaaaaaaaaaaaaaaaaaaaaaaaagctccaaaatgtttagcttagttggtacttcataaaaatcgggaatgataatgttctccaagataatgtcctatctctcatctgctgcaagggaattttcactgctgcaagggaaagcttcaatcagtcttgaaagaaaagtgttgggggtggtggaaagcctgtaggcgttgcagttggcagatgtgtgtttggttcctggctctctcctgctattgtttacctcaaattttctcctctgtaaattggggataataaaatactttttcagtagggttgtggtgaggactaagtcaacggcaataaatctgagttgccttctcttccttctttctgactaagcttttcgtgtcacaagaccaatattaccaatcaggaagcatttccaaacaagtactcctgcctcatcccaaatatgccctgaatggtctgacttttctcggttcaagtgagtccagattctgagagataccggaagggcgcttagacgacatctctccggtgtgttgactcctctgtggagcctgagtctctctgagccccaaggtcaaggctttgcaaatcggggctatgatccggaaaatgtagtgctcatatggttctgggcgtcagaacatgattacatattcctcagtcatagaccactgtgagttaaggtccccatagaaacagatggcacacttgaaggggtaatcaaagaaagtgcaatgtgcacaggctaactggggactagccacagccacagcagggggcttttccaacctctgagcctggagggacagggggccaagggaa

SEQ ID NO: 41649 - DNA, 1076 bp, Homo sapiens
ctatcatagtcttttctctcaggagttcatgggggcagttattttaaatgacaatgaaatactttcttttctggaaaaatagagatgacagggtcgacctaaaccttggctatgttttgttctaatttttcttttttgttttctttcctttttgtgcacagtgagagcaggtaaaaaggaagagagtttgccaccagtcagcatgttttctgaggttatatgtttagtcccattagaaacaagctaaattatttggttacattcaatatttccttcaaaacctaagaatctctacacttgtattttgttaaccacacacatgtcaaataaacttttgttttagagatgtgatgtcttctgcaagaaagtatattgtactgcatggtaacaaggggacaaggacctaaatgcggttcatacgcattcagcgacttactcaacattgcacctctcatgcttcacacaagtgcttattaccaagtatgttctgaactattgaacccatagagaggaaagctataagacaggattatgtgaaacaaaaatcagaattagccagtaactttgaacaaagacctcctatctaaagaaacatatggaaaatttaaaaaaaagaaagaaagaggaatctaacatatgaaaacccaatcccactggaatgttttcctatacacagcataaacgccacataaataaaaccacaaacctctgcagaagtacgtgagaggacgtgagcccccagcactctctcctgttacggccccctctgggaagtaagacccgggttagtttccagagacaaaagctgtttggaaatccttcctcctgggagcagtgggcctcattggaagggaacttctgacagcctctaagcataatataaagtgtgacgcaatcccaaagggggctgtgattcaggttgtaggattctgagcttttgggataccaggggatggcaaatatctttgaagaacagggatattcttctggtttgaacagaatagtaatatttaaccgcagtgttatgtgtcaagttcaggccttctgggggagactactggctctaaactgcccag

SEQ ID NO: 41650 - DNA, 1052 bp, Homo sapiens
ggatgattgggtagccactatttccaatattgctagttgccatgttaaaacaaaggggaagggggaatgctagagtgtcttacaccaggaattagatgctggcccctgggtgacatgtcactttcattcattactcaatgggcagaactagtcacatggcttcatgcaaccacaagagagccagaaaattcagtcccaccatgtgaccagaagtcagacagccaaaaacatttgggagcagcatttttgataaccataatatcattccctgaaaattaaaaataagcattggtttattacattgtacagaacatagaatactaaaaataatttgtcatgttactctaaaatcatatgtgtaatttaaaaatatcagataataggtgggcaaggtcttcataaatggaaatatactgtacagatttcacagttacatttgtagatacatatgtcaaataattaggcatggcatgtaattctttcccaaagtctgacttgaatcacgattctcttctttcatcatgtatatctcctatttttggttaatccatagataatgtctagcatacttatcataccttagacttaacttttacactgttgtgtaaaacattaactacatttgaaaagttccaaatgattttgcaaaattccagtgctactgaggtctaaattcactttcatgttttgcacatggttttctcatatgtataagaagaaatggaaaaattttaactcgtcatgctgccattattagttattcttcatgaccacaaataagcattcatttaaacacttattttttgtaaaatgctgcctacttaggtaggcattaggacacagctcatttttttgtatatatatgttattttaataccttcagtattgttcatttacttcttcctgttttattccttaaatacaaagtttaaagtgcaaacccatagctcctaaagaaatatatagtttagtgattaatcagcatagttggatatatccagggactatctaagaagtagagtgctttcaaaaaaagttcccagggaaggtat

SEQ ID NO: 41651 - DNA, 1026 bp, Homo sapiens
acttgccttgctgagactacttgtggatcgatccagcagagtgctacaaacttggccttatgaattaggaattaccccatcagtcacattatcaggcctggggcaggtctcagtttcttcatatgtaaaccaggaaaaataatttttacataatatggttggtgtaaaaactaatgagatgctgtatgcaaagcacttagcagaatatgtgctcatgcacgtgcacacacacgcacacacacacacatgcacacacgcacgcacacacgcacatacacccttttactttcactctcagatcttgtccatacactttctattcagaaaactcctttatctatatagccagcccttgcctctgacctgttagtatcaaacttccagctgttacttatgttcccatttgactgtcctttagtcacatatttcttcgggctatgaacagtgactttttaaagctaacccattatggtggtgattttaggatttataggatcatacaactttagaaatttttttgaaagatgaggaatatgaagtccagagaatgtaggtaaattcccccatattacagtattctcaaatctagatttctgggttgttgaaattgttttctacacacacaacagagccctttggatcagggagggcaaagcattgaatttagatcaaaaagggatagtgtctgaaggtaagagaggacttagtagtgataagatggttacaaattgtgtaaccttgtgcaaggaagctcgtttcttcatttataaaatagtatcgactcttgttacctcatagaatcatgcgagatctagattctagacaatatgagtgaaaatgttaattgcaaaatcctgcataaatattaattttgtcttctataaacacacaatagttatatgtgtatattagggacctaggtgtatatgtgtgcctcttaataaataaattagttgctaataaaacaatattcaacaaaacccactctttcacacatcccttatctgtaatgccgaatttacgaac

SEQ ID NO: 41652 - DNA, 1803 bp, Homo sapiens
cactgcactgcagattgtgttgatgtggccttgaagtattttagccatttgtgagtatttgtctaattttttttaaaagattactccttgattatggcagaattcaaagctagataaatcaaaaatttagtcaaacttacagattttttctattctcaatcagctgttttactttgctaagtatttaatagcaaaccttttgtgagcagtgagtgcagaagaatagagccaatgggtgagagaacaggcgagtaatcttcatggtagaagaggggatttcatcagactttggcccatgttgtaactgtctgttttcgataatctttccagtcattctgcaccaaattcataattatttcctggtcatattaccttgttctagtattgaacatctgttgttgctgagacaaataagttgagtacaactgtgaatcatttgttcttaaaaatgtaggaaaatcattttgtgaaacccttaagaatatattcggtgtttatgggaatgtgctgaaatttaaaatcactttacaagaataatgaaaggagatggtggtcacaagtcaatgtgatgaggatgctttttggtattttgttcattgttattatacagcattattgaatgcccacattgtattaagaaacaaattagatacagtctgtgaacagaaattcaaaatgtgaaaggtgattgaaaggaaagaccagttaggtagtaatgaattctgaagtccagctgttccatccggaaaagaaattttaaaaggttctgatatttctctaagtgtttcaaagccttttagtccttgtctatgtgaaattataataatcccccctccaccagatttttcctgtcacattctcatgtcataatagtcaagggcttgtatttagcctgtatggcttcaggagaaaccatgaaaataagtgatgcttacaagaggggtacaaaatctcagtcaactcgttttacttatttataattaatttatcatgcatgcttgactctctcctccactccccctcaaaggatatgaagtgccttttttcttttttaaacaagcacttacatagcaactattatttgccagccaaataataaggttctgagcactttaaaaaattaacttaataaaaataaaagacatgcattctatattttgttgcaatagaaatgtatatgtatatatatttaaaaccataaaaatagcatgcaagagaggaagaaattctcatcatctagtcaacttcctttggttgagtaataaattttttttttgatagacatgtgtatgtagaagactaaggaattaagttcattcattcctcaagatagtcaaagctggcttcttaaactgaactataagaaagatgtgtatttcatccatattgtcttcatttctgatagaatggttttacctcaagtgtgtgcccttgattttactaaagacatttttccaagaacagtttcgtgaagcccgtggtcggggtgtggttttagatattctccattgcattattcatgatttcttatatgaagccctgtgtgaggaaattcttgcagatctgaattccaggaaatggtttgcttcccctgaggaactgaaatatttttctccttatggacatgagaatcatgtaactggttctgtttctcttttcgctttgactgccaggttaacacaaagccaagtttactgctaaactttgaaaaccttttcgaacattgtgacgagcatattttacttcctccctagaccagactttcagttctagtttatattttctctggttctgatttttaat

SEQ ID NO: 41653 - DNA, 1033 bp, Homo sapiens
ttagtaaagtggaagatggattaatttatctggagaatttggctaaagaaagttcttgcttgaactttctatgtgtcttacacaaaaaatattggaaagattggactggttctgcacaccacctttaaaacttctagctgcagttggtctagaaaattctgttaaagagcaaatagagaattgatccttacttgacccatgtggctgtccattggggaaaagtctgttgtacagactctgtctctaatcccagcatccttttccagaagcatcccaatgtgtatatagaatcagcgcaggctgtaagcaggttatgtccactggagaaagccctcattatctgtattaatactatacatagcagacaacacgttccataatagcctcaatttccatattaatagaagcttataacctcataaatctttaataagagaattgtttccccttagaaaagcatgttgtaattcactatcaggtatcataaatgtcaacttgccaatggcttagaactcagactagttcatatcctgaaatatataagaaattttgttcatcatttttcattcaagaaacattttcaagtgcccaccacatggcaggcactgtccaaggcattgttgaatataccactgaataaagatgataaaaaacaaacaaaaatacctgccttcaggtagtttacctctagggggcaagagaaacaataaatatgtgaaaaaaaaatctataacatgtcagatggtgataagtgtgatggagaaaggaatagcagggaaggggcacagggcatgctgcgggtggtcaggcaggcattgatggttagtagatgtgcaagcagagacccaaagtgggaggaggtctgaaccaggtacgtactggggagaagaatgtttcaagctgaaagcacataagtgcaaaggcctgaggctggagggtgctctgtgtgttggaggaattacaaagagacccaaggcgggtgtaataaggctagagatccgggtctgggagggcagatcctgggaggccttgt

SEQ ID NO: 41654 - DNA, 1045 bp, Homo sapiens
tgatttgttatgcacagagcttaggaactttcccagaggatttatgaacataaggttattgctgaatttgttggcatggttggcccaggcattcctgtccattgctctctaaccagagcaacaagcctttggataaggaagcctgggcttctcagtgctctagaatgtggtgggcatgcgagtcccacccttgtaaccccacttggttggtctccaaatggctagagggaaacaagatggcccagaattctggcaacccctttctcagtgtgtcgtgcccaagagctcttccccatgctgccaggccacctgaaagtggcctccaaacacttcctgtgcgatccacactccccccatgtggattgtgaggatgtgacttggagtgtggtctgaactcaggacgagggcaagaagtcagctccattccatcgctctctaaaagtcacacatgactttattttctcactggtaaaatgggccttttgacaactttgaagttctaaacacaggaagttagaatacatcaagatctgaagaattgacattaaaactggttcctaggtaggggttgttagattcatacatcactagagcatctcactttgaacattctttctgatgttgactacaagaagtgtccaaaaagcgagcaggaaacaggaatccaaactccacgttcacagagacaattacaccgttgtgacattgctgcctggaagaggcgtctttttcctgcatgtcagcagtaaggaaataattccttgatccagatctctgctagatttttttctttatttgtattacaacaatacatgtgtatatgttttaggcacatgtattacaacatacatgtgtatatgttttaggcaaagttgggaattcagactttgggaacaatttcatgccaatttctgggaagttctggcagacattctgattatacctaaattgcttataatgttcaatccaacaccagctttaacagataattgctatcaaagtataactacctgctgccctttgattttgaagatggcgtcactga

SEQ ID NO: 41655 - DNA, 1432 bp, Homo sapiens
gtcttgtgatgaaacctttattcgcttaaagtctttatcttttggtggcatatgtagctatgtcccctattttattcctgatataatatatgactcttctctttttttctttcacgacgttgctaggggttgatcaattttattagtgtttttaaagaatcaagctttggctttgtcagttttctttattgtatatttgtgtcttaattcattgatttctacttttattttttataatttctactttctctgggtgtaatttgcccttctttttgtaacttcttaagatggatacttcgatcattgattttcagccacttttcctttctaatatgtgcatttaaagctgtgcatttccttctaagcacaactttagctgtatcccacaaatttgatatattatgtttttattatcattcagttaaaatagtgtctgttttcactgtgatttcatctttaaccaatgagttatatagaagcatcttgtttcaagtccaaacatttaggtattttctagatatctttctattattgattctagcttaattccattgtgatcaggagaatgtatttagtatgattttaattctctgctgtttgctgagacatacattatggcttgaaactaataacctgctatggtattttactttaatagttcgacatctttctatacatctactggaaagttattgcatacatcactggaaagttgcttaatctctacatgtctcagttttcttttgtgtacactggagataataacagtgtcttcctcaaagaggtcctgtgaccattcaatttggtaattctttaaaggttttcagaatggtacctggcacatagtaaatactcaggaactgttagctgttattacttagttgattaaaattatgactgattatcctgctggatcaaatataaacatccactgcctgtcaccagcccaccttggctgtctgctcttacttgctgctaaactttaaggcctatgtcttaaatatcacttaagtatcacagaatttccaagacactgtaagtattattttctgtgttttacaaataagggaatttaggcacaaaatcggtaaaagacttgaatgaaagcctgtttctcaagatattagcaacagcctgttatctggttcacatctatattccttgctcatattttattctatacaaataaaagaagtaatagttttgcaattaagtgtttttgtggttgacatcattttcaggtgttgcctttggactcctacagccttcaggccatgggaaggtctgctccctaatcagtaggttagcctaacctcagtcactaagtttcagtctgagtaaaggcacagtccctgagggctgaacatatgtcaaggttcccagcccttaacatcctccaaagacaaaacctgccttcgtcaccttgtgggaa

SEQ ID NO: 41656 - DNA, 1046 bp, Homo sapiens
aatgctacgagtcatgtggctttgctgtgtgagttcacgttcctgcccagtgttccctcaagatgggaatgttaatacatttgagggttttgtgtcattgttgctgggggtggggaaagaacagtagagaagtgggtaaatgatgccatcactgaaggtcatggcttaaagaagacctaaatgacaaagcagcttacaggttaagaatgtgtttgccctgtcaatgcatatgcgtatgaatctatttttaagagcttcctaaagctcctcaaaccaaagtgagcatgagtaagactgtcgctatctaccacaggctaatgctggggatattcaggccagcctccttcctgctggagacagcggggcagcaggtcccggcttgtcactggtcctcagcccttagccaggacaacttgaagcccctttgagtaatgcagaccagaagtcattatttcctgctttgtgttttgctgaatatcacggctatgaacatagctttattgttggaaagttgctgtatctttcacagccccgagaacatttacgagggcccttctgggggatgctttctgggagggttgacagacttaaccatatggctcccgttaaatcccatgcagagccttgagaaattacctctgacaagggggccggcagccttccactcacggggttttatgtgtggaacgaaacataaagtactgatacttgaggaaatataatgtttcttaacattcaaaagttgtaacaccacatggtattgtggtcagatgaagggggtagagccagaacatgggagcaaatggctgggtattctgagaggcagaaaaataccccagctctcgtcttcgaatctggtccttgcctctgattcttcaggcaagcattgtgtcttagtgtcatctcagcttcccacctggaacacagcaagcctgctctactcgggagagaaaatcagaggtaactccccaatggctcaagcccttcgttagaaagggccttgatactgacactgaagaagagaaaggaagctaatatttattcag

SEQ ID NO: 41657 - DNA, 1586 bp, Homo sapiens
agtttaataaagacagaactttaatttgttcattctcaatggtaaccttcacggggaaccacatttttactaagtcacagtagtgtattgtttgtatcagttcttaatgagttccattgttaacttttacgtcaaagaccctgttgcatcaacttctttttagtcttatgataggaagcttgttttcaaggtgtttccatgaaaagcatttgatccttcatatttccgtggtggatttctctggaaagttgggagttttccaaagtctaactgttatatcagtttttatggtgatgggtctcatttttcttgtagtatacattatcttctctactaattgacttaattttcagtccttatctccagtcaagaaatgaaaagaacttacaaattttgttaattgtactgaaattagacgtgtggtgagttttagaggagcgtccaaacagaactggattccatcagagccttgaggaaagttagacggcagaccccaagggagaagagggcagaacacaggctgacatatgacaattcttgggaaactgtttaaatttcttgggaaaaacaagataactgatggtttttttaaaattaaataagtaaatagcaggcagatcccagaacattgtaatgtgaaatctaggtgccataatataaagatgaattattaaaatatgggcacctcgaatccactaacttgggcccaacagagcctgcccaggggctgccaagcatgaggggtgtggagattggccaggtgggcagggctccccatttcccaggtatgtcttcaaccacagcagcttcacatatgtgaacttagttgggtttccacataagcatttctttgaacaaagggctcttcagcaagagcatagtttgaaaactacaaaattggaagatgcttttttctctatgtaccacaaacaagaggaaaagtgaattattgggtatgataaagcaagtaccatcttaaagatcaatttccgggagaaccagtgatgccatcatcatcatggaaagtggatgagattggacaggcaagctgtggcttctgaggtgataggtgattgaggggagaataaaacatgaaataacttctagtatttggatgcgagggaagaaaatcatcagaagggaaacatagagacttgatggggatctgtccatttcaatctctcaggaaagggtagaacaacaataacaaaggaagttgtatcatttcagtctacccttttaggcagggtacacttacacatgattgcaagaaggtgcccacagcactgagcttcaagaggagcagagaggcagcattcatgggcagagccgcctgtgcttcagcctccaccttcatttttatttttatttttatttttgagatggagtttcgctcttgttgcccaggctggagtgcaatggcatgatctcagctcaatgcaacctccacctcctaggttcaagcgattctcctgcctcagcctccagagtagccgggtttacaggcatgatcccccacgcccggctaattttgtatttttagtagagacagggtttccccatgctggtcaggctggtctcgaact

SEQ ID NO: 41658 - DNA, 1023 bp, Homo sapiens
ggctgcaaacctacactgccataaacatccactttgaggcaaacaagggagttttttctttagcctcgaatgttctgctcagtagtagttgcgggattctgaagcacacacttcttgttgattaagctgtctgccctataatttgcaaagaatggaagatcagcattgtagagaggtatgggggcttttcaactcagccttctaagatgttcttagcagctaataacattccagcagccctgaaccaacttcctgtgtggacacagaaggaaaggacaccagggacttacctggggaaggagagcccagggtgggccttgtttttccgtgtgtgtgtttgtgtgtttctgcagacactgagcttaatcactgagaaatttcttttaggtggtgcctaatgcatctcagcccctcagccggagggctagggctcattttcgtgaccgatcagagttttaactgctgtgctcctaatacatgtttttgaaaaaggaagtagcttatgtgacaggactgttcttttgatctgttaacttttcctaattctttttgaagcgtcctctgccttattccctggctctgagtgatttaaaggcaacgtccttgagtttatatgctcccagaaacctaatgctccgagaaatccaataaagccccaccaccagaattgttctggggcatgagggggcaagagatgaccacccagagtgagcccgcatgggagggtgttaaaagcaactagacatattcattgtctgaggctctcattgagtcaggatgggtgcaggctgcagacacctgtgcggtcggaactaggttaacgattacttgaacatttgaaaatttaatactttcagtcagggaagtgtatttacctttgagcataacagataataaagggcccctttggctgcataacctccctatttgtttgaattctcctatctttagaactttgcatctttttttggatggagtgatcctgggttttctgtttctcaagggctcatcaaatcactatgt

SEQ ID NO: 41659 - DNA, 1026 bp, Homo sapiens
agaaatctgagcttgtggataaaactaaccgagaaatgtgtacaatgtgaggccccaagactgaatgcaaggagaaataggaagaggaaagctgttgcacagagtatcccttgagtgggcgtgaatgagtgtttgcatacactcactgggggcggaatgaggccttccaggcactggaacgtgcaaatacatctggagcgtgctcattgacaggaggatccaatccataataacaagctgggttcactttgctgccataggagaaaggtgtgtgtttcaccatttgccttatggatttgaaaaacattaaaccaggtagtatttcagagtttaaatgaagtacacaatgctcagtggttccagcaccaaactctggaagtgtagtgcattggaaggaaagtggtttaatgtcgttttatctgttgaaccacaaaatgataaagaacattgactcttacccaaaataagaccagtgcccacagggctgtgtgtgtgtgtgtgtgtgtgtgtgtgtgtgtgtgtgtgtgtgtgtgtgtgtgtgtgttttaccatgtgcatacttggaaagatagtattctaacaaagccagccttgggagttggcttgcttttaaggctcacagtagaagagttaaacagaatttctcttcctccctctggctttctctgttttcctccagactttgcccttcgaaacaaacactgaacagcgccgtacatggtgtttcctgggtaatgtcattggctgtgagcttggtttattaatcgtggcatcagggcactgagagatcttatatgacttccccttataccatacagatttcacacccatgcctctctctctgtctctctctctctctctctcacacacactcacacacacacacacacacacacacacacacactctcaaactttctttgcccttcattttggtttgtgtctttccttactcctaaaggagaaggcaggaccaagactttttccccctgatatgtatccacaggtttcatattttcccatgttc

SEQ ID NO: 41660 - DNA, 1694 bp, Homo sapiens
ttctctgtttcttgtatctcttgtaaactggtaattaggggcttttaggtttgatttagagtcaagttcaaatttttggcaggaatacttcccatgtggtatggcacatttctattaggaggcaccaatggttggcttgtttttctctttgggccattggcagtcactgacacggtctatatccattatttctttagggattatgaaatggtgaagtctgattctgtcattcattctttgtttattagctggagtacttctatgaagagaaccttctcctcatcaactctttggttaccctgaattccagttcaatacttcttcaagcgtgtgacccatttattctggtttcagagagatgccttttttttttaacctaatgggtacccagaaacaactataggaaataaaacctcacccataaagggaggtattgagcagcagaaaaactccagaacaggggtctccagggtcttgactcaacctctggcacctgtatgatgttggacaagctgtataatttctcagagttagtggactccaggcttctatctgcactccaaccagagaggcagttttttctatttgttttaaacaaataaagctacagccttaaaaaattgtgtacagtttattactaaggtatctttcagcttaaacagtttatgattttcatttatgatttaaaaaaacaagtccatgttaggaaacttagcaatctgatgaccaacagataccaagtgttatttctaaaaatgcattatttcatttattaattcaatagttcatttatttctccattctttaaacaagtgtttgtactatctaagtccctataaagcataaagcttaggcgtagacattgtaggcactaacattttggggatcacttggaggtaccattcttgaagcctcagcctgaaattcacagagttgaggaaaggatcctggaattcttggaagtctttctaaaaatcatccacaagaaggattccaggtacatgagagctaaacttggaattttccccatggaaagtctgtttgctatgcagagccagcttagggagtatttaacaacatccctgggagggaagagcaatttagaacatctggagactgctcattaattgtttatatgataatgttgatctgaaattgtagaaacgaaaacctgatctgtgatccctccttctcaacccatttcccatttcttttttacccgtgcaactgatgaatgcacacaggtcagaagtatgaggactggtttgaggacagtttcaggttccaaataggaattatggatcctactttctctttagtgcatcttatattccactgtgggtgtgttcattattaacagtggctaagactgaggggctgaacagggaaaggagagcagaaaacagaattccagaatccaccatttgaatcacactggtttgtgatggaggaagcacataaataacatctacagttctcacctctgaaactaagagcaatgggggcttcccttcttcacagtttcacccagttcttattcacagaaggtgctgttctcctagcacttaataattcaataatgagagttggaagctgtcccagcaggagatgttatgaaacaaccttaaagaataatagagggggaaaaagagcagcgctctatttttaaaaaatcagagcctttcttggaggcc

SEQ ID NO: 41661 - DNA, 1059 bp, Homo sapiens
cttcgagttctttttttaagttgagtgtgctgttctttttatattttcatattcttttctaataatatattcacacaatacccttcacttgatgaaagagaaacacgaagggcaggatcacacagctatggccagaagccagagtgtgctgcttgcccatgcccttttttgagggaccatgtctaaggctctccactggggggtgggagggaggagggatatggaggaagaggagtgtggaatgtgtttagagtgttccaatatgggattatcatcacacatgaaaagattggcagggattatcaacaccatggtactgatgactttatcatcttcctccttctccaaatctacccctactgcatcccctgcctccctccttgagggcaaacaccatatactgctcacttctttcctgtgtggcacttacttctgctatgaaaaatcattcctttatataattctttgtttaatgttccctttcctacactgtaaactccatgatgattgatagatactacgcctgcctatgacatccccaattatttgttggattaataaattatcatagtcatcctagacttttccctttcaatcataacctacaacttgaaagtttgtgttctatatgctatttatctacttggaaaatctcatgtttgtctttttgtcttcatccttaccatacctgccttagtttagggcctcatcaccctttctgtggttttctaaatggtctcttttatccagcctcctcactcctgcagctagagctgtttttctcaaatgaaaatttcactgagtgcagtggctcatgcctgtacccagcaatttgggaggttgaggtgtgcaggttgcttgagcccaggagtctgagatgagtctgggcaacatagtgaaaccctgactctacaaaaagtacaaaaattagccaggtatggtagtgtgtgcctgtggtcccagctacttgggaggctgaggtggtaggatcacttgagcccaggaggatgaggctgcagtgagccatgatcgtgccactgtactccagcctgggtaaca

SEQ ID NO: 41662 - DNA, 1030 bp, Homo sapiens
tgaattgagggtgttcataaagatatctgagtccttcaacttctacaagtcaaccaattaagaacttatgtttaaacataaaatattggtttaaacaatgcatttatagttgttattttttattttttactgtgtttttccaacaatacttggttaatagtttggccaaggaatattagactaggtatggaaatgaaaaggaattcagacagctcagtgcttcagactgtgtgggcttatcaaattgtagcttgacatcgtttttggtgacttaatatgcatctttgggaatctttatcattagcctcgttagctacagagactctttcctgagtgtaaatattgatttatgatttttaattaatggtctctcctggatttttccaatgtttatcaaattttggggcttgttttgtatgccaaatgaggtttatcagcaaagatacggactaagaatttttaatatggaacaatcactgcagtgttggttaagaaaatcttgatccctgccttcattcaaattgctatcttaaagaaagaaactagacacacacacacacacacacacacacacacgaacacacacacacacagtgagggctggttgctaggaaggtttgcatattcttttttcttttttttttggaaacagaatctcactctgttgcctaggctggagtgcagtggcacaatcacagctcactccaacctcaacctctccggactcaagcaattctcccacctcagcctcctaagtagctgagaccataggcacctaccaccacacctggcttattttggattttttggcagagacagggttttgtcattttgcccaggttgatcttgaattcctgggctcaagacatccaccagcctcagcctcccaaagtactaggactgcaggtgtgtgccaccacgcccggtcacattctgtttcttgatcttaaacaagagagaatgcaccaatacaattgatattattataacttctgcagttaataataatacactccacataatgtttaga

SEQ ID NO: 41663 - DNA, 1075 bp, Homo sapiens
ctggttctcaggtcttggaacttgggctggaacttacaccactggctctgcttcagggttgaactagaactacaccaccagcattcctgggcctccagcttgcagacagtagatcataggacttctaagccctcattgtcatgtgaacctgtccctcataatagatctgtttatcactttattttctatcggttctgtttctctggagaaccctgaccaggagctagagagttaggaaaacctaaaatttcctcttcagtgagaaatcctcccactcttatttttccatgagcaatttttcagtctaaagatcccgagcaaacctagagaaatcattccaggtagtctagtggttagggggaaaaaaaacaaaaaacaatagaaagtggaagagagaaacatcagtcacatctttctctaaaggcctggtgctgccatctccttaaatattttgaaggaacaatttgaggtgatacctgctttatctttcaaagccattcctacttgcaccatctctgcactgactatgttaacagtgcaaaaggtcatcctctgagtgtctttggatcaggattatttcatgtgttttcaagagagatagtgccggttaccatgacagcattaaccaagggtaacagagaacaaagcttttaaacttagaagaaagaaatcgtccagaaaggaaagaatatttttgacatggaaacccaaagggcaggttggaaataccattacaaattggaatgtgttttttttaatgttcttacttatttgtttgtggactaaatccttttgcaaatgagatttttttaaaattgggctgccaccattatttattttgcaacaaagagtgattgtaaatttttttttaagtagctaccagtacaacaacaggagcaacaataacaacactctttgcatctgggcttatttcattggccgaaaactagactaacctgtaaaagatgtttatagaatgtgaaaataacataggggcaacactggtgatacatcagtggagatgtatcttggtaatgagaagaaaaagcttactcctattaagcagaaaagggga

SEQ ID NO: 41664 - DNA, 1051 bp, Homo sapiens
gtcagcattgtccagtagaactttcagcaataatggaaatgtggctggtgcaactgaggaacggaattttaaaatcttatttaattttacccaatttgggccaggcatagtggctcacacctataatcccagcactttgggaggttgagacaggaggatctcttgagcccgggagttcaagaccaaccagggcaacatagtgagacccccaactctacaaaaaataaaaataagagaaaatgaaaaagtacataatttaagctcaatttgaatttgacaataaccacatatggctagcagctactgtattggacacagcagatctagatgaaatcttataaaaattatagcatcatagcgcagagttggaagggatatttgagattcccatagcaagtttgaagttattttttaatgcaaagtatgttgaatgcaagataattaggtttatacctggtgagagggtctgggagggtatagagactgtcattctcaggggtaagataaatgataactggatcataaagaatttatgttgaaaaaggaccactgattagcaccaaagtgtgtgatttctcttgatagtcttttatttgaagaggagatataaagacaatgggatttagcctttaaaaaaagagtatccaactcaatttacaaacataaatatgggtgtaagacaatgaacaggctgtattgccctcgacgctgaacctcttgagatataaagaggaataggaagatgataactttggccgggtgctgtggctcacacctgtaatcccagcattttgggaggcttaggcaggaggattgcttgagctcaggagttcaagaccagcctgggaaacatagtgagacctcatctccactgcaaataaaaataaaaaaattagctgggcttgctggtgcatgcccgtagtctcagctgctcaagaggctgaggtgggaggattgtttgaacccaagagattgaagctgctgtgagctatgatcatgctactgcactccagcctgggtaacagagtgagaccctgtctaaagaaaaaaa

SEQ ID NO: 41665 - DNA, 1027 bp, Homo sapiens
tttacatctaagaagatttttttttttctcttttgaggatcagttgtgacccactaggaaggttttagcccttctctcagtgtcctcttgttttagaaatatgtcaggacagccaactcacaggacaatacatgagacaattattgtgtatggaagaaaagtaaggaaaaagagggactttctgagagaatttcaagtgattaggtgcatgtaatacttttccatgcagccaggatcccaaacacacataatccctcctgaaaatacacctgtccatctgcaaggcaccaaccccattaccctcacctgccatactgacagagggccataagtacatggtggatgtagttgtaaaataattttttcatgccatgtgttggagaagtaggtgatagttacaagtttcaagggggtgtctctgaacaattggtttccaaatatataccctgtcaagacagaaggaattcagggaccaagccagagcctgctttgataattctcgccagtgatattagagcagggtcgatcctcagttccccttgctgttgcaattgtattctccaccacccccaccaccatatccccttggcctacacttcaagaataaaattgcagctggacattgtggctcatgcctgtaatcccagcactttgggaggccgaggcaggtggatcacaaggtcaggagttcgagaccagcctggccaatatagtgaaaccccgtctctactaacaatacaaaaattagccaggtgcctgcagacctggctacttgtgcagcggaggcaggagaatcacttgaacccaggaggcagaggttgcagtgagcggagatcgtgccactgcactccagcctgggtgacagagcaagactctctctcgaaaaaaaaaaaaaaaaaaaaagaataaaattgctccaaagcactattctagtcattatgtctcctttgtaaaagtagtggaaccaatcagctatccaagccagctgcttagatatatgttggcatggctcattagagtacagtta

SEQ ID NO: 41666 - DNA, 1046 bp, Homo sapiens
aagctcatagaagtaaagcatttactgttttaccgtaagctctggaagtctgtttcctgtgtcaagaatctttgttgctgtaatttcacctgctcctaggatctgcgtcgtcctgtgccctgccataaggatgtaactctcagctcaaagccaagggctgctcaagggacagacacaccaggcacaacaaggggagcccccgctaccttgggcttctcttcttgctttctgtaccaattctcctgctgtcactatcccctttgaccgtgttctcatgttctctgccacatgcgagagaaagtaaaacgtttttgagaccagttggtacatggtctgaaaagtgcttgcaataattctccctgtctacaggggacacttttcaagacccccagtggatgcctgaacctgtgatcataccgaaccctctatatactgctttttcctatccgtgcatacctatgataaagtttaatttgtaaattaggcacaataagagactaacaacaatacctaataataaagtagaaccattatagcaatatactgtgataaaagctatgtgaaggtggtttctctttctctctcaaaatatctcattgtaccgtactcacctgttttctgactgcagttgactgcaggtaactgaaacggcagaaaaccaagctgtgaataaggcagggctactatatttgagctcattgccttttagtcggtgattttaaatgtatctctccgttaagaccatttacctgaatttgggctactgtgtttccatcattaggaatgttttctgtagtcattaatgcagactaagagaagctgacactttaccccaaaataatataaacatatttcatctatgactactttgatacagagtacggcataaggggatatgtagcttatatgaggaaattgtcttaagtttgtctttaattctacatatctcccatgtgccatctaaaaagcctggaactataaatcaatacaagtcaaaacaaagaagttcactaatatgaaaatatataggcatgtgcatgttggta

SEQ ID NO: 41667 - DNA, 1031 bp, Homo sapiens
taggttttgacacaggaaaggccagtgaattgcctaagggtacttagtgccagggttggggtataggaggtgcagtagttacacgacaggagtcaccaagggcagatcactcccttgtcttctctctgggagcacctggagctgacttcagcagggctgacaatttaagccagtgaatcctgcctgcacatggttcaggatgcatgctgcaccaggtcacctaggcggcccctcatcctctgtccactgtgaaaacacgggacacccaggtcgaagggaatgctgaatgacaccatgtgggtgtgcagtggtctgtgaccagagggttcactggaagcaatttgcaaaggaggacttagaaaaccacctggatggttattgtaaattaaaaaaggaagagatgccacttttttctgaataatttttaatactaggtttatggctgggtacatgtgatagtcattacagcttatttaactctgaaattatctggcccctcaaactccaccgggactgtagaaatcttgggttaaattttaaaaacaacatttgaaagaagatgatatacttttccttgaggagaataaattcaaacctaaaagtggggggggggggaaaccccagctctctctaggaaggatctccattgtttctcatatttgctatgtttctcataacgtgtttgagctcagaaattcacccaggcacacaaaaggtctactctagttggctgttgagcccctccatccctgcaatccaagttgtgccttttctattgggttatttggaaagagtccaaaagcattctgaactctgagctcaaatctcaaaggtttccacttcttcggagccgaacatttcatcaggggctgggagtgtgtgagtgagttacaccgaacagctgcgcggtacccaccaccctctccccaaggatgacacgctctgcaaaggagggtgttgtaagcattcctgagcaagccagctaatctggagacctagcctgttggccgggggctacttctaagaagcct

SEQ ID NO: 41668 - DNA, 1050 bp, Homo sapiens
tggcactgtgaacaagaaaataaagtgagatggaggtgagtgaattcagttatgagaactgaattctattcctagcttgaataaaagaagtttgtaggccaggcgtggtgacttgtgcctgtaatcccagcactttgggaggccaaggcagatggatcacctgaggtcaggagttcaagagcagcctggccaacatggtgaaaccctgtctctactaaaactacaaaacttagccgggtgtggtggcgggtgcctgtaatctcagctactcgggaagctgaggctagagaattgcttgaacccaggaggcagaggttgcattgagtagagattgtgccattgcactccagcctgggtgacagagcaagactctgtctccaaaaaaaaaaaaaaaaaaaaagtttgtatttgcaatagcatatgtgtgttattcttatctttagttgggtgaagttaccatttaaacttgctgcctccctctcacatatattttctagtggttaaaaaaggatgttttgtagactggagagaaagggacttccaaggaggcaagtggaagggttaggatggcgggtagtggaattagacaacatctctggggtccaagaggcaccttgagagttccatgctgggatccccgaatctaagctgcaaaagggcatatggtgtctcaagctgcttgaaagaagtattgtctcagattttacttagtaagcattggtcaggaaggccaggtcaacattaagaagcagaaattagtgtagactgagaatgagccctgtcatgtgcctgacagaaaataggctgggccaatctggaactctacttaaaaaagaagcagctgtggctgggcgtggtggctcacacctgtaatcccagcactttgggaggccgaggcgagtggattgccagagctcaggagtttgaaactagcctaggcaacacggtgaaaccccctctctactaaaatacaaaaaaaaaaaaaaaacaacaaattagctgggcgtggtggcatgcgcacgtagtcccagctacttaggaggctgaggc

SEQ ID NO: 41669 - DNA, 1059 bp, Homo sapiens
tcactgcagcctcgaactcttggggtcaaatggtcttcctgcctcagcctcctgaagtagctggagctacaggtgcacaccactacacattggctatgtttttaatttttttgtggagactgggtatccctatgtagcccaggctagtctcagattcctggactctagcaatcctcccacctcagcctcctgagtagccagggttataggcgtgagctacttagcctgacccagtcttataattctaaatgcactgatgaagccagaacctaaagattgatgtttcaacccaacccgttcaccttacagattaagaaatcaaaggccaggcacaatggctaactcttgtaatcacagcatgcaattcgggaggccaagatgggagaatagcttgagcccgagagtttgaggctagtctgagcaatgtagggagaccccatctctacaaaaaaaattaaaaaattagccgggcatggtatcatgcacctgtggtcccagccacttgggagactgaagcaggaggatcacttgagcccggtagttccaggctgcagtgagtcatgatggcaccattgcactacagcctgggccacagagctagacaggagggagggagggaaactgaagccatccaaaaatgtgaagagagttattctatatcataaaaccattggtgtcagtgcccagaccaagctctaaggcggtgaggagcacatttctgccctgccaggccagtgagcttcctggtgccaggaattctgtcatattgcccaggctaatgctttgcagtccctttttgaattctgactcctggggatggtggggtgggagggagcaaccaacaggcaggcccttgagactctggaaatcattcaggcagctgtgcagagactcctccctctggtctggagagaggggtgcagaggccacaagatagcttgctttttgcctccagccatcagccccactggggtctagttagtgggccagaagttgtgggccctaatagcattggggtaaatgtcctggagtccagctctttgcttcccaccactctct

SEQ ID NO: 41670 - DNA, 1050 bp, Homo sapiens
tcagcacagttcccgagatacagcagaagctgagtaaaagtttaacaacaacaacaaaaaaactttaaaaataattttagctgtgtttctgttggatcgaatgtttattgaagtcacacaaagttaggtgggactaaaatcggccctctgcaggctttctgagttcttagtactcctaggaaaagtgaggagtaaaacgcaggggagtttgtgctcagatgatgagcttcctgcttgatttcaactctctcctgtaacctgtgtttatcttgatggccttatttatatctatttcctttcgataaaaatagaagctccaaaaagtgaatctaccacacaagggaggatacttttaactcaggcctaagtttcacagatagagttacgatgctgccctgcgtgtaggcatccagctagatggtcattttctgagtcatctaacttctgagttttcatttttttaagagtataattaagataggttcccagggatttaaaaaaaaaaaaaaaaacaacccaccaaccctgtgagtaaagtagacagtctatatgtggagacccatataaggagatttgtgggcacctgcccaacttgagagaagcattaagagctattcgaaacctactgaaatgtcaacacacttttgaaaaaggtccattagggatgcaaatgtgcagctccctgattatgataagcactggaaagaaaacagtgaaacccattaggaggctttgagaactgggttctgaggcgcagggaagacaagtctagtttctgcgggtgctggggagatgaagcccagcccttctctgcaccctgaaccagtgattctaatgatttaaatggccccccaaaatccctcttattttggataaagccaattaactcatttgtaaatgggccaactttgaaattccatcaatggcagataaaattcattttaataagatttattctgtaaagtacaaactgtgacttgcttctgtaaaggatctgacattagaagctcacttcaggcttttgatgtgttttggttggttcttgcaggg

SEQ ID NO: 41671 - DNA, 1031 bp, Homo sapiens
agttcttcatgtatatgaataaatactcagggtctgtgtctgagatgttactccctgtggtttactttggaatcttcttatctgcttcagggtctgtaccttttggagggaccttccagatagatattaggtagattctaaaacacaattccaaactgaatttctctgccagttgattttcactggattttatgccactgcttgactcaaaagtgtccttcttctcttcttgctggcaaagaaggaaaatgcttccaaaggtggtgcaggtttatacttatttatacgtatgaaataaatcatatgatttggcaaatgaatagtgaatcatgtcagttggaaacaaagggaactggtctgtacttataaaaatagttttaccccacaaatgtttgttgggttaaatttactgagtaagcacaccacgaggctgattcatgttctaagaaaatgaatatttccaggtccacagcatctgagctaatgaactctatcatagggttggggcttagggagtacagctattctctgccccaagctcccacctctacccctgttattgccaatacatcaatttgaagggaaaaatggtagcattggctgctcatgtttgaaagaatagtactggaaaaatgttaagtgaatttgaatatgtcactcagcatctctgttcttattatgcttgcatttttactggagaaatcagttattgccatatactaaccatatagtattttctagcagctttgggctgctcagatgaaaagcttttacgaaatacaaagtagtgaaggaaaaaaaaaacttgcacgattttaatgtcagccagagcctccccaggtttctctgaactatgggctttgttgttctatgcctaattttcttcctgtgtaagactggaatggattccagatttcaactaaaactcttgtttcactgttttcaaggacttttccaaaggtcacacatggactattgtgatgaatgcactctgcagggtgtgttcccagagcacagaagtaaccagagag

SEQ ID NO: 41672 - DNA, 1047 bp, Homo sapiens
ttttttgcttggaagcagtgtttagaggtttgtttttattctaagcttaagctttctgatttttatagttatacaacttatgtgatacaaaaatattggcttctccaggattattactctggctctttcacattttctgtgtttatctaaccaagactttgattatttaaatatatgcctaagtatctgaaataaatcagagatgtgtttgtgtcattcacaatgttctgaggtaggattacagggatcctgctcttatcccatttatgacaaatcaatctctggccatttttatttcctcagtcactatgtacgtatatagatttatgttagttaaactttatcattatcattgggtgggtaagtgttgctgactccattctcaagcaagaaagttaaacagaaaatataaggagtgtaagtgttattaatggagtattcttttaaagttgagtgagtcctctgttaaccaggttgtaacctccttactagtgtctaggctccctgagggggagggatctgaacacctggcatatagttgctagaaaatatctacttatcaaatgaattaatatgaataattcattatataatagtattaaacatttactgagtggtaatcatgggccatattactgtgtgcttcctctctctctctttttttttttaatggaattttgttctgttatccctgctggagtgcagtggtagaatcatagctcactgctgcctcaaattcttgagctcaagcgattctcccacctcagcttcccaagtagctgggactacaggcagacgccaccacgcccagctatttttaaattttttacagagacagggtctcgcgatgttgaccagtctcaaactcctggcctcaagcgatcctcacatctgggcctcccaaagctctgggattacaggcatgagccccaacacctggccccgtgtgcttgctatgtggtaaggagtcagcaaggaactacacacaaagcactatatggttttttgtttgtttgttttgttttgttttgagacagagttttgctc

SEQ ID NO: 41673 - DNA, 1239 bp, Homo sapiens
tatgtttttagtttctcaggaccaataatacattatgaacgtattacctggccatgcagggatttttttttttttttcaaccttgttaaattaactgatttctacttgactaaaggttgttgagttaccaaaaatgttgtggaattgagcacagttcaggaggttttacaatgcttcccctggaattccaaggtagatcttccacaaacacttccattaaaaacaggcctccgtgcgcactcatgggtggtgttcccaaagtgtgtttaaaagtcagtcattcagaactcaaaacacagttttcctcacaagaaatgtcagagatggttactttcccagggctgcccacaaaagccttttattccataacgtatctgaaagagcctccctccatctgttgagggaagaatgaaatagtactggacagaaatccaccccagccacccccaccctgccatccctgaggacaacactttttatttgctgaggcagccacctggacttcagggagaaagaaaggaaacacatctctctctgagtggattctatctctgaagccatccctggaagagtcctttgtagagtgaatgtttatcagccgagatgtgtttctttcctttgagatagctccataccaacaattaagtacgttttgaactttctcttcttttattaccatgatcttcgtcatgactgttctgcaccattactggatttcgaaaccagaggaatgatgatcgtatgacaatcaaaattaatatcccttggattcattgtttagcaagggcacggatctcccaccagccaagatatatccatttcatagcccttaaacatagccataatgtaagccaggcatggtggcttacacctgtaatcccagcactttgggaggccaatgcaggtggatcatgaggtcaggagttcgagaccagcctggccaacatggtgaaaccctgtctctactaaaaatacaaaaattagccaggcgtggtggtgtgcgcctgtagtcccagctacttgggaggcggaggcagaagaattgcttgaacccgggaggcggaggttgcagtgagcagagatcacaccactgcactccagcctgagcaacagagtgagattccctctaaaaaaaaaaaaaaaaaaaaaatccatagtgtggtgttctcacatttgattaacatattatgactttttgatgtctgagtaattgattcttattaccattgaaaccagaga

SEQ ID NO: 41674 - DNA, 1093 bp, Homo sapiens
ccagtctctccctctgagaaagcttcagacaccaggctgggttggccagcctgacacagtgcctgtcctgtaagtgatggcaaagcgtatcctgaccctactttacctaacacgaagatcaaagcctcccagcatgtaatggatgctgaaaaacagcctttgtttaccagtcttgccctttaacttgttaagggcgcccctcccctgaagaaacacactttctcagctggatgcaggagagggaacagaattgtggaagatgtccttaacaggcccttctagaatcactgctcacggtggtgtctccattcccataggaggaaagccagaaccacaggccagggtcaatgaacgtattccagctgggcctgtggccatgtggctggctgcagattttgctttgttacctgatggctttggataagcaggataaaaaataatgacttaatagaccatgagttttaataacatgtctgcaggtcactgggaacagggacagcatagagctcatgtgtagtgttttgctttgttttcttgacaagcaaaatgagttgtcttcatgggtactgtatgcaaatctaaatctctacaagccaaattttgtggtaaattctgtgatctgtgggtatgtcaggattttatgaatgagacaagcacatatatgtgtaggacttctttgaaatcccagttatcactctagctgtcactatgaggaagaacaatgtgtgggcaaggaaaagctctttgctcaaagccagagccagcaatcttgaggacagagacagcattctaagtgtgatcctgctaaaactagagagaatgtgtccaagccaaggacgacgaattactagagctcagtggtatgaaaaaagaagaatctcagagttctggagaaaattctttaaatacccagggcaggctttgtggaggtaccttcatccttgagaagagagacttcagtatctgtggaacaagtgaagctagaacttggcatcggagcatagtgctgagcaaagaagcctctactcagatagatttgagttaccacggcatgccagtgaggaaaagcagcctgcacaggccccagcgtgca

SEQ ID NO: 41675 - DNA, 1049 bp, Homo sapiens
gctactcaggtggctgaggcacgagaatcacttgaacctgggaggtggagattgcagtgtgccgagatcgtgtaattgcactccagcctgggccacagattcaaaatcaaagctttttagattccctgtactatgagtctagtggttctttcaactcttactcttgaaatgtactgaagcatttacccagcatacaagatgatgcttttttatttcagcattcagtaactgcagactattttctccctgtttgcactgtagttttgtacactgtgtagttttgcatttaagatgacaaaacagtaaaatatattcaaactgtcttagccaaaatagggctaagttctgaatgcatattaaattggaacttgaggaatagaattgtgttatttctgtaactttgaactctgagggagaaaatattccttcctgctagtgcatctcgaagcattttgcatcctaaaggaagtgtggacttcattggttgtgttgtgacatatattagagcccagactgtagctaagtcgactctctgagcaacagacactctggaggatccagagacagtaatgaatgaagccatttggacagatctgtgcccttcgattttcctgcattcaacaaagcagatggtattcccattccctatggaaaacatcaagagaaatcctgaaaaatccctaatgtacctgatttacttggaaattataagtcttgcttgcacagagctatttgaaaggcttccatggagaaattaaaaatttctaaaatgttaatgtgtggtcttaaggaatctacatgaatgaaatgatctggcaatgtttccgttttcaaaggaatcaggcttgaaatgtaaaatttgtgttcagtcataagaaccttccagaagcaaaccccagaagtcaacctgagaaatacttttgtgaagatcaaacaatgtccagggatgaatcatccacagcatttcctaccaaagttgagaagccagaccttcagcaccaaggtggtctccatgctagacaagaatatttctctcacttttaaaagta

SEQ ID NO: 41676 - DNA, 1050 bp, Homo sapiens
tccagagaacatttttagtcacatttttagtcaaacgccatactagaacatgtatttagaaagaaaaaaaaaaactacaaagtcaatgatgggcaaattgattcacatttgtacttagtttataaggaaacgagaacatcaaggtttggttgcctttatgggcaagttatttcacagagcaagttatataacaattctttgaatataaaagccattcactagctaattaccaattagccaattgccctctgtttcaagtcagtaagtggccaatagtatatgcaattagttaattgctattataattagctttatgaacagttgctttttttaattgtatgctaaaaagaaagagcccaggttggtcttgctaaaatttgaaccagatcatttaggcagtatcccaaaataccactcttaaattgtattaacttggctgattactgagatcttgccattttgcttaattgtatgattatctgaaagtaggaatagaatcctttgaactctgagattctaaggtgatttggaataaaatctgcctttttgaaattataatttattacttttgatcaaaattttcagagcatctatgccaagagaattctgctttaaaaataaaattacaagcgacaataattaccaggtatacaaattctggttttagggttgtatttgcattttctcctggcttcttgtgctcctcctgcatgtaaggatgtgattgtagagtgctggtttcaaggaatttctcttaatcaatcctgaacctaattacacctgaaaccacgtcacttatgcctttgggtgaaggcacaggaaaagtatcatgggttacaggttgattaaacttagggtaggaggatacagaattgaaagataagtccctgcaatggagattaaaaatcaattttttcctatttgagggttttgtctggggctggcaataagagattataattcacaaaaggaaacagttaaaggcaaaaatatccgagcagttagcacattccctcttaatgcttttctttgcagtagttagctcaggaa

SEQ ID NO: 41677 - DNA, 1045 bp, Homo sapiens
aactttataggtattaccgtcataaacctgagtgactaagaaatgggagaggaaaaaaaaaaacaccttttattgagaatgaagaaggaggaaggagtgaagtgcatgagggaaagcattaggtgtccagacatataaagaaaagagtcaggtgtagaaatttcacaaggtgctgtgtgtctgccttatgaatagaaataaagctctatgtgtgggggtctccaagccttagatgttgctgagtcccacacagaccttgcaaggactctataagcatagtaaaactttttaataaagtgctttgccactcaggatttccttctaatgtaactgtatggtaatgcacaagcaactctcactatctcacacacacacagtgtgacagggctcagtgctgcttcaggcatcaatttaatgctttcaaaggcccagcttcccaatcacctagaaagctctcctggatctcctttcaccctggtgagcgctctgaggggcaggcaggcccggctggagtatgcaggtccagctagtcctctgcattaagaactgtgtaatagtcaaaataggatttcatctgctttcctggcttcatgggcttcttttcataggagtcacagtggcaacgatgtcccagaggtatgttaggaacacaattttaccactattagaatgaaaggagcccacaacctgctcagaggttttctgtagatgacagatgagtcatccatattgtgataataaccctgacctttctgttttcaccctgtagccatacattggctattttaaagttgttcatttgtttttgtttttgttttagagacaaggtcttgctctgttgcccaggctggagtgcagtggcacgatcatagctcatggcaacctcaacctcctgggctcaagcaagcctcccacctcagcctcctgagtagctaggactacaggcatgcgccaccatgcctggccaatttttcctttttttttttttttttttttttttttttgtagagacagggtcttgctatgttacctaggctggtctcaa

SEQ ID NO: 41678 - DNA, 1049 bp, Homo sapiens
ataagacgacacagcagcaataaacttacaagtaaaattcaataccaaaacaaacacaaagaaatttaaaaaacaaaaaacctagctcatcatgttgtgaaaatgaaaaagtgaatgtccattcaaaatattttactatttcttgtggagtttttcagtgatgtaatgcttgtagccaaattgcttaaagagtgtttatatatttttttccttataaattgtctattttttaaaaaagctatttaaccacagctgaagtggggggtaaggccaaattgccaacacttgttaaaagattaatactcttaagtggcactctgatacctttccaacttgtcatcagaaaggaatcaataattaccaactgttgtatttagaccaacttacaatatctagctcattagaagccaggatctagaaagctccttctaagccatttaagatattcttacattgagcttcatattatagaactttataggattggatattttacaatagaataatttagcctcaggactgagaatgtggaagctgaataaattagctttaaatacatcattaaaatcttatgcacaataagctcattagattctagttttctcctttagaataccaatgccacagacactacaggagataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactgaggaagtcccaaaaaggtgctgtcactttaagttctggacttggggttctttgtatttgtaa

SEQ ID NO: 41679 - DNA, 1027 bp, Homo sapiens
caggcgtgttcagggtgggtcgggggttaactaatactgaggttagaaaattagactggagccagcttggaaagggcaagaatgctgagctctagagactgatgttgttcaaaattagtagattgggaagtctgtttccctttttttttttttttttttttgagacagagtcttactgtgccgcccaggctggactgcaatgtcgcaatctcagctcactgcaacctccacctcccgggttcaagcgattccctgcttcagccccccgagtaagctgggactacaagcacccgccaccacagccagctaattttttgtatttgtagtagacacggggtttcaccatattggccaggctggtctcgaactcctgaccgcaagttatccacctgccttggcctcccaaagtgctgggattacaggtgtaagccaccgtgcccagcctggaaatccattttcttaatgaaagagaataaaatagaacaaaatagtacagaacagaatagaaccataggacaggagtatgtgctttccagggaggttgtaactgagcagctattaacagtagaaatttattgtctcatagttctggaggctacaagtctgaaattaaagtgccagcagggccaggttccctctgaaacctggaggggaaggatccttcctcgctgcttctaggttctggtagccccaggtgttccttggcttgtggcagcatcaacccaatctctgcttcagccttccagggctttctctctgtgtcttttcacagtgtctcccctccatgtgtctgtctctgtgtcccaatttcacctatttatgaggacaccaatgacattggattagggtccactctaatgacctcattttagcttgattacttctatgaagactcattttcaaaataaggccacttcactgctgcaatagatatttttagcccttctcttgtattgagaatattcaaaggttggccaacaaatcggtttgcaaagagattcgttaagccttctttgattggctttcc

SEQ ID NO: 41680 - DNA, 1035 bp, Homo sapiens
gtaaagctatgatgtgtgtgggtaagagtggggatagctgaatcctgaaaattcaggcagaatggctcactttattttattgtgtagcctagtctttatgtgataatattgatacttaagtttaccagagaggaaaatatttccttcaacatcctctacgagatctgttttcacatgtgtagagctgactgtatgcctgaataggtgaattatgcatttcacccaactttcttttataatttgagtcattagacatggccgtagagttaacagtttaatataaaagtgttcctggagattttgcttgttctttttggactgtaatcaaatgtgaaagagattagtagtagcagtatttgtgatttcaccctattttaaatatttacagatgcttaactcttagagagatacttctgacattccaacacatttcagctctgtataaacattcctttgggggctttcattttgttctgatagtaaaaattgctagaggaatgtaactgaaaactgatttccaaataagataccctgcggcaatcgaaatatcctatgtagttattatccactgtaaagtacactttccctcagggaatctgctatcagagaaaattaaaacctagccacccattttaaagcccattaagtcattaggtggctcttcagtgttttcctaatgggctacacagcacaaggagccctcccagagccagtgagaaagcattgtgcagactcctgcaagcagatttctttatctgggagtcacagaagtttagacctgagatggaccttgaaaattattcagcttcttccacttgcagaagaggaaactgagcacagaagaggtcacgtggttttccactatccacagctggttagaagcagaataagggttgaaacccaaatgcctgcagcatcctggcatcacagagccttcatggtcttaaaggtgggatgaattattctataccagaataatgttttggatggcagtattggaaaactatctgccttgaaagttgcttcagatgaatg

SEQ ID NO: 41681 - DNA, 1039 bp, Homo sapiens
ttgctgatcagctttccattactatagattagcttgcatttttaaaatttttaaataaatacaattatattaattggtatctttcactttgtgtagttactttaagattcatctatgttatgcatatcaatagttcactccttttcattgctgaattcattgctgaattggactgaaatatatttgtccatttacttgttcaaggacatctgggttgttcccagcttttgactattacaaataaagctgctgttaacattcgtggacaagtccttatgtggacatatgctttcgtttctcttgggtaaatacctaggttgacacatatagtagagaatgtttaacttttcaagctataaaattgttctcaaaagtgttgtgccattttccattcccaccagcagtgcatgagagttttagttgctccatatccttcccaacacttattgtgtctttttgattattgccatcatgctaggtgtcaactcaccgtgatttaaacttgaattttcctaatgactaatgatgtccagcatctttttatgtgcttatttcctgtttgtacagtttcttttttgtaaaatgtctatttgatttttgcacagtattttaattaggttgtttctcttcttattaagttgtaagggtttattttatataaaatgcaaacccttcataaaatatatattttgcagataattttgcccagattttggcttgccttttcatttcctctttttcatttcatttcatttttttgaagagcaaaagtgttcaattttggccaggcacagtggctaacacctataattccagcacttcggggggctgaggcgggcagatcatttgaactcagaagagaccagcctgagcaacatggcaaaaccccatctctactaaaaatacaaaaattagccacgcgtggtggcatatgcctgtaatcccagcatccctggtggctgaggcaggagaatcacttgaacctgggaggcggaggttgcagtgagccgagatctcaccactgcactccagcctgggt

SEQ ID NO: 41682 - DNA, 1025 bp, Homo sapiens
gtgcaccctgctcttcttactatccttttccatagctgccaaagtgatcttttcagtatgaatcagaacatgttatccccttcctaaaagcttctgtggcttcccattgtgtctagaaataaacagaaagtctccactatgacccacgtggctgctaggatctgacatctactcagcctctgacctggtcttcctctgcgtgcggtttcattcctttgacgccagctccactggccgcctttcctgttcctctaacatgcccagctcgtgtctgactcagccctttaaatctgctgttccctcctccagacctgcaagatcaagtctctgctgaaatgtcacatcctccgagagacgttgcctgacatgctgttttatgttcatctgaacacatttttcagcatttgaagttatctttttaaaaaaagcagttcattgtctgtgcctcttaagggcagggactttgtttattgttatattctcagggtctatacctatgcctggatcatagtaggggctcagttattgtttgttgaatgactgtttggcattaattaattaatttcacaacttggagtggaattagccatctgcattcatatgaaaaatgacttaaatccctatgatatatcaaattaaggcaaataatcagccaataaaaatgggtttgccacaaatttgaccaatcaaaggttaactactatgtaaagagttattacaaactaataaaaagaacactaacacaccatttaagggacattatagtccaggcaggaccccacctaccagagctaaccagcatttgcacctcctcagttatggttttgaggtctcctgcctccttaggattataggggacccagcatctctcttggtgtcagaaaacaggaggtgatcctccaatatcatgctgacacacttacagtcctcatggaccctttgaaaacagcccctccattttctttttgccaagcttgggcataaggcttatttgtgttaggccatgctgccatcttgggagaacc

SEQ ID NO: 41683 - DNA, 1052 bp, Homo sapiens
agtcctttgaacatctaaatatatgcagcattttacagaaataatgtaagcgaactaaccgtttgtggtcagctggaaaacttaactttcagagggatttgaccagctatactgacctagaaaatgaaataagcagtttggaaaatctggtttgtgcatataattatttttatattatctcaggctgtgccttgcaatgagtaaaccacggtagttatctgacctattgctctaccactgccattgcttcaacacagtaattatgtaagactcagcatgtttttaactaactaaatgcatgcaggacattccttagcttcagcagcctatctggagactactcaagggctctttatcagtctttcagtttgaatggaaaagagactgtaaaatcatgacctgcgttaaaatgtgtagactgggagggccattgtggaaatatttaatacaagcacttggcacttttgttagctgaaaatgccctgaaagtttatgacgtatcaaatatttctaattaaaatagaaaattaatcttcatgatgaaagaatcctaacagcgctttttatatgaatacaaatatttagttgggatataggttatagaatgtctttaaggccctgaagtcctttggatttactgtttttcattctagttcttcctttaatagctcggagcaaataaaagtgatttcctttagaatgtgcacatgctcctaaggatatctgaataaaagatacgtatctgataatttgccatctcagcatcatcccttgggcagcaggttggaaggcaatagtttaatctgaatgtgaactaatgcttatgcgcaaagacatgtatgtctcttcctggatttgaaggaactgagagtagagcagtttaaccaggattccctagatggcttatcatcctgatgagctagcattgcaatcagaagacattcacttttgcttaaaacatgaaattgactggtagagttcagatattaataaaactagttttagcctgtagttttaacccttttcatcttacatttaagaaaaaaaagaca

SEQ ID NO: 41684 - DNA, 1046 bp, Homo sapiens
aacgagatgcttgtgaggtatgaagaaaagggaacacatacactgctgatgggagtgtaaatgagttcaactactgtggaaagcactttgaagatttctcaaagaacttactaataaaacagaactaccatttaaccaagcaaccctattactggatatataccccccaaaatataaatcattctaccataaagacacatgcaagcacatattcatcacagcactattcacaatagcaaagacatggaatcaatgtagatgtctatcaacagcaaactggataaagaaaatgtagtacatgtgcaccatggaatactatgtagccataaaaaagaatgaaatcatgtcctttgcagcaacatggatggagccggaggccattatcttaagtaaattcatacaggaactgacaaccaaataccgcatgttctcacttataagtgggagctaaacactgcatacacagacacaaagaagggaacaacaggcactgggccggcttgaaggtggagggtgggaggaggatgaggattcaaaaactacctattgggtactatgctcattacatgggtgacaaaataatctgtacaccaaacccccatgacacacagtttgtccgcggaacaaacctgtgcatgtatcccctgaacctaaaataaaagtcggacaggaaaaaataaaaagcagataccctctggaggtatggtttaaatgttgcagccattgtttactttctagcaaataggtttatcagatcttgtcttgaaataagcttccctggaggagaaaggagtttagaagtacaaggagagcctgaggggaagagtagaatttctgtgagaagataaaaggcatgataagtgtatactgaggccagtgagtaataccctcacttgtctcttggatttctccaatagtggatcctgactattcttacaagttcccctatagagtaattgacagtgagatcatcccaggcctggtttgaagcccatctttgtgactcagtaaatacattggttgtcctagtgtgtctggcatttctt

SEQ ID NO: 41685 - DNA, 1075 bp, Homo sapiens
tggagtgcagtggtacgatctcggcttgctgcaacctccacctcccgggttcaagcgatttgcctgcctcagcctcccgagtagctgggactacaggcgtgtgccaccacgcccggctaatatttttgtatttttagtaaagatggggtttcactgtgttagccaggaaggtcttgatctcctgacctcaggatccgcctgccttggcctcccaaagtgctgggattacaggcgtgagccaccgcacccgcccatatatattctttatgaaattaaaacttcgggtctgttatgtgtattatcccctaatttcatgtcatcaggcagaccattaaatacttttgcatggggaatgatcatatgtaagtatgatctttaaaaatagcttatagaaataatatgtatttattcatttatttaacatatattgatcatgagctatgtgccatggattcttctaggcaccgagggtatggtagttaacaagacacataaatgtattgaggattgtctttaaggagcttatgttctagctgagagttacaacaacaacaaaaataggtacaatttagggaagaaaaaatggggcaaatatgaggatataaagtattaagaagggctgaatttgagataggatgatcagggagggccttcccaaggtggggacttttagcaaagcctaaattaaatgaggggactggttagtggatatctggggaaagaacatactaggtaggggaagagccaggacaaagaccctgaggtgggaacatgcctggagtgttcaaagaacagcaagagagccagagtggctggagaaaatgagcaaggcggggcagtagtcagaaggaagttggcgtgtgtgaggagagggtggttcatagatcttaggagatcgtgtaggtcacagcagaggctctgtcactctgagtgcatgggacatcactggaagcagctgaactggcaatgatgtgacctgacttttattttcatatgatcggtctggcctctgtatggagaagggactacaggaggcatgggcagaattaggtgcagcatttaggggactgttcca

SEQ ID NO: 41686 - DNA, 1050 bp, Homo sapiens
tgtgctgtgtgtacagaaaaaagataaaatgccatctactcctatgagattcacagcctcttggaggagacaaatatgaaaagaaacaaatcatagcatcatgaaaagaaccacaggccagcaatgccacagaccaaagatgagggtggggggcggtggggagtgggagggctgtcaaacaaggtgtggtgttgcaggactttttctttcttcttctttttcttcttcttcttcctcttcttcttcttcttcttcgtcgtcgtcgtcgtcgtcttcgtcttcatcttcttctttcttctttcttcttccttcttccttcttccttcttcttccttctttcttcttctagtctcactgtgttacccagcctggagtgcggtgaggcaatctcagctcactgcaacctccacctgccaggtttaagtgattctcccacctcagcctcctgcacagctgggattacagatgcatgctaccacacccagctaatttttgtatttttagtagaaacagggtttcaccatgttggccaggctgatcttgacctcctgacctcaagggatcctcccgcctcggccttccaaagtgctgagattacaggtgtgagacacagtgcctggcctagactttttcttagttcagtcagagacggggttctttgtcccatggccatgaaaattcaggctcgcagacaatttgaatggtgactaaaacagggttttattgggtgaaaaggaagaaaaggggggaaacagggtctctcactaggccagagtccctgctagagtgcttcccacctggcctttggaatctcagtttccacatagaaagagtgggggccaggctcctccccaatgcaaactgtgcaaacttctcaaggttccaccccagtgtgcattcctcccagtgcacaggctggttagagattctctggggaccctctcccgcctggctgtctcagtggtagctgagccaagttttggaaaatgaaaaggagcctaccaggcagaccatggggggaaaccttctagaacatgggggcagttcagg

SEQ ID NO: 41687 - DNA, 1078 bp, Homo sapiens
tttctcagacaagagtgatttgacttgtaacacatgccttttttctttcttttcgttcatttcatgtaaacaattaggtgtgatgttacagtgagctttcacctttaggttgtggtcagctctagacccagtgagaggctgccatgtcataaacttgatttaaatgccatgggtgtgccaggtgtttttgggtgaatgaatgagacatatgccctcaagccccagataacttctcagtctatttcagaatcactgaatcatgtgacagtatgagaacactttatctctaataaagctggagtgtaatgactcattctcacatagttttaatgtttatcgatttcaagtgttctttcttgataagaaaaggtttgtatgtgaacattcgaaagaagagcaacgggcattttttgttctttcaattttaacacaagtacaatattttaacctttaccttgtgatttttgggtgtatgcagtgcagcttgcctataggtgatttagttgttcgtttctgacctcattacaaagaagtggtggaagctgggtggatcttttcattccccagtatattctgccagaagctggtgctcatggatcatttgttcaaggacttaaagttcaatttctagtcaaggtaaattatggctacatcaggctggtctggcacaggtgatctcgatgatcttctgaaagctgtccatgtgggctccagggtagggaacctagaggaacttaggcaggccagggagccaattctatagtatttgaggaggaaccgatcgcccccccaccacgatccaaacctacctacagggccctctgttaaccaaagaccttgtattagcaaggagttctggctgaaaattccttttgtcattgggggaaacaaaccctaagcaatgtatgtgatactttcttggagcccaggccatctgggtagcatgagttttctttaaatacatcccgagtaaggcaatagatttccttcagagcatttggcaattaagactggggctgtcaactaggcttactgttaaaaacctgccctgctttcccaggctgcctggtctgaaatt

SEQ ID NO: 41688 - DNA, 1666 bp, Homo sapiens
ttaaatttcaaaatctaccatggacatatttcatatctttaagtatttgacattattttaatggctatgcatagttcagttgcatggatggaactttcttttttttaaccagtcaactattgttacgtatttaggttgataccagtttttctttctaataaaccatgctgcaatgaacattcttgtggctaaagctttgcacatccttaatgttttttttaagtattaaatcctagaagttgaattgtttgatcaaaaactgccacgattcttacatgaatctatcctgtataccctttaggatggcacagagtatctgtgtagcaaaagttagcaccgaatgttttccacactaaacctgagatagggaaagagcaggaaggacttttgccctttactctcggaagttttgtttgtattactgcctgctataaatacaaagagaaggacttggctcctcctatattttggctgttgcaagccctaaatatttaattcaatatgtttaaagtaggccttatgaactaccggggcggaggattttatgacacttttaccatgatgtgcaaatttgtatatccacactttatctgtaggagtatctacatacatttagttatgggaggcagaggatggagcgagagacgggccagcacccttaattcttctctgtgttgaacagagatgcatgtttttgatatgctgaggagcattactataaaatgcagactaatagtatttcactggagaatagaaaatacttagggaagctggagtgctccgagacaacctttcaatccatttaccaaaagagcttataatggaactcaggtttcaagggaggtcaaacactaataaatattgagaaaaaatagttaaaaggacatcaagttaatattttacaatctattctttgatcttggaaggcttgaaatatttttctacactacttctgtgatttattgattcacccctgccaattggcatattggaacagacacagatgccttgcttttaactacagcttccgcttctataatgctttgcaatgccaacagatttttatgtattcactggcatcacttattgatactgccacagttctggaatatttgctagttaaaaactggatcgttgtcagtaaaagcgactgaaatgttattgatttttgtttcaatgctgtaataacatctcttggttttgttgtattggtttggggggaaaagtaaaacaccctgcatttcattgactcttccacctttatctgtattcaaaatatgttcagaatctgattatttttctacttttgttgtcaccaccctagtcttggggaagaaaatatatctgtcacggattacaataacctcttaactggctgtttccactcttgcctctcttcagtctattctgaacccagaagcccgagagagcttccaaaatgtaagtcagatgatgtcactcctccgtctttgcactcagagccagcctctgcatgctgagcctcatcttcctcacctgccacatgccccactccccgcttccattgcaaagacagagctgtcaggagagagtctggattggcagcactcgtttgcagctaccaatctcaaggcccagatgctctgccttccctgctgtttctgaaggtgattgtccctgctgctgc

SEQ ID NO: 41689 - DNA, 1063 bp, Homo sapiens
agaaatagctaagctttctagagtatggagtctgtccagataatcttggtatagtctccttttttggagggtgtgtggtagcgggggaatcatgtggtccctggaactctgtatgcaattatttgctctgctgataaaaaaaaatgttttattgctacaaaaaggggtgtaggtagcttgaaaataggtttcgatttagtcattgtactagagttctgggaaaacaaattgttcttttgaatttctgaacaataataatttgcttaagacattttgcacaatcatgataagtaacacatcttggtaaggaagtcttgcattggcagagcatctgtagaaggactgctacacagataatgagcacagttatgtttaaattaaattaagtgggcaccaagggatagaagtagatagggaaggaggaagtaattgaagcagcaaatagtccgaggcacagaaatggaaatatgtgtaaactctgcaaatttaaaagtcacttgatgccataaactattttattaatttctctggagttttaaattggtacgagtaatgatgactgtggaaaaaaaatcaacatatgcgtcagaattggggaagaatctctttgtgtttaggcactttgggaccgaaggatatttcccagatcctcgatgtgcaaagtgtggtccatggaccaaaagcattcagtatcctggggacttaatagagatgcaggatttcaggccctgcccagacctactgaatcagaatctgcatttagcaaagtctccaggtgatatacatgcatatcgaagtttcagaagcactgccccagagttgctaaaacagttcattcattcattcatcaaacgtttttagcacctctttcgtatgccagacattaaactagacaataggagggagagatcattagaaacataggtaagacatggtccctgcactcagggaacatataattgaagtgggacatatgagatatgaggctgaggcaggtggatcacctgagctcaggaattcgaggccagtctggacaacatggaggaggcctgtctctacaaaa

SEQ ID NO: 41690 - DNA, 1065 bp, Homo sapiens
gatccaatcacctcctaccggggtccctccctcaacacgtaaggattacagttttcaagatgaaacttgaattgacgcagaccgaagccatatcatagcccaaagtggaaaatagtctcaatgtccatcaattagaaattattacataaatgaactaagtatattttgctatactcatgtaatggaagtccaagcaacagttataaaaagaaaataacatagatctatgtgcgctgacatggatagatgctaaaacaatatcatgaaattcaaacagcaaattgcagaacagtatgtatggtatgaaaccatttttgtaaatttttattctagctattcacagaacaaaatctggaaggattcacacaaatctcttaatggtgcttttttttccccctcaggttgggaactttctacagtgtacatgtttaaattattggactttttctgtttttcagcaatggtgtattactttaaagttcagtaaaaacaacggaggtattactttatttttgctgtgctcttgaaccaggaagatgagcttttatgccacctattccctattgccccgattgttccctagtctttctcagacatggaggagctttctgtaggctaatcccagaattctttgttttccctcaaagaccagaacagcagcatcatctttttggggtttagttaaaactttagcacgtaaggttttcttaaggtggctttcaagtcttaacctgcacttccaggcccctttaacccgcttttctttcctcttcttttcttttcttaacatgttcagattctttatggattatttcaacggtcttattacccattttttaaaggttttgatcattttctaagcatctgtatcttccccctccttccccatcctttcatgagaggagacacctgtttcccagcctgcttagaattactcgttgatatttgtttcacagaatttttaaaagagggccaaaggaatcggacatgaccttttgcagcagaaataactgtcttttgtctcactcctagctcttcctgcacgaatactgtacatgctgtgtg

SEQ ID NO: 41691 - DNA, 1028 bp, Homo sapiens
ttggatgacacctaacttcagaaacctgtacttctcccttccctaccctcacccctttctcctccattcttagcatcaagtctatctccaaatatatctcgcattgtccactgtactctatccccatgaatgttgtgtggtttgggccattgtcatttcttgcctggatttcattgcaggtaaagagcctcccacctgatctccctgcttccactccttgcagcttccctgcagctcacatatacacacacacatacacactccagtcaccagacaggagcccaaatcatcatcgttaaatataaattagacccttcaatagctttctgttactcttagtaacaaatttcttgccgtgcctatgagccatagtttgcctcctgtgtctgtcactgccctgtctgtaccattcttctccaagtgcactgccttttagccccactagattctattcccattcattaaaaaaaaagaaagaaagaaaaagaaaaaagcactgtcactatcactgggcctttgcacttgccctttgcctgaaattctcagacccaggttctctgcacgtctaggtttcaggtcaaatttcacgtaataagaggcccttcctaaactccataaaaaagtagcacctccccaacccttggagcgtctctgtcatattgccttgtttattgtatctgtggcactttatatactctctgatacactttcttaacatatttgattgttgcttgtatatgcctctccaggagaatacaacctccagagacttcatcagtcttaatcatagatatatccttagcagtgagcatagccaagcaacagtggggaatcagtaaataaatcagtaagtttcaaaatgatgaaaaaaaaggatagcgattgctagcataaggaatttgggattctcaaactattactaatagcatatcagatttactcaatgctgttattaggatagtgagctagacttttggcagttgttaaggtactaacttaaacacagactaaaattttttcctggacta

SEQ ID NO: 41692 - DNA, 1074 bp, Homo sapiens
cacaacatatatatatgtagacctcttacagttaaatgcatttcagtaagattaaggcgctctgctaaagagtcttttttttttttttttttttttttttttgggagacggagtctccctctgtttccaggctggagtgcagtggtgccatcttggctgactgcaaccttcatctcccgggttcaagtgattcttctacctcagcctcccaagtagctgagactacgggctcacaccaccacacccagctaatttttgtatttttagtagagacaggtttcaccatgttggccacaacggtctcaatctcttgacctcgtgatccgcccaccttggcttcccaaagtgctgggattacaggcgtgagccaccgcgccaggacactaaagagtcttaatgaacctggtaaaccagattctcagcaacttgtgatatttccgggaaacttttttaacagaatgggatgaaacatggccccttttgcagcattggatgtggccacgagagccctctgttggaaggggtatctctcagatcattggtacaacagatgagcagttgggaacctgtagactctgaagaaggaaaggtcaaagttccatttgtagtctttcagaattaaaggcttggcctataagaatttgtaggggtgggtgggtggggtcctggatcaactgtgggaagaagaaggattttgttccctgaataattcccattgccgttaatggaaatgaaactgtcagggctacattggtttgttttcatggcctctggaccaggttgcagaactggcattactcattttgcaataaaaaaatgtctggccgggtcttatgatgatagtttataaatgcccctgttggttttctctctccttatacacaatcactttgaagttcccgcaaagttaatatttcactttgttcctaagtccccatttatgaacttaatgaagtccaagtatcagaagagaaagttaaagtttacacatgcaactttgattgttctcaagtgactcattggtttaaaaaattatttaaaaagtcaaagcactgtcatttgcaagagacactt

SEQ ID NO: 41693 - DNA, 1671 bp, Homo sapiens
tgagggtggagtcaaaaccaataataataataactctatcataatattgactgtttgggggccaagccagacttgtccctaaatatgtctcagacttctttctcagtctgacaaatgcttgcccttccttcaaggctcatctcaatgccacttctttgaagatgtttctgaccttgaccttggagtacctcccatctgctcctctgaacgtattgcttctttcaccctgcccctggaacactttgaacctgcctttactacagcctgtttcacagagggttttgtgattatttgttcagatgtctatctcctcaactagaccaaatgtttgcttcttgaagtgaggtttgctctgtgtgttagacgtcattagctgccttcatgtggcctggcccagcccatggtgaagaaagagagagggggacagaagaagaaccattctggatcgagagcaaattctctgggaaagtgaagttcccctgtgcccattcatgctccataaatgactgtatgagctccagggtttaagtctcaagctcacaatgcatgaatgtccccaaggcatactcgttcaaaatgcagattcctgcccctgccaccacccgccccctcccccccaccaccaccaccaacacccctcttctcgccattctgatgtctagatctgaggtggggcccagaagtctgtgttttcaccggcactccaggtgatattctgattcaggtgatctgaggacacttttgagaagcactggtctccgactaggagggttctaggaatgcaggcatttagggcacagggagcgtgcagactcaggccctggtggctgcctcctgggctggggagggcacgctgcagcctgcactttgtctccagaaagcaccaggagctggaagatcctggggatattgcccttcatcttccccatctgcagcccagaatccttctcaactcattcaggccacagtcacacagaggcacactggtatgcctctttttccagaatattctggacaaatattcagcttattaaggatgcacctcctgaatatttttaatgctagtcattctgagctgtggaatagacatgcagggagctagcacgggcgatggcctgcagctcgggaacgtgaggcccccaacaaagtgaccacaaccagtgccaccatcagagcaggtcctggatgacctcaggcttccttcaggctgtacctcctctgctggcctcagcagtgacagcaccatgtcctttagtcaagccacacacatccttgaagctgccacattctctgcacagagagtcacgtctgtgctcccgctgagtgataatagggtcgtgacctccttggaaagggagaccatgttccttgcattgtcatcagcccccaggccgtctcagagctccccgtgcctctgcaagccccatttgatgaatctgagaacgagattctggaaacggtctgagtgctgagcagtacctgtcacactcactcacataacaaagtatgtttgtttcccagaagacagtcattgtatattcctactcattaagttactataattatacccacatggggtataattgattttaatttcactctgaggttgctccaggtttcaacagcaagtctctggccttggagaactctctccctttatttagcatttaa

SEQ ID NO: 41694 - DNA, 1026 bp, Homo sapiens
gagcagcccatagcagcaggtgggggcctctgttacgacagccaccttcaccgcaggccaggtgtgacatcagcctgcaccctagcagggctccttgtctccccctctcctccctgcatggcaggctcaggtatctaagaaagcaagaacatgactccagcaaacccacaagtggtagaagaagcccgaaaagcttgtctatcgttaccattagaaaccaggcaaccacaagaagaggcagagaagaggaaagaggagcaggacggggaggaggcatcgagacaatagaatacaataggcgttctctgcctccccctctgccactcaggcaagtcaggcgtggctgcccctttccaaggtggcagccacaaactcagttctgatccttatgttcttctaaagcaaattccccttagcatatgtacattgaatcaccagattaaaatattgctacctggctttcacccccagagattctgatttaattgatctggggtaccaagtagacttctggatttttaaagccccctgagcaattctaatgtggaataaaattagggaaccactgcattattggccagataattcctaggtcccatgccccacccgccctcaaatagagcttgccacaggctccactttaagagggcaagggcaaacccatcacccttttgtaacagtagaaatttgggggcaaattcagacccatccaacatttattgagcacctactacttgccatgccctggattcgtgcctccctatgtattatctggcttagccagcagggagcttctaagagggtacccttctaaaggcaaagcgctgtcttgaggtgtaaatacaaactgtctggtctttatgttctgtggctttctaattcatagatgttcctcggacaaaggatgtttcacaggtgccaagagaggatggttttaaaaggccagaggtcatgaggcaagtgttggaagaggcaaagatctgaggggctctgatttggcttcaggacctttcattagagcatcag

SEQ ID NO: 41695 - DNA, 1056 bp, Homo sapiens
ttattttttcttaggtaaatgacaaaacccttaggtaagtggtatttccgtttgtaaaggttattcttccccaccttttccagtttttcaccaggggaagcatttctgtctcctgtcatgtgtcttagttaaaagatgagatccttatataatgagacctctagatattctcgttctgttaatacttcaaccaactctttaatctttgctataaatttttgactaaaaatatttttgccactgaataaaagatcataaaaaatagacccagtgcctcctgtaaaagaaagtgttaaaatacaaatatctgataatttgtgcttgttccaactaaattgtgggcctgcatccaagttgccttagcaccagcctgtaaaatgctaactgtgtctaaccctatgtcattgtgtgtattagtttagtgcaccattagtttagttttggtaataaaataacactgatgttacctgaaagaaacacgtactaccccatgagatctctgctcaattttactatggttttatgctgtggactctgatgagtattttccttttcggtctttctgttcttgttttaatatcaaggaatgaggcagtaacacagtgatgatcaggctccttctttcaaggagcctgaaatactttgtaagaaaagtgtagttgtgtacaacaatcagcttatgcacctccttggaactcttaggaaaactatcatggactctttccccaaaaaagttgcactgacacacatattttacgccattttcaatttttgtacaaatttagattaatcctgctgggaaaaaagatggtaccatatgatccagcaattccactcttgcatatacgctgaaaagaatgaaaagcaaggtcttgaagagatatttgtacaccaatgttcatagcagcatttctcacaacaccccaaaggtgaaagcaacccaggcactcatcaatagatgaatggctcaactaaatgtggtgtatacgtacaatggaataattcagaatgaatttctgatccatgctacaacatgaatgaaagttgaaaacatta

SEQ ID NO: 41696 - DNA, 1043 bp, Homo sapiens
aactaggcacttataactcttggtgggagcaaaacttagtgaaatgccctaagatacaatttgtcagtaaaaaatggacctagtttcacttcaagtaattttcttgacatggcttcacttcaagtaatttttatttaagtaactaatcatagatatacagaaatatatagctataggagattaatgaaagtattacttgtaataataaccaaaaagaaagaaacaaaaaacaacccacattttttatgacagcagattcaataatttattatatatcctctaaatggtatatgaagcagccattaaaatcatatcagaattaaaaagaagaaaatgacaaatgttggcaaggatgtggagtgatggaaactctcatacactgctggtgggagtgtaaattgatataaaccctttggaaaaccgtttgacagcacctaccacagttaaacatgtgcatcctaggtagatatccaagagaagtatgtgcctgcatgacccaaaagacatgttaagaacatttgtagcagcatgaatagcacaaaactggaaacaaccccctatgtccatcaatggcagaatggattgataaaatgtgtgttatggtcatgctctaaagtattatacagcagtgaaaatgaatcaacaatacatgcaacaatgtggaggaatagccacgtgacaaaagaatacatgctgtatgatcccatgtatataaagctccaaaacagaaaaaaataaactacagtgtttaggaatgcaagacaagctggtaaaattatgaggaaaagcaagaaagggataaccataaaatcaggagatggcaccctttgggaggagagtgggggactcaggatcagaaaggccctgggtgcttctagagtgctggcaagactctaattcttgacacaggtggcgatgacatacagtatcactttatagaaatacgttaaactgtacaaaattattttatgtgcttttctatttgtggcactggacaatttaaaaggttaaaagagaaaaaaatcatatccaaattaatttgt

SEQ ID NO: 41697 - DNA, 1063 bp, Homo sapiens
gcctttgttgagtttcataggagcccggagcataagccgctcgcaggcggtgtctgagctgagggttacggcaggaaggtgacagggggtacaatgccaaagggtgaccctagggtttgtctctggagcaatgattcctaactggagctttctgttatacccaaatcttctggctctttgccttggaaatattttaagattccagggtaactaacgattcctagaaaactgccagcgaacctttcctccctccaccaggtttgtcttttcatctgtacgctgctgtgcttgcgaaggtcaccatcgttgggaggctgggatctttggagccacttacttctttccccaaactgttctttccttctttaacctttcttgtcataaaagggaaaaaaaaactccacccacgtcaggttgttgctggtggttagagaaccagccctgcccagggaggaaaagctctcatcaggtggggtgaggaggggtggcccatgctgagctccacatctagtggtgctggactctgcaatgtgacttcctggctgccaagccaacacgccacatctctgcagtggagggctggcttggcagccaggaagtcacgtttcctagattgtttaataaaaggacaggtaacatgaagtgagaaaaacaggatacatgtagacagtgtagtcccaattacgtaaaagaaaactgtgtgtgcacaggcttgcctatgcactctcacataaaggctgtaaggacatggaaaacgtgtcatcactgggtatctggggtggaaaagggttgggtgatttttattttcttttttttgtgagtctgcgtctcctcagatgtctacatggaacatttgtttcttttataattagaagaaaaggtttttaaaaaggaatgaattatcacttacccattggctgagttggatcctgtaacaataatgcttcataataacaggcatctactaaatagctattgtgcccccaagtactgtgttaagcacttaacatggattgtctaaattatctaaatatttacaacaatccaatgaggtagggaccgg

SEQ ID NO: 41698 - DNA, 1048 bp, Homo sapiens
caagccaaggggagaggctctcagaaaaaaccagccagccaacaccttggtcttgaccttctaacctccaggactctgagaaaataagtgtctgcggtttaagccactcagtctttgtactttgttgtcagccctaacaaactaatgcacaatgtctttcttagcaagcgtgtgcagaaaccaactgaggctccctcagctctatgaagtcccagcttccatcctctgagatgctgccattaacctgaggaaaggcttttaggggtaaacgtatttttcttgaggcagaattcagtgttcctggacagaatctgcaccttgtatcttcaccccgtgctcatacatggatgtggatgcacatcctttcccccaagtgtctgtgctgttttgttttggtcgtacttgctttgttttgccttgttctgtctactgtttagaaaaagtgcagaatctctgattagaaggagccttttagggctttgcttctaatgacataaattgctgagtgtgctgcagtagcaatgcatttagaatcaatggacagatatctgctatttctagaagcttatatggagaattgtgtcaattccttgcaaccttggatggtctcagcattcattataggacagtctttcagtaatcacaaagtgaattgtccctctcacatgccatgcagcagctgttggctcccttttgggggccactgttgttctaattgattcttgctggagtgatggggctcagttatggctggagtggacgagcagacccagggttagcctcagggggacttagtgtaggctgatagttgcaaacatgtaccaaagaaaccacaagaagtgaatgttaactcactttttacaaatcatctcactcctgccctttctttgtctccattttttctcactctactgtccctttattattttgtctctgttgccagagtgagcaaatcaaagtacaggacaccctgttaaacttgaatttcaattaaatgacatataattgttttagtataagtgtgtagcaaactcacactaaatcaatt

SEQ ID NO: 41699 - DNA, 1074 bp, Homo sapiens
tggtcacttgggctgggaaaggcctggtcatttgttggcctggggatatattatcatctctgtcctgaaaatgaaaagaaattagaactgagcaagtggcccagtgggcatatcaaatttttatgtgtccatggttaaaaaatgagctgtgcaaagagtcggcagtgaaaggagcaacattgcaagcgtagtttgtgtccgttaatggggctcactgttttggccagggtgtaagagagataataagcttattgcagtgtgttgagtttaagttgcaatctctaaataatatgccaacactgttatttctttatttatcacactgagacatcatctgttgacttgctactatgagtgatgaggatttagcttccttgaatcatccctcttctcttcttccccaccttcctccttattttttttatccttatggcactatttttacttccttttgtggttacctttgtaactttaaataatacactgaagcctctgttgcttttggtcagcttttgacagcattctttcaccctctgttttgtgaaatgaggttgtggtgcctctcccttttgctacatctcttttctatcttccatgtcccaatttttctcaactgtattttttattttgtttgtttttatttatttattttgaaattaacatatagtaagactgacttttgcaggggagggtaacaactttgtaaattgcaacacatgcatagatttatgtaactaccaccaccatcaggacacagtgcaattccatcacccctaaaaactccatcgtgccacccatttgtaatcacaccttccttccacccataatccatggcagccactgctcttcctttattatcattattattccattgctgggtagtagtcctcagcttattaatctattcacctcctgaagtacattttggttgttttcagttttgagcaattatgaataaggctgatctaaacattcatacataagttttcatatgaacataaatctctatttctctatcataaccagaccataccatcttgattactgtagtttacaggaagtcctaaaatcagg

SEQ ID NO: 41700 - DNA, 1085 bp, Homo sapiens
ctgtgtttgttatttgtgtctttcaagacctaaaatttagtcaaggagtattatacatgtagggctacacattaatactctagaacgctggttcaggagtcagagagacctgaagcctggcaaacagccctattactgccaactgcagggtcactttagcatcctgagccttagtatcttcctccatttaaaataatgggatttactagtttataattgtaagaactgttaaaaatttattagtacttacaatgtgccaagcacttttctaaacattttacatggattaactcagtctttgcagcaatttcaaaaaacagttgcctttattatgcccattttccagatgaagacactgagatatagagacgtgggtttgctgaaggtcacacagccacttattaagtggcttcagagtcagtgctccattagacaatacttttaaaggtccttcttgcttgatcattatgtaattctagctgattcataatgtacctatatttaaagtatgtttgacctagaatagcagactatttcgggggtgggaagtggggaggaattcagaagtgaagaaagctttgactgcccaatgttgtgcatatgttttgccacgaggaaattttctaacctgtgctttctactttgtagttttaggtccttttcctgcccactcagctgataggagggctgctgttgtgaactccagccagccgaaggctgcttgtgcctctccagcaggttaaagctcaagcacattgcattactgcattctgaaaataacaaaagcctgcatcatactggccagatggttttcattaaggatgtgctataattttgtttcccctcaggtggaggaaggtgactcttgccctatatactatatatactagtgctgtgtaaacagtaccaggaagacatctggagtatgaggattcttggtttcacaaccactggtcaaccctttttgttgttgttaacattttaacatctttatggagataattcataaaccataaaattcatccatttaaaatgtacaagtcagtgattttagtatatataaaaagtgtaactattaccatgat

SEQ ID NO: 41701 - DNA, 1227 bp, Homo sapiens
aatggagacccctagaggaggatacagggtataggggatatttctgcttttcagaatttgattttgtttcttttcttatttcattattattcattgcttcttatatgctttgtttaaaagtacctatgagacaatgacctggtaatctagatgtaacttactaaaaatcagtatattttaaagacgtgctgaataagtggaaagccatctcttaaacataataggaagacctaatattatcaagaagttagttttcctaaatcttcaaatatattatagtctttgaaaatcagtatacaaagaaaagcttgaacaccataacagcgggttggcgtgggggaatcccagggatttgttctggagtaagagtaaaggttttcgtcgtcgtcgtgtaactcctcaaatatataatgctgtgtgcgtcccagtttctagtcataaagccaaaatgggatgaagggcttggtcagaggagatcatcttatatctccagcaccttaaagtagtgactgcaacattgtaggtgcttaataaacattggacaggtaggtagatggatggatgtgtggatagagccatttatcagaccagttttggaaaatgttgagattggggagcatccttagagtgcttctaatggagtggctgaactctcaccattgatctataggaaattcttctagcatgggccatgaggcgtgtgtggagaaaaaaatgaactgtgacataaactaattagatgcttctggtttgagagggagctagtgttctctgtggctttttttcagtgtcacagttgggttctacctccttctgttagtcctctctctgggccatgagtcctcaagaattctgcccccacgtgatttcccgagtctgccccatctagcaactgctgatctgccataaaaatgagagctgacatttctatagcactttgtgaacaatgtagacttcataaacttaatcctcatttcaatccatttttacaggttagggaactgtaagattaaaatattgcttaagaccagcataaggtctgaagcagagtggctttgaggcccctgctttgaaggtccacatttctcctacaaagggtcttttccaccattcctgggccacctgcatttttacattccccatacatccctgaatttcaggatggtctcagttatattctcccctctgtgtcctgatttcaagtactaaaagtatattcagcatgtc

SEQ ID NO: 41702 - DNA, 1046 bp, Homo sapiens
cctagctactcgtggagctgaggcaggaggatcacttgagcgcaggagttcaaggctgcaactattatcacaccactgtactctagcctaggtgacagagcaagaccctgtctctttaaaaaaaaaaaaagtacattatacaaatagcacatcaaattctgatgaaagtgttcctcatggagtttttcttcttttcaagataatgcatatggtaaaacattgcggcaacaccatggctgggtagttcgaggggtttttgcggtaagtgatccttcttgtctcctattattaactgtattgggtatgccagtggctagggctagaaatctcttcttacccagttatttatctagtcatgattgtcagaaacaaagttgtgtgtgtgtgtgtgtgtgtgtgtgtatgtgtggtgtttttgtttgctttgtttttgaggataagaacaaaatgttatttatttcatttacgtttataggcctttggtgtgtggaaatgtcagcagtaaaaagtgtctggaatagcaaagactgttaaagaaatatgaataaaagagttgatgctttaccctagccaattctaattactctagccaattccaatgaccttgtgaagatttgcctcataagtggttgcctttctgataaggtagtaaaaagcttaagtatcctagcagaagtacgtaggaagcagtgatcctaaatacttatcattgaagggaaatgatgcattcaggtgatgaagtcaacctaatagctccctctgctgcccattgtattcattccttttaattcttaggtcttagttgatttttttttcactaattgaattttgtccttgaatattaactgtattgggtgtgccagtggctaggagggctagaaatctcttcttagccagttattttcattgtgaaggtgttttgtattcatgtgttttggctctgattacccaccaccctcttcttcccagcatgtttaactaggaagaacacaaacctgagactcttagtctcctggggaagtcacttagactgctttataaaatag

SEQ ID NO: 41703 - DNA, 1026 bp, Homo sapiens
aggctgtggtctcagagctccaatccagacccacctgcctactgaccatcccttagagaccctaccttcacctgaaaccccaaagccaaacttggttgcacctacagcttttccatccaagtcagttgagtcaccattgttctagtctctcaggcaagaaattcagacactctgaactcttttctcacttcctctctatacctgctgtgtcagcaaggcctgcctcagcctccaaactcccagtgctgtgcacagctatgcttgatctctggattctctgctcttcaacctgtcatggccttccaaacctgaaaatgctccctgtgactctatgccaggctttaagtcccttcacaaacttggtatgcccttttctcatccttattcctggaagcccctcaaaatcttcccagactcaacacatctctgctatggattttacctctaaacattccctgcatttctaaatgatactttatgaattacaacttaaggatgggaagtgtgactccaaggtaactggactaattctttggtgttaggttctggttattggtgtagccacctctctcattaaatcatgaactttactttcctgtcaatgtgccccgcacctgacagtgccttccttgtccgtcgtagaattccaaaactgtcctaggagttgggcgtcaccaccaatgtgctttgtgattcttccagatgtgttagttctgttagccagctagataaaaatatttttgaagcaaaaccatacacttctattccctcctgctcccttggctgctcaggaaatactttttgagtgcctgaccactcagagtataaataatttatgtgtttttttatattttgtctttgctaatgcacatgcaaaatgtttgtattttataggtgcttatatatatcaaattatgaacgattagaatgcaaggtccagctcatggttctcaccctgtttgtgcattagaatcacgggaaggactcaaaaaacaagcaaataagaaaaaatatatgtatcactta

SEQ ID NO: 41704 - DNA, 1056 bp, Homo sapiens
cacctgccctacttttcttttttttgttacaatagtagctaaaacttactctgtgccaagcatatgtgtactcttctaatcactttacatatattaacacacttaatccttacaataacccattgatatagataccattagtatacctactttacagatgagggacttgaggcacagaaatattaagtgacacacccaaggtcacccaggtggtggtaggtgatagtgacgagatttgaacccagcactttagcttcagtttctgcgctcttagctaccgtgcaacagtgcctctcatgaggtttgttccgttcttggtgttttaattacatcttttagggctttaataattttaagcatgtttattttacattccctttccaattgtcattctattatatgaagttttagggtatcttttagtgctatttattgtgtctgctgacttttaagtcagcaggattttgtcctcctgcatttcattatttgtgtttgtgagcttatctttaaagaaggctgtttttctgtgagaatccccgtggcctgggttgtaaatgtgtccctcaagagcagttttgcatttgccacagaaagatcaccagatgtggaactcttttttggctgtttatcattttgggagtcatttatcatcatggttcctggaccatctgcaaatttgaacctccaaatttgaggtagaaaaagaccctgagaattcatttctcagaggacatttttccccatccagacagaggcatataaattcttttttgtctctccgtgccagtgcatcgatggttctcctaatctactcttttcagtgtgggtgtagccttttaaaaactgctgcagttttttaactaagcccagctgtggcagcatcccacatccttaccactcacttctctctttgttactgacacacctggagacttcctttctctgttgccagttcattcatgcatttaaaataatttttgctgtattttgtcaagcattttaaggcagtatggcaggagagttttcagactgtttccccacatcttcttttaagaa

SEQ ID NO: 41705 - DNA, 1008 bp, Homo sapiens
gctacactgcagtttatgattctgttattgtttgagtgatatacttttctaagtttactttgtaatttaaagcccagatgtacttactttttaacaaagtaggtttacaagcttttcataggtgcacctgcttctgaattaaccgcaacctgagttgcctcaggcagtgctctcagtgagtcacattgggtgtctgatttactcattgtgtgaccatagccttgtggcagatggtaagcccaccccttcccctctgtctcccccatcctcctgcagatgcaaagggggaaagaaggtacttaagtccaccatttactgaatattcactgcatgtcagctaggcactgtgccaggtacttactcagcttttaactctgtcatcttcacaagtctacagaggacaggcttcaagtttttgaaatgtggtggtagatgttaatcccctctttaacttggataataatttgaaataagctggaacttttacacatttgagtatgaaaatggatgctgagcagaacttactaagtagaacttttgttgttcttccagaatctccactgattaagaatcaactggcataatggatatacaagtactttgtaccattacacttttgtacaatggaagagactattacataaatgacattgtggtggtttgacagctttaagggtctctaattagtagggaagagcatttgagctgttcgctaaagctagagagcccagacgttgtctttattgggttggggaagcctctagagaagtctgctggcatgagagcaacgtgtgtcgaaaatggacctttgcaactatgaaacacagataattggggtataaagatggtacattggcacctagttattctcatttggatctgagcagtattttaagtctgtaggtctagttctcagaaaccctgcaatgagaagaaaggagaggaaatgtgtttattgagtgatagggatatggggccagtgtgtgcttggcatggaccatgtctcca

SEQ ID NO: 41706 - DNA, 1055 bp, Homo sapiens
gcctgcttggcttctcaccacagcttgttttctatggtgattgtgtttagaataacaggggcggtggggaaggtgggcaaaacctgggatgactaattgtttttctcttgtctgtcctgtggcttagagatagcagccagtatagggaggccgagggcgggaggagggggacgggatgtgacacagctgtttgctgcagggatgatggttatttctagcatcacttgagttgagaatccctgatggggggggaagcaaacagatcctttatgagacaactgagtgttcctgttctcctctaggagacttggaaccatggcacttgcaagcccaatggaggttcttttataatagtggggcgtatatttggggattgctgggaagctgtatacaggttatattaatacctccacgtttgtgggtatggaaaaggatgaaactggatactggctctattcttttctatttttaaaaagtctctgttatgagctactgttgctttgttttccccttttgggatttaggaatgtgtatttctgtggctagctgacagtctgttttcattctagctgataaacctttaaaatgaatgctcacttctattttgaagattacctacttccctttatcttcattggaagataaagtcccatcaccagtgtctcagtgtttcccctaagttcgattccctgcccactgtaaatactgcacatgttcagtggtatttgctagaatttctatttatttttcaaatctgttctaatgctgtctccttctctgctgcgtttttcaagcttgtcttctgtttctttgaacatagtaagcttggttgcatagtagactatgtctgatgatatttcattttgtaagtctgtttggtcttcttttgtttctgctagttctcaaacctggtatcttgtttctctgtgtgtgggattatctttgtgtgctagttattgtatttgaaagtttacatgtaggaataaagtgaggcctgagatgacagtaccttactccagagaggatttctgtttgcttccgtcaggacttggggg

SEQ ID NO: 41707 - DNA, 1068 bp, Homo sapiens
cccgaataaaggaccacagagatccctggagaaactttgacactctccacctccaccaaatagagcactgcttcccaatggcaccatttatctgtttgttttacgtaagggaggtttgttacagataagacataggtaggggttttgttgctgtcatcacagttgaacgtatttgttgaaacgcttacccaaatgctacaggttatcaagtgggtaaaaccagcacatcatttccctgaaaatacatgggaatctgatcaatccatgcagctgcttttttgtttatcgtgggccagccccaggaggagtgtttttaccttcatcttagagcagtcccctgctctgcctactgcactctactggttcttgggagagctatttctgtgagcatgttctgcagggggttgcttgtcatctcttaacccaattatgagggaacaggtactacagtcatgaagaacccaaggtctgttgtcaggctacccggatttaagtctcagttctaccacttgctggctgtgtgaccttagacaagttacttaacctctctgtttctcagttcatttgtaaaattagaaaattaatgatgatagttcccttagggttgcagtgaagattaatggagtttttgttgggtactcagtgcagtgcgttatccacggtaggcactaagtcaatgttagtatgatgtggataggatgaggatactagacaaaatactgtggagaagtgagcaggttaccgttggggggaaccttagattattggtggagagagaaaacaatttgctaagtgatttcaacatgaaaaggcattagaagggtaagtcaaaagtttatcaacattggttttggtaaaattacaagcattcactgagtacctgatccacacgactcactgtgctagaggctaggactccatagaggaccagtggatgcacctgtcctcccagaggggcacgtggccaaagcgctcagggttatggatgattttttattttcttcttttccacattttctaagttttctatgatcacattatcagaaaatatattttttaatgaaactg

SEQ ID NO: 41708 - DNA, 1062 bp, Homo sapiens
ttggactaacagtattcccatcacctgggagtgtgttagagatgcagaattgggtcccacttgagacctgttgaatcatcatctgcgtttgaggtagattgctgagcacattatccacacctacacatagtgaaggagaagagagactgcctaaggggagtccctggaaggtacatacaaggatctctgaagccacagggcacttgctcgatgcacaaaagccatggttgattggccgtgctctccagggtacagacaccacctccccttcctttatgaagaccttctagcccactgtgctgagtgccccctccagagacagtagctgctaaatgccacctcaatatggcctcacatagtttacactattatccaaaagacctgtagtcggccctacagataacagatactctcttgggtctgaggaactgaattctccagagttggcagctctgcctttctggtgcaacctgtttggatagatgggccccagcagtgcttatgtgatcaccgatagctcacaggaagctttgtggacagtgagacactggaaatgctaactctcttgtccagagtgagcataaactattttcccagtcagctgaaaaaaaattcactgaaataggaataaatgattataactgtcaggaataatttaaatataccagtcactttcgttttttggcccacctttttggtatgagaatgtgtggttgcagtaaaagccagggctccagaattcttcccagtctgtgtgtacgcctgtctcttcttgactgttgaaaattgggatccagaagttaaatttagacttgcccaccataggtgggattaagcatagaggtgaggatgctagattactacatatctgtaagatatgtcccttagaattccaggcagtctatttctggtgctttctatccatgcttccaaattgtccctcctcacaaatttagacattagcatttcatattgcatttttaaaaaagatttattccccagcggaaaacattgaaacctccagctaataggaacagcattaacagctgaatgggagtctcc

SEQ ID NO: 41709 - DNA, 1953 bp, Homo sapiens
ctcaggaggttgaggcaggagaattgcttgaacccgggaattagaggttgcagttagccgagattgcgccactgcactccaacctggcaacagagcgagactccctctcaaaaaaaaaaaactctgtcataataaaagtgcaattttgtcatgctttttttacacttatgtgcatctttttaatgtcatcaagtcattcaaaaatgccattttgagtggatatataagattccatttcaataacaccataaccattttgctgttgaacattttagttgtctctagatttttagaaatgtgttataaataatagcaccaataaataatagcaccgtgtgtttttaggacagaaaatacagaatcagtttttgacatcttggtgggacagtgagcacagttcatttcatacgactgctgacatcccagatgtgtgtgtgggcacatagctagctctctgtgcatatgtggtgccacattttgatacttaaaaatagagactctccaggctccccagtaaaacctagccctttgggcactaatccattgaaagattgacatttccgtctaacaagtttatgaaaatcattgtaggggtggttgacggggaagtctgcagctgctgggttaagtactctttaatgtggatccgatgcctttggttgtcttcctgcctgtgggccatttggcgctcacagctgcttttctcttgttctctccctgtagttactggggcttccggatgcagatgacgatgcgtttgaagagtacagtgctgacgtggaagaagaggagccagaggcggaccacccccagatgggggtcagccagcagtaaatctgggggctcccctgagaaggagagtgagccccacagtaacctaggtggggtcactgcccctcctgggttagcattttgcattagcacttcgaaataggacatctggctcccagcatccaaattaaaatgaaatacctttttaacgaccacaaaatatctgtgatgagctttgctcagaagtgacctgaatttcactcccgcttcagtggggtttctatggagttgtcttggtagcctttgccattttgaatttagagtccattttgtggctgactattctcttaagtttatgttggagaattaacattcgctgactcgaatgtagagaactctgaatgtattaaggataggttttgagtcctcacaggtgaccttactgagggaaagcatggcagagaagaaatgcagtctgcactttttatgtactttttaagtgtccgtaagtgaaaggttttgcttataaagcatgaattttaatatctagtcattaaactgcacaagtgcaaatacaagggcaggaaaggataatcacttagctttggactaagagggtaagagaggcccagaagcctttaagtgttttgccattactgagttacctgggtatgtagcgactggttcgtggttaggtgtaaatgttacttgcttgttcgactgtttcaaaacatgctaattccaaagccacttttgaagtctatagtggaaaatatagatggggtgaaagatataatgtattgatttttaaagctgtttataagccgtcccacgtataaaatgaaacattttaccttctctctttctaatgagatggccgcttgttaaatcatgaaaacatccagaattcaagtgccgcttaaactttgaagccatagataaatttgttagaaaagtaaaccaggattaaaagtttttaaaaatatggtagaatccttctttactttttaagtcttttatttaaaaaaaaaaagtcaaaaaaaggattccattgtgtaatttatttaaaaatttaatcacatgtttcgagggacttaattgtggtgtatttgtaaagggacacgaaggtaggaatcttttaatcgtgggttagcttggttaacagggaacgttttaataatc

SEQ ID NO: 41710 - DNA, 1023 bp, Homo sapiens
ggaggtctggccagaactgagatagttgggagcccctaaaaacttgcagacatacctgtggatccccgaagtacaagacccaagagcactgtgcagtgatggccacaggcttcatagaccaccggaattcaagtccaaaacgacaggcagccttgggaggccacagaggctcctggtgttgccccggggtttcattttggcccaacaaggaacaggaaggggaaacaatacaaaggctttcctcccttctctttcccttgccccttctgttcagggtttactgttcctgtctactaaggaaggcttgacccataacacaaatagtattgacaattactctgctgggtgattagatgagccttggaccctgaggttctttcactcactgagaagatacattggtggaaaggacaacaaatatgtcacaggcacgatggaagcccagtcttaacatcttagcacttagtggcataacagcgatttcactagtactattagatttcaaaatgctgagtttggatcctcgtgagtatgggctgtattctttgcaagtatggaacagtctgattctgatgacttttcagttgttttgtcatgaagccaacagtgctgagtaaatatgccccacctgtgtgtgctattacatataaaaatttttttgtaacaaacttttatgtagtccttgctaagtgccacacactgtactaagtttcttttaactcatttaatccctccaacaatcctacaaggtagatattatggttgatattctctttttacagatgaggaaactgaggcacagagaatctaagtaactctcacaagatcacacagctagtaagtgccagagctgggatttggacccaggcagtttggtttcagaactcttaactactctgctgaataatgaatgtcgtgggtgttggtcttacatttactgaaatctatgattttttttcacaccacagcacagaggccctgcctgcccgtatacttcacgcagtgcatgctgctaatatccat

SEQ ID NO: 41711 - DNA, 1025 bp, Homo sapiens
tgggttcaaagttcaaatttgcctcttactatgtgagcttcgagttctaaataaatcttaatgataacatgagcttattacaaagatttgatgagataatatacactaagggcttagttcagtgcgtggcacatgacatgtaatggtacctgttgttgctgggagtcttgatcttagtatgggtggtttaaaagaagaaagtaagtgggtcagtcttagtttctaaatccattgtacagtgccatccaatagaacattctcgaataatagaaatttctatatctgtgctacccaatacagtttagtgtcttgctgcatatagctattgagctcttcagatttggctagaggaagtgacttttcacatttaactgatttaaatttcaatagccatgtgtgatctgtgactaccatgttaggcagcacagctttatgagattaatattgtagaatcatgtgacaaaaagcagcattgtgagagaacagttacgtgaaaatataaggaagcatagagctcatggggttgagccagtcagaatcgcatttttaattagtcatggacactactcttattatgtcctttattgtacaaacaaaaaaatagaaaacatttccaaaccttaaatgtcaaacagtccagtgtcaagatgtattagtttgttctcacactgctataaagagacacctgagcttgggtaatttataaagaaaaaaggtttaactggctcatggttctataagctgtataggaagcatagctgcttctgcttctggggaggcctcaggaaacttacaatcatagtggaaggtgaaggggaagcaggcacgtcttacatattggagcaggagcaagagagagagaggggatgtgctacccacttctaaacaaccagatcccatgagaactgaccgtcaggaggacagtaccaaggggaggacggtgttaaatcacgaaaaaccacccccatgacccgatcacctcccatcaggcccctcctccaacattggggattgcaattcagcag

SEQ ID NO: 41712 - DNA, 1055 bp, Homo sapiens
actttgttgaacctaagcataaaaatggaccattttccctgtatctttgggtcttcatcctgaagactccagggtcacataaaatgatgatcaaataaatctgtatgccttttctcctattcttctaccttgtcagtgattttcagcgaaccttcagagggcgaagggtaagttttcccttggcccagacaccagcaaatgtaagtaaagtatttttctgagtcctgtgagccactttaacaatatgaaacagggggaaggggctgtgggaacccctgatttacagctggtcagtcagaaatatgggtggcctgggccccgtgactggcatctgaaatagggatagttttgtgagactgagctcttgacttgtggggtttgcacaaactctgggttactaactctggtgtcagaattgaattgtaggacaccctactggtcttggaaaatttgctggtgtcagaaaacatcccagagttccctaccgcaatgagcttaccacgtgtggcagggaagagagataatgaaacaagtcattataataagataatgagtttgaagagggggaaggatgaggtgcccagagggcccacagcagggggatttgtcctaactgagaacagatagaaagtgtccctgaagttgggcgcagtgtcttgagcctgtaatcccagtactttgggaggatcacttgagcctaggagtttgagatcaacctgggcaacatggcgaaaactaatctctaccaaaaaaaaaaaaaaaaaagttagctgggcatgatggcacgcacctgtaatcccatctacctgggaggctgaggtgggaggatcatctgagcccaggaggtcaaggctggcaaagagggcaaggaaagagctccagggagagggaggagcgtgggcctgtgggagggctggctgaagaccaggctggaggtagagtgggcctgcatttgaaggacacctatgccaagtaagacaagcactggaataatcctaacctcaggatgataacaacttcacaaagcctttcagacacctgtggatatttcccct

SEQ ID NO: 41713 - DNA, 1054 bp, Homo sapiens
taaggtccctcatctgatcaggtgatggtggtaagatgcttccacatggacaccttctagcttcatcagggtatagccctgccagagactgtcagttgtttctgtttttgtgtgctgtccacgaagggtccccagttggaagagagaaagggaaaggggagagaggtccctgtaagagccaaagaaatattgtaggtgcgaatagctggggctggtgtcatgggccataaaggaatttaccaagacagttgtagataaagaaaggcagatttattagagaagctatgaaaatacgttgcaaggttgcaatgagcagcacaacagagaagtgactgtctgcaaataggcaggggctggagggaagttttatagggtcatgctgaagggggctacatgtggaacaatgtcattgtgcccaccagttgtttgtgactagccatctctcagaaaaattggtcattgttctccccaacctggggctccttcctcattgttgcttacttatcttatcaggactccgtaagactatttgaaatttatagtgaaaactatgtatatttccccatctagtctaacaggttgtagacttatttcaaagtaacagcaaataacacaaatattttcccaaatccaatatttacaggaaatgcaccagtctctgatctgcccctgatgtaagtgtcagatgtgcttccagggctgtggcccattcctgtggctggccaagggtccagcctgaccaacagaacgttgctgtaactctaggaatgagtgcacactcaacctgagccggggcttattggctgtacctcagggttgccagcctttgtcaagcttcctactttgtggtccttctggcctacactcctacggcagatggtcagggtcacctttcatgagaagggaatatgtattggtagccaggggcctgcatgccatttctggcacaaacacattgcaggttgcaaatccctgcttcacctttatgaaaatggtattgatgaccttcagggcagagcagtgttttcttaaagtagcttctgtccaaaggtaa

SEQ ID NO: 41714 - DNA, 1034 bp, Homo sapiens
tattcgggcttcgaaggatgaggaggaatctgcattgcaaggtgaatgcccaggggttggacatgttccgtgacaataaaaagtccccatctttctaagatctggctttctcatctgcgggatgaggataaggaaactgcccttgcctcactcatggcatccttgggagtgtcctctgacggacccaaggcagaaatgttttaggaactatgaactgctgtacaaattattatataatactcagcccccagcacaaacattgactgtcagcagagagggttagaacaattgttttgcaagttgatgaattattttaatcttttataaagtgaactctcccagaatggttttcattaatgtccgatacccacaactgaaccaccacgccacttgtcttttactaaaacactgataaaacagaatccagcttgcctttgtgaacgtgttaaaaacgatgttttcagggagaacaatagaaaagtagccagtgttgtcagtttgacattcctcgctaggatttattcaggctgctgatgtctatatgcaaacagtacatttagaagccaaatgggttctggtgccttatgaatttctttcttctccccaatttgcatagaggggaggccagcaggaaatgtagtggcaatcaaatttcacttgtaatgaaacaatgcagtgtttttgactgtggatgggtgtttaaataatcttgacagtagcagctggttcctttcttcctttgtccaattaggtgctgttttttctgcaaggattactcaaaggcagtcaaaccttgatcctccctgtgtcaaaagtctgcctgaaagcctgacttctcatcatctaagaagaaacagcacatttatttttctgtctgggtgtgacaccatttcagagaaaggttgctagctttgagctgaaatgttatttcatccctggagtgtaggtgaaggctgtttcttctagggattggagagaactgtgccagctaaggcaagtactcaggatagccagatgctgtcagcaaacaaaga

SEQ ID NO: 41715 - DNA, 1005 bp, Homo sapiens
tgtcataataataataataataataatggctcaaatttattgagcatttaccagacttactatccaaatgatcacatttaattctcataaccaccttgtaagggaggtactcatcactcccaatttgcagatgagaaaactgaggttcagagaagttaagtaaacagcctaggtcatacgagtaggacacagcccactccagctgaggcagagcctgtggtcttctgaatcactatgctatgcggcctgggtctctgacacttagccctgttcgtcctccagggagagacatttgaccagtattaagagcctactgtgtgccaggaatagctctagacactggtgatgcattcattcactcaacaaatatttcagtatttcctgagtgctcactacatgccagattctgttttgtgtttggggtacatcagtgaacaaagctctctgccttcctggagtttacgttctactggagcaggcagacaagaaacaggacacatttaagaaaatcatatggtatgttagcaagtgatacactctatggaagaaagaaaacttacagcatagtaaagggtaccaggaatgctggagttggggtagacagggtacacttttaaataaagtggccaagagaggtctcattaagaaggtggcattcaaacacaaaaatggaaggaaatgagggaagtaactgtgtccacatatagggaagagcattacagacagagggaagaggcagtgcccagcatgttgaaagaacggcaagagggtaacatggccagaactgtgaatgaggaagagacagcaatagagatgtgatcacagcatggtgaggacccagtcatggcaggcccccatgtcactgtgaagactctgagtgaaatggagcgccctggcagggctctgagcagaggaatggccttttcttgtttttgtgtttaaagaaccactctgaatgctattttgagatgaactctaatgtggcaagggtggaggcaggtcaga

SEQ ID NO: 41716 - DNA, 1071 bp, Homo sapiens
gtctttgagagaaagcccaggcacaatcactgctgtctgggcagagcctcagaaatcaacttgctcacttaaggcaaaggaacatttactattatactgaactttgtctacactcaaaaatgggatcagaagaaagggaaaggtttgtgaacctcaagtccaagaataaaaatagagggctgaaaatgaaaactcttattttttagctgtctcaaaaggaagccagacattacagaccaaggaccactactataaaagccttggatataaagtcaaatttctcacattttaaaactctatgctattgcttccttcctctcctcctcctcctcctcctgctgagtgaagagcataggccctaaatcaggccacttggtccagatttcccttctaccacttactagttgtgtgaccatggagatgttacctggcctctctaagcttcagttcccctgtctgtaaactggagataagaataggacttatctcctagaggtacatttggaagaaagaaagaactactacaaaacacacacacacatacacacacacacacacacacacacacacacacacagagtcagtgcttcaggagcaatgacaatgggggatctttgtcatagcctactgccaggtttgagaaaccccaagggatacagtagatggtacagtgatggaggttgtcactaggctggatggggggaaacaattgaaagaatgtactcgaagctcagtttggaggtccagcataggagaatggctgggggaggcaggaacaacagcctaactcatttaaagaatagtagaatcaaatatatccctcacagcttccagcgcatgatctttataaatgtgtctgaatccaggaagattgcttcatagcaagacacactttcccccgttgccatggaaacagcactgttctcatgtgtcaggagcgcatgcagacacacacacacgcacacacgcacgcacacactgtatgttaatacattctggtgttctttatacttctaaaaggacatgttcagagccagaattttactaattcctatcatccacttgttatct

SEQ ID NO: 41717 - DNA, 1086 bp, Homo sapiens
gcttcttaactagaattgcactaacatttactaagggtacactgcgtgctaggaactgtgtttgatgcttccatgtacatcattttattcaatcctcttaggaattctatgaggttggaagtgttatagccatttaaaataagggcaatctgaagctcaaagaagacaaaccacttggtcaaggtccccaattgttaaccatcaaagtctgaatttgaacttggtttgtctgagcccaaagtccatagtttttaacctcactagcctaattctgtaaatagatctgggatgaacaggactctttcatccatgacgccttcctatctgctgagttggtgagagtctgaagaggggccaaagccagggacaaagtgagaccaagtccctgagtcacacagtgaccttgagtgcattccagagatcagactgaaacatcctcgatgatctcttctgtggtatcatctacccttgattttctataaataggaataatcaatgttgactggactgaatgacacagaagcaaacgaattgtttgtcctccaggactgtaaccagcaatcagccttgtattcagtgacatttgggccagtatttacttctttatctcatatctgttttgtctgtgattaaattccactatgaaggtgaccaagaaagctaatgttttgaattttcaagatttcattgttaagaaatctgttcaaggaaaggccaagtctttgggcagaatgaccaaatgctcctaagcctcaagtttgcgaactttatttcaaaaagtagagtactggtctttttagctaaaggttcccattctgtaggtctcatgggggtgtcctggaatcaaacctggggattgaatataggcagaagatccaggaacacacattgggaacagttctaagatacccacatttcgttcaagaggcatatataatcatcattggctggctggacacttttcctttattgtttttctttccaatcaacagggatgaagaatagcccttgttgaccctacatgccaaaaacaaattgcacgagcctccaaataatcactttttggagggtatattttagtacaaa

SEQ ID NO: 41718 - DNA, 1034 bp, Homo sapiens
aactctcataacatttggcttagtgaagtcaaatggtacaaaattcaaaagtaaaaggcacatggtataaagtcttacttcagcatccagccatctagttcccttgcccggagatagcaaatgttagctaatggatcaactttgagcaaattgttaacccaaaacttacctctttatcatccaagacaaacactgcttccatgccccacctcccatctgtgctctgacttcctggctggagacagaattctcaatgaaggagagaaacagaagtagtttctcttcagtgccagcctcaccttcccttcccttctctttacgtctcccctcccctaccactcctgggtctttctttcccaactcaaactatcaccactttacactacactaaaggtatcctcaggagaaggttgggacatctgctttaacttccacaactcctttgctaccgtgactatcattctgggtttatcaccaattaacataccactcacgctgtgaagtataagggctggtgtggctggaccaccaaagaagactcatttgctgtaatattcctaaacacagaaagaaaaaaaaataagattttctttctctaagtattctagtactaaaccttatagctacatatgtacaggaacagagagatatcaggacatgctattgatctcatttgcaaaaccccaaaataatagcaacaacaaactaagcatgcacacattgactagcagtttaaactgttaacagtgaatatgttacttaccaactattttaacttttaataagaagcatgaatttcatatatatacacatatatatgtatatatgattttcagatcgcagatcttttctcccctttttattgtggtaaaataacatacgctttaccattttaactatttttagttagttgtttgtttttaacagaggtggagtctcactatgttgcctaggctggtctcaacctcctggacccaagcactcctcccgccctggcctcccaaagtgttgagattataggcatgagccactgc

SEQ ID NO: 41719 - DNA, 1029 bp, Homo sapiens
ggagatcgagaccatcttggccagcatggtgaaaccccatctctactaaaatgcaaaaaattagccaggtgtggtggcacgtgcctgtaatcccagctacttgtgaggctgaggcgggggaatcgcttgaatctgggaggcggaggttgcagtgagctgagatcacaccactgcactccagcctggtgacagagcaagactctgtctaaaaaaaaaaaaaaaaaaaaaaggtctccaatttcatccaggatccaggttgctgcaaatgccatcatttcattcctttttatggctgagtagtattccacggtgtgtgtgtgtgtatcacattttctttattcacttgttgattggtgggcatttgggctggttccatatttttgcaattgtgaattgtgctgctataaacatatgtgtgcaagtatcttttttgtataattacttcttttcctctgggtagatagccagtagtgggattgctggatcaaatggtagatctatttttagtttttaaaggaaattccacactgttttccatagtggttgtagtagtttacgttcccaccaacaatgttaaagtgttcccttgttagcacatccatgccagcatctattattttttgattttttttattatagccatatgagtttcatttttttctcttcctgagacggagtctcactctgttgcctggctggagttcagtggcgagatctcggcttactgcaatctctgcctcctgggttcaagtgattcccctgcctcaggcttctgaatagctgggactacaggcacacaccaccacgcctggctaattttttatattttagtagagacagggtttcaccttgttggccagaatggtctcgatcttctgacctcgtgatctgcccacctcagcctcccaaagtgtggggattacaggcatgagccaccgtgcccggcctcatatttttcgtaaaaggtgtgatggtcaattgtgtcatcttgactgagccatggggtggctagctgtttggtcaaacact

SEQ ID NO: 41720 - DNA, 1051 bp, Homo sapiens
tgtggtgtggggggcaggagaagattctgagaactggcaactggttaaatagaaaatgtacctatgggagggaacaatgatttatcccaatacaaatgaaactaatttgaggaataaccacttattgagcatgcacatggatcgaacattgtgctaagaattttacatatagtttctttatctttccaatcttataaggagattgatggatattatgattccccattttacagtgcaggaaactggagctcagagaggttaagcaacttgctgatatagtttggctctgtgttcccacccaaatctcatgttgaattgtgatccccaatgttgggggagagacctggtgagaggtgattggatcatgggggtggatttcctccttgcttttctcacaatagcgagtgagttctcacaagatctggttgtttgaaagtgcgtagcacttccccctttgctctctcttcctcctgctcctaccacataagacttgctggcttccacttcgccttctgccatgattgtaggtttcctgaggccttcccagacatgcctcctgtatagcttgcagagctgtgagtcaattaaccgtcctttttataaattactcagtctcaggtagttctttacagcagtgtgagaatggactaatacacttaccaacagcacaaagctagtaagtggtggaattgggatacgtaataataatgctaataactcacacatgcgtaccacggtgtccgtggtgttctgctcagttctcacacccaccctatgtattatattatgttatatctccatcatcagatgaaggcaactttaaataactagcccaaggtcacatcactaggaagaaagggtgccaggcaatttactccagtaatcatatgcctggtcactacccttgctctcctccaggtctgtctgactttgctatctcagctctttttatgtagccagagaatccatcagatggctcttccctcctttctcaagatgtggtcagcagaccatcagcatcaacatcacctggaagcacattagaaagaat

SEQ ID NO: 41721 - DNA, 1047 bp, Homo sapiens
cttccagtagcagcggaggcgccaatgggaccgcgggcggcggcgggggcgctcgggccgccgccgcggggaggttcccggctcaggtgcccagcgcgcaccagcccagcgcctccggcggcgccgcggcggccgcggcggccccggcagccccggcggccccgcgcagccgctccctcggcggggccgtggggagcgtggcgtcgggggcccgcgcggcgcagtcccccttcagcatcccgaacagcagcagcggcccgtacggctcgcaggactcggtgcacagcagccctgaggacggcggcggcggccgggaccggccggtgggcgggagccccggcgggccgcgcctggtgatcggctccttaccagctcacctctcgccgcacatgtttggaggtacggacccctctccgcgcacccgcgctcggtcctcccgcggctgcacgtgggccgtggccgccggctatttttacccttctccttttctccttctgccggggcgccgggggctgcctcccggaccagcccgcgtcggtctccatcctggaagaaacccggcgcttaacaccggcggtgccgctaccgcatagacgcgtggttttgtttttaaacatcctgagcaccctcacctcagcggctgcccagtagagaaagtctattttccagtgagatgactggagcaaatgttgttttacaacaaaccgacgaaacagcccttgtggttgtggtttttagtaccaggaagtcaggaggagaccagttgctaaatgtagttctatctggggactcgagtggggaacagtttttaaaggccaaaagtcaaagcgtctcaaatgaacactgagttaccatgtttggaccgacttttagtataaagctgtaatcctgaaatctgtgtcagtagtcccagttactatgtcattttaattggatgaatgcgttaatgaaaagtttgtttttaaacctcactaaactgctacttaagatcacagttaatgtgagtcctgcttaatttggaaagcatttaaaaaatggaaaagtttc

SEQ ID NO: 41722 - DNA, 1019 bp, Homo sapiens
tgctgtatttcattcattagaagcaagtcataggtccagttcacgtgcaaggggagggaattatacaaaggtttaaacaccaggaagtgtaggaatcaagaatagtcacatcagttctttctgccacatggattatagatagattgacagctgaacatgtaacttcttttttaaactcattttaatttacttttaaaaagttgtactaatgcatatggttaagtatagcattaataaacatgaacttaaccccttttaggggctggacattatagatactgagggtacaaatatggagcttctttatgcactgctcaactctccattgaatttgagagatggatatatgtgatcattatacaatgcaacaaattctgtaatagaactgttaacaaaacacttagtgaagtatctttgtctaggctggtcaaaaaatgcttcacagaggagggtacgtttgaactgtagtttgaaggatttagaagttgtacggagagagggcagtacagactaaagaaaaatccacaaaagtgtgggttttgatagggcatactgaaaagttaaatatgtctggattgtagggtgcatagaggaatgatgagaacctgaagctagaaaaatagaaagtggagccagttgaaagattttatagtgctgtaggtttgttttatctaatgaagtttgaaagcagggggagtatcatgattaggccattgggcacaattaacactcgtagtttacatggatggcaaccttctctagtggtgcagacttcaggctgtatgcagcaaccctgatcaggattcagttcttaaggaggagagtgtgatagcaggagaataagttaggattcttttaaaatataactgatagaagatgcctatgttgaaaacatggcattggtgagggagaagaaaagttagatttgattgagatttctaagctagaactgatagaattgacctgggtacatagtgatgtctttaaccagtattaaagatgaaaagaacaagttttag

SEQ ID NO: 41723 - DNA, 1050 bp, Homo sapiens
tgctcattagagatggaaacagcttctagcaaggtataatctttgggactacgtaaaattttttaacccataaaaacttgtgaggtttttgatatttataagtgcagattggtggatatatttcgagtaatgtcacctatcagagtcattatttcattcagggctctttttttagcgacgaaaatattagtgtgtcagaaaattatagatgtattcagtcatttgaatttcataagttccgaccatgtggaatatcctaatttttgcttgaattgtgattagtctgtaatagttctttaatttacctatttatatgtgagctgaggaaaaaaagaagaatgaagccatgcatacataatgggttatttatttttatttttattgtcttttttttctttcctttttgtggagaacagggtctcgctatattgcccaggcaggattatgtgtaatatgtttcagagagccagtgctcagtttgaacaacacattttgctatttttgttggtttttaattttttctactgttacctctattctgttcgttctcattttgtaaagttaattttgttctttctcttagcttcttttattttttatttattattttttaatgataaaagcgtttaaggctgtgtttacttcttgttacatatagtcacttcccaaagctttggatacttaccattttcattatcattgagtacacatttttgtttcttttaaaatcagttctatcggggaataatcatgttaactgcatttcgatattttcttttacttggaagttattttaaagtgtggctttattgtggtggtccttactagtaccctttcgttacttctagtgttaatttagaaatattgcaccgtggctgggcactgtggctcatgcctgtaatcctagcactttgggaggcccaggtgggtggatcatctgaggtcaggagttcgagaccagcctggacaacatggtgaaaccccatctctactaaaaatacaaaaatcagccgggcatggtggcaggtgcccgtaatcccagcttactag

SEQ ID NO: 41724 - DNA, 1060 bp, Homo sapiens
aatttttaatgtttttaaaatttctgaggtctttaaaaatagttttttttcatatattccatttttgttttgtgggtacaatacctttttctaagaatattactgatacgaatttacatgtgcatctgtttgtgtatatatgtatgtgtatgtatatatatgtatgtgtatgctttgttccctttcctgatgactcggtttcttcccacttgctttttctgtttgtttggcttcattcttttgttagatattttctttaaatgtttggtgatctttggctaactcctgatacttttaaagtggggggcactaaaaagcaaattggaagctctctgtgcatgtagtgtcctctgtctgggccattttcttagggatattactgtcttttctcttgggctggtcatattttccagaaatggcttttcttgcctggaatacacaatcgtttatgctagtgatctaggagcagagtgagaagaagattgagagtcttaatactcaaaatgatactttcatttaatctcaatatttagtatcaatacaggacctctgccttcagctattcctgttgtctgcaagtctagaaacttttccctttcctaataacaagcttgtagtagagtgccagggttggggttgcttagctgctgcaagtcagggaggacaactaggagatctcacagctccttacgcagactggcgatgaatctttctcttttaggcctgccttcacccctgcttccagggatatcttgtgcttgccagttcttgtgcctgctgtaaatcagtttgcttctctgctttcctagttctgcagtgaaaattattattctttaattttctttccagagtctaaaggtactgctttttatttcatcttcttgattttttataggtgtattccctttaaaaattacatttttatcattttagtaggatgtttggactgagcagaaactaatgaatgtgtacaactagttatctttacttagtttttttttaattgcagaagaaataataattcactcctataaaaatttggatgatgcccctgggcgtg

SEQ ID NO: 41725 - DNA, 1035 bp, Homo sapiens
caactagccattgcttcatttttctgtgataaaactaccgaaaagtatgaatgggtgttaccagtctattatgtttagggccatgggttgggtcttgtttgaacagcaaggataggtggacttaagggatattcatcatatagacttagggtaaatcattgagagagctgattgatgaaaatagcatgacttgcttcctcattaacccaccaaaaagttataggaaaatgagggaaataaaggactagggtgagttaaaaagggagctctgtgcccctggtgtgctggaactagctcttcctggagttgataaattattaggacttcggcaagccagatgttaaatataaccatcattaaaattaaattatataaattgcatttaaattatatttaaaacaaaggaaatactcaaaacttatgtcctagttttattatattttactgttatctgtgttcttgaggttattgacacctgttgtatctgtgtggtggaaattctgtcagtgtgcagttgcacatctctttcctattctgtgttcaatgataccactttggtgacttgaaataggacagactatttataccatggaaatcagcaactagtacaaatcaggatttttttcccctggagaacagttgttaaatatctacccgaataccactgggtataaagttttgctgtttgagatactgattgtctttcatcattgtaaatgtacttattttctgaagcttcgagcattctaatcttacgtaaagttttattgttcttaggaaaataggtaactatactagttttactcatgttttaaaagatatcttaagcttcaagggagatatggcttattttatttagcttttattttcatgtagatagtatttttgtaagtttgttctccttgttttttaaaacattgtcatttaaaaagtatacttaaaaaacctttataacaaataaccacccagaatttatctttcttgtaagccattagtttcatttcttgaactcattttagcaaggagtacactttt

SEQ ID NO: 41726 - DNA, 1029 bp, Homo sapiens
tttggttctggagcttactatcattctttggtcttaagttttctgcaactgaagggaattggaaatgtgtttgtttagaaacattattctgggacattgagcttaattgagaattttagctgtggctggtacaggtttttcctagtgttttgctttaagccaatgcgtataaacagtagccatagaggctagagttcattgttgtaattattctgaaacccatagttgtttaaaccttttttctcttcatttgacttccacaatataatctaagacccaggtgaaactaacatattgctcatgttacatgtggcctcataggctagtgggcattatacatgtgagaagttagtgtcgggtaagaagctgtggctcagacatgcatttctccctctagtttgtgaattcccagagcaaatgccattactccatccttcctccctccctgcctttctactgagagaaaattcccagagcagaggctgttgtcatatttatgaaaacaaacaaatagactgtaactactgttaaagctcatgctcagttccaaaagtgctttgcatacttagtcagatttctagaattgcccccgagaatatggactaagttaccgttggcactgaggcatcctcctattctgtagtgagcttgtttcacatcagtgaagaataaaaaactacttaacctccctgtgtctgtcttgtgatcattctgtaccctcattcactaccttcctcccccagtggtgatgtgtggccatttcgaggttccctggtggcagaatatgttcggtatattcgattttacaaggtccatttgtattaggtaaaccactgatccctaggtccttgttgtgttattggcatactctctcatattataaattaaggatgccttgtttgtattgccacatggattttatttagttttccatgagagctgacctgtcctgtgctaccatagtttaagttgacttttctaccgttgtgaatagtggtttagttctttcccttcatcagctgtttgata

SEQ ID NO: 41727 - DNA, 1068 bp, Homo sapiens
cgtactgtttttccccttaggctctactttgtaggcagttggatggctctcaagtgaggctttttaggttcacagtattgcacttttgtttaagtttgtttgccagtacccagatgattctgatgtttcaaatcagttgcctcttgccctcgtttatgctaagtttaacttcagggaagcaaattttttaagtttcaaggcaagaattctttagttgatgcttaaaatctggttgcagttttaggatctctgctttctccccatggttgatcagtttcacagtattcgatgtagcctgtgtttggccattatagtttttttgtagtttcatttttaggggtgtctaatcttttggcttccttgggccacattttttatagtttcatttttaggggtgtctaatcttttggcttctgtgggccacacataaaatacactaacaatagctgatcagctaaaaaaaaaaactgcaaaaaatctcataatgttttaaggaagtttatgaatttgtgttgggccacattaggccatgcgttggacaaacttgttttaatcgaatcctccttcctgttttttttctttctctttttggtggttttcaagaagttgaagtaaacatacctttattcctttcttttaaaatgcatgtactacagtttgaaaaacattgtacaaaatcatatatttcatttaggaaattgaatacctggaggattagctgtgccaaaatctttttcccaatccttataaagttcggcatgaggtataattctagcctcactcatttggttgcagtgagtttcacatcacagtgaagggaggacagttcctgtgagaacacatgtgttggaactagagagctgccaaaacgtctctttcaccacccatcttattagttgtctctcacagtgcttctgttcctgtctacactctagcttcatgtggccttctttcttgtgcttgcctatagtttctgttctctcgtaagttcagcttacacctgagccgtcatggacaccactgtctctcttttacttacttttgacctttctgcttaagctctttact

SEQ ID NO: 41728 - DNA, 1541 bp, Homo sapiens
tggatttgcatcttgtaatgtgtttaacaaagccacgaataacctataatggtaagtccaatggtttaaaataatattttaagttagaattaacttacattttatgaatttcatgtttcaagtataatttaaaaggagggaaggacattgttttctctatttttactagtgcattaatgcagtggttctcaaattctgtgatctcaagacttctttacacttcaaaaaattactgaggacttcaaagagtttttctttacttgggttatatctatccatatttgtcataaattaaaacagaatttataatttttaatttattttgttaaacataaatataattatgttgacaacttttaaatgaaaagtaaattttctaagacaaaatatttagtgacaagagtggcattttcaggatttttacaaactctttaatatcaggcttcatgacaaggaattctcacatctgcttcttcattcagtttattgtgatatggcacgtcttgtgtcctctggaaaactctgctgctatactggagagaatgggaatgaaaaaggcagatatggccaggcacagtggctcacacctgtaatcccagcactttgggaggccgaggtaggcagatcacctgagatcccaagtttgagaccagcctggccaacatggtgaaaccccatctctactaaaagaaaaaaaaaaagaaaaaaaaaaattagctgggtgtggtggtgcacacctgaaatcctagctactcgggaggctgaggcaggagaatcgcttgaacccaggaggcgaaagttgtagtgagccgagattgtgccactgcactccagccttggagacagagtgagactctgtctcaaaaaaaaaaagaaaaaaaaacaaaaacaaacaaacaaaaaaacagatacttagtgttaccatgaaaatagtttttactttgttaatctaaaaggatttcaaaggctcttccacttctcctactgtacaagattctttggaccacagtttgagaactgctgcattgaaataaaatcttttgggttaagcctaagtaaaatgtaatgttcataatggccattttcaaaagtaagtaagcatggttgaaattgcaacttttttctttttgtttaagagtatagagtaaatgaagggaacatatatgaggagtagggagaataaaagtttattcaatagtaaatagatgcctaatgggagaaaaaagtcattaagagaaacccaaaactctacctatgcagtgcatatgtgtctctgtctttcctcccatatacaaatttagtctgtgagctctggagcgaactggtatttttttaggtctggtgttttagactgtaccattctttcctgaccaaaatctctagatattccaaaacctaggaaagattttaaatgtagccttggcatactttggaatagacttgggggggaaaaatcaagtagttctgtcctaaccaatgaatagaataaaatgaaggaaaaatgaaagttgttttcaaaattttataaagaaacagacttc

SEQ ID NO: 41729 - DNA, 1035 bp, Homo sapiens
gctatagttgtctttctgtgcctggcttatttcacttaacataatgtcctccagttccatccatgttgttgaaaatgacagatttcattcatttgcatggctgaataatattctattgtttatagataccacgttttctgtatccattcatctgttgatggatacttaggttgaatccatatcttggttatcgtgaatagtgctgcagtaaacatgggagtgcagatatttcttcgaaatactgatttcatttcttttggatatatatccagtaacaggattgctggatcatatggtagttctctttttcgttttttgaggaacctctgtactgttctccataatggctgtactaatttacattcccaccaacagtgtacaagggttcccctttctccacagccttgccagcatctgttattgcctgtctttttgataaaagctgttttaacaataagatcatatcttattgtagctttgatgtagcaaattcttagtcttgattgtattggtctttaaactatacctgattatggtatactttataccatataaagttcagtttttactttagacttctgtgattcaaggcagtaagatttatttatatttaaggaatctttgttttacttgtggttggtactatgtttgtgcatgtgtacttagaagaggtacaacttgaaataaagttgtcttctgggagttaaattataaacttgtgaatcaaaacagagctattcagaatcatcagaaagaagaacaactctatggacagagcaagatgtgactattaccctgttaaagtaaacatgtttgaagaaagattgagccagttggaaggcaatttgttctgtaataaaaatgatgaaaaaagctgccaattgctacactgtctgtgggagaatctattttgtcaggctcacacaaatattgcaggtgattgtatcaggctgtcagcaccttgattccagtttgcatatacagcctgctaatcatctgggttcctgtctaacatgtttgcaggaaagagcatat

SEQ ID NO: 41730 - DNA, 1024 bp, Homo sapiens
gagtagtttggtatcttctcagccactgagtagtttggtatcttctcagccactgagtagtttggtttcagggagggcaatattaacacagtggctccgtcttggggggaactatatttaattcttaatattttaagtattttaaggtaacatgaaaataataaaggaaaataatgaaagtattaataatgaaagtattgtaggcatagagatgtttttcttatagctttagttatctgagattttaatttttttgttaatttctaggtagtttctcatttaatttttaactttttctttgattcagagattatgtagaaaagatacattataatgcagagaaaatttaggggagcaggaagatgtgtagtgggaagtcattttgatctcgatattagagaaagctgtccatacttctctatattttaaaaatgttttgatgttttctgtgtggccaagtacatcattgagttctggaaattgtgaatataagagaagcatatatattttcttctgtagagtgtaaaatctgcatttttctgacacatacatggacatgtatgtgtgtatatatgtatgtattagaaaacatgcgtgtatgtgggtgtaattcccataaattgaatttggttgtattattgaaatattttgtatcctttattctgtttgatctacatagtctgacaaatttaaaaagtttattaaagcatccctactgtggctgtggttttatcaattttttctcatttttaaagtctcttacttgttttggtaatatttgccttgcagcagtgttttctggttttatgtatttcataactatgttgtttgcacagatatttatgacttatgttcttttcggattgaatctttttatgttataaagtattcatctctatcccatgtaaggcttttagccttatattcactttatctaatttttttttcttatgcttgttagtaactgtgaagggtctgagattatagccacttgccagccagcaagttagcctggctacatttt

SEQ ID NO: 41731 - DNA, 1036 bp, Homo sapiens
aaaatctgggtgctcctgtattgggtgcatatatatttaggatagttagctcttcttgttgcatcaatccgcttaccattatgtaatgcgcttctttgtcttttttgatctttgttggtttaaagtctgttttatcagagacaaggatttcaacccctgctttttttttttttttgctttccatttgcttggtaaatattcctccatttctttattttgagcctatgtgtgtctttgcatgtgagatagatctcctgaatacagtacactgatgggtcttgactctttatccaatttgccagtctgtgtcttttaattggggcatttagcccatttacatttaaaattaatattgttatgcgtgagtttgatcctgtcgttatgatgctagctggttattttccctgttagttgatgcaatttcttcatagtgttgatggtgattacagtttgttatgtttttgtagtggctggtactggtttttcctttccatatttagtgcttccttcaggagctcttgtaagacaggcgtggtgatgacagaatctctcagcatttgcttgtctgtaaaggatattatttctccttcatttgtgaagcgtagcttgactggatacgaaattctgggttgaaattctttaagaatgttgaatattggcccccactgtcttctggcttgtagggtttctgcagagagatccattgttagtctatcatttttctgttttctaattcattaatttagacttttgtttatattatttattgtgctttccttaggtatgcgttttctgagtttattgtgttgggggtattaatttttctttcttgtttttcagcagaagtatacaagcctatgaatttttctctgaagatgttttagctctgtttcaaaggttccgataagtagtggttttttttagatgaggtactttgtattttgggggtgtcttttttaactcaaaagttatttgagagtatctttatccaagtgtagaggacttttttccccctggttttgctatttgtttccta

SEQ ID NO: 41732 - DNA, 1040 bp, Homo sapiens
cttcaaatatatgaaaagcttttatgaaaagacttggagagatgatataaagcattggattgttatatcaaggcagagcattttagctaatcctagaattgtttcaggagtgagagtctctttgttcagggactcaagacagtaacagccggcttttctaggaggctgagactgatggcaaggaactagaccagatgacgtccagaggtctagtcctgtgtggtaccatttccttttatttcaataacttctcttaaatttgagaataaaagtgttgaggtaataaacaccctcaaggaattctgttgctgtattggtggaagatgatttaagagtagcagattagaatattgacagagaagatttgagataatagcagcaatagcacctgaaatgagaactgcagttgagtgtcataagactacgcatgtgcatgtgaaatgtggaagccttggtagactgcagagtactaaaagactgccaattttaacctttcctgtgaacttacttagatcatgccttgacacatttaaaatatgaattgaggctgaacactaattgcttgagataaggagtttgaggctgcagtgagctatgaacacaccagtgcactcctgcctgggtgacttagcaagtccctgtctaaataaataaataaataaaatgtgaatggaagtaagaatgctaggtaagagaagtatagtggtggagtggtattttgaatatatgtgcacatatgtttttatttcaccatagaaaaggtttggaatgccttcattgtcaccttatgtttgagacaaaacgaaactgtggctaaaattatagaagcattttaagggaagtactgaaactgatgctaacaaaatgaaatttttgtcttagtattttacatgccaaagtaatacatctaaatccttcatctatagataaaatttgtctttttagtctttcttagtgcattttgggctgctataacaaaataccttagatgagtaatttatacatgacagaaatttagtgctcacagttctggaagctgg

SEQ ID NO: 41733 - DNA, 1079 bp, Homo sapiens
taatgcaaaagtcattgcaaaaactgctattacttttgcgccaatttaatagttcacttgtttactttttaacctatattggcttaaattcactttttagcccctctttgtcataaggttctgtgctgcatttgctacaatagaagctcctatggttttaaagaaagttcagtgttttgtcagtgtcaagtgctacttgatgattatatttgtctggaacagtattcacttaagtctgtttatagcaatcccttttttgacaaaatttacaaagttggcatttttactttaaattccatctctatcagtgacttcctaaaaagagcaacttagaaattgggggaaaaatgtttttaaagcccaaatgctccagtttttattcaaagtcaaagtcgttattctggaaaatacaagtaatgttctatataatgtcacttaaaatattcgtaaatctattttgcaaacactgaatagtataagtaagatataaaatcacaatagatatttaaatactaagctgaaacttctgacaactaattattatgggggacacaataaagattgaaagcctaggttaccaagttggttttagctttctagaatctttgtaaatactcacgttcaaataagatcacacgtgcatatatagaaagcaatatgttctgaaatttcactttagtgccactgtttgtccataatggatttattgccaattttgaatcctcatcttactttgatctggcttttttttcccccccttgccagaatgtttaggagaaagtaaaattattccgttttactttggctttttgccagagatacaaactaagaatagtctgaatatgtgtttttcagatctggttacaagacggattatagattgtgttttagagcaatgttgtgattgaaatataaataatggtataactttttttgtgttagcaaaaacaacattaaaaaggttatgttacataatatgtaggttttggtttcttagtgcaagacttatatttctcttaaatgttgtataattatttcagttttcactcactagctactttactaaaatgtagccccaa

SEQ ID NO: 41734 - DNA, 1067 bp, Homo sapiens
atcacattgctgagaactatataaaactacatagaggtaaatggtgcttattaaatatgagtatagtttgttacttgctggaagtcttctagttcatttggaccattttcttaccctgaggtgaactcaatatctgttggcaatgggtggttaaatgtgaagtgcccttgttcagtgtcccttgttcttgtacaggtattttcttagtttaaaaaaaaaattctagcatgccaacatttgtctttggcctattcctttttttctgaagtgtgtaacttctgattttttctttgctatgttgtaaataacagtagctaaattctctgttttactatctacttttcttttcttcccagatcatttcattctaaaattaaattgcttggttttctttagaggaaattgctacatggtatacttgtagtagtgattcatattaaaaaaatagctggtaaatctttctaggtagtaacttatccaaacaatactttgagtatcatattttgtgaatgacttgcttaaactgggaaactgaatattctttttaaatcatataattcctgtattaaatgtgaaacacacagtctccaaagtcacctgattctctgtggaaaatgaaaggcattgaaggaaaccagatacattaatacttagttttggttgaaagtgcaacattactgtacttagaaggggcttggtttatttttagatatttaagctatcattaattttagaccaatggctaataataagagagatttttggttgctcatttatggagagacaaagaacagcatggcataaacaaacatcccagaaataaatgaaaagttttaagtgataaaattgtgttttctatgaaccagtgttgtacatgaaccaacattgtgtttcttagctctgacctgtacagtgaggtacctgtcaggacccctagtcttggcactggaaatgacaaagttctcctattactaaattctcatgccttccttttctgacttagtagattgaaattggtaggtactaatgatttatgtttgataaacttaagttctgctgatatcctg

SEQ ID NO: 41735 - DNA, 2779 bp, Homo sapiens
gtagaaaataagagaagagtgctttcaaggaaatttgtcatattctcccttctatctagaagttgacaatgaattgcaataaaactaagaaataactgaatgctgaaaaataccatgaattaatgttatggcttctttatttttgtatatccattcccacaaaattgaatttaagattattaatgaaaattctatattaagtaataatgcttgtattagtaatgggtaaagaagtctttctttgttacattaaccgttagtaaaagatgtactttgacatttctgatgtaaaacctatatgtaaatattgtaatttaaatatgattggacagctgttaagttttggggagggaagcagatgccagcgttctctgctgaaaagacaagatggcgcttgacggaccacagcagatggagctggaggaggaaaaggcaggcagtggactctgccagtattatctgtccaagattgaagaactccagggtcaactgcaatataaattggatgggggaaagccacaaggaacagttctgaactccaggtgcatttgcagctgattttgaatgataagacccaaaacctctggaggcggcaggtgcacgggaatgaactaaatgttaaagtgtgcctattacaggaggagctacagctgctgcaggaataggactcctgtgtcagggaagtagtccaggccatgggtaagaagaaagtgttggtcaaggtgcatctcaaggacaagtttgtcatagatgtggacaaaaatatcagcatcagtgatgtgacacccagttccttggtggttctaagaaatgacagctacactttgcacaagatcctacccaacaaggtggactcattggtgtcactgatgatggtgaagaaagtaccagattcagcttatgaaatgattggtagactggataggcagatcaagaagatcaaagaagtgatcgacctgcctgctaagcatcccgagctcttcaaagcactgggcattgcacagcccaagggaatgctgcttggaagagactgttggcctgggctctggctcatcatagggactgtgtacctttattcatgtctctggctctgaattggtacagaaattcattggggaatttctgtgatggcagagaaaatgctcatctgtcatcttcatggatgaaattgactcttttggctcctcagagctggagggggatgctggagggaacagtgaagtgcagcagatgatgcttcgagggtggctttgaggccaccaagagtatcacggtttatcacggctgctaatacgattgatatcctggactcggcactgctttgcccagggcacattgacagaaaaattgaattcccaacctgcaatgagtaggcctggctggtcactttgaagattcattctcagaaatgaacctgacccaggggatcaacctgagaaaaattgctgagcttatgccaggagcatcaggctgaagtgaagggcatgtgcacagaaaccggcatgtatgccctgagtagcgagtccatgtcactcagaaggactttgaggtagtccaaagtcctatctcatgccaaaggacagtgaggaaaaacatgtccatcaagaaactatggaattgagggcacatcctttgtgtgtatccctacaataaaactcagtgggacaagcaaaaaaaaaaaaaaaaaaaagttttggggagggatgatctgctagtgtataatcaataacttttaacatttagcttgtatttagtaacatttcattgtgttttgaaaaaaagtaaaaaatcttttgaagcacaattttcatgatgtaaaaggtattgagtttcctagtgtaagaacatgaattctggaaacagtcttagggacactgggcaagatagaggcctccacccctcccccccccaccaactttgtttgtaaaaggagataatactgcctacatcagggttggtgtgaggattaattagaagagtacatgtatgtaagcaccagacacatagtaagcacttaataatgttagtggctagtataaacagtaaacatatttgtgcccatttatgaataattttagtattcgctccagtcatgaggtgtagtagtaatatctaagaccttaactgaaatgtttaaagaaacctaggtataacagagaacattatgggtgctgatttccactctcactaaaagccagtgactttactatatcagcaagtataaagcactacttgactctgtagattgtatggaccaagaatgtagatatgagacagctgatctctacgaactgaatttttagtgagtaaagcaagcaagcatgtaatagagaacaataaaagctctgatagacatatgtacaaggtgttgtagaggtacaaaggaaagttattcagactaggcaagagagtgattaaacttaagtattgaagaacaaatagatcatagctctaggggatgtggaacatacaaagtggaaagtttgggaagagtattcccaaggcaaaaagcttagcacatacaaacataggaggaaagcgagacactcttaaagagttgctatgctttgggaggtggaggcgggcggatcacgagatcaagagattgagaccatcctggccgacacagtgaaaccctgtctctactaaaaatacaaaaattagctgggcgtggtgcgcgcctgtagttccagctactcaggaggccgaggcaggagaattgcttgaacccaggaggcagaggttgcagtgaactgagattgtgccactgtactccaac

SEQ ID NO: 41736 - DNA, 1051 bp, Homo sapiens
cttgggatatccttgtgggtcaaggaggcaactctcctcacggattccctgatttgataacaacatactcatggaaacaccaatccaagttttcacaagtttctcttaaagttaacttaagacttcctagaccaagaattcctaccacgcaaggcctgtgaaaatattgtaaacttaatatccgacagggagatattcaaagatgccaaagtacctgtttttataaatattaccacatggtttaagatttgacttctcacataaaatgagtaaaaataacaatgatttttctgcagtaccttaatgatgctgtaattatgaagcagggttttaaaattctgccatgtagtgccttatttttatagtaatgttttctatgaaccttctaatttaatgtgtattaagagatttaaagagtatgtaattaaaaaatatctttccaacaaagtcaccttgagatttaatgctttctaattggcttgatcatttgatggcaagataactagttgggtaactgaacatagactctacagtgttagcaaatatgaatttatatttcagaaaaatatcaaataactaatatcagagcctgtgtgcctgcctttcaaggtagtacattaacacttggaatattaaatctgtaaatactaaggatattatccaaatagatgatattcatcaaatggtatataaagttcatccgttgttggaattcaaatgttgcaaaggccaaaggtatttaatatccaaactattgttttagcatatatttattctttgaaatctggtgtgtattttacacttacagcccatctctattcaggactatagccacattttaagttatcaagagtcatatgtgaccagtggccactgtgctggcagcacaggtctagatgactctgggagacacttctactcctatctctccttacctgaatatttctgaaggccttctaattccaactttgtgaagactcttgggtctctttcaaagtttatttaactgctgcacttgagcagaacttgtcctaaattattactaaaattg

SEQ ID NO: 41737 - DNA, 1046 bp, Homo sapiens
cagcaccatgcttcctgtacaacctgcagaactgtgagccaattaaacctcttctcaggttttttttttttttctcagtctcaggtatttttttatagcagtgcaaaatcggcctaatatattgtctgtatagcattctgatgattagttcttcactgtgtattaagattgacttatgttgctgcatgtatggctaattcatccctctgactgcttcagaaatattccactttattcatatttattcaacattttacttatctattcccccgtgtactaaaagtcaaaagcattactaatttaataatgtcatatttgttcttctaattattttttgctgcataacaaagcactcctaacttagtggcttacaatgataacagtcatttattttattcaaaaatctgcaatttgggctacaattggcagaacagctcatctttgctccttacagtattggctggagttggcgatgactcagcagatcaaggctggaagactcattctcgtcaggtggttgacgttggctgtcagttggaacctcacctggggctgtttgccagaacacctacacatggcatgtccatggagctatttgacttcctcactgcaatggctgggttccaagagcagttatcccaagagaacaaggcagaagtgcatgacttttagaatcttgtctcacaagtcacacagagtcacttccaccatcccctgttggtcaaggaggacatgaaggtcttcctaggagcacggggagaagacagacttctaccacctgttggaaggagtgtcagtgttacatagcaagagaagcacatggaatgggatgtattgtgatgcccatctttggaacagacaatttggcatatctgtgaaaattaaaagtctgatttggatataacaaatgagactgattagcaaagatgtctaattataaaagttaaagttaaattccaaatatactttttttttttgccaaagaccaaagactaggttatagccaaggaattctggctccctatatccctaggctttttttattt

SEQ ID NO: 41738 - DNA, 1045 bp, Homo sapiens
gtcagctgtcttggcactggggggagggtcatttagcatggaaattagattataatgaagttagaggttcttcagaggtcaagtgagctgccatcttggttcccaccactcttagctggtttggtgtcatgatggggagcttttgaccacagacatcccgtttcctaaagataaccagagttaaggtggggaagaaatttacttaggtcacacagacgttacactgggtaacaacattactttgacaacaaaaataaatgcactttataacagaaaaaagtccaggaaaaaattgagacactttaatatttgttattggtctgaaaaaacacccaagtagtcatgggaaagattagaaacttgtttaacatctttgcacttactttataatttagtatttaaatattttcattatagatccagaggggcctataaccttttcagtacttaatgtctctaagagtcttaagctggtcttgggtgcagttcattccattttaaggttgagagagtagtgttgggatgtcctctggtaaaatgagtctcagcctcctcataatgccattctactttcattaaaattcttcttcatgatcctgggttaatggtcatggttttgcctttcagctctagagcaaggtttttttcttgtaagtaagcagttggttactggaaacagacctgtggtccacctggaagtgaaccaaaatatggatgagcagaaagcgctttcccgcttggcaaaggctcatgggcctggctccatagggtggtgccagctcctgccctgttcttttgtgctgtgaagacacaggtgccccctatgttcagtgacttgacacttaaatggcagtatggtctttggtaataataatgaaaactaacagctatgcttttcactgacaaaggtaggatattgcaggaagcttgatgttgaatactttggggttttactttgagaactcctagtcctgtattggaccttgttggaaagttccctgagcctatgagtgagaaggggacaacttgggagtcccacggtgag

SEQ ID NO: 41739 - DNA, 1068 bp, Homo sapiens
tggggaaagagattaccatgaaacaggccctagcagtcacttacaaatacagttgaccctcattatttgcgaatcccatatttgcaaatttgcttacttgctaaaagtgtctttgtaatccccaaattaatacttgtggagctttcaaggtggctcctggatagacacacagtagtgaaaactctgtcactctttgcacacgtcccaagctaaggtcaaaaaaggtgacccttcgtcttcttgtttcagctctcatacaaagatgacctgaggacagagacagtagaggacagtgcagggtagtgcaagaagctgtggctctggggtctggtcaagatgcccctttcttctgttaggaagctttcccactcctctgcctgctttcgcatctcttccaaaatacaagtgattgcatgtgactcccttgttagagcaggctctcaataaataggctttgcttgatttcatttggttcatcttcatttatttccacaatagaaaaagtacctttaaactggatgccagataccgttcccagaatcaaaggaggaaaaacgtcaaatacttggtgaaggttctctgatgggcataactaagtttagccttactttgggtttttcgaatttggccctcttcgattccatgggccatgtgagggaaacacacagctctccctgacaggcgggccttctcctggcctccctccctagaccctgaacagtgcagcagagcctggcaatgtgcaggaatccctttcccagagtgggactttaatttagaataatgtcactgaggagctccaacagaggagtccaggctgggcacaggcaccccagggtggggcccttgcagctctcccacacaaggcaaagcgaagtcacagcccttctctttgcagacagcctcccagtcccacgaggataacccttgggcagaagcccacacatagagctcacatggacaaacaacgctcagggatggtgcagcgggaacctgtgtcaacaaagaggaacattttcctaaagtagcataattggaaataaggttcctttgccgtaaaaaaacctc

SEQ ID NO: 41740 - DNA, 1031 bp, Homo sapiens
attttttattgaggcataacattcaaagagcaaagtgcacagatcttaagtatatagatcaagtcctttattttttaaaaaagttatatgtagataattagttatatacagataatttttctaattagcaaatgaatcaagacaataccatgactgctgttgtaaaatcaactgtgggattcatgtaaattaagaactttatgcttggatttactttttaattgtctagcattgaaactgaaaagtgcattgtcctttttcccattgattgatatatgtcaacactgttcttacagctcatttacagaaattgatgtctgataagaagtgttctgtcgaaaagaaatcagaaatggaaagtgttttggcccaggtgagtactctagagatgttatcagagtaacctaggtggtcgctgtccttctttcagtgtttaatgactgttgcatttcccattatgctgaccctggccacattgtaatgaagcagaggttaattctgtcctgtatagcgtctctttttttgcatttttattttcttctctcttttgtgactaaccctttatttcagcccaaactaacaagtccgtgttaataggcattcaatttgtctgaccttggaaactacttttctggatttaatagctaaaaccacaggagtgactgatgatgggtagtgttcagcactggtgtggagacttcggggcagataacttgatgagcactttctcactggctacttgatctgcctctgcttggaccctgatttcatgctattattcttagaacctcatgagcaggtcctgacttttctgtccttgcttttctcagtttgcctataggcctaaagttttataatttgtataatatttaagctgacaaattttagagaagacaaaaaagagaccacagagataatttattctgaccttttaccaattgcaggaatactttctatattagaagtagttcttatccttttgttgggtcacagaccaccctaagaatgtgatcaaaactgcacgtctccct

SEQ ID NO: 41741 - DNA, 1174 bp, Homo sapiens
atttacattgaaaactttcttaatttggctgttgaatcatctgctgatttattttgatacttgtggagtgtaattttatcccttgcttgaagctcattgttttagtaattactcatggtttagaaaattatttcttacattttgatactgttgaagccacacgttcatctcattttcttatccaaaggcatgccctttattagaaaaaatggaaaatgcctctaagtatccctaaaattttccattcagaattttagatttactgaggttttgtgtatatgtttttgatcttaacagtattattcatttccaagtacgttgtcagagttgggaagtaactagttgatttgacaagtcaatttattgtttgagcattggccttctctcttatttcagatctgtgttctaggagagcaatttgttttttgacttgccatatcagatgcatgtacagctgtcaatataatcttcaatgaaaagtaagggacccatgggaaatggtgtagcactcagaaatggccctggtggattcactggctgaaagcccatctgttgcttaagcacagagtagcgttttctgcaccttagtgtctgactccttttcagctttatgaagcatcattgtttctttaaaaggccctgattcaccttctgtggtaggaagacctctactcctattatgtggatttaacagctcagaacgaattcttttgtttctcttctctgtctgtttttgtggcccatctctggatgttccagttttaaaaaccatttttaacttgtttatgaaaaattcaaaacatacaaaattttatatgttaaataaaaacataataaacaattatgtacctatcaccctgcttcactgttagatttttttgtatctattcccctctcactttcctgacttctttcccctaattctttgtgtgtggtagggtggggacagagccccactctgtagcccaggctggagtggaggggcacgaacatggctcactgcagccaggacctcctgagctcaagaatcctcctgtctgggcctcccaaagtgctaggattacacatgtgagccatggtgcccagcctgaatttttttgaagcagatctcaaacattattttattatacctgtaaatttttcattatctatctctaaaagagaaaaatccttt

SEQ ID NO: 41742 - DNA, 1055 bp, Homo sapiens
ttaggtaattagcttgatgttagcttgttcaattcatgccttatatcctttgccttgaataacactttatttaagaagctcttgctccaaagaaaccaactgtatgatgccattatcagtcatttacttttttgtagcagtaaaaaagaagaaatcaaactgctatgaaagctaaagaaccatttcatttcgcttttaatttcccattctttgaaatgggatgaagaaacttcatttagtgtatacttataaagacttgctaatgctttaaggaaaaccattttatctgcatgtcactattcaatatcttatttcttatttttcatgtgatttttgcgtatgttttcctaatttaaaaaactatattaatctgcctttaacaagttattttcagttaaaagtaataatctttttggatgtagctggagggaaggaattaatacttcagagaagttagatcatgtttattttaaatagtgagtaataaaattttcattaatgtgtttaaaaataaccttcacatgtaccccataaatttgtacaaatataatacatcaaaaaaataaaaataacaactacccagacaaatttaattcaaaatttttttggccattcccttaggaaaccaactttctgtttagtgaaaaagaccactatagtatggagcctttatcactagaatgcagttgaaaatagaggccttgttttttgtttgtttgttttttgtagttaaatatgcaggtttatcgcttacgtttttgctttcagagaattcacaatggcagaaattgagcactttgtagatcccagtgagaaagaccaccccaagttccagaatgtggcagaccttcacctttatttgtattcagcaaaagcccaggtcagcggacagtccgctcggaaaatgcgcctgggagatgctgttgaacaggtaggattctggaggtaacttaacttagattgtgcctgttcagggtttgcagcaattagcaaattctatgtgttctgggtgacaagatattttattttggcagtcatttgcttttttacagtac

SEQ ID NO: 41743 - DNA, 1035 bp, Homo sapiens
tccttttgttgttgttttgtgttggagtttctgagctcatatgagttttatatttgcttgctttattacagacaccccatgtgataacatgtgcttggaaagcttagtagttttttctttttttctttttttttttttttttttgagacagagtcttactctgtcacccaggctggagtgcagtggtgcactctcagctcactgcagcctctgcctcctgggttcaagcgattctcctgcctcggcctcccaaatagctgggattacagatacatggcactgcacccagctaatttttgtattttcatgaagacaggatttctccgtgttagccaggctggtcttgaacttctgacctcaggtgatccacccgccttagcctcccaaagtgctgggattagagacacgaaccactgtgtctggccaagcttagtagttttgatggttgaatttccccaaactctttggatcaagggcaaaaaaaaaaaatgaatcttcttgagaaggactaactaggtatctaccaaaataagctctttacaaactcttgttcttattgaaataacgggttcttaagagtttgtcatagttggggtttctataagaaagcaccacatacagagtggcttataaacaatggacattgatttctcaccgttctggaggctggaattgagagatcagggtgccagcatcgtctgatccttgtgagggccccattctcagtcgcatactgccaacttcttgttgtatcctcacatggtgaaagagggcaagagagctctctggggtcccaaattccagtgattagggctccatcctcatgacctaatcacctcccaaaggcacctcctcctaataccatcacattgggagttaggatttcaatatacgaattttgtcaaggacacaagcattcaattcattgcaggttctttgaaaataatttaaattttgctttttaaaagtatcttatgtgtgtatttataagaaagggaacctggcatcaatgtgatcataatgctcttatataat

SEQ ID NO: 41744 - DNA, 1050 bp, Homo sapiens
ttaatttccataattaaattccagaatatgttagtttaccccacagactcagtataacaatataaatccatccagaaaggaagactactttgtgtacagtgtgaattatatatttttttctttctttttttttttttttttaagatagggtctcactgtgttgcccagattggtctcaaactcctggcctcaagtgatccttccacctcagcgtcccaagtacctgggattacaggcatgagccatcacacccagatcagtgtgaattatattttataggcttattagctgcctgatatatgaggctattcccatttcaaatatttatgaaatttgaatgaagattatatcatcgaattatcattgaatatatgaaaggtttataatctgcatgcatttgtgaatgaacccaatataagtaataataagtaagtaatgtttttattgattatatctttttagggttggattgagattgttggatgtgctgatcgttcctgttatgacctctcctgtcatgcacgagccaccaaagtcccacttgtagctgagaaacctctgaaagaacccatatcctttctggtcactccaaaaactcaggattcacatgtgaacatcttgctaatgaataagtccaagtctttaccttgttctatggataaatggagatgttttagacactgtagtaacgcttgtttaaacctattattttacctatccctttgttcctttcctattctctgtacttgtagtctgacgtgtgcccactcaatgtttggcctttaaaagaagcatatttagaaaaatgctctgaatatctttcagaacgttaatagtttttctcagctgtttccaaaacgcacttcacacctgcacctacctacgtgctctttaaataaagggtacctggtgaaagctttttccattaaaagatgagtgccatttgatagtagctgaaataataatttagctcacttggtctgaaaatcagcaaaatagaaattttctttctttagtaggcagtgaagttatgagctgatttcttagggg

SEQ ID NO: 41745 - DNA, 1139 bp, Homo sapiens
agttgaagatacctgtttcagaaaaatttaaaaacatttctcgtcttccagaattaacatctatttatactaaaacaatatcaaatcccattaaaatggactaagttatattactagttaaatatcattatccataaacacagtttgctttattaattattctcaaataatggctgtctccttgtcaattacaactcttttttttttgagatggagtctcactctgtcacctaggctggagtgcagtggcgtgatctcagctcactgcaacctctgcttcccaggttcaagcaattctcctgcctcagcctcccgagtagctgggactacaggtgtgcaccaccacgcctagctaattttttgtatttttagtagagacggggtttcaccttgttgaccaggctggtcttgaactcctgacctcaggtgatccacctaccttgacctcccaaagtgctgggattacaggtgtgagccacctcgcctgacccaattgcaactcttttatagctgttaactatgatacacttagactgtgctcacagagagaatgcatgtgacactgtgtatgtaatggaaccttgaatgcatgcacacacagacttcagacagaatagtaaaaacggaagaattcagtgaacaccagtcagatgaggcatgagattatcacaggtggaaactagcaaaatacagttataacatatgccaactatccagcttctgagacaaccacatgagggctctctatcctagcactgaattgcttgggagggaggagaaatccaaatggatattcaaaatgtgaggaaatacctcctaagctgaaatacaggtattacatgaagctctttataaagatgaattcttataacctgaaactgaatgggcatatctcaggacacaaatacatggcagccagtgattttgagggggataatattttatattgccatatgaaacagaaacattaaacttcttttaaactgatcttcatcaacacaaatgtccaaatttattttgaaaatagtgtgggtattggattgtaaaattacttctgtaagatggcatgctggttcatttgtacatttgttgggacagtaatgagaacccttgtgtttttaccagcaggcctatttctg

SEQ ID NO: 41746 - DNA, 1041 bp, Homo sapiens
gtaatagagataaagtgtagctgctgctattcgtagtttgctgactggtgaaggaatattctagtacctcaggtttcatttttacacagtataaacagaatttggtgaaaggttttttcactccagctttctcttcaaaggcatgtttcctatcagcaaatagtttttaggtatgttctagtttctttgttctgatatacagagataaaaatccatctagaatagagatatttttagtgctaagaatttttttcttttcttttctttttttttttttgagatgaagtctcgcccttgccttccaggctggagtgcaatggcacgatcttggttcactgcaacctccgcctcctgggttcaagcaattctcctgcctcagcctccggagtagctgggattacacgcacctgccaccatacccagttaatttttgtatttttagtagagacggggtttcaccatgttggtcaggctggtctcgaactcctgacctcagatgatccacctacctcagcctcccaaaatgctgggattacaggtgtgagccaccgcagctggtgaattgtttagagagaatctgaaatgcattatgtggtatttgagagaatgttattgaatttctatctctttttcagtggaagaagttgttccgaatgtaattgaaccttccttcggcctgggtaggatcatgtatacggtatttgaacatacattccatgtacgagaaggagatgaacagagaacagtaagttgttgtgtacagtgtgctgttatagtgtcagaaaataaaaattttctgaattacattgtgaagtacattaataagactctagaatggtcaattagttattactataatctagtgctattaacactcatctttgcttaagtatgtatagacaaaccagtttcctgtgttatcttatttgagctttaggttattctagaagctattgttttagttgcctggtgctctctattcttagactgaacctattactttggggaacaatctatattatgtcaatggaaggaatggta

SEQ ID NO: 41747 - DNA, 1032 bp, Homo sapiens
tctggggtacttttggggtaaagatgtgaattcctaggttctactctggagatgctgattcactaggtctgagacccagggatctggggtttttttaaaaaaaataagaatcctgagtgatttcactgtgaaagcttgacagatcataaatgggataatagttgtctggggtatagcctttcctagcattcaagtattgctgaagatagaagtttataagaagtcttcatcagctcccacaaattttcttttcggtctgatgcttctgaatcactgctccttgccttcttcctctttatctccttgccttacttcaccatttttacctcacctctgcctgcagaagttacactcctgggcagattactaggaaagccaaccagaagaatggctagaaaggagaggttgtatatgtcaggttaattgaaagaaacagcgtcatccacttggccattctaaagcttgagtgtacgtaatgttagacatcaaccgtgtggttctttctaggacatttaacctcaaagaatgaactagtgagttctcggcaccagtactttagtctgacacactattgtaatacatagctaataaagttagtatggtactctctgccctaaagttgcatcttcatttcccaaccttgaaggagcagccctattcattcaacagattgtaagaacctgggctaggccccaggtgcgcaaacataaggcttggttctttttgagaaatgatgacaaacataactgcatgtgttctttttagatgtcaagtctgcttcaagctttgtctgcttatttttctaataaaaaggttttagaaaatcttttagctgttcctttgaatctaacaatattaatataactagagctttaatagaaatttcgtaagggctaaacaagaataaattagtcacagtgttttatgaattgcatgaattcccatcatgaagagaaatttgattaggctgtgggaagccaaaaatgtttctaaattattagcacctagttcctcaatccatttgcctataaa

SEQ ID NO: 41748 - DNA, 1051 bp, Homo sapiens
tctacagccacagaatccacagccctgaaaggaatcctggtggtcatctggcacatccacttatttcagagctgggaaatggggagagtccattgacctgcttagagccataaaaatagaggtggtggagtcaggactcaccttctggccttggctcttggtcccatatttgttccccctatagctgtatcagatggaggtatgagtgaagatttggattcccgcaagggatttattaaactttagggatatttctttctcttgcaactcaacttgttgctttcttgtcttggtcccatttataagtctcctgagcttgtaagacagtagttagataacactgggcttaactccattgttttatttttaatttactttgtttattttggatagcggaagccctgaccaggcatggagtatctcacaaagtagacgattcctctgggtcaatcggaaggcgctatgccaggactgatgagattggcgtggcttttggtgtcaccattgactttgacacagtgaacaagaccccccacactgcaactctgagggaccgtgactcaatgcggcagataagagcagaggtatctggccttctctttggcatttttagccttagaaatgtgtactgcttcttactgatttgtgttggattttgatgtgtttatgctccctttcctttttttttctttttaattttaatgaacggcttgtatcagacagagcccagattctcaagtcccccggtttaattatgaaaatatccattagcacttctctaatattttataaacatttgtgttgctccaggcttattctccagcagtttgcttttatacttgtttgtttattgggcaagagaaatatgatcctaagaatttgttgccatagttttattggtaggctttggagggttagacattttaatgttttatttttacagacgcgtatacatgtgtatgtataagcttttccgtgttcatatattcaaaacagtgaatcatgtttcagtagttttggtcaataggaaggcagtaatggagatggtaga

SEQ ID NO: 41749 - DNA, 1026 bp, Homo sapiens
cagccaccctgggagaggggaagggtgctgaagagggtaccagaccgggtcaggacctggattatggttgtgtggaaacagagcatcactttctccgtttgtgaactaggaatagtcatctctggcttgcctaaattggactcagtaagaaaatgcaaagtcctttgtaaatcttcaagggctctataagtgagtagggccattgaactcagcctgccatggtacagatggggaaactgaggcccagagagggaaagatggttgttcagggtcacatctggcatccctggcagaaccaagactggcacctggtgcccctgtgtcacattgtgctgctgtgccctgcaagaggcatggagcagtgggggcccagggaggccaggaggaaggctgagggctctgagttttagacttccatcgctggacacccacacagactcctagggaccaaggggtggctctgttcatgaacggcttcacggtggaacctcccctttggctttaagttagaaaagatgaacacagaagagtacagagagcaacatagcaaacacctacagagcccctgccccacacgagcaaagggaaacactgggtcacgtgggcaggaacctctctcagtcctcagctcctcggtttcattgacttatatagttttcacattgattgattgtgttattgatgttccttcaaaagccatgtgtgaatggttgggtgtgaggcctcagcactcccttttgactctgaaattctaggatttcagacatgatccagcttaaaaaaaaaaaaaaaaaagggcaagctcttctgttttcttcaggaacaccacgatgacctgccatcagctgccatctgctctgcggctctggggagctcaggccctgtggacccagaggcagcccctgcactttcctgcctgtgtgcggggtctgccttggccctggaggcccccacctcagatgttgcccaccacatctggtggggaaatggttctgtgaaagcagatggaggatgggatcgcaccct

SEQ ID NO: 41750 - DNA, 1026 bp, Homo sapiens; identical to SEQ ID NO: 41749

SEQ ID NO: 41751 - DNA, 1029 bp, Homo sapiens
ctattgtgatttggatatggcccctgccttatccacctccctgccagccgcctctctgatatcagtgactcgcccatggggtgcagccctcccctgttggggccacacaggatgctggaattctggggtctcaggcccagagctgccgtagggccacctgaaccctgacgactccagcggtaccggccagcctttcactcacatacaggtatggccgtgcctctcagccctgacttggagatgctgctctctgacgcagggacattcccaagttggattttgtagctactaaagccagggagcagaagctaattcaggatggggcactgcgtggggcttgggccactcatcctgagtgtttgtgtcttctcagcttacgcttcacagtttgacctgctatgaggacctggtgacttttcttcaacaaagcattcatcaggtatgaagcatgccttactcctgtgggatgtgcgtcactaagccttctgatttcactgtgggaacaatgctgtgaactggagttgttctcctgtcgtcccaccctgggatggcgaggaagctgggaaggagtaatgctggcccctggttgggggctgaggagaatggacttggggtgagggatctggctcctgccattgcatcctcaagagctggtcctggaggcagggcacaggtagcagccacagccaggactactgacagcagagctggacgggtggggtcaggacacaggaagcagctgttagatggaggtcaccagagctttctctctgtctgagtggaagcagccgccactggaatacaggagctctttgtcagtggagtgggtcctgggaccagctggtgaggtaaccagaaagcggcttcttgggtgggttggagggcttagcagtgtgatacacaccttgattagtatccctggggtggcagggctgctctgggtgggggctctggagcccccccgcctgccagaggagagctgtacatccactcctggccatgagctgggcgggacgtggccagggccag

SEQ ID NO: 41752 - DNA, 1069 bp, Homo sapiens
taaatgtaataatagttccccaaatttacacagagttggggtttacagtgggtttctgtgtctgttacttcactgcaggtaggtaggcgttacaggcattggcggaaggggaaacagaccacagaccaagaaagtactgcagctgccccaggactgcatgtatgtccatggcagaagtaggcaagagttctagaaggagaaactgagaccaagaacactttgtgactgtccaaggggagatggaaatttgtggcagattaggtaggctttctatggaaagggacaccgagaccaagagcttcgtgacttccctaggcagcatgcagagctggtacaagggactggtgacccaagtcctcctgagcctgtgtccccctgtgcagggggagacatcagcattactctttgccattgtcagagcacttccacagacattgtctcaagaatgtgcaccataagccaaggaaataggccaggtgggtcttcattattcttattttgcaaagaggaaactgagggcagcataaatgaagtggctggcctgagatcacagaatgaagacgaggttgatttaacattgttgttgattcattcattccattcctacttccaaaaaaagactggaagttgctttgaaaagtaaatgatgtcctcagggctctgctgtgcccccgcatagtcagcttgccctctcttgcctgtggacctttgcacgtgcttctccttttggagcgacgttcacttttctgattccttactgtcccttaggtttctgttcagacatcgctttctccaaaaacccttccttgatactccctccccgaacttgaagtctgtgttgaaggcccttcctgtgtgtttttgaaggagcctgcatttctgtcatggcagaaccccttctcccagccttttcaaggtgcttattgttttttcttccctaagttatttccccaagaggagagatccatatccaccttgtttttttttttttttttttttttttttttgagacggagtctcgctctgtcgcccaggctggagtgcagtggcgcgatctcggctcactgca

SEQ ID NO: 41753 - DNA, 1069 bp, Homo sapiens; identical to SEQ ID NO: 41752

SEQ ID NO: 41754 - DNA, 1020 bp, Homo sapiens
gccattctcctgcctcagcctcccgagtagctgggactacaggcgcccgctaccacgcccggctaattttttgtatttttagtagagacggggtctcgatctcctgacctcgtgatccgcccgcctcggcctcccaaagtgctgggattacaggcgtgagccaccgcgcccggccatatccaccttgttaacaagtacagccttagccaggagcatcctcttggcacagaaatttcaccaatacaatctttttaaaaagactaattgaccaagtgaattcctggatgacaataaagagtatattttgaggaaaagaaaaggtaattttatcagaagcttgagctgcaatagttaccatagtagagcaccatatttggctctgagcttcctggcagccaaggcaaaaatgtaaacatggtaagttttataattttcattgtctgttccaggagaaacaagttgggattttttttttctaattttaagtccaaaatgtgattacacataaggaacactgactattataacaggcggtgtcttcagtcacagttcatggtttccaaagtggaatgagtgaggccttcacactgacttgaaggtggggatggtgtttctccggggagcagaagtgacatggccgatcccagtaggctgtggcccactgggcttactggacagatgggcagggcagagccagctttgttttaacagctaacacaggtgccaggccctgtttgaaatgctttataaggattaactcacgtaattttcacaacttgataagggtaggtgctgtgattattaccctctttttacagatgagaagactgaggatagaggagtccaggagtgtttccatggtcacatagcaaggagtggcagagcgaggatttaaattaggcggtcaggccccgggacaccagctccaaaccagagttgggaggaggactcactttggatgcaaaatctaagggggtgccaaaaatctcagaaattagcaaaacctatcttttttaaaaa

SEQ ID NO: 41755 - DNA, 1020 bp, Homo sapiens; identical to SEQ ID NO: 41754

SEQ ID NO: 41756 - DNA, 1065 bp, Homo sapiens
ccccaaccctgctgccttgtgagagttgggtatcaagtgaggcattgattctctggcccgccataggcactgggccaggggaaccttcttcctggctccattagctatcccctcatccccaggtctgtgttccatgtctgcgagaactttgctgacaccagctgcctgcctgttccacttcccccatcaatcccccatcatggtgggtccaccttggcagttgttcctagaaaagctgagtgggtgagtggtgagtgggaacactgcccccatacccaccaggtgacataccactgcagtgggaaacagcaggcttaggggtaagtcctgctgtctgtaggaaggccccaccgtgtcaggaaggggatacacgtgacatcgtggcatgagctcaggtcatttcaaaggctgcagtgagagcccaagctcctgataagatgcagctgtgtgcccacagcatcttgtccatcttgctcggtaggtggggctgcagggtaggccagtctggtgggcaggtagaattcccccacatcaggtcaaccctcatagaacccctgggctggacaccatggaagaaacagctgagtaagacttggctcctgctctcagagagtttgccatcagccaaaagtcaagtttggaatcaaccctgttaccagtccagggaaagatgcaccacccacccttaaacccagctctgttgccctgcaagaacccccaagccacacagctggctgtctggcagcttgcttggctctacagaaaggcctttgggcaccccctgttatcacctcttcttttacagacagggagatgggggcctccagaatggaggtccgtgtcccagccacactttgagtcacaagctccaaggactgtggcttacgcttttgctgtcccagcccattggaaggtcacttagtgggcagtgacttcccaccacctggctttgttgcctcggtgacattgcacaagcccagactgctggtttcgccttcagagaagagcatcctaattcaaaccatcccagaccccatgtgtctctgcgctttgctgtgacgcaaa

SEQ ID NO: 41757 - DNA, 1065 bp, Homo sapiens; identical to SEQ ID NO: 41756

SEQ ID NO: 41758 - DNA, 1030 bp, Homo sapiens
cctaagtggcctcaagtgggcatctttgcaagtgagcctttgctgatgtggtccatctcccctgtgtgagtgcacttagcccctgggacggccacaaagcatagtggaaggtgctggggcttcctggggaggggtcctccgggggcagctgcatggggagggccttcatgacctcacagcagcttccattcccttctctttccatgagtcatgtttctaaaagtggcccaggagtaagtggcagccagacggtggtggcggggcctatctggccaggcagagggagggtgaggctgaggccagcagtggggaggaagaagagagaaggagagacagggagggcagggccagaagcaatgggagacaggccttggaccaaggaaagagacggggtggagaaggagagagagagggtggagacaatagggaggcaggcacagaggagaaagaggggtggagggagccaggacctcaccgaaggcctcctcagccctggaatttagatgcagtcgggcatggggtggaatgttctggacttttgggtatgaagccgtgtcccctgctgggccttcccacctttttgcatctcttctcctaggagtgctcctgaccatcaccttcatgcctggggctcgccccttgcctctggtcttggtaccccagaataccctggcctggatgcagctggatgcaaaggccccagctcaccccaggcctctccagcttctaggcagagtggggcctgggtctaggcaggtattaggggctgggctggagtttcattaacacagggggtgggttcaaggcctgatttccactacctgccgtgtaggcttgcctgggaccctgtgatgggctctgaaggcccatctgagggtccgcccttcatgcctgggcctgggaggcctgggtatccttggggtcctgggacacagtccctgcctaccctcctcaccagtcctcaccacctctctcccctgcagctggctgatggtgtgaactcgggccagggcctgggcatcgagatcat

SEQ ID NO: 41759 - DNA, 1028 bp, Homo sapiens
ccatgtgacctggccttagcgttcttcttttccagcctaaggcttaggctgatgtcctagaaggggcgagtttccaggctccactccagcactgagtcctgcctgctgcagtcccctgtcttctctgagaggcaaaaggcaaatttgctaatttgctgtcaaacctcgaattccaataactgactctgtcctggagggggaggggcttgcaggaggtggcagagaaaacagtggcctgtgttgggggtcccaggtccccccgtctctggctcccaccccaaggtttgtctaagatgcactgcactctgcagcaacacctccacctccagaccaccggccggcccgggaggagggtggcattgaactctcccatctgagggcctggggattgggtgtgacctgagcagtccagagtgaattttgaaaggggatacaggcagcggaagtgctggagtgagagatacagtgggactggggggcagtcaggcatggtggcagccagtgagtgattcagcctgatttccaattcattcctgtagaagccaacttaatcacttcctccattcatgtatttctttcgttccgtcatttatttaaagtttgtttattgaacatctactctgggtcagattccatgccagactccgtcttctcaacaacgaaaggcaaaatgaatcaatggtaaaataagattttcttaagacacactttcctccacactccctccttcctctggcagtggcacaatgaaggtgttatttacacctgattcttaatggttcattaaggcagggccttttagcacctctgttcacaaaacttgattggtgagacttgccttgaatactttgcaaggagagaatgggattcctgtgtttcttctcagttcccaggtagcctgttgtgatgactgtggctgtgtaggatattggagagactggagatgtgggagcacggatctccctcctcctctcaaatgcctctgcttgtttctgttctggaggtctccagtgtccccagcttatagt

SEQ ID NO: 41760 - DNA, 1029 bp, Homo sapiens
catgcagttcattattgtaattctatgaagatgtatatttttctaatttttttcctgtacatacatatgataaagtttagtttataagctaggcacaagagattaacaaaaaaatttttttaatttttaatttaaaatgtttcgactttttaattttaaaaattttaaactttttaaacaaatttttttaaacatttagaaatcagtcataagagattaacaaaaataactagtagtaaaatagaatatttataacagtatgccaacatcactactcttgggctttggggtcattattaagtaaaataagaattactcaaacacaagcatcttgatactgctgcagtcaatccgataactaagatggctgttcagtgactaatgagagggtagcctgtacagcgaggataagctggttgatgggatgattcacaagtcaagtggaatggagagggacagtgtaagatttcatcatgctcctcagaatggcacacaatttaagacttatgaattgtttattactgaaactttccatttaaaattttcagaatgtggttgaccatgactaactggagccattgaaaatgaaactgggcaaggtgcagtggctcacacctgtaatcccagcacttcgggaggccaaacgggaggattacctgaggccacaagtttgagaccagcctggacaacatagaccctgtctctatttaaaaaaaaaaaaagaaagtgaaactgcaggtcagggggactattgtaatgaagaaaataccaatccttcacaaactctgtcggaaaacagaagaggagggaacatttctcaacttattttatgaggccagcattacattaataccaaagccagacaaattattataagaaaaaaacaaagatcaatatccctcatgaacattgatgcaaaaatccttaactagatagttgcaaaaaaaatccagtaatatataaaaggaataatacatcataaccaaatggggtttgtcacaggttggtttcatatttgaaaatatcctt

SEQ ID NO: 41761 - DNA, 1076 bp, Homo sapiens
gtaaggacaaaattttttattttaaatgctactgaatgaaagagcttgtttgtattgatgcacgacccacagctcactattgaacaatccctgatgagtatatgtgatccaaaggcataggaggttattcctgagataacaaccagcctagtagactagataaatgccactgtaaggtctgttgtaaggtctatttgccctgaaaaggagacttcctaactcttcctgtaaaacaccaactggagcaccccagatgaagcagttgatacgcttcttatgcaagccatgtaggactacctttttgaggactgggatattctcccactgaatatgcctataacccaggtcatggcaaattttgggctgagaggggcaccttttacatgggtacccctcccacagaatcatatgactgtttgagaagctttatcaaatttgctgtccctcatgggtgtacagatggttaataatacataggggtaattgggctgtgtccccacccaaatctcaacttgaattgtatctccccgaattcacatgtgttgtgggagggacccaggaggaagtaactgaatcatggggtccagtctttcccatgctattctcgtgatagtgaataagtcacacgagatctgatgggtttatcaagggtttctgcttttgctccttccttattttctcttcccgccgacatgtaataattgcctttagcctcccatcatgattctgaggcctccccagccatgtggaactttagtccaattaaatttttttttcttcccagtctcgggtatgtctttatcagcagcacgaaaacagactaatacagtaaactggtactggtagagtggggcactgctgaaaatatacttgaaaatgtggaagcgactttggaactgggtaacaggcagaggttggaacagtttggaggactcagaagaagacaggaaaatgtgggaaagtttggaacttcctagagacttgttgaatggctttgcccaaaatactgataacgatatggacagtaaggtccaggctgaggtggtctcagattgagatgaggaacttgttgggaa

SEQ ID NO: 41762 - DNA, 1072 bp, Homo sapiens
tgtgtcccagctgctgcttcagctgtggctgaaaggggccaatgtacagctcaggttgtggcctcagagggtggaagccccaagctttggcagcgtccacatggtgttgagcctgcaggtgcacagaagtcaaagaattgaggtttgggaacctctacctagatttcagatgtatggaaatgtctagatgcccaggcaaaagtttgctatggggtggggccctcatagagaacctctgctagggcagtgtggaagggaaatgtggggttggagcccccacacagagtccctactggggcactgcctagtagagctgtgagaagagggccattgtcttctagaccccagaatggtagatccactgacagcttgcaccatgtgcctggaaaagctgcagacactcaacgccagcccatgaaagcatccgggagggaggctgtaccctgccaagccacaggggcagagctacccaagaccatgggaactcacctcttgcatcagtgtgacctggatttgagacctggaatcaaaggagatcattttggagctttaacatttgactgccccactgaattctggacttgcatgggacccgtaaccccattgttttggccaatttctctcatttggaatggctgtatttacccaatacctgcacacccattgtatctaggaagtaactagcttgcttttgattttacaggcccataggcggaagagacttgccttgtctcagatgaaactttggtctgtggacttttaggttaatgctgaaatgagttaagactttgggagactgttgggaaggcacgattggttttgaaatgggaggacatgaaatttggagggcgcaggggtgtgatatggtttgggtgtgtcctcacccaaatctcaactcgaattatatctcccagaattcacatgtgttgtgggagagacccagggggaggtaattgaatcatggcagccagtcttttccgtgctattctcgtgatagtgaataagtctcacaagctctgatgggtttatcaggagtttctgcttttgctgcttcctcattttctcttgccac

SEQ ID NO: 41763 - DNA, 1053 bp, Homo sapiens
catgctactgcactcctccctgggcggctgagcgagactccatcttgtgggagggagaaatacacacacacacacacacacacacacacagagagaaaagaaaatgggtattatatctaactgagggatgtttcccctatctagtgctataaaactgaaggcatgtaaatctgctctttgagaaatgttaattggacacactaaatgggaactagtaagattgcctgagcccacaaaatatgggttagaagctgcagtgctagttgggacaaatcctccacttcatagccttttgtggagcatttactggggcttatggcaaaagactgtgagtacttcccagtgataactactggactagagaatttccacttgaggggcatgtactgtcttgctatggaatgttaactgaagccacccctatgctaatggaaataatggtgcccaagagttccatggtaaaataaaagtggtttacatagatcttgctacctggatgttcaaggaggacaatactcatgagcagggagcttccttttaccctaggactgtttctaactgtatgacgggctgctagattccacagtgcctgatggttctcatgagctgtttggctcgtgaatggcagttcaaaggtaaacaaacaccttgtttggaaggctgctgctctggctaacgaagggtcaaaaaaatttatttttcctttatttccagtttagaacatttgggtgaagtatatttttgtaagcaaaattacatttctgagttctccaaaattcagattgtgattttatgacagtatagttgtttgcataagtttagtaagagtcttttagaacaaaacagttggagacactggttattttaccaagactttcactagaatagcatatttttaggtaaagttccaacaaagccaacttaagagcctatatagtcaatgaattcttgctgcactttatgtaaatcatcaggcaaagtataataagcttagaacttattttgcacacaaattggtcttactacaatttctctttaatagaaaaggagggc

SEQ ID NO: 41764 - DNA, 1018 bp, Homo sapiens
ggcttgagcttgggaggtagagattacagtgagctgagatcgtgccactacactccagcctgcaaacagagccactgtctcaaaaaataacaattaaaaaagcaataattatttccttcaatttgtttgggcctattacaggccacacacatggctactcctgtggccaaatacatgtttgccctgattggcttaaacttgggttcctgaccactccctaatacaaagggatgggtttgccatgattggcttagtcccaaggccaaatctgacctactacctattgttatacataaaattttattggaaatcagacccatttatttacttgctgtttatggctgctttcacactgtagtggcagagttgagtagttgtgacagaccatatggcccgcaaagcaaaaatatttatctgaccttttagagaaaaagttcaccagcctttggtttagactaatcaggagccatccttggatctgggccagttttatacaccgtattactgtgcctagtggagtcggggttgaaagaatgttggggagtcgaccatgcacaatatccactttagttcattaccttaaaaatattcctttgacccagtaattctcctgttagagatctattttccaaaattaatctgaattggacacaaagctctaagagagtctatcacagaataataaattataagtgagtaactattagtttatcttgtatgttgtatagaatttcagacaataaaaaagatactaagatgtttttattgttttaaagattttcatggcatgttaagtgagaaaagtttgtctacaacaagtcaagcctatgatcccattttataaatgaatatatattaattgaaaagggactggaagtaaagatatcaacctagtttggtgagaacataggttattttttttaaagggaatatttttctgtatcctatttttctataagaaatatatattccttcaggctgggcacagtggctcacgcctgtaatctcagcactttgg

SEQ ID NO: 41765 - DNA, 1264 bp, Homo sapiens
caagtagctattgttcataagagcataacatgagtggtcaaatagcctttaatgatgcagcaaggatggggtagatgaattgggctatagaaatataccaatacatggagattatttccagagacatcgtgtggacttctataatgtatctttgagtccggaagtgaaaatgtaaaatgacttaatctaagacaactagtggtgctgggttgcttttggcctcctgattttcttgagcttttttgggtgtggcttgctcatgagtatttcagtagtctgattgtaactcaggtgccttgttacttgtgcaacatgttttcttatattgaaggagtgtgggttatctcttaaaactgaatatgttgaataagacctgtatttctaggacgatttctcttaatttttaagcagatgtgaagttttatgctgttaggttgtcttcatcaattaaccattatggaattggtctcagttatctcttcttaccaatatcaagtgccaaaatgtttgaatttgggatactctaattaatctacttcctattcctgaatgttattttgtgccattgaaggcttttatggggagtggccaaagaggaatgtttgcctctttctaagaaaaatgagccttctaaccacaacccctgccactcctgaagtaataagaattttggtggttattgtttctcacttgtaatttcataccttcgtgttatatgttttgctgtgtgtaagtgtggcctgtgtcatggacgtttctgctttggggattttttggaactattcttgactgcaaggtggggaggattggtgagttgcacagggcatcacctgatctgagagcagcgtgacctaagaacctggtattttgatgctttgctggctggtgcagtgcctgagggagtaagagccctgttgttgtcagatagtgtcttactccctcaggcacatctccagcgagtctcttgctctcctccaatttgattgctttgcctggtgaccagtaagtaagttcttttgattaccaaatatcattaattagatatcaacttttaaactatttattattatttgggtttgtaaggagaattgccctaatattaaacttattacatgtactaagtattatgtacaattgggtatactggcaaatgtgttaaaagagagtgtaggaactgctttatgtagcagattacttcctaagttttaccttatgtgaatattcttaagaactattgtttatttgaaatgttagtctgtgtttt

SEQ ID NO: 41766 - DNA, 1102 bp, Homo sapiens
ggttggagtatagtcatgtgatcctagctcactgcagccttaaactcctgggctcaagtgatcctcctgcctcagcctcttgagtagttgggattacaggtgcatgccaccatgcccagatagggacttttaaaaatgtgatcttataactcttttgtcagtttttatttgtttctgtaattttaatttttaacttaatttttaatgttttttaaaatttctgaggtctttaaaaaaataatgtttttttcatatattccatttttgttttgtgggtacaatatctttttctaagaatattactgatgcgtatttacatgtgcatctgtttgtgtataagtctatatatgtatgtgtatgtatatatatgtatgtgtatgctttgttccctttcctgatgactcagtttcttcccacttgctttttctgtttgtttggcttcattcttttgttagatattttctttaaatgtttggtgatctttggcctactcctgatacttttaaagtggggggcactaaaaagcaaattggaagctctctgtgcatgtaatgtcctctgtctgggccattttcttaggaatattactgtcttttctcttgggctggtcatattttccagaaatggcttttcttgcctggaagacacaatcgtttctgctagtggtctaggagcagagtaagaataagattgagagtcttaatactcaaagtgatactttcatttaatctccatatttagtatcaatacaggacctctgccttcagctattcctgttgtctgcaagtctagaaacttttccctctcctaataacaaatttgtagtagagtgccagggttggggttgcttagctgctgcaagtcagggaggacaactgggagatctcacggcttccacacagactggcgatgaatctttctcttttaggcctgccttcacccctgcttccagagatatcttgtgcttgccaattcttgtgcctgctgtaaagcagtttgcttctctgctttcctagttctgcagtgaaaattattactcattaattttctttccagagtctaaaggtactgctttttatttcatcttcttgaattttttata

SEQ ID NO: 41767 - DNA, 1117 bp, Homo sapiens
aaaataatagagaaagctgtattagtcttttttacattgctataaagaaatacccgaggactgggtagtttagaaagaaaagaggtttatttttgctcatggttctgcagaccgtacaagaagcatgcatggtaccagcatctgcttctggtgaagaccttaggaagcttataatcatggtggaaggcgaagggggagcaaacaagagagagaaagtttccagtggggagggggcaggtcaagacagagggagcaagagagagacgagtgaggtcccagattctcttaacaatcagatctcacataaacttacagagggagaactcccttattactgtggggtgggaaccacgtcattcatgaggattccacccccatgacccaaacacctcccactagatcccagctgcaacactagagatcacttttcaacatgagatttggagggaacaaatatctaactatatgaaaagccaagggaaaaaaggagctggttcttcaaaaaggtcaataaagttgacaaacctctagcaagactgacaaaaaaagagaagacacgaattatccatatccatgtcaatgaaacaggggctatcactgcagactctgcatacatcaaaaagataataagggaatactgtaaacaactctacacacttaaatttatcaatttagatggaatataccaattccttgaaaaactcaaactattgccataaataaaatcaatataaaatagatcatttaaatatttctataactattaagaacttgaattcaaatgtagaaattcttcaaaaagaaatctctagacccaggtattttcactagagacttctgctagaggtttaagcaatcattaacatcaattctatacaatctcttctggaaaagagaagaggaaacacttcccaattctttacctcaaactattattaccttgatactaaaaccaacaaagtaccaacagtatcaaaacaaagtaaacttcagactaatatcccttgcgaatataaacacaaaattcctaaacaaaattgcaaaaatagatttcaataatatattaattatataccatgaccaaatgaggttttcttccagggatgcaaggctgttt

SEQ ID NO: 41768 - DNA, 1028 bp, Homo sapiens
aaaaaaaaaaaaaaaaagaaaatgcaaactaaaccataatgacaaaaagaatattagtggtttcctagggatgggatgtgggcaaagagagacaaaggaaggagggattaccaaggagcacagggaaacttcgggatgagggatatgctcattatcttgactggtgatggttttgcaggtgggccaaaactaatcaaactttacacttcatctatatgaccagctatcatatgtcaattatccctcaataaagctgttttaaaaacatttagggtatatctactggaaagtaaaactgcttttaattacagactatatcatcatgtacatagaaaaatccaaaggattctgcaaaaaagctactagaaccactgacttcatcaagatgcaggtacaaagttaatattcaaaatcaactatatttctatacgagagcaacaaaaaatggaaaaatgaaaaatttttaaataataccatttataatagactactggggcagactgtacattaaaaaaatacaaaacattgctgagactaattaaaaataatcaacaaaatggagatctataccatgatcgtggattagaaaattcaatattattaagatgtcaattcttcccaaatacatgtacaaatccaacataatcccaaccaaaatcccaggatttttttgagaaattaataagctgaccctaacatttagatagaaatgcaattttaaaaaggaaaaacaaagttggagaactacctactttcaagatttattgtaaagttacagtaatcaagacagtgtggtattgacataattatagatcaagagaataatagagtccagaaacagattcatatttaatgtgatcaatcaattttcagtgaatgtacggagacaattaattcaatgggggaaaagacagttaccacaatggagcatttctgaaaatgttttgtaactcaattgtggtgatggatatatagcttcatatatttgtcaaaactcagagaatggtacactcaaaattggcacattt

SEQ ID NO: 41769 - DNA, 1026 bp, Homo sapiens
gagatgtggggagcgcctctgcccggccgcaaccccgtctgggaactgaggagtgtctctgcccgaccgccaccccgtctgggaggtgaggaacgtttctgcccagccgcccgtctgagaagtgaggagcccctccgcctggcagccgccccatctgggaagtgaggagcccctccgcccggcagccgccccgtccgggaggtggggggcagcccccacccggccagccaccccgcacgggagggaggtggggccagcccctgcctggccagccgccccattcgggaggtggggggcagcccctgcccggcagccatcccgtccgggaggtggggggcgcctctgcccggctgccccatctgggaagtgaggagcccctctgcccggcagccaccccgtctgggaggtgtgcccaacagctcattgagaacgggccatgatgacgatggcggttttgtcgaatagaaaggggggaaatgtggggaaaagaaagagaaatcagattgttgcggcgtctgtgtagaaagaagtagatataggagactccattttgttctgtactaagaaaaattcttctgccttgggatgctgttaatctataaccttacccccaaccccgtgctctctgaaacatgtgctgtgtccactcagggttaaatggattaagggcggtgcaagatgtgctttgttaaacagatgcttgaaggcagcatgctcgttaagagtcatcaccactccctaatctcaagtacccagggacacaaacactgcggaaggctgcagggtcctctgcctaggaaaaccagagacccttgttcacatgtttatctgctgaccttccctccactattgtcctatgaccctgccaaatccccctctccaaaaaacacccaagaatgatcaataaatactaaaaaaaaaaaaaaaaaaaaacaaccatagtcttttaggctaagtgttggaagatagtaatagatttccggctgtgtgactaaataaatcttactttactaacgtaagtccaag

SEQ ID NO: 41770 - DNA, 1034 bp, Homo sapiens
ctatatagggaacactggagatattgctgctctaaccccaaagaactcatcaccaaagcttgggactttgggcccatggtaggcaactggaagagctatttgtggcaaacagtgtaactcaaacatcatcataactatctgacagactttaaggaggccaatccaatgttctcaagcctggctgcatcatgaatcactcaaggaatttattttttatccagatttctgaacccccaacctcgattctgacttactgggttctgagtagaacatggaaatctgtatttacagcaactcacccaggtgatttatccaggtggctctggtgcaactcttcaatgggatggtaattaggagcatcccagggggtcagagctcacgtacctcatggccaggaactgtgtaggcctcctttgcttacatctaaatgttttcccctggtccaactggaatacgaatgttacctcctaagagtccaactttatcacttcttctaaccatctagatatctgctggtaaactcaagacatctctaattcttcctctttccactagagattaaatgcatttttttcacataaagatagactttaatctaatgtggttatgtatgcatataaatgtccaaatgagagccaagttgggaaatatggccatgtgttgatgtgatgtcttggaacaaggaaggacacctctgcagaggtgttttgagggctataccaacatgctgatgtgatcccttatcaaagcactctagagcagccattcttaaatattttggcctcaaaaagaccaaacaagtcctttatgattgcttaagtgtattgtatgcattgatatttacatggatatttataatccattcatgttaaaactttaaaatgaaaaaatatttgtttataaatcatttacaaataacaataataaactcactatattaacagaaatatcttttatatgaaaataactattttcaacaaaaatttagtgagaaaagtgacattgttttaactttatgcaaatctctttaagtt

SEQ ID NO: 41771 - DNA, 1016 bp, Homo sapiens
cagcaataaaataccaattacaagatattccaaatttgaatatgaactccttctcatcatgaattttctgaaattaaaattaaaagattaagttcaatgattaatgtacaaagatattaaaccccaaaggagttaaagtccaaaatcatattctcttcaccttgtaattaaaagtttaaagaaaattaatgcccaaaatatatcccaatttcttattcaacctctttgttatatttctcaatgttcctaggctatgcgcaaaatgttggagttgagatgtccaaatataacttcttttttcctcatgagcatcttgaacaaattataaaattaaacaaagagaacagagaagagactaaaacaacacccttattactaacaaatgtggcttgtgcctacaggcaagaaagcctgctaacaatgaactctagaactggtcttccccactgtggcataaacagctactgttcacccatgtgtgtgtttggcccctcttccgggcacaactacactatatctttctcagcctcccttctggttaactctgttcatgtgattgaattttggccaatggaatgtggaaaaaattctgtgcaccctcctaacatggtcaataagaatttcccaaatgtgtttcatgctttcacaccctcccctcatttgcaagctgaataaagaggactctcagggcttaaaagagggcaaagccaccagatggaagaacactaggtctcagcatttgtgcatggaatagagcctgtttctttaccatcaatcctcattgaacactgacataagtgagaaacaaacatttatttttgttacgctacggaatgtttggaagttgtttgtttcactggctagcctatcctgcctgaaacaccccgaaaatccctggaagccctgatgcaggacaggttttcctgtggcaggaagtgaactgctcaggtgatccagagatgcagaagaaacttctgaccctatggacagctccccccatgaaaaagagagtaagg

SEQ ID NO: 41772 - DNA, 1030 bp, Homo sapiens
tgactttactccagttcctaataacttcatttccatctgagacctcatcagcctggacttcaatatctctatcagcattttggtcacaaccatttagccagtctacaagttgcaaacttttcttcatcttcctgtcttcttctgaaacttcgaaattcttccaatctctgcccattacccagttccaatgctggatccacatttttaggtatctttatagcaatgcccctctcctcagtacttattttgtattatgccattcttgcattgctataaaaaagtacctgaggctggctaatttatagagaaaaaaaggtttaattggctcatgattctgcaggctttacatgaagcatggtgctggcacccgcttctggggagccctcagggagcttacaccatggtgaaaggtgaagggggagccaatgtgtcacatggtcagagcaggagcaagagagagacagaggtatcacactcttttaaacaaccagatctcacatgaactaccagagcaagaactcactcttcaccaagtggatagggctaagccattcatgagggagccacctcctaccaggctgcccttccaacattgggggttacatttcaacatgagatttggaggggacaaacatccaaaccataacagagatgaatgccaagacagctggactaggtggggcaagccaggaacaggcttcagaaacagcctaggcaggaggcaggaagacaagacggcaggaagcagtgcagaacaaagcaggctcctcatcattcaacctcccctgagtgcagcaaaggggccttattgtcagcccctaactgatcattgataactaaagttacaacaactcatacctgtaagggccatggtgagttagagctggcaagagccctaatgatacacagtcttctcttgaaagaggagaagactgaggcccagagaagtgagtaaatttcccaacaagcagagagttgagactggaatctggcttcccaccccagcccagtgctcttggaaccagaggac

SEQ ID NO: 41773 - DNA, 1174 bp, Homo sapiens
agaaaatggcactttcgatttttccatcctacaagatctaaataatccttgtcgtaaaatgggcaaacagtctgagatgcctgacgtccaggcattcttttacacatcggtccctccctagtctctgttcccaatgcaacttgtcccaaatcttccttctttccctcccacctgtcccctcagtcccaaccccaagcgtcgctgagtctttcttctttccaatcttccttttctatagacccatctgacctctcccctcctccccaggctgctcctcgccaggctgagctaggtcccaattcttcctcagcctccgctcccctaccctataatccttttatcacctcccctcctcacacccggtcgggcttacagtttccttctgcaacaagccctcccgcacctgcccagcaatttcctcttaaaaaggtggctggagctaaaggcatagtcaaagttaatgctccttcttctttatcccaaatcagagagcgttaggctctttttcaccaaataaaaaacccagcccagttcatggctgcttggcagcaaccctgagacgctttacagccctagaccctaaaaggtcaaaaggctgtcttattctcaatatacattttattacccaatttgctcccgacattaaataaaactccaaaaattaaattccagctctcaaaccccataacaggacttaactaacctcgccttcaaggtgtacaataataaagtggaggcagccaagtagcaatgtatttctgagttgcaattccttgcctccactgtgagacaaatcccagccatatctccagcacacaagaacttccaaatgcctggaccacagctgccaggggttcctccagaatctcctccccaagccctggaaatctggccactgggccaaggaatgcccatggcccaggattcttcctaagctgtgtcccatctgttcaggaccccactgaaaatcggactgttcaactcccctggcagccacttccagagcccctggaactctggcccaaggctctctgacaccttcccagaccttcttggcttagcagctgaagactgacactgcccgatcgcctcagaagcctataggaccttcacagatgctctgggtaaccctcacagtggagggtaagtctgtccccttcttaatcaatacaga

SEQ ID NO: 41774 - DNA, 1027 bp, Homo sapiens
agctctttgctaacacataacaaaagtgacattttctccagttgccaatatattcttcatctctgtctgagacctgggcctcattgtccatatgagtattttggtcacaaccattcagtaagtctctaggaagttcaaactttccctcatctttgtcctcttctgagctctctgtactcctccaacctctgcttattacccgattccaaggttgattccacattttcaggtatctttatagcaatgcaccactccaagtaccaattttctgtattagtctgttcttgcattgctataaagaaatacccaagactgggtaatttataagaaggtttaacggctcatagttctgcaggctgtacaagcagcatagtggcttctacttctgggcaggcctcaggaaacttataatcatggcagaaggcaaaggaaaagcaggcatgtcttacatggcaagagcaggaggaagagagtcgggaggtgccacacactttaaaaaaaaaaaaacagatcatgaccactctcccactataaaaccagtactaatgaggcatggtgctaaaccactcatgagaactctgccaccatgatccaatcacctcccaccaggccctacctccaacactgggaattacaatccgacatgattttgggtggggacacagagccaaaccgtatcaatggccatgctcatgttccagtttctgtggttgtaggcaatgcttggtgttccctggtgtgcagctacataactctaatttctgcctccatcatcacacagcaacttttcaaaaaaaaaaaaagaaaaaaaaagaaagaaaaagaaaagaaaaaagtagtaaggaagatagagttgtactcatgtaaggctcaggttttgtcagttataagttaatgacaacagggcaaaaggagtttaagatattgccatgatagtggcagaagtattaagatgacagatctgagctggatggagaggtaagtgaaaaggttactaatggaactactaatgagaattaaaaaactg

SEQ ID NO: 41775 - DNA, 1084 bp, Homo sapiens
agcagcattccccacccagccacagaggtactatcccttgtgttttgctgtgttctgtacacacctttgcacacacccactttgttattactttaaaaaaaccatcaaatttaccattgtaactgttttgaactgtataatagtgttagctatattcacactgttgtgcaatatatctctagaatttttccatcttgcaaaattgaaactttgtgcccactgaacaacttctctgcatttttccttcttccttgtccgctgataacaacattccactttctgtttctatgagtttaactactttagatacctcatataattcgtggaatcatgcagtatttgtctttctgtgactggcttatttcattttacgtaatctcctcaaggttcatccatattgtagcatgtgataggatttccttcctttttaaggcggaataatatttcattgtgtgtgtataccacatattttttatccatttatttgtctatggacatttagattgcttctagcttttggctattgtaaatcgtgctgagttgaacatgtgtgtgcaaatatctgagttgttgttttgtttttgttttagtttagacagagtggtttttttgttttgttttgttttttgagacagagtttcgctcttattgcctgggctggagtacagtagtgcgatctcagctcatcgcaacctccgcctcccaggttcaagtgattctcctgcctcagcctcctgagtagctgggattacaggcacccagcactatgcccagctgatttttgtatttttagtagagacagggtttctccgtgttggtcaggctggtttctaactcccgacctcaggtgatccacccacctcagcctcccaaagtgttgggattacaggcgtgagccaccgcgcccagcttagacagagtcttttgttctgttgcccagggtcgagtgcagtggcatgatcacagcttactgcagccttgacctcctgagctcaagtgatcctctcacttcaacctcccgagtacctgggactacagtacctttgcaccaccacacatggctaatttttgtgtttttgtaaag

SEQ ID NO: 41776 - DNA, 1065 bp, Homo sapiens
aggggtcctgatctagacccccagacagggttcttggatctcaaacaagaaagaattcagggcaagttcatagagtaaagtgacagcaagtttattaacaaagtaaaggaataaaagaatggctactccattggcagagcagccctgagggctgctgattggctattttatgattatttattgattaaatgctaaacaagggatggattatttatgagttttccaggaaaagggtgggcaatttccccagaactgaggtttcctcccctctttagaccatacaatgtaattccctgatgttgccatggcatttgtaaattgacatggcactagtgggagtgtcttttagcatgctaatgcattataattagtgataatgagtagtgaggacaaccagaggtcactttggtcgccatcttggttttggtgggttttggctggcttctttactacatactgttttatcagtaaggtctttgtgactgtaccttgtgccaacctcctgtcttatcctgtgacttggaatgtctaaccttctgggaatgcagcccagtaggtctcagcctcattttacccagtccctattcacggtggagtcgctttggttccgatgcttctgacaaagctatgaatgaacatctttttacataaatctttatctacatttctgattatttccttaggatagagtggagaggttgagttattaagtcagacacttgtaaaatatttttttccaatatgaaagtagctttagtccttaaatactgtataaattgcaaaaagttcagaacttaggtagaagaaagtaagactccaagacttgtacatttcataagaaagcccactttctaagcctgatgtctttaatgtatatttagtgtgcacctttccagtagtgagtgggtgattcttttaattggaaagcttccctggagttgatgttatttaaaaaagaaacctaaaaatccttgttttctactttcctctatttcatatggcatcttatggaattattgtttggtattcatgtcatgtctcaataaaggaattaaacaaaactaa

SEQ ID NO: 41777 - DNA, 1625 bp, Homo sapiens
attctttaataatttttcttttggatacaggagaagaaaggaatgctaaagtacacgggttcttctgtatgatgttgtctgtcttgtctttcttagggagtcatcctgtaagaaaatatcaatattggggtgggggaagggagagagagaatacgaatgtgaatatgtgtgtgtgttggggtgagggtgtgcagacagagacagctcattccccattcccagattctgacacactcacaatattcttctttagagagttcaatagttagcatgttaaggaaattgctattttgaggaaagttaacttaaaatagtcagaaaatcatttgaacagccaacagttcccacagacctaagttccgagagacttctcatattttttaaagtcttaaaacccccccatttttggcaaaaaagatgaatttctgagtgtatatgtatgtgtgtgtgtgtgcatgcagtctttctcatgttaaattttatccatttttctctgaaagaattttttcccttgatttttaagtttttcaattttaagtttggtctataaggaatagaataacccagtaatatcaattacttaacatttagtgaatgcttgctaggtactaggcagtatgtattttaattatatttaatccttattgcagtatcatgtaatattctcttcttaccattactttacagttgaggaaactgatagagctcccaggggtctgggataaggatgcagcaaacttgtcctcaagttgtggctctgccatcagttctgatgaacatgtcatcttcatcaccagtgtctctctgcacccagtccctcccctcccaacaccttccacccacctctttttaaatccatgtctcgatgcatggtgttccatctgcttttgcttctctaattgcttgggaaactctttctcaacctgcaagacccagtgttctgaagcttttaatcatccttccatagccttttaaattactttaatatatctctgttcttacattgttgtactatttaattaactcccatgttcacccaactttctgagagtagcgactgtgtctctcctagcacatactaggtgtacaatgaatgtgcatggaatttgttgaatgaatatgagttatggaaaatgttatcaaaactttcatgatcgttccatctgacaaaataattcacccaatattttgtggatgcaagcaataatataatgtttagggccttcttttaaactctaaaattgcattcatattgaacctatcacatataatgctaatttaatcaatggttgtaattttcttatattatgttattaaccttgttcacagtttaggggaaaagattgtgataaatagcttgacagaacacctagtaatggtctttgtgaggcaattaaaatttgctattaaaattagacacattaaaatgtcaaaagacaagttcataggagaagttaatatgtagacttaaattttattttcttgtatcttaaagcaattagtctcatgaggctatttattggagtaacacttgaattatagttgagaatttgtgtaactttccctggtacatcatttaaaatattagctattcagctcaacatatgcattctatttattcattt

SEQ ID NO: 41778 - DNA, 1056 bp, Homo sapiens
tgaatgaatgcatgatgaagagattaatgaaagaatgatctgaaaacaagtgactcacttagaagagggttcaaagtcatgttacttcacagcctgaataccttgcctgtggaaaattaaaagaacatttagtttggctacttaaaaatgtttttttttttccccctgagacaaggcctccctctgttgctcaggctggagtgcagtggtgtgcccatagctcactgcaacctctgcctcccaggctcaagtgatcctcccacctcagccccccaggtagctgggaccataggtgtgtgccaccacacctggctacttttgaatttttggtggagatggggtttcaccatgttggccaggctggtcttgaactcctgagctcaagcaatctgcccaccttggcctcccaaagtgctgggattacaggcatgacccaccgcacaccatctatttgtggaacatttatttctttgtttaggtcaaactttttactgtttttattatgtcaggtgaatatcccatgaagagtcttagatccatatataattaaggtgataattgcaatttgaacttattgtatgcataaataatatttgctatgctgataagtatgcctatactgttactttaaattatagaaaaaagttggccgggcacaggggctcatacttgctctcccagcactttgggaagccaaggcaggtggatcacgagatcaggacttcgagaccagcctgaccaagatggtgaaaccctgtctctactaaaaatacaaaaattagccaggcgcggtggcaggtgcctgtaatcccaggtgctcgggagtctgaggcaggagaatcgcttgaacctgggcggcagaggttgcagtcagctgagatcatgccactgcactccagcctgggcaacagagtgagactccgtctcaaaaaaaaaaaaaaaattgtagaaaaagtttcaaaagaaattattagcgttgacctcattttataccaacagtcatgagttcaagtgtttttatgtacaaaatttctcataccactttcaaaaaagcag

SEQ ID NO: 41779 - DNA, 1022 bp, Homo sapiens
agttgccattgcaaatcttctgtgtctgttttttttaactgaaagaagcaaaattaatgagctttatagagaagaaataaaacaacttttactctacatgtcttcccatttgtttattccagttctctttctgtgaacaaatataggtatatttaaaatagctttaatttttcttattacaaaagaaatgtgaaatttagaaaatgtggataaccaaaaggaaaaaagtgaatgttactagtaattctactatccagcaatacctttttctgtttcattacatttttctaatctttaaataaatattttttctaagcatttatccccaaaaagaatttcacttgtcattctgttttgagacatctttttacaccattagatatttttgatatatgattttaatgattacatagtattctctcataaatccatactataaaatcatttgaccagcattatacttttagatatttacgttgtttttagtttattaatattgtaaatatacctgtgatgaacactgttgtaacaatacttcttcaaatttattatagtttatttgatgaatatttaaaagtggaattgctgggtgagacagagaatcagaatgtttttaaaacttctgaaatatagtgtgaaattgacttccttaaggaataccagttaaccctaacaacaatgtttgaataaaggcgtccagtaccccaaaccttgccaatagagaatcttataagaaaaaccttttaatatgcttaataattatatagaaaacatttatttacatatataaatagctatctggggtgcttctggcaccccagaaaagtgaattaagcaataaataccttttttttttttttgagacagggtctcattctgtcactgaggttggagtgcggtggcacaatcatggcttactgcagcctctacttcctgggctcaagcaatcctcccaccttagcctctagagtagctgagactacaggcatataccaccatgcctagctaattaaaaaaaaatt

SEQ ID NO: 41780 - DNA, 1121 bp, Homo sapiens
aatttcttaatggttcataaatttactgttacatctaagagatatttcctaatccaaggttgcaaagtttctctctctttttttttgatagaagttttctagttttaaactttacatttaagtctcttccccattttgtgctgatatttatgtgtgatgtgagggatggatgaaattcatgtttttgcatctgggtgtctaattgttacagcactatttttcagactatccttttccactgaattgccttttcaactttgttgaaaatcatctgaccacatttatgtgggtgtatttctgctttcttaattttgttccattgatatttttgtctattgctatataccaataacattgtgttttgatgactgtatatttataataagtcttgaagtcaggtagtataatttctccaactttattcttctcaattttgttttggatattttaggtcctttgcattttcatatgaatcttagaatcatcttgtaaattaaataaaactggctgttgggattttgattgggattgtgattgtattgattccatatatcaatttggagagaaccaatatcttaacaatattgaacatggtataattttctctctgtattctagtttttttaagatgaaaatgcagaccatcgttcatttatttagggtctattttgtttctctctgtgagggttggtagtttttcatgtacaggttttacagatcttttgtcagatatatccctatttcatatatttttatgctattgtgttttatttcaatttcagattgttctttgctaatacatagaaatacaatttattttattttcttttgatatggagtctcactctgttgtctaggctggagtgcagtggtacaatctcgtctcactgcacccttcgcctcccaggttcaagcaattctcctgtctcagcctcccaagtagttgggactacaggcacacgccaccatgcctggctaatttttgtatttttagtagagatggagtttcaccatattggtcagggtggtctcgaactcctgacctcaggtgatccacctgtcttggcctccccgagtgctgggattacaggcgtgagccaccccacttggcttacaattga

SEQ ID NO: 41781 - DNA, 1029 bp, Homo sapiens
aacttatatatgtacttaattaaacttctattgattcatcctaggaaatacattttatggtagttttgagtcttaaaagtgttattcagtctacaaatgttcaatgtaatatgtaagaatatttggggatactagggaaaaaacctcttagaatgaatattatttgatcattaaaatttagggattaagagattcaatttaaaggattgtgctatcaaatatttatcaagcagctactctgtgtaggggtctttatgattagaggaggtatataaagatgtttataatatggtgtatagcctcaaggagcacgatgttttatacagataataattataagcatggacaaatgttactccttatggtagtcatttaccattgaggatgattatttaaatatctgaaaaaataaaatggtgcttaagtgaaatatgagcagatgcatcatactttttttttaaactaaaatgtattatgtgaaaatcattttggttgaaatcactagtgactaataggaactgtatagctcaacaatagattattctaatgtatttttgtaatagaacccattttgttagaaaaaaattcatagccatgcttctatgtcattttttcttccaagacgtcaaactatttagcaggtaaatactgcacaatttagttgaattggattttcagtctgtttttagttcatctccagagtaggactaactgccagacctaacgttcactcctgtgccacagtgcttaacatagagcctggtgtgatgcattctaggtgctcagtacacatttgttgagctctctggtcctgtcccaagggcaactggcatttcttcagtgagtttctgaaggtatgccttctgtttctgccagtaatttccctgggaccaggaaattattttgctaatgagatatgcactttacaacttgcatgcctatgcttatcattcctattcctggagttcagcagtcattgcagctgctgtggaaagtactcctttgctttgactgtgttttaactatcaa

SEQ ID NO: 41782 - DNA, 1032 bp, Homo sapiens
tttcttatttatttgttaataattatgtttgttctcactagatataaattccatggactcagcagcttttttcttgttctctactgtatccctagcatctagaaaatagttggtatgttatagtatctcagtaagtgtttgttgtatagaggaaacttgggtactcttctgggagaatacaaagtcttgttttactttgtggcctagtcacttatgtggagggaactctagttccttgtttatcgaaagcagtggataaaagtccaaattctagaatttatccttcatgtttttccttatctctgcttctttcctctatcaatctcatgtggatttaaaatatgataaaatctgggacaatgtttttcttacccaccagtggccaatggacagtggaaattgaataaacatttaataaatgagtgtttcgatcataagaaatagggcatgtctgcctctcccttgttggctgtttgcacacttgggatttgcagtcttcaatgaatatgaaaagagttggccgtaggtgtttgtgagggagaagagaaagatttgacaatggtactggcctggcatggtggctcacgcctataatctcagcattttgggaggctgaggcgggtggatcgcttgaactcaggagtttcagactaacctgggcagcatggtgaaaccctgtctctgtgagaaaaaaaaaaaaaaaacttagacaggcatggtgctgtgtgcctgtaataccagctacttgggaggctgaggtggtaggataacttgagcctgggaggcagaggttgcgttgagccaagatcatgccactgcacattccaaccagcctgggagtgtggaataagagtaagaccctgtctcaaaaaaaaaaaaaaaatggtactggttacctaagaaagctgttcttgtccaataaagaagtgactaatagcattctgggtttgggttgatgtagatttttgactaggggaaggcagtggattttggtggaactcttttttgaacttccagccttctctgctaaat

SEQ ID NO: 41783 - DNA, 1061 bp, Homo sapiens
tactaaataagatggaaaatggtatagaaattgataaggagtaggggaagatattttttaactaagatgcagaatgaaatggttgacgaagtgggaaaatatctggagggttaaatgaactgcaacaatgcaatatctatttgaaatgctttttagttttgcaaaactaagcaaagccaaaaaagtaacttttttgcatcaagcacctcaccccacaactttcccagctgttaaaaaaagaggagaacaaagaaaagaaagaaaaagaaagctgcctggccctttttggttccagaaagcatgtaaacctggtttgtaactcaaagcgccctagggtgttttctttgcttccactttacctcatgatatgaccttgaacaaaccagctggctctgttgtcttgattttcttaaaataatatcttctttttctctagagtatatacttatgagcacatttaagttttctttattttaattactataactattaatagcagatgttgctgtgttaaattgaatttgttctgagaaagcctttgttgggcttggaactagaatgtaagctcttcgagggtagaggccatgtcttgctcatctttggaattgaggacttactacaatgcctggggtcatggcaggtcctcaagaagtgcttattgtactaaatccaactgtggtactactttgccttttcataacaatatagaattacaagaatattttttccagatttttacatttattttcatattagtttcctagatttttgtaaacattgaacaccagcattctttttttttctcagataaaatgatttgatacaggtcactcaattataggggaagctagaatctaggttttttattttttaaaaaaatcacttctggaccttctaaaatatatatttttttctattgctattcagcttctctccctaatcttctaacgtagattccatttctaccccttcacttttttaccacccctatttattgttctcttgtagattatcctccaattttccgtgaaaatagcaagctttgttcctctattgatatg

SEQ ID NO: 41784 - DNA, 1071 bp, Homo sapiens
gcagagaaatgatatttttatttcttcagaggcaataggcatatctaaagcactgtgaagatgtccaggtaagtttattaagttctgagggaaaagaagtagatgaggagcaaatgagaatcttggataaaggcctagaccttgatcatggaggattttatttgttttttgatattatagtggataatagcaaagcaaaattcataaggaggatcattttccagaaaaatatgtagcactgatttcttatgcaatacttgagaaaatatctctcagagaagattctgtatctaattctagtaaatgggccaaatgtaataagtaagcttgaagccgggtgactgctcagatctaattagatgagggcatgatggtagataacatggaggttaggtagtgtttatagacaggctgtccctagcaggcctggcattagttaactgcttgagagattctttagcaaagaggtaattgtagaatacatcgacaagcagagtttatagttgaaattaatggcatatttaattgtgtaagctatttgggccaaatggcttctttttatcttgtagttcttggatcctaacatacggtagcattacccccactctctcaaccacccttacttttttcctgtagtgaacacgtatactttattgtttgtggaacttgccacatgataaacattgtcaacagtgtcagtgaccataatcacagaacaaattgcttttccacttggtcaaatatgtaataaaatgattcatcccaagaactcttcttcatggtgacttggctgggtattgatctagttcctggatccaacctctaccttacctcaggccctaagttgaccaggtgggccctggatggccctgccgagctccagctctgggatggattcttctttgaacttgggaagattttgtcattcatgaaattggaaccatccttggaatgttagttttgaaagattatgtcttcccctaccagttagaaattaatgaagataaatctccaagtgcgatgaacttttaggaagaatagtattttgaaaaacaaaaatgttgcctacag

SEQ ID NO: 41785 - DNA, 1017 bp, Homo sapiens
tgatccaagtttgttttgatgaagaggctaatataggagagtagtataggttgacattggacaagataaacacttgcaagattgggaagacattgaatattgttattaaattactccatagcataggtaagacctataactttgacatgtatttctctataaaataagggtaggaaaaggtcagtgaagaaatacaactaaagaaaatgatatttcagaattaaattatgtaatatgatattatataatgttgcatgaacaaagcagtgtacaaatttacataaatatgcttatgtgatacaatgtgatgaatatgaaatacaatgtaaatttgtatacatgtccatatatgtgtaggtagttttagagagaattgtctgaaaaggtgtttcccaaaatattaatactgtaaaggctctctctaagtagtaaataattttaagtaatcttttatgccctttttaaatttagctgaagtctgtttctgtaacctaggggtgatttgtagaggatgctcttgtttggagtggagaggaagaaataaatatagggagatattttaagggcagaattgaaaggacatggggtcttaataaaggggataaaagtagaatttttaggtctgattttaaggtttcaagccaattggcataattaatagcaaattgggagggatgtcgtcctgtagtttgggacgtttttcatgggaaaattggcttattaatgtccacatcttgaactattatgtaaacacatatagcagcaactggactagtagttaacggtgtctctgatcgggtaaagattggagtaatcagagggtggtactaaagtgtgattttttttttctaccacagaactcaacattcatgaaaagtcagacagttactcaactctcacatattctttaggagaatgggaacatactgtttgttctcattttagagactgataaagcaagaattaggaaaatggagaaaaggacagttatgttcaggtgctcactgagtggcagag

SEQ ID NO: 41786 - DNA, 1034 bp, Homo sapiens
cctaagggctgtgtccgtatctaggatgtggaacattttaaaacctctgtgcaaagtttttaaatgtatggaagtaaaggacagagaaagaaggaaaagaaggaagggagaaagaaatgaaaagaagaaagatggacagtgtgtttgttcacagtccagggcgggccatcagtcagatttatgcctggcctggctgagttcgttctgttggagagattcaggctgtgtgcatgggcaatcagggtcacagtcgcaatgccttgcctttacttgccgacgacccgcttgccactctgtggttgagtggctctccctcccacttgtcttgatctaatcagaatagtgaggttttaaaaaattgttaaatcagcacttgttgtcattaacatgcttaattattgcctatactacttttcttccctataactcagatttttcccatgctttatctctgtattggcatacttttgaggtagaagagacatgtagaattattgctgtcttacaaatagaaaatggaggcaggaaaattgaaatctcttgccttggggtttcatggttactggaagggttagatctagaatccaaatctcccagcccactgtgcttccctctagaccacacagaccacagtggtacagatttgtttttaaccagagcctcctcctgtgtaagctgttctgtgattcggccttccccccgccccccgcctccccccaccccacttaaattggtctagcagtgtgaaaggaaaagggcagaaatagtttcacacagtctcttttcttttctttgctatgagaaatatattaaagatttatcttatatttgttttgtgcttaatttttattatgtccaaaggtgacatgataacattatcatgagtatttcttattaagaaatactgtgaggagttatttctgcttcaagcctgtaattgtgcagtttacaatgttggtttagctccagtagttgtatcagaatatacaaagtggcatattagaaaggactggattactgaataagcataaaag

SEQ ID NO: 41787 - DNA, 1032 bp, Homo sapiens
aaataggagcaacactctgcttctgacactactcagccacaacacgcaaagatgacgttctttagaactgtcatgctgaatgaagccagatctatgctgccaacctttaaaaaaaaaaatcttttcatactgaactttttctaaaaacaattttagtgtgtttattccaataaattgttggaatagtcaagtcctgatttatgtgtcatgtggatatttttaaacaattaaaaattaaaatgaaaaacaattatcttgttcctggtggttctcagaacatatgaatatccaattctaaaaagtaaacacctttagttgtatttctgtgtacaggatgtctcaactctgtatattatttaaaatttagccttttcttttagaaatgcttaattttttatttaaaaataattattttagttagctagggtttttgtattcctttcaagtctgctttctgagccatactccagtgtcatgtggaaaatgttaccaaaaaaataaaatgatgtcactttaactttcagaagttatgatttatgctaataccaataggatggtttttatttagtacaggtgtttgcttgttggttgctctaagatatttttagcatttgttaaaaataggcttgggagtgactgcagttgtaaaataagaagcaaatacattgtcctcgtaaggatcatagcaagggggtgccaggccccagttgactgccgctatagttatgagcaaatgtggtgatagatattaagggctgaggtgtaggagtctggctgggtttcaaagaaaaataaaattagttgcagcagtaaacggagcacctaatcagtatatgtgactatgtactgtgtaaataaattacctgatatttttacctgcttttgaaagagatgaatcttccctttcaaaataagataagacaccagattgtgatcttttttaaaacttaacctattaactcatggaaaatcacttagctgtggaaattgtacactttgtacattatttccattgaaaaacacaacatatac

SEQ ID NO: 41788 - DNA, 1052 bp, Homo sapiens
attgtcttgccagtgaatgtgaaagacaggcatgtcatcacttaagttttaacagtctatcttcaggtctgacttggaaacttgcataatagccagcatccaaatagggttgaaggcagagcccagatcaatacaaaacattaaggctatcagtagtatatatatatatatatatatatatatatatatatatatatatataccgctatatatactgcttatatatatatatatatatatatatagctataaataaattaggatacctcttagactgcagttgtagagtatttatacaggtacaaggtgagaagtggaagagatggtgtcccagtatcttatttgaatcacttatttactattggggaaaaaaaatgtaaggagtgtggtctgcggataacatctggaccagttttatctacaaatgtctatttaagtttccttccattagacagattctgttgacttctgccttatgggtaacagactccattctatactcacaccttcacatatttatagacacaatattgatatactgatggaaaagattggttctcattattgttaagatattggcataatgttaggtcagtgatcaagaaatgctgcagacaagaattaatgcttttttaaaaaaagatgtctgtacttttgccaagtttgaaagatatgcatgtaatatatatatatatattcacaatacataatacatgatgcataacataattactaatattatacatctatgatgtatatgtatacattatgtatatatattttgaaattctgatggtaggttatttcctgaaagacagagaattttgggagtaacatcacccttaaagttcccacttaatgaagaaaatcaaacacttataaggaccttataacttaaaatttaaagaggagttgctctgttgtttgttttgaagaagtatctatgatttgaaaggtagagataaaagatttagtgcttttcaaatttaaatgcctgttttctatttttatagctctggttattatcagaatgctacctttttattttttta

SEQ ID NO: 41789 - DNA, 1078 bp, Homo sapiens
ccagctctttgaggggccaaggcagagggatcacatgaggttaggagtttgagaccagcctggccaacatagtgaaacaccatctctactaaaaatacaaaatttagctgagtgtggtggcacgcacctgtaattgcagctactccagaggctgaggtaggagaatcgcttgagcccaggaggcagaggttgcagtgagctgagatagcgccattgcactccagcctcggtgctggagactcaatctcaaaaaataaaaacaaaaaaaataaataaaaaagaaaaatactgcatgacctcacttatttgtggaatgtaagaaagtcagactcatagaagcagaaagtagaatggtggctctcaggttctagtttgtggggttcagatgaagaaggggaggtgttggttgaagcataccaagtttcagttaaacattgtgactatagttagtaataatgtatacttgaaaattgttaagtgagtagatcctaaatactctcaccacacaaaaaatgaaaagtatgtgaaatactagatatgttaattagcatttcacagcgtatacacattcaatatcaaagcatcactttgtataccgtaaatatatacaatttttatttgtcatttatactttaataaagcttgagaaaatacatacataaaatacaatttacatggaagagcaaaggcctcaaaacagccattcttgaaaaatttgctccaccagatatcaagtctaattgtaaagctaaaacatagtatggaattaatgtagggatatactaatagaccaatgcatcataataatgtctccagaaacagaatgtccaaatatgacagagataatattgcagatcagtgggtaaaaatagttttcaataagtgttgctgaagcaattggataaccatattgagaaaaatgaaattagactcatacttcaaccatacagaaaagtcaattttggttggattaaatacttaaatgtgaaagacaaaacaacaaatattttaggaacacatgtaggagaatgtctttatgacctcagtgcagtgaaggattccttaatttcatcatagc

SEQ ID NO: 41790 - DNA, 1045 bp, Homo sapiens
aatgcagttataatggtcagatttccccaatcatttcaaaaattgtatagttttttaaaaactacatatgatataatgagtcatctcctataatttaattgcttgacttcatttagtctcctttaatctggaatagtctttctgctctctctttgttttttaataatggcatttttcatgtccaggctgtttgtgtaaaatagccttcaatttgaatttgtctggctgtttctgaatgactcaattcagattaaatattttggccaaaatacccctagtgatgccatgggttacatttcctgaggcagggtgttttttttctcccatacctccaagtttacttgttatttaattaagactggggtgttcacattttctcatgcttcattattgtttggggaggaagaatattcatcagctaaaaggttttttatgatctgctttcatcttctagtcactttgtatggatatgttgctatttacccttcattttgagatgttttctttcctggagcggccagcaatgactgtcacatgtagacagaggtgaggaggtgaggaccgggtgatacatgaggtttctgaattcaagagattcttctgtttgtttgtgaagtgcaatttccttaaaaattgccctccttttggggagtggcagtttgccttctggttttgtaattctcttgtttttccagtactttaatttccagttctttcttgtttttcttcaacatcaaatctctgaaggccgccctttccagttaatccttttcctacggaacccctggcttcccaagatacctacctctgttcctgcagactttcaatctccttccttgtgattctcagtagccagtgccctaatccgccacgtctcacaactgtgttcaatgttttcccatttgggatgagacattgtttccctggggggtgttttccatacctactcctctgctttcctttcttcttttctgcactttttcttctgaatttggtcatttatttacctgtttgggcataatttgaagtttggagtattctctgt

SEQ ID NO: 41791 - DNA, 1013 bp, Homo sapiens
gcactgaccaacttcctgacacatgagtacagtgaaccgtgatgtatgccataaatgggaggggtgtgtgcttgctcagaggaggaagcaattacccctccttgtagaaggtcagagaagcctaagcagtggcggttgagctgggtcttaaagagtgtataggagttcagtgaaggataagtggatgaggatgagggtatttcaggtagaggaaaaagacataaaacagctcagcatggtcgaggaactgcaggtgattctgcatgtgtgcatcccctcagtaactcaacagcccatgtaaattgggaggcaggagcactgtcccactgagtttcaaacaaaagccattccaaactgccagataaaattccagtttaaattagtgaaatttgttgtgagacagcctgtgcactgcagatgcctgtggtcctagaagataaagtctatttccttttgaaggacatacatgtagatcaacatggaaggagtagcccttgaccatcagtgtatgactccattgcatagtgcttgctgcagaattgccttgcctgtcagatgacacagccagtgctgaggtgagctggtatctaccccgaccctcctttgccagaagtaaagatgatgagggggagcccccttactgacccttgctggggatggatggatgggtgaaggcttctgacaacagccacctttcccaatgaggtcatgaggacctcagtgctgtatgatggggaaggatatggctatttttgtaccatggataataaaaggggaaaaccctgctaatttgacgtaaaaaagattcaaagtcataaatatcccaaactgaaagcaaaccccagaaaggctagttttgaaattggaggtaattaattcctcatgcgatgtgctgaaattcaacccagacatccctttttttttttaatttctttcagacagtttacagtccagtggaaagtaaaaccatgcaatcccttggtgtggtacagttttactatgtgtctcttttt

SEQ ID NO: 41792 - DNA, 1058 bp, Homo sapiens
tgaaactgaaacgtagagaataaagctaagtgcaaagttcccagccggaaaagggagaacttgctaggaaaattcaaaccagggtggtatgatgctgagaccaagctttaaacctctgcaccaggttgcctccctatagtagaaaaattatccaaaccaacactcccttctcactgtgtagaggatggcctatgggtagaattttttctttttattgaaagcgataaccagtggaaaggtttagatttattattactgcagcataaagaatgaaggaatctcagagatcactgctgtctttaatctcctcttggaagaaaaaccttggaaaaggataaatgaaagtgaactatgcccagccttgggcgagaaatggtttcccacatctgagatgactcacatcttaacccttttactccagtttctctcttcgtatgtatcctgtgatacgctctctggaagatggctctgtagtaaataccggaccaacgcacgcaggcattatccattttagaagagacatgcactctgcttttaagtggtcactttccccaagcttcccatatttcttttcccctgagaatacatcgtctaccatgaagttgttcaggaagcagacccatttcacacaataaaaacggcaggttgattttgtggatttttgctacaccggctacaatcattgatcctaggtattcgggactcctatgaaatccttttggtactatggcagtgtttaagtgacaccagttttgtaaagtggcatatgcagggttgatccctgcctgataattaggagcttgctctcttgattttgtcccatcaatattgttcattttgcctcagatacgtttttctccctaagatcatctccacaaaccccagtgctgagaagaatgaatcccagtaagacctaataaatctgacagaaaaatgtggggttagagatccacacagaccatgaggactgtcgcattaaaggctcctggggattttttttacgaccttttttttcgtccttctaatgcttggtctcttgcttccataaattgtgcagc

SEQ ID NO: 41793 - DNA, 1002 bp, Homo sapiens
accacacatggtaagacaaatattatatgatttcacttatcggtggcatctaaaacagtcaaactcatagaagcagacagtagaatagtagtttctgggagatgctgatcaaagagcagaaagtttctgtgaagttctggagaactaatgtacagtatggtggctatagtaaatggtactgtattatatacttgaaatttgctaagagaggagatgttctcactatacacatgcacacaaagctaactccatgaggtggtagatataccaattagcttgattgtgatcctaatttcacaacatctacatatatcaaagcatcatgttgaacactgtaagtacagaatattttttgtatatctcaatacagctgagggaataaagacagaaaacaaaatgcaagaggcttgaaaatggtcagtgtaatttggaaatgaagggaaggttttgaaacagactcttttcatcaagagtccccagtgtcctagtgatatggtttggctgtgtgaccatcttgaactgtagttcccataatccccacatgtcatgagagggacctaatgggaagtaattgaatcatgggggtggttacctccatgctgttcttgtcacagtggatgagttctcacaagatcagatggttttataagggatttttccgcttttgctcagcacttcttgttcttctctttcttgcctccatgtgaagaaggatgtgtttcttccccttccgccatgattgtaagtttccggaggcctacccagccatgcagaactttgagtcaattaaccctctttcctttataaattactcagtcttgggtatttcttcatagcagcatgagaatggactaatacacctagattcaatgtggttttagcttgcttatcttgaagatgatgatgaaacatcttcttgccactctaggcctatggcaaagtggttttcaggctgtattcccgggaatcctatggttccttggaggattccccatggagatc

SEQ ID NO: 41794 - DNA, 1048 bp, Homo sapiens
gcaagaggagaaccaggaaggtacatgccaaggcagaagacgtttgaagaagacaaagactagtggcattaaacattgcaaagacctggaagattctaggaggatgtcaaataaggaactttctcatcttcttggactatttgaaacaatgaacaatggtcccttccccccagaccctgcgtatttgcacatgggattgaattgatcatagatgagattcagtggatccccagttggcaggaatccaaaactaagattgctgtagggattttgaaaatttaatgcaaaaatcacaaattttccaaactttgactttaaaagatcttaacaaaagtgaataaataccacatgaaattttaaaaggtacccaaacaaaactaatttcacggataacagtaatatgctttttgcaaacgtcattggaatgtttctatagttaaatgtaaaatggaccaggccacattgagggattttttattaggaataaaagcaacaatataaaagagtctgactaatataaaaacttactattgtaaacttttaagtttgctctattaaactgttaatgatgctttaaaaatattacgatataatttaatgtcttaaattctaggtcttcaggtaagatattttcttttctcatgaaatgtttaaagcccattttgtcagtgaagtgcagctgtggtgtgggggcctgaatgtatgcctgaacgtatgtgtgtctgaatgtatgggtttgagtctcacctggttgcctggtagctgtgcaccactgagcagacaccttaccctctctgagccttcattgtgaagtctgggacaagtctcagtggtatatgcccttcatccgacttaaatggttggctgtgggcattaactggggtgatgggaatgggttaaaggccaagatgtgtgtgaaagctgtttgtgaacagtgtaaatgaaattgttattaagggcaagaacttgaatagaagaaagtgaagtgtatgccataaaccacttttcagcaactacttcagtgaatatattctttgggaatgatagc

SEQ ID NO: 41795 - DNA, 1045 bp, Homo sapiens
cccgggttcaagtgattctcctgcctcagactcctgagtagctgggattacaggtgcatgccaccatgcctggctaatttttgtatttttagtagagatgggatattgccatgttggtcaggctgatctcgaactcccgaccttgtcgtccaccctccgtggcctcccaaagtgctgggattacaggcgtgagccaccgcgcccggctgcaatacacttgtaagtcaccttgtaaaaacggttcctttaaatgactgaggcttaaaataattcacggagacttggattcctagaaatgtgtactcagagaacttggaacagtcaggtgtcctttaaggcagattcagttaggtctttcttgaaaggcactagagggtagacagtccttaaaatagcttcaaaaagtcaggaagggaaagaggcaggggagtcatcaaatatctcaactgtttctgtttttaacaaaaatctgctgcttggatctgcaagctcaggaaggaatccttgttttgttttcagcccaactctgttgtctgtgatcttttttacccacaagcaaggatgcacatccctgcctgtcctccagaggtacaagggctttttgtggtatttggcattcacagattatacctttcatgagtgaaagaaattcctcaaatagctctttctgtctgagcaaggatctagtctaggaaatgtgtcccaaaatgctgccctgcattttaagaggagaggactagataggcagggacaggatatccatggcacttggagtcttctctctgagctctgcattttcagtggcttgcccatcaagtgtctgtctgagcactgggagtcatttgaattagcctgtcttctatgcatgtcctgtatgggccagaaccatggcacatctggtaattaaccacctctggacatctcaattaactattggtgcttgggacagcttaaatattttagtcttatcaaacgggaaaattagatttctgtcattgtatcatgtatgaaaattcatgcttggttttcccccagggtggaacta

SEQ ID NO: 41796 - DNA, 1006 bp, Homo sapiens
acatgtttgaccatgttccccatttttttgtgggatatttttagagaccagtggtccatggcatgctttgacaagtactgttctgatactttttataaatttgaaaaaaaagtttacattctaatattaagtgcaaaagcaagctactaaatgtcataaactataaaatcatgattatggtaacatgtatttaagaaacaggcaggaaatctattaaaatattaacctatcaactaaaagagtaatcttggggagggagacttacagtttttatatttattttgcttcctatattttctagtttttctacaatgaacatgtattgcctttatagttcagcaaatttacttttcttttttcttttggttaagcagtctcagaaggaatcattttctttccacctacaatgttagatccacctgaatgaaatacgcctttcattgcgtcctgagaagacggaagaatcataaaaagccttcagaagcccttgaggaattttgagggcagtaaaagcaaagactgtaaaccgaagaaaaatacacaaagatgtaagagcagtaagagcaaagtggggacaagggatattgagtatctgaagggaaaaataagaagcatagcctatcctggaaaagaaaagaaacgtcatggtaaaaaaacaactgcggtttttgtgaacacctactacggtaaggaacaggccagccatagcccacacccaggtggctgacaagagctcgccagatcacagggccaccttcctgcctgagagctggatgccctctgcatcttcctgggctttacagcacatgggatctgtttacatgtggtctccgcagactcgtgtcaagatcctaagtcagtgaatcccgagggaagcaaaaggcaggggtggaagcatggtaaggaggtgtaaacacccttttgtaagccccatggaggggtataggcttcaacagggagcagtttaagatactttggagattgactgtttggggttaagtgttgg

SEQ ID NO: 41797 - DNA, 1047 bp, Homo sapiens
tttcaccaagatttgatactttatagctctgtcactgtaactatctgagcctcagtttccatttttgtaaaatgaataccaaatgcttattccacggggttgttttattggatgaatagccagtgctgagcaccaaacctgatgtataggctgtggtcagtgaacgtttccttcttctctcagctgttcaagcccgttcaggcctgggatcaagtgcacacagtgctctcgtagattgagaatgaccaagccagctgaggatttaagaaacagagggaagatggtgatgtacatgtgctctgtgtgcactcagcacttgtgaaatgcctattgagcaatcaaatgacagaatagtgaactagattaatgaaaaggcaataaaaagagaaactcagcactgttcatacatcaaaatatcattgtgtccctcagtcccacaacaccgggttgatatgaaagcccttatcacaagaatctcttgtactgaaaagacctgggtttgaatcctgcctccactacttacaactgtgaactttagtaagtacttacctctccaagtcagtttgctcacctgtgaaatgtagatagcatgccatgacattgtgggaagggtcagtgttatattctctcagtggagggcccacagtaggtgttcagtaaatgctacttactttcttttctcttcctcctcctcctcctccttgtcctcctcccctaccttcttttccttcttctcctttctctctagtaaaatggaaatagtcgtagcatccttacctgtggagttattgtcaggattaaatgtaaaacatttagactagtgcctcaaacacattaaatgctgcattggttgatgttaacttattttcatatggcacttctatgatggagacaaggcagggcaagtctatataaaaatcttttctgatttgtctctagacaagaaatctaaataaaaggaaataaatagctcatgtaacttagctgcttttttattttagggcatttgatttttggattgtctttctggtgcattttaaagttggt

SEQ ID NO: 41798 - DNA, 1032 bp, Homo sapiens
gtcttggtatacttttatttctcagcaaccatgcaataaactgccttcaccttcagctcctgctctctgtggctgggggtgtttggggagtcctactcatttcctgtccacacatgcttccctttgtgaaaggtggatcctgggttctccaatccctgtcacaaaacaatctttttcccactgtgtcttatattatatttgtggtattttgatgccatcattctcagtttcaaattgatgtagattttcttttcctttaatgtagcaaaaatctgtatggagtgcaaattgtttggatttgactatagtctgctttctcgtatccatttgcactggtgattgattggtttgcacagaaggtcaaagaggaaaatggtaaaaaatagaacttggattctgtgcatactttgtgtcctggtggatttgttgggtcagggaagatgtggtgacagaagtcaggttgcaaggagcgatggctgcttctgaaaaagaattcaccctgcctgagtgtaggtggcaagttgaaccaatcataggaacaggatgttggaggcatctgggagcagcaggacaggtaccatgtggccaatggtcctacatctgttgcagcccagtcattccagtaggatatgtgcaactcaggggaggaagtcataggtgtgagctggaagcgttctctccgtaaacttaacacttcatggtgggcaccaagcaactaaagcacagcaaaaggaaaaacagcattcttcttgttgaaagagagagtctcaagaggttgatgagcctccgtgactccatagaactgatgtcagccattccaccattgccaaatcccaaaagttactgtctactctctgctgagaagttttccatactttttttttcatattctatgtccccatctttcttctgagcagtccatctttcttagggaatctgactgaccaagaaaagttctctgtgcttttacacttgacccaggtcctggggaggagaggagagaccctgatgacagggcagcagatctctcaa

SEQ ID NO: 41799 - DNA, 1035 bp, Homo sapiens
tccatatcctaagtcttcttggcacgagacaacaaacccagggtatttaccccacacaacaacaccacttcactgactggatataactctaaatcaacctggaagagaggcaacagcacctaggcagcaaggcattgattattaagcaaccagcatggaaatcatttaatcatcagtttgcctctaatgttgcatattgactaggatcagcctgactgccaccagaatggtatagcgtttatatcaacaagttttttggtttattattgctgttgttgtagttgtgtgtgtatgtatacatgtgtaaacacacacagttatttgaacattttccaagttatatgtcatacacacgtattgaattgttatacaaattattttaatgatctctcagttgacaacttgattagatgttctttcaattttttatagtcaaaatatttgactgtaacaaaagaatttgttatccaatcattaaattcatttactttctcaagattttatgtaggcttaaaaatgacgggtgaatattcctatcactttttcaccctgaggcacttgtttaacccaaaggaatttggaacagtttggaaaatgaaaagaaatcattttagtgttgttgacaatgcaatattttatcttatcacaaaccttttaaacatgttttaaaactaaactttagaatgacgtatgcagctcattcacttaatgggatgttcctgtcatataaccaccctggtaaagtcagatcttgttgtgaaatactcagtcaaatcagaattattttgtgtcagaaaggaaatataatttaatttttcaattcaacttagtgtgttaatgtatgaccttataaaaaatcatctctatctctgagtttacttgaagatagaggaattaggcagacgagcttgccaaaatttgtcacctggctaaagtatttctttctgatgcactttttgccttttagtcacaaatctttccacagggcaaagaattctttactttcattacagaatcgaagaagcaggtcaatta

SEQ ID NO: 41800 - DNA, 1110 bp, Homo sapiens
ttcagacaccaaagcttagagtagctgagtggattgtcattgtaacaaaacgggtcttagcagaactggagccaaagctcaggtcttcagattcccggtgcagatctgtgtcctctctgatgcccagggatacactgagcattttcttgtttgtttgttttttttttttttttttgtctaagttctgtgaatttttatcttagagtgtgtcatttggatgtgcctcagactcataagaccttaactggtttaattcttctttttagggataggacatttgaatagacagggctgagacgtatagtcattcattcatctgagccacaaatggctcattttggtgacctggcccaagcactattcctcatgtatagaaagctctttataaatattgttgaagaaacgataaatgaaaaaatttccttgttttattcatatgttgtgaactgtaaggcagaaaaagaagaaaaaaagatttactgctatcagtgaaaatataatcttgaagctgaaagcacaggtggaaataacagtgtaagaaaccatatttaattgccagaatgaaagtgctataaaagttcagaaatgcaaaactagtagaaccagtgcctataaaaatataaggagtgtggctagagtaaacaccagaatatgttgtgtaaaatagggaatatgtctgaagtttggaaagcatgtgtacatgacagataaaataatgagaaataaagagaaacactactttcaacagagaaaattgagggaaatcattagagagagaaagaaagcagaaattaatttaagtacactcataaataatcgattcacagtatttaatgtttcttaaaaatgtaaatcactttattgtgtgggttttaagagtatctcacaaatgtacctcgaggcctttgactcagtgcttaaacctgctaggtagggagaataacttataactttcccaatgaactcttttactaaaatctagattcttattaattcttctaagtgaattggtaaagggagcaaatgcacttctttactattgattcaaaacataaggtgacgacttaataaataatttagattttttcattaattaggcatctcctgaga

SEQ ID NO: 41801 - DNA, 1081 bp, Homo sapiens
ctgaattaactaggacatgaaggctgaacaggtttataacttcagccttcatttgacaactttgttgtctaatttctccagtttaattatttaaggctcaaaacacttcagtgagatctgtgtgttaaccccaactctgagaataaattattaaaagaaatggatgctaaagaaatgattgacacgtgtgctaagtcagcacaaactgactttaagtcatcttctaccccttaccttgctgaaatgtggtgtctgggtggggaaaaggacagcatagttggatcctgcttcctagaaacagtagagactcaggtttatctgtgactcctcagccctgtgtgaccaccattttgcttggtccaccagcacttctttctgtaggtgaagcccggtccagtctagaccccataagcattctcatcattgtcttaactaccatcctaaaatcccttgtcctccagtctccagccgcctgcatactaatcacatatgtagccttcaatagacacctttctccattgctagaggaagacttgaaaatgtgcacctctttccactccaagcacacatcgtgcaagtttaagcacttaatggctcagcaatattttaaactatcttttctggtttaatgatcttgtcctccacccattcccagccactcatatccagagagaaacgttaaacattgtttctaataataattgcagaatctcaatctccatcgtcacaatttctgaccatctgtacttcccacatttctagccaactccctctactactcttactcagataatttttaaaacccccagtaacactcaagccgttaactttaatacattttctctgtccattaacctcctttcatccctgccccatagttatcccactaagatgccatgaattgtcatgtattgctcatatccactctcaagagtgcattacactcacgaggaaaatgccagccctagttatgtctccacctactcactgcttgcttcaattgactgagtgtggctggagaaaaacataaaatcagaacacctcatcttactttaaatttatgaccacaaacctcaggtag

SEQ ID NO: 41802 - DNA, 1043 bp, Homo sapiens
agagaataccaataaggcatggtgaggccctggagctgttcacactgaggagtcattgctaccctgagagctgtccaggcaagggggtggagtggttagaaagagctgtggctgtaggtgaggaaggaagacaatccccagagaggacccacagccttccggagaggcacataccactgtcaacatgcgacccaacagagacccaaggaaataaattcccaatccttcatgcctccctatttcctgctggtgtctcctactgtgcagatgtcttctcctaaaggacagggagacccatgatgtggtccttacagctcagcctcttggagcacagagcaaggcagagaaggatgaaaaatgactcgaggggagaacagagcaaagtcaccccacctggggaaggagaaggtcaaagctcttcttgctgatggaatcttgggaggtctaatttattcatctcatgataccttcaattatcatggcattgtctgggtgaatttatggatacctcattagagcttgaagaggcaaacttctcaattaaatatgcttgttatagtacagaattagctccaatctctagccaattgaatctccttcttctgaagcactcctatcccataaacagtcacagctattattattttctccagtatcagtgacctgcatatgcacaaaatcactatgtaggtggttaaagtaccagatatcatgtgtgcttcccaggacaggtgactcttgtcaagactgcaaatctatttgtctcctttattcaaaagcagcatttgcataccaacactcttaaatcccatacattcttccatgcttctaggagagaaagagtcacctagctttatttacaagtcaggctgtaaataaacttggagacatacattcagatgaatgctcctgaggtcagtatcatatgccggatgtgggaagggtattttacattataaaaatgttttgctaggagaacaaagggagtggaggaggattgttaagcctctgagaaagcgttactcatctcagagggctctagc

SEQ ID NO: 41803 - DNA, 1088 bp, Homo sapiens
catcaactacttagatttaactcctccccttctccatcatatccaatctccatcagggcactttgattctctgttctaaacttgctttacttttttcttctattctctactcctgcctttgttctgagagtgtctccgagacctgtgcaaaagcctttcctgggccccctacttctttctcaactccctccaatttattctctttgcactattgacttgttaaaagcaaaactttggacaaattgcacttaatagagtttgagcaaagaatgattcatgaattgggcagactccagaacaaaatcaggttcagagcaacttcaggactgccacctggttgcataacatttccagacagaaaaaagaaagtgatgtgcagaaaatggaagtgggttgcagaaacagctggatttgtccccttcttatgttaaaacatgacctccagtgttggagatgggcttagttggaggtatttgggtcatgggggcagatccctcatgaatggctcagtgctgttctcacagtaatgagtgagttctaactctatgagttcatatgagatctgcttgtttaaaacactgtggaaccttccctgtctttcttacattctccttctccacgtgatacactagctcccccttagctctctgcgatgattgtaagcttcctgagaccttcaccagaagcccagcagatgcaagcactgtgattcctgtacagcctgcagaaccatgagccaaaataaacctcttttatttataagttactcagccttaatgcaaatggactaaaacagaaaatgggtatttaggaggggtgcactgctataaagacacccgaagatgtggaagcagcttttgaactgggtaatgggcagaggttggaagagtttggaagtctcagtagaagacaaagatgaaagaaagcttggatcttcttaaagacttgttaagttgttgtaaccaaaatgctgatatagatgttaatagtgaagtccagattgactccagggaactggagccaaggtcacctgtgttataccttagcaaagaacttgattgcattgtgtctatgccctagggatctgt

SEQ ID NO: 41804 - DNA, 1026 bp, Homo sapiens
tacctaggaatccaacttacaagagatgtgaaggactttttcaagaagaactacaaaccactgctcaaggaaataagaggggacacaaacacatggaacaacattccatgcccatggataggaagactcaatatcatgaaaatgaccatactgcccaaagtcatttatagattcaatgctgtccccatcaagctaccactgactttcttcacagaattagaaaaagctacattaaatttcatatgaaaccaaaaaagagcccacatacccatgacaatcctaagcagaaagaaaaaagctggaggcctcatgctacctgacttcaaactacactacaaggctacagcaacaaaaaccgcatggtactggtaccaaaactgagatacagactaatggaacagaacagagccctcagaaataacaccacacatctacaaccatctgatctttgacaaacctgacaaaaacaagcaatgcgaaaaggattccctatttaataaatggtgttgggaaaactgggtagccatatgcagaaaactgaaactggatctcttccttacaccttatacaaaaattaactcaagatagataaagacttaaacataagatctaaaaccataaacatcctagaagtaaacctaggcaataccattcaggacataggcatgggcaaagacttcatgactaaaacaccaaaagcaatggcaacaaaagtcaaaattgacaaatgaatttgactaaagagcttctgcacagcaaaataaactatcatcagagtgaacaggtaacatacagaatgggagaaaattttttgcaacctatccatctgacaaagggctaatatccacaatctacaaagaacttaaacaaatttacaacaaaaaacaaacaaccccatcaaaaagtgggcaaaggaaaccaacagacagttctcaaaagaagacatttatgcagccatcaaacatatgaataaaagctcatcatcactggtcattagagaaatgcaaatcaaaaccacaatgagat

SEQ ID NO: 41805 - DNA, 1035 bp, Homo sapiens
cattttatttctctttggtaaattcttggggtaagtaatatggtagatgtatgtttaatttttaaattgcaaaattattttgcaatatattagtaacattttacattttcacccccagtgaataagaattcaggttgttccatgtgctcaccaacacctagaatggtcactgcttttaattttactcattcttatagatttgtagagataacttactgtaattttaatttgtattttcctaatgactaatgatgttgaggatctcctgtgcttatttgccatctgtttgtcacctttggtggtccattgaaatctttggtccatttttaaattaggttatttgtcttaatgaattgtaagggtttttttaatattttaggtactagttttttgttggactgtgcaaatacactatttctcattacacttttacccactaactttagtatcttgtcaatgattcttgcctatggcagttattactgtgctgtttgtgttactggtgattttctgttacatgattttctgtttacatgtacatgatgctacattttaaagctgggattctgaccgggtgtggtggctcatgcctgtaatcccagcactttgggtggccaacgtgggtggatcacgaggtcaggagatcaagaccatcctggctaacacggtgaaaccccgtctctactaaaaatacaaagaattagccgggcatggtagcaggcgcctgtagtcccagctactcgggaggctgaggcaggggaatggcctaaacctggaaggcagggcttgcggtgagccgagatctcgccactgcactccagcctaggcgacagagcgagactccttctcaaaaaaaaaaaaaaaaaaaaaaaaaagctgggattctgttgtaaggaagagctcttttatttattcatcagttcggttatatattaatttttttcattgttcagttgtccattgatagacctttcaggtggctcttgttcatcctttcactgtgtacccatcatttttaggggtacttctttactt

SEQ ID NO: 41806 - DNA, 1033 bp, Homo sapiens
cctttcttttaccctgttctcattctccttttttctaccactttcccacacatcgatagaggtaatggatctcatcagtttctgattgattttttgtgagtatttttttgcgcatatgagaagatatgtgtgagaaaggagatataacaatttatgaaaggtagtgtacagtacatgcttgtttttatcacagatttattgagataatttacatgccataaaatataccccttgaaagcgtgattttgtggtttttcgtgtattcagggttgtgcaaccattgtcactgtcaacttttaggacattttcatcagccccaaatgaaactttgcagccattaataatcagtccccatcccttctcttcccttgtcctggcaaccactaatttactttccgtttctatggatttgtctatcttggacattttatataaatgagatcatataatgtgactttttgtgatgggcatctttcacttagcagtgttttcaagttttgtctgtgttgtagcatgtctcagtagtacttcattccattttattgctggatattattctgttgtatatatactaccatatttcatttatccgttagttgatatttgggttgttttctactttttgactattatggataatgctgctgtgaatgttttgagtacaagcttttgtgtggacctatagttttcaattcccttggatatatacctaaggatagaattactgcatcatagtgtagtgtaactctagtttaactctatgaagaactgcctgactgccgaagcagctgccttattttacatttctaccagcagtgtatgagagttccagtttttccacattcttgtccatacttgttattgcctgtgttttaaaactatcctactgggtgtgagctggtatcattgtggttttaatttgcatttccctaatgatgttgaacatcttttcatgtgcttattggcaatttgtacaccttctctggaggaatgtctattaaaatgctttgctgagtttttaatgaagttgtct

SEQ ID NO: 41807 - DNA, 1046 bp, Homo sapiens
ttttttttacgttcttgatagtgttctgtgaagtacaagcatttttaattttgatgaagtccagtttatctacttattgcatgtgcttttgatgtcatagtcaagaaagcatttctaatccaaggtcatgaaaatatacccctatgttttctaagagttttatagttttagacctttatgtttaggtttttgatccattttgagttaatttttgtgtatggcgtgagataggagtcattcttttgtatgtggctatccagtagtttcatcactcattgttgaaaagactagtctttttccattgtgtggtcttgacaacttctgtgaaaacaactggccataaatgtaagggttttcttgtggattctcatttgtttcttattgatctatatgtccttaatggcagtaccacactgttttgatgactaactttgcagtaagttttgaaactggggagtgtgagtcttccaactttgttctgtttcaaaattgttttggttattctggttcccttgaatgtccgtctgaactataggcttagtttgctaatttctacaagtaggccaacaaggatgttgatagccatggtgttgaacttgtatatcaatttgaagagtattgtcgtcttaacagtattaagtcttccactccattaatgcaaagtatcttctgtttatttaggtcttcagtttttgtgaacaacatttttatagttctcatgtataagacttacatttctttttgttaaatttatttctaggtattttattcttgatgctatcacagatggaattttttcttaatttttttatagaaatgcaattgatttttgtatattgatcttatatcatgcaactttattagttcctgtagtgttttttttttagtggattcttttggattttttatttataagatcatatcgcctgcaaatactacttacattactttacaatctagatacattttatttctttattttaccaaatgccttttctggaacctccagaactgtgttgattaggagtagcaatgatagacatctt

SEQ ID NO: 41808 - DNA, 1016 bp, Homo sapiens
cctccatggtttctgataggatgtcagctattcttatttacagtctcttatacatatagttgcttctcataagctgctttcaagattctctgtttttggtttttaacagtttggttatgtgtgggtctctttgattttatcttattcagtttgttgagctttgatgttgatactaatgtttttcttcaaatttgggaagttttcagttctgtttcttcaaatatacattctgccccttccttcctaaacccaccccttttctccttccctcccttacttcatgtttgattttgttctgtaggtctctggctctgttcatttttctttctttacttaaattggttaatgttatttaacccattttcaggtttggtgattcttttttctgcaagctgcaatccttcgttgagcttctctagtgaatacttttatttattatattttttaactccagaatttttaaaaaattatcttttttgatattatctatttgatgaacattgttttcatacttgacagtttattagacttttctttagttctttgaacatatctaaaatagcaggtttaaagtatttgtttaatgtctgggctttctcagggactgttgcttttttcccctgtacatgggccatgcagttttgagttttttttgcaaggctcatacttttctcttgaatactagacattttaaatatttcaaataatacagtgtggcagctctggaaatcagattctcccttctctgcagggtttattgttgttgctttttgttatttgcttagttccttttcgaactaattctgtgaagttaatttttgccatatgttgtcactgaaatctctgcttggttatcttagtggtcacttgtgagtgggcctttagggactaccagacacatcaaataatgacagcagtttgagagtgaggctttgaaagcattccatgattgttctgtttttttccagttgccactaggctgctggtttttactgtgattgtgtgctgatggtttt

SEQ ID NO: 41809 - DNA, 1035 bp, Homo sapiens
ttcacactggcactgtgaacatttgtgcaggaaaagaatcagtgggtggttaagtcttttgaattacagactatggttgattttagaatttagggtatggaaaaattcttatgagatatgacaagtctatatgttttaatcgaccagtattaaattttttattttttttgagacagagtcttgctctgtcatccaggttggagtgcagtggcgcgatctccactcactgcaacctttgcctcccaggttcaagtgattctcctgcctcagcctccagagtagctgggactacaggtgtgcgccactatgcccagctaatttatgtatttttagtagagacagggtttcaccatgttggccaggcaggtctcgaactcctgacttcaagagacctgcctgcctcggtctcccaaaatgctaggattacaggctggagccattatgcctggccaaattattagtatattttctaaatagtatttgtgctaggtagcttcagagccatatttttgtatctgataggacacttctatacgaattttgggatgatatgtttttagccaaacccatgttttatctttgtacagagtttcttcctcagaagatgttttcctgaaagagtagtcattcagatttttaaaatatctactgtgtgtcagcactttgctaagaacatagagatgaatatgacatggttctctccctctgggaaatcagtcatatgggggaactgacaaaatgtttaaaataattttattttaaaaaatatttattataataattacatgcaaataattgtctactgtaaatcatcctagttactcttctttgtcaccatgttactgagactgctcttattttttaagttaccagtgaccttatttccaaattttatcagtatgtctgtttctgtaatggtatctttctctgtagcattcagcatagttaagtgaatcctccatccctgagatgatcttggttttcttcctgtctccactgactgatctttctctgctccagggctttgcctcgacc

SEQ ID NO: 41810 - DNA, 1043 bp, Homo sapiens
ttgctttatggttgctgaatattaatgctaccccttgcaaacctttcgagtatcttgttttccctggactgtgtcaggtatttaatgttagtgataggaagactcttaggaattgattttttttaaagttaataaactttaaaaaaagttttactttgagattttggacctgattttatatatgtggatgtttgcctttgttgttgaatcaacatgaattatatatttgtttgaaatgtggttggatatttagataactcctgttttttttttgatataacagatattcagatatatggcttgaaattttcttcctataaaaactaggacttgttacaaaatggtttttgattagaaaagtaatatgaaggaagtatatggcattttaagagagaggacatcaccattgttaaattttgttatttttctgcatcttaggcatagctgtaataccatatttattttgtatactttcttcatctaatgctgtggcaagcatttctctatgtcagatttttaaaagctaattttcaatggctgaataatatttttataggtgtatcataatacgcttagcctgcctcccattgttggacctggaaggtctccctctgccaccacacacacactttttttattgttaaaatattattgcagtgtttttctctgtgtgtttcattcctagaagtaaatggcatggtaaaggatgttaactgaaaatgtcgtaccaactaatacagtttctataggtgtgtgaatgctcatatgtgtctcatccttgccaatattgagtggaaatctcttttattttcctggagaagttggttctttagcacgagggaagcatttgagagtgtcttcaggatggctcaactttgcagtgtcttcaataaataacttcccataacttcccactctgtaatttgcccacctgtattaccccacccccaagcctcagactttaggaaatggcatcaggcctgtatctggagagttcagagttctgtgaggtagagcattccttccaatgggacctagaattc

SEQ ID NO: 41811 - DNA, 1075 bp, Homo sapiens
ttaaatcacattgaacaactacacgtccactgctctgtccctcttttatgttattgatgtcgtaaattacattattatacattatgtacctattaacacagattcatgattttttaatgcattcgcctttaaaaactcatagaaaatataaggtgaacttgcaaaccaaaattataataatactggtttttatatttgcccttgcatttacctttacgggatctttatatctttatattgctttgagttactgtctagagtccttctatttcaacctgaaggactaccttcagtatttcttgtagtacatgtgtagtgataatgaacctccctcaggttttgtttactggggaatgtctttatttctaccttgtttttaatggtcagttttgccagatacagaagttgcatttgacatttattttcttgtagcactttaaatgtatcattgcactgccttcaggcctccaaggtttctgccaaaaagttggcttatagtcttatttgaggattctgtctatgcagtgagttgcttctcttttgccactttcaagattctgtcttggcttttgacagtttgattgtaatcgtgttggtattggttgtgagtttttcttatttggagtttgttgagatccttggatttgtagattcatcagttacatcacctttgggaagttttttccttcatgtaatctctgttcatttctcttcctctgaaacatccattgagtatatattggtccaattgatttatttcataatctcttgggctctgtttaattttcttctttcttttttctttctgctcagatttgataatttctgttgtcttcagatttgctgagttttttcttttgcctactcagttctgctattgaacctatatagtgaaattttcaattattgtatttttcagctctacagtttgtttttataatttctctttattgatattctcattttgctcattattttcctgatttcccttcacttttttctttagctctttgggcatagttcagacagctgctttaaagtctgtctaataaatctaatatctgtatttcttcag

SEQ ID NO: 41812 - DNA, 1077 bp, Homo sapiens
ggaatgatagtaagtttatttgagtgagtggttggggccaaacttgatagagaatagtccaggaagacatttactgtaaatggtagattagatgttcttctctgattaattacatttgaactctgtgaattattaaatcactcaaactgcttatttgtattattagatgcacatttaagttatataagtattacatgtctttagtggtgatcactattttatcagttcctctgtctgtctttataccaagtatgagtcataaacccagtatgaatttgccaagagattggcagactatttgtatatatgcttttctttcaaataatctggatttccaatgcccgctatcatcaattctaaaggtaatgtggtagtaggtagatttagtttgctaacagtttcccagttggttttgataaactcgaacgtccctaccatcaccccttgtaggaaatcactgatgtaatgtatgatattaacatctgcaccaattactcttacaggtggaacaatccaaagttttaatcaaagaaggtggtgttcagttgctgctcacaatagttgataccccaggatttggagatgcagtggataatagtaattggtaagaagggtttgtcctcacaactttgcagtgcatttggggtactggggtggttaaactttttcttcttaacattttaaaacttctcatcttagcaaaggtcaccaaacttcaagcaacatgacttgggtttgtataccaactttgccacttatctgacaaagttgtttaacttctttgaacccatttacttttctataaaatggagataatacctatcataaaattgtttttaagacatattctaaaataacataggtaaatagaagaattctcattattgtaagaaatttaaaactgttcactttaattttattcatttgtataaattctatctcaatcctaatttaaacctgatatttagactttcagtttttctgtaagtcctaagtgaagaaaacaactatgaaattttagtctgaagtaattatcttagtattttataaataatacttttatttttgtttgaattc

SEQ ID NO: 41813 - DNA, 1022 bp, Homo sapiens
agttagcctgtactccctttttttgttttttgtacttctgctgtcattttgagtacatatatgtgttattgacaactgcagaattttccagttattcttcctcagtcttttcctttgggtaagtaactcagtatatataattcagccacctgatgattataactccaccatctctccaccaaaagaactgtagtagcatcaggctaaatagcattaagttatctaacactcacattacagtagtgtaaaccaattccttcaagtatacctttctcttctatttttggcttcttgctctcttttacttttttatagataggtcaatgcccattatcactctagatggataagggagccttaattatatacttatatgtttgcactgccagattgtagtggagtaaagatgtttcttcttttatgtctaatattcttttacagtactctcagtttacatgtttaaatcactaaactgactctgacttaaaaggctcaaaaaaagtaatctcaaaaatacaacatattatataaccttttatgagtatttgtgtagctacttgaatttgtatttttaagtcattctcgtttaacttgtcagggctttttcctttaagccagcagagtgaaatcttaacctgcatttaagtcaataaaacttgtcagcttataaccaattttattattttagatcttctggactctctccaagtttagtaattctcatgaagtcacattccttccatccccttggggaaaattttatttcctaaaattgcatgggaaatgagagcttttttaaaagaacaaatttttatattcaaatgatatgtagtggctttgtgccatttcttatttgtcacaaggggtaagatgtttaaaattgctatttcttatatataaaaatgtacctttgaacaatttctcagtttatttttagaaatggagcaaagttttgccctttggtacatgatattgtggattaagtgaaggaatatgacacagaattttatgtatagagttcc

SEQ ID NO: 41814 - DNA, 1047 bp, Homo sapiens
agatttttttcataaataatcaagttttatatatgaaatatggaaagaagttctaggttataaatatattaatagtgacatatagcatctgatttgttttcatcagctgtttcatagttctgtattataatttttattcacagacatttaatgattacccttaatattcgtgacaggagccctctggcacaaatggaagaagaaagaagggagcatgtagctaaaatgaagaagatggagatggagatggagcaggtgtttgagatgaaggtcaaagaaaaagttcaaaaactgaaggactctgaagctgaggtaatcagtctaatatcccatctcttagcagacattgtgttcctttttaagtagtatcttcagtaaaatttatagataatataacctttttatacatattttttcaaaattaataccctagtgtaacaaaacggataaatttctagaagcaagcaccgtgtttataataaaataatacatacttcaatatgcaagtgcttggacgtagtatattaggtaggacagtgtaatagaatacttataatgaattattagttataatgaacaagtttgagttgtgaaaaataaaattacaaaccattccatacaggtggcataagaacactaaagatgagagtttgggggtggatttatgcacacaaactgtgttaggataataataattgaccatatttatttgtgtatgagtgaaaaagagggaaataacctttattgaactaaagacatgcctggataaattccacacaattaaagaagagaaaattagggaatgtgatatttttgttaacaggttaggccttctttatttataatgtagtgtcaaggtagttcctggtgttacaacattgggcagggtaatgacaaaacatcccagaagacatacctactatcttgaaacccttctagatgttgagttatacatttagtttctattaatcaaaaagaccttggagacatttccttcaataggtggcaagaaagaaaagttggagaaaaagataaactgaacattaa

SEQ ID NO: 41815 - DNA, 1061 bp, Homo sapiens
atgtgaggccaagacaattcttcttccattgtggcccagggaagccaaaagattgtacacctctgctttataataagccaataaaccttaagtcagtgtttctgtgagttgcttcagcaaattaaccaaacccaaaaaaaaggatcatggaaacctcaacttgaagccagttggtcagaagttctggaggctcagacttacgactagtgtctgaaggctggggggtggggagggcagggggattgggggcagtcttggagactgagccccaagtgggtggggtctggtactacctccaggtagatagtatagaaacagaattggaggacacccagctagtgtctgatgcttggtttgtgtggaaaaaacactacacattcagttactgacatggtttagctctgtgtccccacccaaatctcttcttgaactgtaatctccacatgtcaagggagggacctggtgggaggggtttgaatcatagggacggtttcccccatgctgttctcatgatagtgagtgagttctgatgagatctgatggtttaaaagtgtttggctcccagcactttgggaggccaaggggggcggatcacgaggtcaggagattgagaccatcgtggccaacatggtgaaagcccgtttatacttaaaaaaaaaaaaaaaaaaaaaaacttagctgggtgtggtaatgtgcacctataatcccagctactcgggaggctgaggcaggagaatcacttgaacccaggaggtggaggttgcagtgagctgagattgcaccactgtacttcagcctggcgacagagtgagactccgtcttaaaaaaaaaaaaaagtgtttggcagttccccacccccagcttctcttctgctgccatgtaagacctgccttcctccccttccaccatgattgtaagtttcctgaggcctccccagccatgcagaactgtgagtcaattaaacctcttttgtttataaattacccagtctcaggtatatctttatagcagtgtgaaaatcaaccaatacagtcacagaactcttctgtgttgattgttgt

SEQ ID NO: 41816 - DNA, 1029 bp, Homo sapiens
ctggttgggctgcatgttctccatgaggatgagtggtggccagatctccggaccaggtggaaggctgtgcagggcatcccttctctgtcggtttcctgggtggggcttggtcactggagtggggatgcgcagcgaggggcagctcagggctggactcttcactgctgtcttctgatggtctcagctggaagctgctgggtgctagtctgcactgaagaacccccagcccagtgggggaggcaagccgggcacagagcagtgcgtcatgatgggggcacaggattccgtggacattggcagcaggcatgctcaccacatcttggggtgagtgggatggcagggaagggtcccagaagaactgatgaggaatgccaaggtggaagtgccaaccagcagaagttagatggagaagaggcccagagagcagagttcccgagagggagagtgtgcagaagcctggagcctggagaggggaggaatgaaggcgggatgaggtatggccagagagcagagggaatgccacacaggaggacaaaggagagatgcagctagatgaggagagaacagccacttcatgccagccttgggaggtcccccggggagtgcggtcccctgaaggcagaggcagagggaggccatgggaagcacccagggctgggctctgggtgtatcttctgtgttttgatggagtgctgcccagaggtgctgggtcccctgtcctaggagagtcctgtgtctagaaaagctccagggaccacggccttcagatggccctgcctgtggacactgcgagtattgtttggccttcagtgaggggcagtcttgatcaagaaaatgttcctagggctatgtttccaagaggaattcagaaacccaggccgtcaggtcccgtggtcagcaggtggccagcggcagagcggccacacccatcctggtgccctctctttatggctgccacctccctctgggagggcctgggggaccctgacaccattctgtgggagagatgacagtaaaattaggctgtgg

SEQ ID NO: 41817 - DNA, 1032 bp, Homo sapiens
tagcaatcatggatccttggtcacctgcacacagtagggcgctgtcaatgtttggaaaacaaatgagtggctgagcagggtccctttgcaagcgatggctttagctatttgggtgactgtttttctttatattcttctgaatgtattcaaattcctcacagtaagtagctatcagatacttttagaattttttatggcaaaatgtttataaataaaatttagcattttaactctttttaagtgtagagttcagtggcatggcataaagtacacttacgttgttgtataatcatcaccaacattgtctctagaactttttcctttttttttttttttgagacagagtctcgctctgtcacccaggctggagtgcagtggcgtgatctctgctcactgcagcctcgacctcccgggctcaagaaattctcctacctcatcctcctgagtagctggggtcacaggcatgcaccaccacaccaggctaactttttgtatttttagtagagatgaggtcttgttgagaggtgacaacatgctagcagccctcgctcactctcggctccgcctcggcgtccgctctggccgcgctcaaggagcccttcagccggcggctgcgctgtgagggcccctctctggggctggcgaggccggagccggctccctctgctcgcagggaagtgtgaagagagaggcgcgggcggaagcggcgctggcgggccacgggttccaggtgagcgcgggcttggcaagccccgcactaggcgccgccggccggcacttgctgggcttgatcggaggctgaatcccgtgcgtggaccgccgttccctcttcgcgggattgttggccacgacagccggtctccgtctctttctcgtttcccctcttttcctcttgattgtctgggacgagctccctctgggctgccttagtgcccaggctaggtgccacaaagtcccgctgccagtgccagtaagaggtgaagctggctgggcttctgagaggtggggacttggagaacttttctagctgtc

SEQ ID NO: 41818 - DNA, 1031 bp, Homo sapiens
ttgagacccagtaacttgcctaaggcaaatgaactaagtagaggagtgatgatttgaatcccaatagttccatttccaaaaccagtacttctctattcagtagtcaagttcatgcgtttttatctctttttaggctactactgaggattgagaaactgcctctctgcccccaaaccaacgtttcactgtgccctggaagagatccccagtgtgtctcggctttctatgttcaagtcaagcctgggattggggattttttgccagttgtgggttcaagttcggcatgcatggtggggtgggctccacaaaacaggctgggtgggcaccaaggaagccaggcccccctacttgcccatcaggggcctcccagctgataccaagctctcagaccctggggagttcaggactcttcctgcatgtgtagccgcaggtgataattagaatctgtgttgctaacatgaagcaacagcacccaaacgatattcatttgtttttggttagagagacaagcacttgaactatattcgtttatttttggaatttaaaatatttgagggggctaggtgaggtggctctgcctgtagtcccagcactttgggagactggagggttgcttgagcccaggagtttgagaccagcctgggcaacatagtgagacctcatctcttcagaaaatcaagaaattagccaggtgtggtggtgcacacctgcggtcccaattccgcaggaggctgaggcaggaggatcacgtgagcccaggaggctgaggctacagtgagccaagatcatgccactgcactccagcctggaagtcagagcaagagaccctgtctcacaaaataaaatatctgggttagtagtcagtctgctggttggcactaagacaaataaagtctttaaaatgaacaccaaccagtggtgtgagggaagaatgaggtctgagcactgctttggatttgatgtcccctcaacctcatttctatcttgggtaaaccaaggatagagctgctgcctgacctcagagaggcaaa

SEQ ID NO: 41819 - DNA, 1074 bp, Homo sapiens
gcagacaggacattgaggccaagggagttgaagtgccctctgccccaggtccacagcaggtgtgttggtaatccaggacccatcacagcagactgggctccatttcccagctcctttaagtgcaaccagctgcccatcttctgtgatctcatttaatctgaacatcagccttagcaggcatactggacgatcctatctccgcatttcccaggagtgggagcaggtccataggatcagtcctggcccaggtgatggggaaccaatgcccagatcttctcatagtgtgacttgtagcaaaacagacttgcacagttggtgttagcctcctccagcaggagaggcagagaatgtgggatgggggatagaggacgcagaaggaggttctgggttccagatgtggacaatgtcaaaggagcacctaaaagtgaaggaacacacagggtgtgagggctgcctagagaccatccacctagcaggttatgggagccatgaggacacgtgagaggttggaggacgtggactggacacacctttcatttgggcttggtgtccaaatgaattacttcaagaatcttaacttataaaaatatatatactttaagatactttttttttttttgagacagagtctcactctgtcccccaggctggagtgcagtggtgcaatctcagctcattgcaacctccacctcctgagctcaagcgattttacccccctcagcctcccgactagctggaattacaggcttgcaccaccacacccagctaattttttctatttttagtagagagttggtttcactgcatttcccaggctggtctcaaactcctggcctcaagtaatctgcccacctcggcctcccaaagtgctgggattacaggcatgagccaccaccctcggccagatactctttttttttttttttttttccaaaaaaacactgtgttatttcaaaaatatcagaatgagattcttcagatcccttatttattttcccccacccccgccacacttagcccttcatgtagtcagagctgaatttgaataccaccttgagtgatcaatattcatat

SEQ ID NO: 41820 - DNA, 1043 bp, Homo sapiens
gtgtctcgtctcccctgattcttctcttggagtggactgtcctcatgcccagtggtctgccagcatttgggaggggagcatgtacagtgtgtttagtgaagttgtacacatgctcacttgaggcatttcgcctgtaccagtcgagtgttcctggaggaaggtcatataccagttaaactctgccattgtgcctctaagtacacatgcttgagcccactcacccaactcctgagatcttatggggaagctgctgatcaccagcttcaggtgtttatctgttgggagactgccattccctgggggcagctgtaaacaaatattattttagagagacagttttacaaccgcctgaccatcacctgatggtcgcttgacagtcctggtgtatggggtaggggagggctctctcctgtcctgctcatgtctgactagctacatgctctaacaataggagactctgtctctacaagaaataaaatgataaaaaactttagctgttcatggtggtgcatgcctgtggtaccagctacttgggaggctgaggattgcttgagctcaggagtttcaaaaccagcctgggcaacatggtgaaactccatttatacaaaatatacaaaaattggccgggtgtggcgatgcacgtctgtagtcccagctactcgggaggctgaggcgtgagtattgcctgagcccagaaggttgaggctgcagtgggctgtgattgcaccactgcactctacccttggtggcagagaacaccctgtctcaagggaggggggggaaaaagcagagttaattaggtttgaagaagacagccaaagaaaacaaagcagcacctcacacaggaatgactctgaaattacctgctctcttggttcacctgttagtggcttcctccacaaggagacagtcaagaaatctatctaagaggctacatggaagcactgtggagtcacagagcagagcatcttcccaatgtgtatagctctggggatcttcaggggtcagaagtgtccaggattaaaacaagatccctagcatgt

SEQ ID NO: 41821 - DNA, 1320 bp, Homo sapiens
agaagaaggaaactgggttcatagaggctaataaacctgtccacagttagccagctcaaattcaaatcccaatggtttgactttagagctcttaactcctgtgacctgcctgatgatttttttgtttttgtttttttgagacagagtctcactgtgctgcccaggctggagtgcagtggcgcaatctcggctcactgcaacctccgcctcccaggttcaagcagttctcctgcctcagcctcccgagtggctgggattacaggcacatgccatcacacccagctaatttttgtatttttagtagagatgaggtttcaccatgttgtccaagctggtcttgaactcctgacctcaggtgatccgcctgccgcggcctcccaaagtgctgggattatagacgtgagccacctcggcaggccacctgatgttttttggcacatagcatagtctatggtgtcaattaatacctatttattttagcagtggtgaggtaagaggtaggactcgactccagatgcgggacttggacactggacaagatagagaaataacaacaacaacaaacaaataaattaaaaaaaaattgaggactagctaaaacagggcctgggggaagcagctttccagtgacatgcccaccagtgtgccatgtcaattcatcattgccatggcaacacccaggagttaccacccctttccatggcaatgacccaaaagttactatcccttccctagatatttctacataagctgccccttaatgtgcatgcaattaagagtaggtataaatatgattgtaaaactgccctgaactgctactctctgcctatggagtagccctgctctgcacagggaatcaacagagctgtaacattgcctcttcaataaagctatttttttttttttttttgaggtggagtcttgctgtgtttcccaggctggagtgcagtggcacaatcttggcccactgcaacttctgccttccaggttcaagcaattctcctgcctcagcctcctgagtagcagggattacaggcacacgccaccacacccagctaattttttgtatttttagtagagacaagatttcaccatgttggccaggctggtctcaaactcctgacctcaggtgatccacccgcctcggcctcccaaaatactgggattacaggtgtgagccaccgtgtcctgcctgcacctaggttataatactagccttctaactggtcttcctgcttcagacctctgccctgtccagtccctcctcaattttcacaccagcgcgatttttctaaaacacttgcctgcttctgctttaaa

SEQ ID NO: 41822 - DNA, 1024 bp, Homo sapiens
gtcctatcagcagatgacagttttattgtcatattttaggaatgggcttaataagacctctagctcttgtaactatactctgtggtgcatgcctgtaatcccagctacttgggaggctgaggcaggagaatgtcttgaacccgggaggcggaggttgcagtgagccgagatcgcgccattacattccagcctgggcaacaagagcgaaactctttctcaaaaaatataatataatataatataatctaggtgcaaagagtgaaggcctgtggaaatgaagaggagaagctggatttgagagatacaggagacaaactctaagacctaacgactggatggtggagggagaagggaggaagaggtcagattcctggcctcagtgactgggtagttagtgatgtcttttcctaagatgaggaggaatatgttcggggcaatttcaacttcacatatgttatttgggatatctgtgggagagccaaatggaggtatttggtagttgcaagactgtgaaggataagccaggaaggatagtagagaatgatgtcacaaatagaaagggagtgatatattttagagatgtcaagaaatacaaagcctgcaaagtgtgtactggcatctagtgacaatggcaaaaccaacttcagggcagtggtataggcagaaggtcagttgagtgagttaagtggtgcgtgaatattgtgcagggaaagaggggcggtagttaaagaggatgtatatcaatgaggggatgtttattttttttgagacagggccttgcctcattgctcaggctggagtgcagtggtaatgctctcagctcgctgcaacctcctccacctcccaggctctagcgatcctcccacctcagtgacccgagtagctgggactataggcgcatcaccaagcccagctaagttttgcattttttgtagatgttgcatttttcgtaggttttgccgtgttgcccaggttggtcttgaagtcctgagctcaagcaatccacccgccttggcctcccaaa

SEQ ID NO: 41823 - DNA, 1081 bp, Homo sapiens
tcctaattttccttctgaaggaaaaaaaggcaaaattcctttattttcacgttaggcttcctaaaagcagggtaaaataaattgactatagatatatgtaagttgttggaagttaccatggccagcacacttcgtgatgaaggtagatttattaatatacatacagtcaatttctaattatttaaattctggttgttcagtttgagagttttctaagccctactgccctctcctcattctaccttttcaaaatttttttttttttttaaataactaaattctatgagtaggttttagggcatgtacttaaatagaatagtaaactttttaaaattttgaagtatttttatagtctactttgtgaatgaatattcctgatagaatcaaagcattttgaagctgtaatgtagtttagaactttttccatagaaatcgtaataattttttattttgaatagcctccaaaaatgtgtgtgttttctgtaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggtatggtgtactgcatttaacattattcatcacatggtctctgcatagaacctagaaatcaaaatgggttctgatgccagtctttttgactgagataagtagcatcttggttttctgtatcactaatttcagacaagattgggcacattcagggtggtatggccgtagacagtatcactcatctcaaattagaaatattgtcctgaattccatgtgtattatgaactttttaaactgaaaactgtttaaactttttaaacagtttaaaactgcaaacaaggaaaattttagtagtgtttggatgttaaacatgctaccggctcttgtgtaaaatacagcttttgatgggtttaggaacgtcaaaaagaactagcatgtcttcgtggccgatttgacaagggcaa

SEQ ID NO: 41824 - DNA, 1078 bp, Homo sapiens
aaatgtgggttaagccaaatctactgggttttgaagcaagaagtttgctgtaacgtggcaagagcagtgttagtgaagaggtgagggtggcgtgcaggtggtgctgtgtcgaggagggaacgggcaagaggagcagagccagtgagtgcaggcatttcttagtttggtcctaatggaggtgataaaggaggtagtggctagaagagatgaagaaaagtatgatttgtatgtgttttgtcctttctgagacctaagtcaatttgtgtgatgggataaggggtgataattgatgggatgaggtgagaatggatgaactccgcacagtgaagggaacagaactgatgaggacaatctcctgtgtgacgaaaaggaaggaggaaagtagcatgtaggggtgatggtagtcttagagttaggatagcaaaaactgatggactttcttctgaaagctcctgttttattcatccttaggaaagggaaggtgacaggggaaatactgtatggaggaaagaagagagagctgactcagacataggaagaatagggggtagtattgaggcttagatgagatatgagaccgtagattttatagtggaaccatttgatcgtttactttgctttttgtgtttttaaaaaatttttatgtattttttaatccactcatctgcatgctaattacattgtttttacacaaccaaagctgcttctaacttgagagacaataaagtctggaactagacctggaacaagagtacctgggtttgtatactggctctgccagtcactaactgtgtgcaagatacttaacttttttgtgtctcagttctctcatctgtaaaatggagatactagtacctaacatagagggttattgagaagattaggtgaggcaatagatataaggtgcttagaaaggtggctggcacatattgagctctgtataagtattagctgcctttattttactcttatttgattatttctactatgacttcattcataaagtcttcttttatttctttgctgaaataatctgtacaacaatataaagtctttaaacatacaaaatagtgaatgt

SEQ ID NO: 41825 - DNA, 1209 bp, Homo sapiens
gttccaacaaatttctaaccagggaaaactcattttgatatttagaaatctttaagtttagagaaagggcttttcctagtcatctgttccagtggatctattttttgttcttgtttttataaggtttaagaactctatgtaaaacaaattgtagtttgcatgaaaggtagaagcaaccgaaaggcatttgaagaaatgcagttgtgcagattgaatgaatgaatggatgaatgaatgaatctctatatatacacatgtacacatacattctctctctctctctctctctctcccttccttcccttatcaataaatagctaaaacaacttctgtgaattttgctgtgtgcgtatatgtggtgatgatggggcattttggggtggacagatgataccacacatgaaaactagccgaaagttgatgtattaaattataaggacttggtaaatgagcaaccaaggttttccccaaccacctaccatgttttataaagatagtgttactgatttcgtcttcgctgttacgtacagtttccatatcagtacacttttttgaatttgctctcattagaaacagttacgattttaatatttggaatattgcgttgttttacatagctgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccaggtatggtggtgatttttctagattgtgtgttaaattatgaacctcacctagattgaattgtacagaatagaaacaagtaaatcatgcataacaatgcaaagtttgtatctttggcctttaggtccttttattgagatataataaaaataagaaaacttcagatatatatagggataccaatctacacaataatggacattgctcttactgaaagtttgaatataaagttttattaaatgttggatatggtttttaaagttccttttaaaattttatttgtgtggaacacaaatttttttgtgtgtgttctggaataccaaagaaataaaggaatactgaactgatttatacacaatttattttaaaaaatttctttttgaggggaaggagggctagacataggtgagaagcaaat

SEQ ID NO: 41826 - DNA, 1049 bp, Homo sapiens
ctcaagacagacatttagtagaggtaaagatgtggatatctgcagcatggggaagcccagggcaagtgagggaagcagagccaactcactggaggagtgccagcattgaaaggacggatggaaggagggaagcctcagaggagactgcagggagagaaacggagaatctagcatcatggttgtcaatagaagagaacattgaaaggagggagtggttgagttagatcagattctgttaggactgttggacttattattgggtgatcattctggcgcaggtgagggcagatgctagactgcaaatgggtccagagtgagtgggagatgaggaatgagcacaggagcttggaaactcttggaaacactttggcagtgaaggagtaaggagagaagagtgttgtgcttgcagaggtatgtagggtgaaaggaggattttgtcaacattttgttaagatgggagagacgtaagcggctttaaatgtagatgggtagcttctaatagggccaaagagattgaagatagaggccatggaggacctgatctagggcttatggggtaattcatagagcaaggtcatgagaatgggaagaattaagcccaagccacaattcacaggatttatttgatacagaatttacagttttctcattatcagaggaggaaagtatgtgtgtagaatgcatagaagattgtgagtatggtacaagaagtagagaaaatccacttgctttggtgttctctgtgaagcaagaacttgaatgatgcaagggatgttacaagtcagtttgtaactgctgtcaaaggttcagaaagaagagctagatattaaggaaagcccggtggtctaagtaactgtagccaacttcccaaggattgggaattgctacttattaacagtattttttccttccttattaggttttatcacatataaatccagcaggtggcactagatagtcttggaagagtgtaaatttctgacttgaaggcagtatttgcctaatgaccttttcttttcatgtaaacatttttatattttattgttgat

SEQ ID NO: 41827 - DNA, 1029 bp, Homo sapiens
tagctctgcctccactgaggagcagcaagaggcaggcgctctggattggcagccagaaggttcaatttttgtggtctgtgtgatgtcacttaatttccttggccctctgtttcctcagctatagaaatgaaaaggccgtccttttcttattcctctctgattatagtatgatgtcataatagctggtgttaatcttgtttatcaaaagttaccttgtctgtttattacctttatgatgtaaaaggtgaacgttaacacaggagggagctggtgagtgatttgtgttaactttcatgcttgagattgaaataacgacattcctttctttcttccttggggagctgtaagcagtgttgcctagaaaaaggctgctttgggaggaaaatggaaggattaggggaggaggaaaaaggtgaggcaggagagcatatggttggagcaagccaattaatctgaggtgtcaatctagcttggtaacatttgctcccacacgtcatggccagaaattagactcttgattcaagccaccttttgggaaatttacataaaacagtgaattgagaagagtgtatatcctattgtcatagggttggagtaaggactagttgagataatttaaaaatacttagaggagtagttgagataatttaaagatatgcttagaatggttcctcacagcaacaaccaagtaatactagtttattcttagcttctcaacaatcagagaagtaaagttggaatatgaaggtaatctaaaatcaaacgcaaagatgcctttggatcatctgtatcagagggcagcacagcagccctcactgactgtttttatagtctttgattggaacataggctgatctgcttacttagcatctgtgactgcttctgtgccacagcagctgagctgagtagctgtggcagggaccgtatggcccaaagtctaaaatatttactctctggcccttatagaaaaggtttccctgatctacagcattgttatgtttttaccttgctttgttctttaacacagaa

SEQ ID NO: 41828 - DNA, 1060 bp, Homo sapiens
aggagcgagcgagcgagcaagtgagcaaggggaggtgccaaacatttttaaacaatcagttcatgcgagaactcattcactattgtgaggacagcaccaaggggatttcttgagaaatccgcctgcatgatccagtcacctcccagtaggccccacctccaacactggggattacaattcaacatgagatctgggtgaagacaaatatcaaaactgtatcattcactgatccacaatgccatttctcatgtgtatcaagatgtcattatatgtgtaggtttatttttaggctcacggttctgtttcctttggtctgtttccctatcccaatctcaatgaccgtagctttaaaataaatcttaatgtctgctaaggccagtctcctaacttatggagtaatgtatagtagttcccccttatccttagtggacgcgttccaagaccgccagtgaatgcatgaaaccatagataagtaccagacccacttgccatcagtcataacacgtttctgttgatgtcttacacccacaaatttaatgccttttgtattttaattaagcacttaccatttactgtggtggtaacttttgcagttggagatgtgacaacgaaactagcatgaatttctttttctttcctcacaatttcatggatagaagatttattcttactgtagatcttgacaacctcagcatacgattttttttctctccttattaagttgaagactttcaccttttcacttaaaggaagcactttatggtttgtctttgcatatctactcttgcactttggggaccttattaagtcagataggggctacttgaacacaagcactgcatactacagcagttgatctttttttttttttttttttttttctgagacggagtctcgctctgtcgcccaggctggagtgcagtcgcgggatctcggctcactgcaagcaccgcctcccgggttcacgccattctcctgccttagcctcccgagtagctgggactacaggtgcccgccaccattcccggctaattttttgtatttttttagtagagacggg

SEQ ID NO: 41829 - DNA, 1082 bp, Homo sapiens
cctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaa

SEQ ID NO: 41830 - DNA, 1033 bp, Homo sapiens
aaagttaactatgacaataaaaataatacaaatcaaaaatatagagtgtaaccactatttatatagcatttacattgtataaagattataaataatctagaaataatttatagtatacaggagaatatgcataggttatatgcaaatactaaaccattttatctaagggacttgagcatctgtgaattttggtatctacagggctccaatcttccatggaggtagagggactaatcagtgtgattttctcaacctctatattgagagacagacaagggagaaggggtacaaatgcctgctgggtcttttagtaagggatccaccatagcactcagatgttctgtccttcatctctctatcccacctggatgaattagcccttctttgttacgtagtagagcaattcatatgtgtacatgtaaaatgatttgtttccctgttaaacgttaactgatgatgataaacacaaatatgagattttcctgccatggttatgataccttacatttatataacaattttatatctattatctcaaattctgttcataagaatgtcataagtttcaaatttttggtctctccatatgagaagtagagagatgacatttattatcatacagctcatcaatagcaaatgaggaagcttgattctttgacctaagctttttaaccttttacgttgtctgtaaaccttatgccaaattaagaaaactagaaagttttttttccctgcttctagtagggtaaacttttagtatcttttctaatgcagagaaattaatgaagctctacatctagttcaaaattccagtgtttttgttgggtaggggtggggaggtgggacagttagtagtatctcataaaatatgagatgggaatttcatttgatccaatgatcccattctataaatttttttgctgggatataaacacagaaaggtaaaaggttttatctccaattcatattcagcatcattaatattaacaaaactgtagaaataatctaaacggacatgatttgggaactagca

SEQ ID NO: 41831 - DNA, 1050 bp, Homo sapiens
tggcatctaaagccaactggtgtggatgagatcatttgtagatgagcactgagcaagtgctctgctgcattctgaggatgggaacagggcctgcttcatggccacatgatcttggcagtcgcacaaaacctcttgcttaggaggaaccggtgcttgattgaatgctctgctctcactctcttgaaactgttaataattttttaacaagggcgctgcattttcattctgcactgtaccttgcaaattatgtagcaggttctggttggaaacataaggatccaaccttacgaaaggaaagagccagtgaagtaacctgaaaaccaagcaagtgtgaggaggtgtcataaaagtcaagggaacaaattgtgtgatgatggacagcatgacccacagtctcaaaaagatgatgcaaggtcatattacctcaggactgaacactgatcattggatttagcaacttgcgtatacttgttgcccatggtgcagtaagttgaagagaaaagaaaagaacaaatgttgaatgtgaataactcttgcaagcacttttcttggaaatgagaagcttaaaattgggtaggagctgagaaagatacagggtcaagagagggtttttttaagatggagataagtgttataaatgggggagtaagcaccttttgtggaatctttaagcaacagtccagtacggctgtggagattacactggggagccatatgaattaaaggatttactgtatttacaggttctacaaagggaggcacaacataccttgcaggagtcacctggagggagcaccaagggagcaggctcaaccaagcagtggaggagccaagagaaagtagggacctgtggacaagcacccttattgggcatcaggatggggtttgccagcaaacgcaggagggaatattatgggtatgcttgaatgtcactaggccacagtcagggaagagcaagaagggggacttgtggcaagaccagccttgtcacattggtgcacctggtcatctgggaaaagtgcccacaagcctgtttctctggagatgttg

SEQ ID NO: 41832 - DNA, 1048 bp, Homo sapiens
ctatgtggataaatttacagaatgttacttagactgtaagacctagctaatggagagacatcatctgactagatgagaatattcagtattatttatatgttgattatctcagccttctccaaattaattatgtttaataaaattttaatcaaattattaagtttttttggaagttgagtgcttgactccaaatttcttctggaagaaaaatgtgtatgaataccttatatttgataagaatgtggaaaggtttgctctattatatataaaaaataaagctaatcaaaacaaaattaaaggacaaactatattataaatattcgttaaaataattataaagactgtctacaatgggcagggcatggtggctcacgcctgtaatcccagcactttggaagccagatcacgaggtcaggagatcaagaccatcctggctaacatggtgataccctgtctccactaaaactacaaaaaaattagcagggcatggtggcaggcgcctgtagtcccagctactcgggaggctgagacaggagaatgctgtgaacccaggaggcggagcttgcagtgagcacagatcacaccactgcactccagccttggcaacagagtgagattctgtctcaaaaaaaaaaaaaaaaaagtctacaatggaaaattagacaaagcatttgaacagacaagtcacaaaaaaaggaaagaaaaataggcccctcaaatgaaaatcttctaaattttcttccaacaacaaagacgtgaaacaggaaattagggtttgatcactgcttctttgttttgttatggttgtttctctttcacatataagaggtttagcaatttgacacccagtgtatttcagacagaaatgtcacttatgtctgtggtaatgtaattttgggggaacattgtactgtatctatagtttaaagtgctcttagtttttgacctagcaattccacctgtagaattttttttctacaaaatagacatataaaaatacaaagatacgccaggtgtggtggcgcacgcctgtaatcccagcactttg

SEQ ID NO: 41833 - DNA, 1033 bp, Homo sapiens
taataaaatacaaatccggcacaagttaggcagcaaagtattcagcatattatctgtcacctaaaatgtcccaaagagtatagaatattttcttgcaaattaataataaatatataacatctgttaacaataaaaagccctattcaccaatgtgctttgtctataatagtaattttccattttaaaaacaggtattggccatgacacccatagtgtcaactttccatgttgtaacaagaaagtcattgttttactcttcatatggggtatatgttttgatcaagatgtaaacataccagtagcataaatgtgcatatgcaaaagaaaactatgattcatggactaaaatagcattcacaaataagctggcattgcttttgaactttgctaagataagagttcaattgttttgccttagcaataggaaaacaaatgtaagccagagaccatggcttctaaggatttaagatcctcttgtagacccaagatatatacaggcaataggtcactgagcttagacaggctgtgcctttttttgtgatacgtatatgcaaatgctataaaaatgaaaaaaatgttgcttttcaaataaatatgatagataagacttggagaaggacagaggaaaaccagactctcaagactggggcaacaccaggaaaaacagagaacaaacttccaaaggagcatgagttgctcaaaggacagcaaaatccgtttgctttgagggaaagccagtttaaagagcatgcaatttctcctgagttcaatgggaagacagtgggagattgagcaaggaattaatgagctcttaggaagactaattttaagactatgtgtacagctcatgaccttttcccccactccctttcaaataccaagttctactattacaaaaattcaggccgggatctgaggctggcccaggagcctagagtctccaatcagggtaatgacagtatatatacctagaaagggcaagtagtttactttccccatctgaacgagcaatgcttttagcaaaactgtggtt

SEQ ID NO: 41834 - DNA, 1029 bp, Homo sapiens
ctactcttattacagcattcattatcttttatttatttgcttttttggctgttgttcctgctagtccatatgacatgacatcactcacagaggaggaatgcaattggtatttaaaagacaattgtcaaataaatgttaaaaaatgaatgaaggccgggcacggtggctcacgcctgtaatcccagcactttgggaggccgaggtggacagatcacctgaggtcgggagtttgagatcagcctgatccacacggagaaaccccatctctactaaaaatacaaaattagccgggcttggtggtgcatgcctataatcccagccacttgggaaggctgaggcaggagaatccgcttgaacctgggtggtggaggttgtggtgagccgagacatgccattgcatcccagcctgggcaagaagagcagaactctgtctcaaaaaaataaataaataaaaataaaaataaaaaataaatgaaaatctagatttgatgtttgatttgtcatttcagtctggcgtgtaaagaaagctgccttataggcagatccttataaaagagctagatgagataagggaataatattttgaaatcaaacagatgattaacttaaaatgagatagaatcagtaacaaaataaccaccactccatgaagtcaaatcagtgttatggaggacaatcttgaaaagttctccagaatgtactgagacaaaagtaaaaatatgagaaaattataggacggaaaatgcaatttgaaaaatagtatgatatcaatatattgcatatgaccaaagaaacagaaaaaaattaattcctttggggagaacagaatattaggtgagtttataaatgaataaatgattttttaaaaattttacatgcctctgttatacagaatccagaaagaacaaaaacaagcatgagtaaattaatgatatatgtaagaatatcacccagaacgtaatatggagatacaacaggatggaaaacagagagaaattcagaaatatggaagatataatgatgatataa

SEQ ID NO: 41835 - DNA, 1039 bp, Homo sapiens
catacaatgatagttgcaatttttaaactaattgaatacctaacacatgccaggcatatctttgggtgctaagaatatagaatgttctctaggagttttcagtatagtactgagaagaagacatgaacaatatgtgaaacatgtgaaagactggaggtgctcttaaaggtatatgggatatatattatacatacgtggtcagagaaagtttcatccaggaagtgatacctaagctaccttgaacaattaataggcttattcttgctgttaatatgatagtttggtggttcaaggaaaaggcattccaggcagagggagaactggggcaaaggcaggatggcgaaacttcctgtgtcagtccatatgtgtcgcttcctatagatactttaggctggataattttataaagaaaagaggtttaattggctcacagttctgcaggctgtacaggaagcatggctcggcttttggtgaggcctcaggaggcttacagtcatggcagaaaaaaaagctggagcagcatgtcacatggcaagagcgggagcaagagagagaagggagatgccacacatttttaaacaagcagatctcatgcaaactcagagtaagagctcactcatcaccaaggggatggtggcaaggggatggtgccaatatatagtatatgatatatactatatatagtatataaccgatatagtatataatatatactatatatataatatataacccatatagtatataatatatatataatatataacccatatagtatataacatataccattcttgaaaaacttgctctcaaataatgcaacaaaacaagcaataaagaaaattatgactatggaaatacatatatatataggcagcatatatactatatatatgtatttccatagtcataattttctttattgcttgttttgttgcattatttgagagcaagtttttcaagaatgctgctagtttcaaacttttattgagaactttatgaaattaaagagatcctactacttttgttgtattctctg

SEQ ID NO: 41836 - DNA, 1824 bp, Homo sapiens
tttgatggaaagaaattcctcctcaggaagtaaggatatttgtgtgatttttgtttttcgtttgaggcagtgtcttgctctgttacccaggctggagtccagtggcatgatcatagctcactataacctcaactcctgggctcaagcgatcctcctatgcagctcctgagtagttaggactataggcatgtgctgccatgcgcagctgatttttcttttttcttttttgtacagacaggaccttgctatattgcccaggcttggaaataagcttttttatagctaatttacacattctgcttacatgctccaggaaagcattcagtagatgattttctagcccatgcacagttatacttacaggactgtggaggttttctccctgtcacagcaaggtaactgagtcgttcaccaagaggtttggtccaggtcatcaggaacacctttcagttgtagctaacatcctgccttcaccctttcctacagtcagtttgcttcttctctcttgccattctttgctaaaacagctattttgtagtattgctctaaaacattatgtgttgcttctcatttctctttctctttatgtcttcatgaaaacataaatcagtcaaggtactctgttgttcagttagagaaatagttgcacagtggagagggttgcacagttatatttgatcagcttggatttaacatggtgtctcttttttatttcccaaaggtgtcttctctttagggatggtgaggttggaaaaaggctcctgtaaccctcctccaggatgaaccacctgccagaagacatggagaacgctctcaccgggagccagagctcccatgcttctctgcgcaatatccattccatcaaccccacacaactcatggccaggattgagtcctatgaaggaagggaaaagaaaggcatatctgatgtcaggaggactttctgtttgtttgtcacctttgacctcttattcgtaacattactgtggataatagagttaaatgtaagttggtggttctttcataactttttaagaagtgtttccagagacaacagggtttttttgttcgtttctcttatcatttgtttcatttagtaatttccatctttttccaaatgaagccattgcttttctcctcctgatttggacctttcttgttctttaatattattgtttaaggcaaatgtgatcagtttaaaactcatgttgtctggggttttgaaatttgaattcctggtattttgctctgtaacaggagttgacaaactataggctgtaagacaaattcagtaggcctgttttaataaagttttattggaacgtggccaggcctgtctgtttacatattgtttatggctggcttttgcactgagtagttgcagttgaatagttgtgacagagaccctctgacccacaaaggcaaaaatatttgttctctagtctttttcagaaaaagtttacccatccttcctccagaaaatgtagaatgcttttggaatatgttttagatgtttcatgtacttttctagttcctaggtttaagattttgcacatgtttgttctttactttcttgcaaagagattacttatttatatttcatcggaaaagttgtcctggaggcatttggaggtttatgcagttattctgtattaccaactaattgtttagaccagtactgtccaatagaaatataatgcaaactattaaatatgtaatttaaaattctctagttgccacattaataaaaatcaaacagatgaaactcattttaataatattttttatttaacccaatatatgtgttttcttcccaaagccttt

SEQ ID NO: 41837 - DNA, 1095 bp, Homo sapiens
tggagaaattggaccccttgtgcattacgggtgagaatgtaaaatggtatagccccagtagaaaacagtatggtgtttccgtaaaagattaaacatagagttaccatatgattcaacacttctacccctgggtatgtacccaaaggaaatgaaagcagagaccacagcagatatgtgtatacccatgctcatagcagcattattcacagtagctaaatggtggaaacaaatcaaacagctgtcagcagatgggtggataaacgacatgtatgtacatccaatggaatattattctccattaaaaaggaatggaaagctgggcacagtggctcatgcctataatcccagcactttgggaggccaaggtaggaggatcgcttgagcccaggagctcaagaccagcctgggcaacatagggagaccttgtctctattaaaaaagaaaagaaaagaaaagaaaagaaaagaatagaattctgacacatactataacatgtatgaactgtgaacacattatgctaagtgaaataagccagacacaaaaggactgtcgtatgatttcacttagatgagatacctagagaagtcaaattttcagaatggtgatgatggctgcacaacagcatagatgaactgaatgcactggatggcatgcttaaaaatggttaaagtggtaaattttatgttaaatatatttttctatggtaaaaaacccactatttttaaaattgctaacacttttttaagtgtcaggtgctgttctaagctttattaatattcactcatttactcctcccttgtctgcttatcttctgagatacagatcacaaaccatagtgtctaatcactcctccattacatccattttttataagtctgtgtcttaccactaatctcttgtaagattgtgtctaacctattttcatattcttaatgcctggcatattagatgtttgctaagtgcctccactctgtgatgtaaaactcgtattatccctaatgtagagatgagcaaatgtggcacagagaagtgaagcaatttacccaatatcacactaataataagtggtgtagctgggatttgaagctggggtcc

SEQ ID NO: 41838 - DNA, 1119 bp, Homo sapiens
tgcccagtacctcggctggtgatatcagccccacaaagcccttagtgatctgaaagtttcctctcccagtgcagaaatcattccagatttctctatagaggccaggtatttgccctaaagagattcaatcaattcatgagaatcaaggagtagatctaaattaaatttgatctttcttaagtctggttggtcttgctttgtttacaagtaggattctctacttggtttccaaaagaacatgtttcacagaaacaagctgattgtaggcaaaccagaaaaccttcccaatgttcagtaacacattgttttaattctaatatataaaaatgtttactttaaaaggattcaccggagaaaacagaaaacacacaatcacttattttttcacccacataccaacaatgaacattgttttatctttgtctgcagaaatacacagacacacatataaatgaatggcatgcctatttgtgttattactcagtagaaaaaatggccaaaggacatgaacaaatatggcacagaataatataaaatagaccttaaacataaaaagatgtttatcttcactcacagtaagaaaaaaagcaaattaaaaccacaatgcagtactatttttacctgtcaaattagcaaaacccaacattaagcagtaggctgtcagcactcacacacattgtgggagaaggggttagggccatttctatggagggcagtttggcagtacccatcaaaattaccagtgcatatgttcaaatgacataaaacactatcattcatttcagcattttttataatagcaaaagactggtactaaaccaaggcaccgattgaaagtatgttcaccagtgaaaaatatctgtatttagctgggcacagtggctcacacttgtaatcccagcactttgggaggctgaggtgggcgaatcacttgaggtcagaagttcgggaccagcctggccaacctggtgaaaccctgtctctactaaaaacacaaaaattagttgggcatggtggtgggagcctgtaatcccagctactcgggaagctgaggcaggagaatcgtttgaacccaggaggcagaggttgcagtgagccgagatcagccactgcactcca

SEQ ID NO: 41839 - DNA, 1029 bp, Homo sapiens
ctagttctcctctagttctgaattctgaaaagtgaaaatgacatatgattatctacctttcacttttacacctaggcattggggtctcttcattctgtttattatttagacccactgggaaaatattagctgagccattggcccaagaggttgtcttgatagcaatatctaccagttagaaagaaaatcttattttatgacttggttttttatcaactttttaccttcttcttagacttattaagaagaggctcctgtctgcgtcacatcattcagtttgttggaaagactattagttctacatgctggattaggactgaacactaatgcaagtctctttccatctaggaggaacttagtttttgcatgaaatcatgttatcatctgcagtaaaaccttagaggtctccagtatataatacatgggactgcacatagttccagctagattcaataggagcatcagtggggaaagaatcctgaaaaagtagaaagaagaccacgtaatttgaccaagaagatcatggttctgatgccttttgttgctgccctcaccactatttccaaccctttttccacaagcatagtgatggcagcaaagtccagatggcattttgagataagcactagatatatagatgagacactgaaatattattcatgatttagctactttgctttcctctcactgaccatttcagggagccatatatcaggaagtcttgggataaatgctcagagagaaagaaacaagacgttaaccaagttgaaagtgaacccaaggcttttctgtcacctgctactaccttttaaaattgtctcattggagaaatgttggtcaacctttaggaatataatctatgaaatcatgtttgacttccacaagcaaatatgttctgagcccctcctatgtgtcaggcatggtgatgggcactgggacgacaggaggagaccaaggaaggcctggtttctgaggggacattctgctgggagggctgacatttaactaaagatgtgcacagacagcaca

SEQ ID NO: 41840 - DNA, 1034 bp, Homo sapiens
ttcaacaggaaagaaagaacataccccaaacaggcaaaaggttttaatctaatgaagccctcactgtctatttgtaggtggtgatttccctgtattcaactgtgctcagccttgatttctcttataaatcaagattggctgcataaatgtagctgtgagctctgcaaagcggactccttgacccactgattaaagtatgaatgcattaatttaaagtagcttttaaaactcaggtattgtactcagcaagtatgctgtttttctcccaccacaaagcataattaaagataagttttcaggagaagaggcaaggctgtcatttttttaaccttcagaaacactagaagattcacttttcagtttctaaattagaatccgtcagtttgactgcctctgtttcttttggatgtaatgcctatgatatgtgatccagaaagctgaaagcatgcagacctactaaaatgcatttggggattttcagaaacagattattgagtgacaatatgatagccttcaggcttgctgctggaaattattatttaacttattttcctcctaatgtgttagtaacatgtacctattttctgaagactgccgaacacatcatcaaatgacagttcaaaaaacatttttaagtttattatttttctttttatgtaacatactttgagagccaggaaacaacattaaaagatgtgtttctctcaccatttctccttactcgtgctgtttgaagaggtcacaatgaaattgcaagttcttgagtctgaataaagaacacctacaaatgtttgagctcgggtgtttgagagagtccgaggttatttgcagaagtgagtgggttaggcaagggggaagaggctacagagagtgattctgtctcatggatgtagcatgtccctcacaagcggccagcagacagggcacccagccacataggacagtgccaggtcccctctggctgccattatctggtggtgatgtctgagagtatacagtggtattcagtttcctcagcctccaatgtcatggta

SEQ ID NO: 41841 - DNA, 1066 bp, Homo sapiens
gggaataaaagcaggctgcccaagggtctagttgcaggctgcccaagggtctagttccatgttgtggaagctttgttcttttgctgtttgcaataaatctttctgctgttcactgtttgggtttgtgttgtctttgtgagctgtaacactcactgcaacgggctgcagcttcgctcctgaggccagcgagaccacgaacccattggaagaatgaacaactccagacgcgctgccttatgagctgcaacactcaccgcgaaggtctgtagcttcactcctgaagccagtgagaccatgaacccgccagaagaaagaaactccgaacacgtctgaatatcagaaggaacaacctccggacacaccacctttaagaactgtaacactcaccgcgagggtctgcagcttcattcttgaagtcagtgagaccaagaatccaccaattccggagactacatcgtcatacaccaggctaaacagttacgttaatataatagcatttaccagtcattacaaattttacaatgaataagttaatattacaatatagcaaaactttaaaaaatacaaaattatgttttagtatagtttccgctactaagaaagtgcagaaagaaactacacaaaggcaaaaactaggtgaaaacaaaccaagatgttagtttctagcaggatccctggtgcatagttctaataacagtaaggagctggaggaaaaagagaggggaagtaatggttaacgcaggcagtgtttactatatgtaggcactatattctaaaagctttacatatattaatttctttaatcctcataatagccctctcctgcagagctgcttttatgcccatcttagagattaggaaatcgaggcaccaagaaggctaagtaatgtgtccagtttgtagctactaaatggcccacttgagatttaaaccaaggcaagcctggttccagagtgtgtactcagggtggatgcttactaaataataacatggtagcagtgactgtgtttagtagggggactgtgagctatgtgtttactttgctgttaatttctatttttctatg

SEQ ID NO: 41842 - DNA, 1050 bp, Homo sapiens
caagtagctgggactacaggcatgcaccaccacgcctggctaatttttttaatttttgtagagacagggtttcactaggctggtctcaaactcctgagctcaagcaatcctcctaccttggcctctcacagagctgggattacaggtgtgagccactgcacccagcctgagactgtatttttaaatgtgaaggtaggagttctgtatttaaatttgtatttctcataactattactaatagaaagataatccattaatccattttgatcactaattctgttctgagcttttgtgctttccgtaattaaaggtaatttgcttaagtatctgacatctccattacaaaatgctctccagttcccaggaggccccaggagacttatgaagggcaattccaggaatgcagctgcagcaagaccaaaggagctgcaggcagtcgcatttaggaaactgtggtcttatttcaagaaacaatgcttagaggcggtagacagatgataaggtcacacacttcaccacaagagacggagactatgactcaccgaaagtccctttccaaaaaccttgggacttagaggaagaaaacaactgacatgtgtcataataaaatatgtacgtgttatggtttacagtgtgtgattgcagaaatagcaaaatacagaacacaagggaatgtaatttgagtacagcccagccatatcaataggaaaatcataagagtgtatacataagtcattactgaatgcatgctatatattaagtatttagtacattaagtatttactaagccattgcactaaacataatacacaaaataataccgttaagattcccaacacaacttaaatggtaatctttttaattaatggagatattttaaaacagataatcatttaatcttagagttgtcatgaaattaaattatttttttaaagatgcttattgagtacttaagatatgtcagataattgctaagggttttatatggactatgttattttattctcataaagtggcaatatgatccctattttacagataaagagctaa

SEQ ID NO: 41843 - DNA, 1054 bp, Homo sapiens
tcctgcctcagcccccaagtagctgggactacagtcacgcaccaccatggccagctaattttttgtatctaaagagacagggttttgccacattgcccagtctggtctcaaacttctgagcttaagcaatctgcccaccccagccgcccaaaatactggaaattacaggcatgagccaccgcatccagcctggttatttctttacggtttgtttctctgctgagatttcctatatgttcattcatttaaattatgttttcttttacatccttaggtatagttacgataactgccttaaaatctttgctaattacaatatatgaagcattctgtggttggtctctagtgattgtcttttccttagagtgttggttgatcacattttcctgtttcttcttatgtctagtaatttggggttgtatcctggacatggtcagtgaatgataaattggagaaactctgaactctgttatgttcttctcaagagtattaatttttgttgtagtagacagataacttttcagaactcaaactccaaactctaccccctctatgttgggcagtagctgaaatctttgttccattcttttagccatgtatgggcttctcaggttctgccctgcacagggatagtgcaggaatcagccagatttccaagtagattttatattcacaaactggggctcctcatctgtggctttctcctttctagaatcttctccctcacattccagctgtggttgctccaaactctgactcttaatacataacctgtatgattatgagtctgtgagtattagctacccggtgcaagccttgctggagcccaccctcaggtaaagagtcataagaaatggaaaaactcacccaatgcctttcttttcctctaaatttgattcctttccattttctgcctactttggtcccttctcaatgccttcattttttttttattgctttgttcagagtttataagtattacttgtggaatggttggtctgatacatgctactctcccattaatggaagtagaacctcattttttttttttgag

SEQ ID NO: 41844 - DNA, 1054 bp, Homo sapiens
tgcttgtggtcccagctactagggagctgaggtgggaggatcacttgagcccaggaggggaggcttcaatgagctgagatcatgccactgcactccaggctgggtgacagagtgagaccccatctcaatttttaaaaaattaaattttaacaaaagatacttaaggagatggatgtggtaagaagcaggaaaggtcaactttcctagtgcatggtaggaaaatacggtgtttagcatggtaactgctccatggtttctcagtttatacaagcagccctgagttttcttgcttctctacacagttttctggatttcattttgttttttacccagctagttatagatgccacagggtgacctccttttcccttctaggctaaagctgtcataggtctatgaaaatctagggattcccttctaggcttcacagtcttaagtggtgtgtgtgctttgcagatgagcaaggcttgttttgtattgatatgttgctgccttgacttcttggatttctagatcatatagcaaggtaaatgttagtctgttctcgcactgctataaagacatacccgagaatgggtaatttataaagaaaagaggtttaattaactcacagttccacatggctggggaggcctcaggaaacttaaaatcatggcagaagatgaagcagacgtgtcttacatgtcagcagaaaagagagagaaggggagagagagaatgagaattcatgagagtgagcaggagcgagcatgtgcatgcaagagcaggaaaaactgccttataaaaccatcagatctcgtgagaactcactgtcacgagaacagcatggaggaaactgcttccatgatccagtcacctcccacctagtccctccctcaacaagtggggttatggcgattataattcaagatgagattttggtggggacacagccacaccctatcagcaggtttgtaattagatgagtttatccactggggggtaatcctagagtacatatctgtgggtggttcttgacaagtgtgtaaggcctgggacatctggctttgaggca

SEQ ID NO: 41845 - DNA, 1050 bp, Homo sapiens
gctgtgaacattcatgtacaagtctttgtgtggacatagttttcatttctcatgtatatatacttgggagagtaattattgggttgtatggtacatttatgtttaacctcttaagaaattgccacactgttttccagagtggctgcacattactttgcatcctcaccagcagtgtttgagggcttctctttctctgcatgtttatggacagttgttacacagtaagtcctcacttaatgtcataggtaggttcttggaaaatgtgactttaagtgaaatggtgtataacaaaaacaattttaccataggttaattgatacaagagttaagtttctgtagcatatttctggtcacaaaaacatcacaaacttctaaatcaagacccaaaacacttctaaacattgaaagaattgtgagctttacatacctttcagaaagattgatacaaacaagtaagactattacttaacccaattttactcacccaatcagtgagtgacagcagttgcattggtggttggtcaaatcaaagaagaaatctttacaaagtgaaaattgtaaggagaactttctgccaccacagttaaaaaagaaatggcggtgatgtgcgcacgtagtcccagctccatgagaggctgaaataggaggatctcttgagcccaagagtttgaggctgtagtgcattatggttaagactgcatagccattgcactcttaaccatggcaacatagtgagaccctgttcctttaaaaagtagagggagagaaataataacaaatatggcaggctttctgagcacttttatatcatatcctgtgttttcatgcatttgtcctatgatcatagactttacagatttttattttctgataatttgtattcatccattcattttccaacctgctttttccagttcaggctcttggatggtgagagcctattccagcaactcagggaaccaggctggaaccagccttgaacaggacaccgtcctgttgcaggatgccctcatgcacacacgcacactcactcagacatggacaatttag

SEQ ID NO: 41846 - DNA, 1050 bp, Homo sapiens
ttaagatcaaagtatcagcagattcagtctctggttccaagatggtcccttattgctgcatcctctagggaggaggaatgtggtgtcctcctatggcagcagagcaagagagggtgaaagggcaaggtgaaaagtgatgaacctgtccttttataagggcaccaatcccacccatgagggtggcctcttatggtttactcacttcttcaaggtcccacatcttaatactgtggcaatggcagttaaatttcaacatgagttgggacaaacattcaaactgtaatagccattccccaccccatatcaattcttactaataattcacatacaaattcaccaaaagtaataattgtaggtataagttttatgatatttgcattagtttttaaacaggaccatagtagggcttctagggatgaaggtccgttggttttattgggttctcaaggatgactaggatattcaaatcctcagttaatttgcaaaaattgttcagttgctgtaatcataggagtaacataaacctgttggagtggatataagaataaagcaattctaatattcctcagactcctaaacttcataatacctgtataaggtaagaagcaagaaaagttttacagaggtttgctactttctagagtgattttagtaaatgcctatcagaggatttgaatttctttgtagtcaaatcttgatgtagttgaattaattaattttattattattattattatttgagatggtctgttgcccaggctggagtgcagtggtgtgatcttgactcactgccacgtctgcctcccaggtgcgagcaattctcccacctcagcttctcaagtagctgggattacaggcatgcaccaccatacatggctaatttttgtatttttagtagagatgtggttttgccatgttagccaggcttgtctcaaactattattattgttagccaggctggtctcaaactattattattattattattattttttgagacggagtctcactctgttgcccaggctggagtgcagtggtgcgatctcggct

SEQ ID NO: 41847 - DNA, 1075 bp, Homo sapiens
cttaaatttattcccaagccttgtacattatagttgcatcctgtcaagtgaactgtaactagcaattcaaaattcagagttacttgaatgttcttgtttctgagtatttcttgggtttatgagattgacaactctatttaggccagagtatttagtctactggaattaagcaaatacaggtcccatctattcatgtttgctatttctcaatttaaaatcctatagcatgtaagagcattagcattttatttgtctttctttcaatcctttagagttaagactcactaatttgggattagttatgactctatgaggctactactgatttttgataggaacaagaacccaggaaaggaaaaaaaggtaatttatgagctgcagccaattatctggcaaccagaatgccttgttgttaagagtctattgtaacaagtttctttgtcttcatacagcacctgttactgtgcaacaagaccgtgtttttgaacacctggcataacatgaaactgttaggttatattgtggctaatcctgaaggaagttagttgaactctggctcatttatttaaactcagtcctccagcatgacagattggtgaatgtggaagtgggtaccagttactaagtaaaacaaacatgctcagcccatctcttgatctggaccctggattttgggataaagtgaagggatgagggtaagggatgttcacttcagaagtcattggggagtttccagtgatgtcacatctgactaccctggcatggatatatagaatctcttggatcataccatcctggctctgttccagttttgtttgtttgtttgtttttgtgtttttttgttttgttttgtttttgagacggagtcttgctcggtcacccaggctggagtgcagtggtgtgatctcggctcactacaacctccacctcccgggtttaagcgattctcccgttcagtctcccgggtagctgggattacaggcacctgccatcatgctcaggtagtttttgtatttttgtagtgacggggtttcaccacgttggccaggctggtcttgaactgctgacctcaggt

SEQ ID NO: 41848 - DNA, 1084 bp, Homo sapiens
ttagagtctatctcatggaaagtactttaaatgtagaaataggtggtcatccattataattttgaagaattcaaaacagctctaatgtcttatattatggtttatggtaagttaattgctttgtgtctacaggatgatatattacatagccattaaaaattacagctatgaagtcagtaaaacaacataaggctgggcgcagtgactcatgcctgtaatcccagcactttgggaggctgaggtgggtggatcacctgagatcgggagttgagaccagcttgaccaacgtggagaaaccccatctctactaaaaatacaaaaatcagctgggcatggtggcgcatgcctgtaatcccagctactcgggaagctgaggcaggagatcacttgaacccaggaggtagagattgtggtgagccgagatcgcaccattgcactccagcctgagcaacaagagcgaaattccatctcaaaaaaaaaaaaaaaagaaaagaaaagataaagtaaggccaggcgcagtggctcacgcctgtaattctagcactttaggaggccaaggcgggcggatcatgaggtcaagagatcgagaccatccaggccgacatggtgaaaccccatctctactaaaaatacaaaaattagctgggcatggtggcggttgcctgtagtcccagctactcaggaggctgaggcaggagaatcgcttgaacctgggaggcagaggttgcagtgaaccgagatcgcaccactgcactccggcctagcgacagagcaagattctgtctgaataaataaataaataaaataaaaatacaagtgggacgtaagtagtaaggaatgcaaaaggcaaaatgatgtataagaatttaatacatcctttccctccccctcttgctccatctctgtacttgattttaagatctttgaagtcaaggatcttgacttgctcacctatgaacctatcccccaccctctcccaatgcctagcatagtacctgactcaataaatacatgttggtgcagaatatagtcataggaaaaagaaaaaggaaatccagaagcataccaaaagatcagagaagca

SEQ ID NO: 41849 - DNA, 1050 bp, Homo sapiens
aagccatcaactactgtacccttaaaacagaatattacttttcttagttcagtctttgttattattttgtgttcttcttattcagtacaattagagtaacgtgaaaatactaagttgttatgtttcaaaagtagaaaaatgccgcagggattttctttgaatgttgttcctaccgagcttgatggcgtatttaaaatggagggtttaactatttaggatgtcagttataactaatgtcatttttttgacttccttccatctctttataataaattattaactaaataataaggctttatttgtaaatattcaaaacatagtagttaatttgccacttaaaatgtcaaacatttttgagacaccaaaagcataaagaaaaatactcatcaaaaaatatgtcaagaaaatgaaaagataagccacaaactggaagaaaatattttcaaaacacatctctggaaaggatttgattcagaatatataaagaactcttaaaactcacttaaaagacaaaacaaaagttttttaatggacaaaagatttgaacaccagagtcatatggatggcaagtaactacatgaaaagagctcaacatgattagttattaggaaaatgcaaattaaaaggaaataccactacacattcactagactgcctaaaattagaagcctgggacagtgccaggatgtgaaagcaactggaaatctcatacattgttagtggaaatgcaaaaaggtacagccactttgaaaaacatttaatcacacaccatacaacctaccagttctgcatctgttgtttacccaagaaaaatgaaaacatgtgtagacctgtacacaaaagtttatgacagctttacttataaaattttaaaaaatggaaataacataaatcatgatacatccagacaatggaatactattcagtcgtaaaaaaaaaaaaaaagatgcatgcactgatacatgcaacaatatttgtgtgtctcaaaagccttgtctaacagaaagaagccaggcataaaaagctacatacattatgatccaaaaggca

SEQ ID NO: 41850 - DNA, 1035 bp, Homo sapiens
tgaaatgcctgggatcagaagtgtttgggattttggattttcttcagcttttagaatatttgcattatacttaccggttcagcatccctaatccaaaaatcccaaatgctcctatgagcatttccttagagggtcatatcatcactaaaaaatgctggatttgggagcatttcacattttggatttttggattagctgtgcttatcctgtaatgagcttctctatcgaaaatctaaagaagataataatgaattctggacatacaaagatcattggggtttttgttttggcaggcatggggtatttgacaccttacttggtagagtattccttagtaagtattgaaaaaacgggttgattgttttttagaataatttttaaagtttaagatagagagtttagagtctggattggagatctgtggtccgaagctccttgacccactttcctgtgtatggtaagcagtaggctgagtaatggccccacaaaatatccatgtcctaactcctagaatctgtgaatgttgctctgtgtggcaaaaaggaattctgccagcataattaaggattttgaagtgaggagattattctggatcatctggttgggccaaatgaatcaccagtgtcataaaagggaagtagagggaggtttgagtttggctaaagtagaggagaaggtagtatggccacagaagcagagtggtgcttctgtgatgcggccaggggccaagggatgccccaggctctagaagcgaaagaggcaaggagcacattctcccctgaagccccctcaaggaaccaaccctgttggcatcttctttttagccctttaagattcattttgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatca

SEQ ID NO: 41851 - DNA, 1034 bp, Homo sapiens
aataagaatagcactttctaaatcttcctcccaagaaccaataaccctactttaatcatgaggaaaacatctgacaaatcccaattgagagacattgtacaaactgccagccagcagtcctcaaaactattaaggtcatcaaaaacaaggaaagtctgagaattaccatggccaactcaaggctaaagagacatgacgaaactaaatgtcatgtggcaacctggatgggatcctggaacagaaaaaggatgtcaggcaaaaagcaagcacatttgaataaagtttggaccttagttgctaatactgtatcgatattggttcattaattgtgatttgtgtaccacagtagtagatgttaacaatagggaaaaataggtatggggcaaacaagaactttctgtgctatccttataatgttaatatttctttttcattttctcttatccagggagcagattttaagagtaaaagaagatgagaatgttccatttctactggttggtaacaaatcagatttagaagataaaagacaggtttctgtagaagaggcaaaaaacagagctgagcagtggaatgttaactacgtggaaacatctgctaaaacacgagctaatgttgacaaggtaacacgtgactctttactactgcatcatgttaaaataggttggtttgctttaacttggctccattttgtctggagagtctatgaaactttcaaatagaggtttaatccttgttgatttttatcatccctgaatactcagatacatgttaggaattttagttcaccttgtccttagcttcccaagagacattaaaacatgagacactacagctaaatgtactttttttctttttaaagcactgatggcattcctgacttttttccccccttatcctattgagtctttggataatttagaaggaatcgtgtgagtcccaagattccagcactaaaccgttcttacctctgacctgacatctacccaaccccacttaagttcttaaaaataagggtacctcccaagatgaag

SEQ ID NO: 41852 - DNA, 1045 bp, Homo sapiens
agggcttcaatcaagataattaagaaatcagtcacatcacatacctattttggtggtgaaaacatttttaaaataattttttttttaacacagctcgaaacagccattgaagaaaacattttaactctactctttggctgggcacagtggctcacgcctgtaatcccagcactttgggaggccaaggtggatggattacttgaggtcgggagttcaagaccagcctggccaacatggcgaaaccccgtctctactaaaaatacaaaacatagccaagcatggtggcgtgtgcctgtagaccccaactactcgggagactgaggcagcagaatagctcgaacttgggaggcagaggttgcagtgagccgagatctcgccacgacactccagcctgggcacaaagcaagactctgtctcaaacaaaaaaactactgttttgtcagtatcagaatatgcagtgcattattgtagtcaccattctgcccaatagatcgctaaaatttattacttctgtctatctgaaactttgtgtcttttgatcaacatctccctttccctatacactcctctcccctagaccctggtaaccaccattctactccctacttctatgagtttgaattttctagattccacatataagtgagatcatgcagtatttatcttcctgtcacaaatgacataatttacttctttttttttttttaattatactttaagttttagggtacatgtgcacaacgtgcaggttagttacatatgtatacatgtgccatgttggtgtgctgcacccattaactcatcatttaacattaggtatatctcctaatgctatccctcctccctccccctaccccacaacagtccccagagtgtgatgttccccttccagtgtccatgtgttctcattgttcaattcccacctatgagtgagaacatgcggtgtttggttttttgtccttgcaatagtttgctgagaatgatggtctccagcttcatccatatccctacaaaggacatgaactcatcattttttatggctgca

SEQ ID NO: 41853 - DNA, 1023 bp, Homo sapiens
cccaagtagctgggattcaagcactaatcaccaaatccaactgtattccctcttttgaggaatgtctatttaggtcctttgcccgtttttgaaattgggttattttctttctgttgatttgagttgctaatatattttgaatattaatgtgttatcagatatgtggtttgtaggtattttctccttatccacaggttgtcactttacttcattgtttcctttgctttgcagaggctttttaatttgattccatccctttgtttatttttgtttttgttccctgtacttttgggtttataaccacgaaacctttgcccaaactaatgtcatggagcttttcttctcctttctactgtataaggtgtgagatgagagtctattttcattattctccatgtggatatccagttttcccacccctgtttatttttaagacacagggtcttgctgtgttgccaaggctggtcttggaactcctaggttcaagcagtcctcccgcctagcctctgcagtagctgggactacagacatgcaccactgtgcctcactcccatcaccatttattgaagaggctgtccttttcttactgtatgctcttggctactttgccaaaaatcagttgactataaatgggtttatttctgggttctctattgtgttccttcagttaatgtctctgtttgtatgccagtaccatactctttggattaacatagctttggaataaactttgaagtcaggtagtgggatacctccagccttgttctttttgctcaggattgctttggccatttgggatcttttgagggtttgagtattccactgaatcagagtcttgaatggggcatttaagacccccaacacagactgaaccaaactactcttacttcttaccgtatatcctgatcacaatacaaactggactgtttactattttcttatatcttagtttgtatccttccttcagtttgccagtctggcttgctcattctttcaaccttagttcaggtgggtttttttgtt

SEQ ID NO: 41854 - DNA, 1024 bp, Homo sapiens
tagcctcaggtgttatttttatctatgaagtcttcattaatctcgttcagaagtgatttttaaaaatacctttagaactgagatcactttgtgagtacttattacatccagtttacccagttggtaggcatttgagttatttccagtttttggctgttatgagcaaagctactgaacatttgagtacaggtcttttgtttttgtttctcttgaataagttaggagagggtttgctgtgttgttgtatgggaagcgaatgcttgacttcctacagtcccatggtgtttttcaaaatgtctttgccatttgcattccagtcagtagagtatgggattccagatgcctcacctcctcaataagacttatttttttttttgtcagtctttgattttagccattctagtggatgtgtattggtatctcattgtggttttatttgcaattccctaatgataagtaatgttgagtatacttccatatgtttatttgcccttcctattttttgctaagtgtctcaaaatgttcattcttcatgaattgggttgttgtcttactaaagttgtaagaattctgtgtatatgctagatacaaataaatgttttgcaaacgttttttcctcagtctgtggctcactttccctaacagtaatttccaagagcaaacgttttaaattttaatgaaaaaccagtttagcatttgtgtgatttatgctttttttttttttttttgagacagcgtgtctcactctgtcgcccaggcatgttctcagctcactgcaacctccgcctcctgggttcaagcgattctcgtgtctcagcctcctgagtggctgggattataggcatgtgccatcacgcccagctaaattttgtatttttagtagagacagggtttcaccatgttggccaggctggtctcaaactcctgacctcaacctgcttctgcctcccaaagtgctgggattacaggcgtgagccagccactgtgttcggccagatttatgcattttatgtccaaaaaaatt

SEQ ID NO: 41855 - DNA, 1047 bp, Homo sapiens
tttttaaatatcttagagatttgagtaatttattccttcaggggaattaacaaatgaacagcaaaggttaacatcacaattaatagagtaagccagctattgtcatagagtagcctagcatagtgcatctcagactttaatggatatcttgttaaaatgcagattgtggttcagtaggtctgggctggagtctgagacacagcatttctgacaagctcacaattggtgctgatgctgcctgtctatggactacactctaagaagtaaggctctagagagtatgagattgatgcattataggggagttagccttagatagaaagaggaacacctcctttcttaattgaggtggagtgtacggtggatgaaggcacaggaaatacagattaaatttgcaggcaagagacatgcctggtagtctttgtttttttctgtgaaacaataagtaaagctatgctatgagaagactaggaatgggattgtgtgagcttgatgaaagttgtgaaagtttggaatagctactaagaggaggaaaatgagtgaatttgggacatgtaataatcgctgaacagtgaggattagtttggttatggtgtctgtagaaatggagcagacacagactagtaataaagtaaaaaagactagtaacgtagatttttttctttcttttttttcttttttttttttttttgagacagagttttcgctcttgttgcccaggctggagtgcaatggcatgatctcggttcaccgcaacctccgcctcccaggttcaagcgattctcctgcctcagcctcccaagtggctgggattacaggcatgcgccaccacacccgtctgattttgtatttttagtagagacagggtttctccatgttggtcaggttggtctcgaacttctgccctcaggtgatctgcccatctcggcttcccaaagtgctgtgattacaggtctgagccaccacacgtggccaagagattgcttatttttttaagatgatatggtactctagggaagtggtaatgaggtctaaagtagaacagtg

SEQ ID NO: 41856 - DNA, 1034 bp, Homo sapiens
ttcacgaaataaaaatttaaaaaaattttgtgggtgcatagtagatgtatatatttatgggttacatgagatattttgatacaggcatgcatgcatattagtcatgtcagggtaaatggggcatccttttatcctttgtgttacaagcatttatcctttgtgttacagacaatccaactatcctcttatggttttttgtaaatgtacacttaaattatttttgactgttggctgggtgtggtggttcacacctgtaatcccagcactttgggaggccgaggcaggcagatcacctgaggtcaggagttcgagaccagcctggctaacatggtgaaaccctgtctctactaaaaatacaaatactagccaggcatggtgcaggcatgcctgtagtatcagctatcaggaggctgaggcaggagaatcgcttgaacccaggaggcaggataatcgcttgaacccggtaggcaaaggctgcaatgagccgagattgcaccactgcactccagccagggctggagcgagactctgactaaaaacaaaaaaaaaaagaaaaaaaatgtgactatagtcagcctattgtgctagcaaatagtaggtcaccttcattctttgtattttttgtgcccattaaccctcccccgaccctccaccatgtcactacccctccagcctctggtaaccgtccttctactctctatctccatgagttgaattgttttaatttttagctcccacaaataagtgagaacatgcaaagtttgcctttctgtgcctcacttattttacgtaacatgatgacctctagttccatccatgctgttgcaagtgacgggatctcattttctttttatggctgaatagtactagattgtttatatgtaccacattttctttatccattcatctgttgatggacacttaggttacttccaaatcttggctaatgtgaatagtgctgcaataaacatgggagtgcaggtatctctttagtattattgatttcctttctttggggtatgtacctaggagtg

SEQ ID NO: 41857 - DNA, 1110 bp, Homo sapiens
gaaatttttatttttcaaaacttcaaaaatgtaactttgaaattaagtaaatttctattttatttcataaacttgaattagcactgtctttgtaaattccaaactgaacctttctcaattactgattaaatcttaattatttctcaccagacggtctggaaaatcccgaagcagaagcccgtattcatctaggcattcaagatctcgtagcaggcacagattgtctagatccagaagtcgtcattctagtatttctcctagcacactaactctgaagagtagcctggcagctgaattgaacaagaataaaaaagcacgagcagcagaggcagcaagagccgcagaagcagcgaaagctgcagaagcaactaaggctgctgaggctgctgccaaggctgcaaaagcttcaaacacttctacacctaccaaggggaacacggaaactagtgccagtgcatcacaaacaaaccatgtgaaggatgtgaagaaaattaaaattgaacatgcaccttctccctcaagtggtggaactttaaaaaatgacaaagcaaaaacaaagccacctcttcaggtaacgaaggtggaaaataatttgattgtagataaagccaccaagaaagcagtcatagttggaaaggagagtaaatctgctgctacaaaggaggaatcagtatctcttaaagagaaaaccaaaccacttacaccaagcataggagccaaggagaaggagcaacatgtagctttagtcacctctacattaccaccgttacctttgcctcccatgctgcctgaagataaagaagctgataggtaagtgcaaaaagtatttgtcaataactgttcaaagaaaaaatgtaagtctgaagtgagaaatgagttgacctcccctaaccccctcgaaacaactttagtgaaaaagactacaagtgaatgaattttcttgattatatgcatcttaaaatgaagcacattgcatacaagatggcaaaattaaagtttatactaagacattcagggaaaaattgccattgtcttgggatacaatgaatatttcaatatgattttgggtattagaaatgccagtattctctttggtttagttttccttga

SEQ ID NO: 41858 - DNA, 1027 bp, Homo sapiens
atagcttaatgtgtttgttgttaaatttccagtgccttacaaatacctagcacatggaagctcacaaccaatatttgctgaatggagggagaggcaaattgagaagtgggctgtgtaatatattactttaaaaataaaactgcaggcctggcatggtggctcacgcctgtaatcccagctctctgggaggccgaggcaggtggatcatctgaggtcgggagtacaagaccagcctggccaacatggtgaaaccccatctctactagaaatacaaaaaaattagccgggcatggtggcacgcacctgtagtcccagctactcaggaggctgaggcaggagaatcgcttgaactcgggagatggaggttgcactccgtctggatcatgccactgcactccagcctgggtgacaaagcaagactgtcttaaagaaacaaaacaaaactacaaaccaatttgttttaaagcatgttttttctctgttaaagaaccttccagtgagtaacacaggacataaatttactatgataattaagtcgtttttatcagatggtattattaagttgtttttatcaagtggtattaaaggattcatttgttttacagtattattcaacacgaataggaggataattacaattacattatttacattgataatatcttcagtaatttctgatcacagcagtgtagttgcaataaattttttcattatgggactcaactgctatgaaagtatgtgaagtccaaattttattatcattatgagattctctttcaacatgtcacattatattagatgacagactttgtcatatcagggaaatttaaaataaattgccaagttaagatatactttaaaactcagagctctttatgcattcataaaaagtacaaagctaatggagtttaaatttcagctgtaattctagaaagctggaatcttaaaaaaattagaagaataattgtccaatttagaaaaattaattaaccctgaaaagggtcaaagctgaattagctgttgcttg

SEQ ID NO: 41859 - DNA, 1047 bp, Homo sapiens
ttctgtaatagtactttcatataacttgtatttttgctttggtttgtttttgttttgagacggagtctcgctctgtcacccaggctggagtgcagtggtatgatcttggctcactgcgacctctgcctcccgggttcaagtgattctcctgtctcagcccctgaatagctgggattacagatgtccgccaccacacccagctaatttttttctatttttagtagagacggggtttcaccatgttggccagcctggttttgaactcttgacctcaagtgatccacccacctcggcctcccaaagtgcaaggattacaggcatgaaccaccgcgcccagccataacttgtattttcatataacttgtcatgttttcatatcttattcttactgtatttctgagagcagggactcaattttattctttgtgttcattgtgtgcagcacacagttgattatcattaaattttgagtaagtgaatgaatgaaatggagaggtaggaatgttctgtggaataggtggaatgttaaaggtgggtgcagtttggataggtatagtggagggcattctaattattagtgtcatgacttgtttttacaagacaatgaaagatcggcatatctcctaaagaatacctagcttccaaattatttaccttgtgtttttctaggtctgaatttatattcccgcagtttagaactgctgatatctcctgaggtttgagaagaaagcaacattgatttgttcattctttctttccacaaatgtttattgtgctagtttctagatagatctgggctggccagtgcagtagccactagccacatgtagctatttaagttaattagtattacataaaatcaaaagtttagttctttaactgcactattcatgttccaagtgctctgtagctacgtgtagctactggctacattttggacaatgaagttacagaacattttcatcatcttagcattgaataatgtccatctaaatactggggatattaaacaaacaaacatctggtccctgactcaacctagtttct

SEQ ID NO: 41860 - DNA, 1024 bp, Homo sapiens
aatacagatattaatgttttatgtgtttcatatgtcagataattttcccatttatattgcttgccctttgtttttctttgttattttaaatctttaaatatggtcacatctgtctgtttggtggcttttttttaattttggaagggtggtttctctcatgcttaggaaggctgaatccttggcagaataataggaatttttttatattaaaaaaaattctattatagtttgaaaaagtattcaggtatcttaatcttttatttttatcttacagtgttctgccatctttagcctgtatgaaattcccacgttcttttttttttttaaattcccacatgttctgaggattcctgtttcactgatgtttttgtatgtcctgccaccatattatatcgctttaattatcaccaccctatagcatattttagtttctggtggataaagatcgccttctctttcccctttaaaaaaaaagattttatttttgtgcattttagatggatatgaggtctgaaaacatactgatggaaatttggctggaattacattgatgttagtgtgggaggaagaatgctttttaaaaaattggtcagggtgtgggatcattgacaagcatattaatgtaatgctggagagtaaaaattgttagagagtaattagggatgtagtatagaacctggtgtgtgctaaatactagataaacattttatgttactattataataatcattatttcttaaaatataatgtgttctttaattctgcaattgtatttttggaaacataagggaagtagtcatacccaagagaaaacaagtcattatatcagaaagacacgtgcatgtgtgtgtttattgcagcacaattcacaattgcaaagatatggaaccaacctaagtgcccatcagctgaggagtggataaagaaaatgtggtttgtatacaccatggaatactactcagccataaaaaagaatgagagtgtcttttgctgcaacttggatggaactggaggccattattct

SEQ ID NO: 41861 - DNA, 1040 bp, Homo sapiens
ctcctttactcttcagttttgaagctcttcctttccctcctgctgttcccccaatgtatttcgttgcctaagaaaggctaaactggcatgctactcctaaaatgttaacagtgattgcatttgtcttagaatgttattgaggttacacatacttcttgcaacatttccaactcttataacagacactacattaaatgatggcagttcaatggaatattcataattaagctaaataaaagttgcttaaacataaatatgcttttaatggtaatattatagctataggtgaaatgctttgtaggtaaaatttttaaaaagcaaggtagcttttaaggaatagattgctttaaatatattaaaaagtaggggtgggcacggtggctcacgcccataatcccagcactttgggaggccaaggtgggtggatcacaaggtcaagagatggagaccatcctggccaacatggtgaaacaccatctctaccaaaaatacaaaaattagcagggcgtggtagtgggtgcctgtagtcccagctacttgggaggctgaggcaggagaatcacttgaacgcaggaggcagaggttgcagtgagctgagattgcgccactgcactccagcctggtgacagagcgagattccatctcagagcaaacaaacgtatatatatatatatatatacacacacacacacacacacacacacacataaagttttaagtctgaaattcccaaagatcagttcatacgctttcttagaaatagtaattttgactgggcgcggtggctcacgcctgtaatcccagcactttgggaggctgaggcgggtggatcacttgaggtcaggagtttgagaccagcctgaccaacatggtgaaaccccatctctactaaaaatacaaaaattagccggcttcgtgttgcatgcctgtagttccagctacttgggaggctgaggcaggagaatcgcttgaatccaagaggtgtaggttgcggtgagctgagatcctgccaccgcactccagcctgggtgatagagact

SEQ ID NO: 41862 - DNA, 1034 bp, Homo sapiens
tcctctgtaagaagtataaatgagtttactatgaccacagtaatgcaaatatatataaatatatataataatgcaaatatacataaagagaaaattaatttcccattttcttttgccactttttgccaaatccagtgttaacagcttagtatatatcattgatactatattacaaaaaaaggaaaacagaaatggaaaaatatattagatatatggttgacccttgaacatcatgggtttgagctgcatgggttcacttatatgcagatttttaaaataaatatattggaaaatttttttttttggagatttgcaacaatttgagaaaactcagatgaaccatgtagcctagaattttaaaaaattaagaaaaaggctgggcgtggtggctcacacctgtaatcccagcactttgggaggccgaggcaagtggatcacttgaggtcaggagttcaagaccagcctggccaacatggcgaaaccccatctctaccaaaaaatacaaaaatcattcgatcgtggtgatggacgcctgtagccccagctacttgggaggctgaggcaggagaatcacttgaaccgggaggcagaagttgcagtgagccgagatcgtgccactgcacaccagcctaggtgacagcaagactgtgtggaaaaaaaaaaaatttagtccgggtgcagtggctcacccccgtaatcccagcactttgggaggctgaggtgggcggatcacaaggtcaagagattgagatcatcctggccaacatggtgaaaccccgtctctactaaaaatacaaaaattagctgggcgtgatggcgcgcgcctgtagtttcagtttctcgggaggctgagagagagagagagagagagaaaagattctttttttttttcttttttttgagacagcgtctcgctctgttgcccaggctggagtacagtgctgtgatcttggctcaccacaacctctgcctcccgggttcaagcgattctcctgcctcagcctcccgcgtagctgggactacaggcttgcacc

SEQ ID NO: 41863 - DNA, 1218 bp, Homo sapiens
agacttggaagtcacatcattcactctccaatattctgttggtcacacagaccgtccttgaatcactgtggcgtggcatggatgccagatagtgaggatcatttaggaccattttggaggcttgctactgtagatgatttcagtttcaatttcagagtacaggatttatacatctttgaccttatctttcttgtaaactaaaagccctggttcctaaaatattaacatagcttgctttgttctaccatatacatgtaataatttcaaagtaacaatgctgatattaattactaaaaagactactgaatgcagtttaagatttcttagtgattctttttgtccttaaaatataccccccagctgtatatagtcagtatactctattgtagacagtttatgcaaccaatttgataaacataaatccacctaaatgtggatatgtttccagttttttagggattgctttttttccctttttgatttaataatgtattttaattatataaaacatttacttggtttcaaactctaaactataaaacaggtacattcagaatagtgtcacttccattcttctttttcttgttctctcccttacccatgggtaactattttaaatgtttgtttcatcctccaatgtttcttttgtacatattcacattcctttttttatatataaaaaaaggtagcaatgttgtaagtgctctgctgtacctttttcttttcatttaaccatatatgctgaagtttactccatgttagtagacaaaaatcattttgttagtagacaaaaatcacgcattgcttagaggcactgcactgtgtgggtatgctatagtttattcagctagtttcctaatgatagatattttcattgtgtaaataatgctgcattgaatagccctatgcatacatcattttgtattttggccagtgaatttttggtacaagttcctagaattgggattgttaagtcaaagggaaatactgaatgtgatttagctagatattgccaaatttctcttcagagggcttttttttgtgttatttctactaccaatgtatgaaagtgtttcttacagctttgtcagtagactctggagttctacttttagatttttgtcaatttagtatcttggtcaagttttagtttgggaaattaattaatttatatttattttgagacggagtttcgctcttgttgcccaggctggagtg

SEQ ID NO: 41864 - DNA, 1033 bp, Homo sapiens
aacagaattaaattacatgtttattgaggcatttagaagtcgcctaacatctttcttggcctgtactctttttttttttttttttaattaaaagcagttcttttaccaacttttaattttttgataaactatattgactttattcagcttctaagagacaatttgacgtctaaaacattaatcacacctagaaactatacaatatggagaacagcagggtgattttttttttttttaaaatcataactgtttttttgcggggagaagaaaatagattagatgttttccttgggatttatttattaatattattaagtccagagagaaagatgaatgttattaaagtaacaaagtaacacttcttttcaaggattaattcttcctctaccagccttttattgttaaaaattgtgaatttatggaaaggttgtaggaataagtttctaatgtattaattattctcattcttaggtgcattttatctggtgtttgaatatatggaccatgatctgatgggactactggaatcaggcttggttcattttaatgaaaatcacataaagtcatttatgagacagctcatggagggtctggattattgtcataagaagaactttttgcatagagatattaaatgttccaatatccttctaaataataggtatgggtatgaactttatatatatttaaaatgagttttaccatggacatgtacatggagagaatagactggaaaccgtagcggcggggaatgtcgggggtggtgagcgttgaaagttacctattaggtacagtgtccaacgtttgggtgatgggtaccccagaagcctaacccctactattacacttgtaatacccatgtcaccaacaaacacatatacccccgaatctaaaatttttaaaataaagatacggtgttacatgatgttgcaccttgattatgttaaaaaagatttaaaatttagtttactttatacaaactatgtaaaaataatcaggccagccacagtggctcacgcctgtaatcccagca

SEQ ID NO: 41865 - DNA, 1023 bp, Homo sapiens
ttgaactcctgacctcaggtgatccacccaccttggccttccaaagtgctgggattacaggggtcagccacggcacctggcctgactttaaattttaatacttggttaatcacttaaggtttaaggaaaaacaaaagaattgtttgattttgttttctaatgtgttactttcctggcagacaaagaaatagtgtctgccttcttttaaaaaatattaatgagatttacaaatgaaagtatttagcagaaggactggccttggtgtctcttgcctgtaatcctagcactttggaaggccaagatgtggagattacttgagcctagaagttcgagtccagcctgggcaacatagtgagatctctattttaaaaaaagtagaaattgaaatgcacaatagttaacgttgagaccattatttttgggtctttacaaagtttagtttcttgccatccaataacaacttattgaagttactaaattttgttttccaatttaatggcagaaggactgtgtgtgtgtgtgtgtgtgtgtgtgtgtgtgtgtgtgtgttttcctgggttattgagtttattgcttggaattgatctaattatgtaaagtggagtggttcatttcatttttagatttttcttttttgtatgtacacatttatttgataacatctaagaagtcgactatatgtttttcagtcctgtttctttttcattgtgagttaatttgctttttgtgcaaatactgggtatagacacaccacaagaatgtaatttgttttttaatccatgaaagaaaaaagcatcgtatatgtagtgtcacatcagtttgcttcttctttgtgtgatctaaacaagatcatctctacgatgttgacagttggtagccaaatctaatagcgcaagtttgaaattcatttttgaggattctggattttttttttttttttttttgagacagagtctttcttgctctgtcaaccaggctggggtgcagtggtgtcatctaggttcactgcaacctctgcctcct

SEQ ID NO: 41866 - DNA, 1044 bp, Homo sapiens
cattaataatgttagaaaaacctaatcttaatttactattaaaaatattcatcttattctgtcctcttttcacagtttttaccaaagtcaaatgtttttgctagctttggagcactgttaactatagtcctatctgtggtaatgctataatgcccaaattgatagttttataatgctagtgcttaagttatttggagaaatttggctggatgggggcagagcaggtcaggcagatcttacactgcctggaactgcaaatctataggtggcaagagggaattgctttctaaattgaatgctccatttccttaacaagactggtccaggaccaagccaagcttaggtaaatgggcttggaatacagcctttctggggaatttgctatggcttttgagtccttgtgatttggaaaacatctggatataaagagatgtttatagctgatctgaatatatatgtgatctccctgaagtaagtaactacagatcagccgaagaacctcctctgactacttaggattctcttcaagcgtgtcaatcagctagaacgtgaccattctctgagcgttgaacactttacattgccagataatttgtgctgttttcgtcaaacctgaccctaatataacttgactaaataatcttgtctgtggcaaataaagaggtagcagtatatttatgtcctcttttcggaaggtgataaaggaattatttgataaagtacgatatgtattgctactttgcagagtagacctcaagtagatacttgagtagacactctgcatttgtgtgcttttttctattcacacactacagtgggtatgtgaatcagtgaaaaattgccaaaaatatgatcaattgaaaacttttgttaggtggtctttatttgaactatatcttgtcatccattagtaatttagcaagatttgatcagaaccagtcaacgctctttaaatcagttaatcccattaaaggtttttatggaaaggaaaaacagtgctcaacaattgagttgatactaaagctttgctttgaccaaattgca

SEQ ID NO: 41867 - DNA, 1032 bp, Homo sapiens
ataccagtaaactactttttttttttgagacggagtcttgctctgtcacccagactggagtgcagtgacgctatcttggctcactgcaagctctgcctcccgggttcacatcattctcctgcctcagcttcctgagtagctggggctatgggcacccgtcaccacgcctggttaatttttttttagtacagatggggtttcaccgtgttagccaggatggtctcgatctcctgacctcgtgatctgccagcctcggcctcccagagtgctgggattacaggcgtgagccaccgtgcccagcctatcagtcaactactttttgtttttatcttcatatattaagggaatttttagttaaacaggttgccctcacatacattttatgatcttatattagatacctttggatgtctgtattttttagtaggcagatgaaagtgtttttagttaggattatagggattgctttagtaaaataatatttcctcagagaatctgtcttactccaacaaatactaactctaaagactgttttctgtgttttttagtcggccgtatactaacaaggtaattactttatggtaccgtccacctgaactgctactgggagaagaacgatacacaccagccattgatgtatggagctgtgggtaagatagccttatttactggtttattttacttgaaacttttggtagtgaattaaaatagatcatttggtaatgacgggtattttttccattagctgtatccttggcgaactcttcactaaaaaacctatatttcaagcaaatcaggaacttgcacaactagaattaataaggtaagctgctgattataatattggtgggaattgggagagtgtcatactccacaggaaatttaaactctcccaagtttgtcttttcaggaagagaacaacatggttctctggagggcttatgactgctaaatggaggacaaactgaaatgtaggcactttgatacttgttccagtgaaattaaggatatcaaagcccctgggtgggtgca

SEQ ID NO: 41868 - DNA, 1050 bp, Homo sapiens
cttgccaacatggtgaatccctgtctctactaaaaatacaaaaattacctgggcgcagtggtgtgtgcctgtaatcccagctacttggaaggctgaggcaggaacatcctgcctcaggtagcttgaacctgggaggcagaggttgcagtgagtcgagattgtgccactgcactccagcctgggtgacagagtgagactatgtctcagaaaaaaaaaaaaaaaaaaaaaaaaggaaacagttgatttggagataaagaaatggaaaagcagcatgaatagttacagaaggctatattgagattgatctcatttaggtaaaacaaaagactcaaattgttaatctgaacatggactttcaagaagactagggaggagaaattttcattttctagtttatatatttcagcatgtttttattttgttaagatacttataattttataaagagattgaccgggcacagtggctcacacctgtaatctcagcactttggaaggccaaggcaggtggatcactagagcccaggagtttgagaccagcctgggcaacgtggccaaaccccgtctctacaaaaaatacaaaaattaggtgggtgtggtagcacacacctatagcctgagctattgggaggctgcggtacaaggatcacccgaacccaagggaggtcgaggctacagtgaactgtgattgcaccactgccctttagtctgggcagcagagcgagaccttgtctcaaaaaaacagaaataaaacaacaaaacataaaaagatgcttcaattttgatttcatagcattaatttcttttcagacatgaagaaaatgaagtttctgataaacaaatctgactataatgaggcaacggagtataccgaaaagtgtgtggcctttagaatcttacagggttgggttctaatgccagctcagctacttcctgcgcttatggtttagggtcccatatgctcttaagtttttttcttcaaaagtaaaagaggactgataacatgcttagggttgtgagaattaaatgtaaataagttttcagtacatat

SEQ ID NO: 41869 - DNA, 1051 bp, Homo sapiens
aagccaaagaaaaatagattatctgtaaaggcaaagcaagccctgaaggaagtgggacaataaggatgatttttattggaagagttttacagagccattctatgaagtcttcaagaactatttggggtgggggcataactttgttgctatatagtaactgtagcattttttgttaagaaatgccatttacaatttaattcctttttttttttcagtctccctttatggcaagattgtcatgagttatggagtaaaaagcgaagaagacagaagcagatgggcatgactgatgatgtttccacaattaaagcccccaggaaggacttgtctctgggcttggatgacagcagaaccaacacaccccagggtgtgctgccatcttcacagctgaaatctcagggcagctcaaatgtggcacctggtcagtaatgcttccatgggttggttttcttcacattgttttgcagttaattctgatcatattgctctaatgttaaagcatcttgtggctaacaatgaaaattaacatttattcactgaactagacatttctttgtgccagtacagaagtttcattgctattggcaccacaattttaagtaatcttaaggtaacttataaagaagcatcaaattacctgactggcaagtcctcggatttctgtatttcctttttactcttagtgcaggagtgagtaggtcttttactgacactactctcagtgaggctcagcattcaatgtctatagatgcttaagcagtaggaagaaaggtataagaaaacagccaaaaatcataatgagagctctttcataccatttatagcgtcctcatgtcactcctaatgttataatttctctggttatattaaagaatcttaaagattggggccaggcatgctggctcacgcctgtaatcctagcactttgggagactgaggcggatggatcacctgagatcaggagttcgagactagcctggccaacatcgcgaaaccccgtctctactaaaaatacaaaaattagccgggcgtggtggcacacacctgtaat

SEQ ID NO: 41870 - DNA, 1077 bp, Homo sapiens
aaaatattgactcaaattctgtagctatttgattttggggtttaaattgatctggtattccctgtgggactccaattgcatttaaatagatgtgagagtcgaaagacccataagaggcttcccttgctttatgacgtctggtttttccttcctctgcttgatgaaaggccagagtaaaagggatagccgattggactagagcataaatactgctctaattatttggcagagtgtccagtaaaggtcctccataatcccaccatacatccgcttagggatgaataagggcagactgataggtcagctcttggaagtgccacacttcactgcatcctgttaagtctccaaggaatgccaaatttttcccttggtcgttggagacatgaggtaaaattgattttggaaaatggaggctggatggcccttgggggctgacccgcagcatgctggactttgggatatagcagagagagagtgtggcacaacttgttactctaggctgtagaatcctggaaaagagctaccatgcagcccatgcctggttgactggatgaccaccctagtggaaaggggacagtctgggcctctggcctgcggtgcgcacaagcataacaattgcttttgtttaacgtgcagacggaatatttgatccattccaaccaggcatttgcatcttggtatcttgtcttaattgccgaagtttgttttaagtctttaacttgtatgatagctatcttggtcttgtcgttagatggaggagtggcaattgttcagttgtgagaggttttggaagaaggcttagaggaaggtgcaggcactgggggatcaaataaacacatttcaaagaatccaatagggtctgtccctgaaacctcagcccccataccataaaactggcttaaagaagggaactggcttagaaaaggggaagaagtttgagggttcgagataataacctgtattggaatgcactggtttagctgacccccagttgggggttggctgtccctctagtaaaatgaatgtatggttttaggaaattacaaaaactggttggggcagtccatccttgctctt

SEQ ID NO: 41871 - DNA, 1084 bp, Homo sapiens
aatcctctggttgtgaatagagcagcaaacaacatcacatctttattgaccaagagccaaattaaagaaggctaaccatccttgcccatagatgctgttcaatgggataaatgcaatatgccattaagaactggctctgtggatattattgtggcagatttgccatttggaaaaaagatgggatccaagaagagaaactggaaccttcatccaccttgcctatgggagatgagttgcgtctgtgtacacctacaacaggccaagctgtacgatgtactcaggacgcgaaatgctttaccaaagcattatctggcatgtgatgtgtatggtgaaaagtggatacagttcgggtgaacattgggggtctttgtgctgcagtttatattttgaaatgtacacctcaagcttttgttcatccttcagaacaagatggagaaacaggagctctggtaatgcaaagattgaagctaactaatagtactcgtacttcccaacactggaaatgtcagcatgaagaacttgctttgagagcaaaatagtatttaaaaaagtgcagtgtgcactctttaaacctgttcagagctcttcactctagttggcaaaagatgtgaatgtaatgtaatgtaatgggattgaaaaagtcttatgagaaagcagagcttttccttggcactgttttgtgttttgggcaattagtattttgcttaaaatgcttttaaagatgcctagtgaaaagcctagtaaaacgctctgagatttgggtgtagaacgttttattttcaggcttaaaactttttttttaatattatagttttttgtagagataggggtctcaccatgttgcccaggctggtcttgaactcctgggctcaagcaatcctcccaaagttttgggattacaggtgtgagccacaacacctgacctattttcaggctttacggcctgttttctattttgccaagcggaaagctactctggcctaaaggaaaggcagagaacataattacatcttaggccacatttcattgcctgcgtatctgtgctattcagttgctcaaattctttaactctagaagtgaagta

SEQ ID NO: 41872 - DNA, 1034 bp, Homo sapiens
gggctgaagtgatcttcctgcatcggcctcccaaagtgttgggattatagacgtgagccaccatgcctggcagttatttcgtttaaagtattaaaatgttcagtccagtctaatatcaaaacctcagactcttgtccagtttatgacgtctccttttccccaacttcaggctactttcttgggaatgtgaagaggatgtgtgtgtgtttgtattacaggtgcacatatgttgcatgtgtgtgtgtttgtattatgtatgcacatgcatgcatgtgtctgcatgtctatgtgtttcggaagagcctagtcagtttcttcattatccatcttttcctattgttagctgctatttgtggtttttttcagaatcaggccctcccagggaagggaagcaagttaaagggtgcaataagggtatgacttgactggtgtagttgtaacctgcagtggagccttctgtgtgcctgaagttctgtaggtggctctctttatggggagttttgtagtctcctcagagacctcagattgtagttctcccacttcagtccctgttttttgtggttgtctatacacagagtctatctgttatgatcaccttgtcctataggcagccctcatgggtagaattccttttcagataaactccttctgctttcctcatggtgaacttggcccatggggaaaaatcctccctcctccttggccattggcaggtgtacagtttattccgaactcttagctctgttgcttttagccgatgtagccataaccccttgcctttggtattctttcagacacatgccacaggtgcttaggtaattccaaattcccagaattcccaaattcccttagcttgtatcaaggtctctgacgcttttttggaagtctctcttgtgtggcttaagttaaggggaaaacagcttgctcctctcttatgacagaatgagatgcctagcatacaataacaactctttccaaggaaattcagctgaaggttttatttagcttttcaccttttctcacatatcctcaaa

SEQ ID NO: 41873 - DNA, 1027 bp, Homo sapiens
ggccaggctggtttcaaactcctgacctcaagtgatccgcctgctttggcctctcaaagtgctaggattacaggtgtgagccaccgcacctggccatgaacttttttttttattttaaatttttataggtacgtagtagacatatatatatatatatatattttttttttttttttttttttttttttttttttgagatggagtctcgctctgtcacccaggctggagtgcagcggcatgatctcggctcactgcaagccctgcctcccgggttcatgccattctcctgtctcagcctcccgagtagctgggactacaggggcccaccaccacgcccggctaattttttgtatttttagtagagacagggtttcactgtgttagccagatggtctcgatctcctgacctcgtgatccacctgcctcggcctcccaaagtgctgggattacaggcgtgagccactgtgcccggcatagtagatatatatttatggggcatgtaagattttttgatagaggcatacagtatataataatcacatcaggataaatggggtatccatcacctcaagcatttatcatttctttgcattacaaacattacaagtcttgctctgttgcccaggctggagtgcagtggtgcgattatggctcactgcagtctgggctgaatcgatcctcccatgtcagcctcctgaatagctggaactacaagcacatgccatcacgctcagctaatttttgtagtttttgtagagatggggtctctccatgatgcccaggctgggttcgattattattatttttttaaatatagacaccttggatagacactactcagtttaagatacagcatatttccatcactccagaaagtttctttttctattcccaagcaatactacctcctccagagataaccactatttttgacttctgatactatatgctagcttaacttctttaagtagaaccatatagcatgttcttttttttttttctttgagatggagtcttgctttgtcat

SEQ ID NO: 41874 - DNA, 1081 bp, Homo sapiens
tttaagctgtaaggaacctgaggtagggtaagcaactgcataaaagttgcacatccaataagtttggaagccatgaaggtttcatgggtgtgtaatctgtgcagtcatgggtagccctgggcttagttaaatgttctgctgtcactgtcttgaatttgttaataacatccacaggaggccctatagtttttatttacaccagtactcacaaattatgtagcaggtcgtggagttgagactctacttaagtctcctgatttttacctaggctgctttactctaatgtataaagagtattgtattatttagatgagtatcatagagtttaattcacttctagcatctaactagtggttcaccatgtgaaggtgtgtatttccctgggagtaagggtggggaaggtggaatcaccatagggctgcttcaaagtgagggcacagtgacggcaaactcatgcatatacacacaggtatatagtcaatcatttttggggtgtgcatgtgtgtgtgtgtgtgtgtgtgtgtctgtctgtctgtctgtgtctgtgtctatttttattgtctctgtttctccctgagactaaattctatgactgctggcacaatgtttttgtgtaccatggtatcctcaattcccagcccagcctttgtcaaagattggcttttccaatcctttgaggtcaatgtgagaactactgttaccagtgggaatgtctcgtaacccttaggtttgccaaggaagatgtgaaaagatagtaaatcattagaattatgataagtactcgataaacagctaatgatgagattatttgcttttggcaaaaaaagtagcagtgatttggcctattgtactacagttaactcagattgctaaaattagtgtatttcagtctcattaactatctttctttttttctttttctgtcgcccaggctggagtgcagtgatgcgatctcagctcactgcaacttctgactcctaggttgagcaattcttgtgcctcagcctcccgagtaactgggactacaggcgtgtgtcaaaactcctggctaattttttttttttgtattttttggtagaga

SEQ ID NO: 41875 - DNA, 1123 bp, Homo sapiens
ccagctatttaaaaagttttttttagagacagggtctcatcatcttgcccaggctggtcttgaactcctggactcaagtgatcttcccaccttcacctcccaaagtgctaagattacagctgtgagccattgctcgcagacttagactgttattatcaatgactatagctttgcctttatactcaactggcaaaatcccagtgcggatagacttaatagttcatctattcctggcctgcagtcaagtggtggatatggccagaagaaaatatgctactttgctgatgatctccctcccaatccatggccatctctctcaagtggcccctcgggcttacccagaaatcctgccacctttacctaggtaatttattttctccccctctgagatgactacctcacatcttctcttctctaagatctttccatctctcctcatccttaaagactttgtctcttattccacttaaaattaatgcaatcaaaagagaactaccttatcttttctctactgtacctcccaaactcttgcatttgaacctatatatagatcactgcattccttcctgtcacaagagaggaagcgtccctttccatattttgcctaagggcattgcatctgcattttatgtcctctatcacctgtattatacttcataggataagcagatgatcatatatataaataaataaataaataaatatatatatatttattttttgagacagagtcttgctctgttgcccaggttggagtgcagtggcgcaatctcagctcacttcaacctccacctcccaagttcaagcaattcttgtgcttcagcctcccaagtagctgggattacagatatacgtcaccatgccaggctaatttttgtatttttaatagagatggggtttcaccatgtttgccagactggtcttgaactcccaacctcaggtgatccacctgcctcggcctcccaaagtgctgggattacaggcatgagccaccacgcccagccagatcatagttttgaccttaaaaagcccaccaacctttctttgattcccaagcaatgtctttttcaaatcctatcctatttctatatgtgctactatacaggactcttccaaaaaattt

SEQ ID NO: 41876 - DNA, 1049 bp, Homo sapiens
tgtattcttaatatatgtgcagaactaatgtgtttttatattttctatgcctaacatatttggctaaaattatctaaaagaatcaaaggccattttgaatattcagtcattagttctagtaatattatcttaatcactataataattatcagatgtaacatttatcaatgattactgtgttattaaatatcttacatatattaaatcaatatttaccacagcccttaaaatagttattgctattatctccactttcacatgtggaaactgaggcatagagagtttagataacttgtgcagggtcacaagtccatggtataactgggattctaactgaggcagggggacttgagctcattgtactgtataggcagatgatacaatgctgcatgtttagtttcattttctatctttatcctacttttgagaaataattatgtgaccttttcctctacataatttcccctttaggactgccaagagcaattcaagaggtataaacaattctgttgtttactcatcacagggatccttaattatgacttaaaagcaaatttccttcagaaatcaggttgtacatcttttgaataaatcctttggtcgcatatgctaaaatggtattaggttcataagtaagtgatggtatagtgaagcaactctacctattaacagttccatctatttaatgagaacagtccttgagcaatataggagttggggatggttttagctgttgtgagactcatcgtttctagttttcaacctgtatttctggagtttggtagtgtggggacagagctgggatgggaaggaatatttgggacatgaggaggagtattccagggcctaaggagggggatagcctgggtagaaaccaagtagacagttttctaagtattcacaccccatttcaaccagaacaattccaccttctggtagttttttgaaacagggattccactgcttaaaactcattacttgtcctagatcgatcatcttgtactgaaggactttattgaacaagaaagtgggttttgtacatgtgtatg

SEQ ID NO: 41877 - DNA, 1093 bp, Homo sapiens
gcagaatgctggaaggttctgaaaacaaaagtacagttgaagcaaaaccattgtgcctgtgcattcttttggttttgatgggcaaatattaaaaaaaaagaatggggtatgataaggacctggtttcagatcctgactcagtccttaaagggatgttctgaggaccaaattaaatacatgtgaatgtgcctgcacatgtggtgcagtggtacatgtcaagtcttgaatacagcatctcagaatggccatgatgaagtcatcctcctagttggaggaaattaatcaatctctcacctggcaggggaagcccctgagaaagtctatggcagatactgatccatcttctctccaactcagccaaagggagacaacttgatttttgaacctctctaattgtcattagtgacctagtagaaagctaactttctgtaattcatagaacaacagaatacagggacgaaaggggacttgagagattactcagaaacctctttcttatggataagtatgagcaatatataggaaaaatcaaagctcagaaaagcaaatgagagacaaattaccagtttgtgaactctgatctttcaatagagtaatcaaccataatatttcctccaggcaaagctacacacccctgtttagttcgtatgattaaatgttgattaatttagagtagggggctctgtggaaagtgcatagaatacttggtatttcatttttgagtctttaaggaaatatctgttatcaatgttgacattttccatttccagcatattagaagttaattgaaggctccaatatcctaaaattactctgtcaaatttctaaacgtgtactttttttttttttgaggcagagtcttgctctgttgcctaggctggagtgcagtggcgtgatcttgactcactgcaacctctgtctcccaggttcaagatattatcctgcctcagcctcccaagtagctgggattacaggcgcctgcccccatgcctggctaatttttgtatttttagtagagatggggtttcaccatgttggtcaggcaggtcttgaactcctgacctcaagtgatccgcttgccttggcctcccaa

SEQ ID NO: 41878 - DNA, 1038 bp, Homo sapiens
tagtatatgtgctgccaaggtgagcactacaatctattttttttaatgttttattttagattcagtggtacatgtgcaggtttgttatataggtaagttgtgtgtcactggagtttggagtacagagtatttcaccacccaggtacccaataggtattttttcaatcctctccctcctccttccctctactctcaagtaggccctggtgtctgttgttgcctttcttgtatccatatgtgctcagtgtttagctcccacatgtaagtaagaacatggcggtgtttggttttctctttctgtgttagtttgcttcagataatggtctgcagttccataaatacatgattcattcttttttatggctgtgaaatattccatgctttatccagtctaccattgatgggcatttaggttgatcccatgtttttgttattgtgagtaatgcgatgaacatacgcgtgcgtgtgtctttatggtagaatgacgtatgtattcctttgggtgtacacctaatagtgtgattgctgggtggaatggtatttctgttttgtgttctttgagaaattgccaaactgctttccaccctatctgaactaatttgcattctcatcaacagtataagtgttcccttttctctacaactttgtcaacatctgttattttttgactttttaataataggcattctgactggtgtgagatggtaactcattgtggttttgatttacatttctctaatgattagtgatgtttagcactttttcatatgcttgttggccacacgtgtcttcttttgaaaagtgtctgtgtcctttgcccactttttaatggggttgttttcagatgtctactatcactaaagtcaagatacaggatgcaacaacaatctgtgtttcaccaagttttcgggtgactggtactgctaaggtttgagaactatttaaaaaataagactagaagagcaggaacagactttttttccccaaaaggattagtctaaatacgcaaagggtactcatagaccagcagcatagatc

SEQ ID NO: 41879 - DNA, 1045 bp, Homo sapiens
attttttcatctataaattggggataatgagcttataatagtaattcctacctttaaaattgtcgagagaattaaatgtgtgaatacagtagagggcctggcacatggcaagcacttgataagtactgcatattgtaggggtctgccagggcagcagcatagtgtgatggtagttaacttgtcttgagtaacagagttcacttaatgaagtctaagttttcactctttttggaagctatgtgccacgttgacttgcattgggtgcccattactaaatcaccttttaaacaaaaccttagcagttcctaaaccgtatttctcctgtgccttcatggtaaagtacattttttattcactctgtttaaaataaaatcatccttgtttaaaccaacatgattgctgtctctgctagcttcttgtttttcacgaatctgaccaacatgacatcatccaagtccttgtttgggttcagcaatagacaccatcctcactacctgaggttgaaactgaaagctctggttgtattatttgactgccttcaaattcacacatttgtgtcattatgcaaactgcatttctccgtcttgttcacgaagatattttgaatgaccttgttagtaacttcggtgaaatccaggaatactttgtccatagtatatccctcatatacctgtttaaaaccaagcaaaatagaaaatgagattggcttggcattatttgctttaaggaaaccatattggtgactaattcttactatttccttttctaaacttcaaaagagtactttacaatctttcattcaatgagtatgtattgagcttgaactctgtgaagcatcatttcgaatcccaggatttttccaagaattaacatcaaatttacaaaatccagtttccacatctttaaaacgaggcaatatgaggcatattacaggattgttactatgattcagtaagaaatatgtgaaagcacctaacagtgtcagagcagagaggtgctcactactaagtcagtttcctttcccatgttcagagagagtgaaccc

SEQ ID NO: 41880 - DNA, 1010 bp, Homo sapiens
ggaattcttaaaaagtttcaaaaacttactagatgacctcagtatggtcctatttaacatacccttgggaacatgtgcatgaaatacattgtggtttgagggtttccaactgaaacacacttaaaagaaaatacagcttttaatagaaactattcaaattcctgcaaacataggtatatatctcaccactgagagggattaaaagcatcattgtctacgttgagaatgaaaagggaatgtgccattctgctttcaggctttgcttaagactttttacttggtgattccagcatatcaccatctttgattaaactgctcaattaaaaactatgagtgattgaagcctctgattagtgtttttctttgtcatggatgccatgacctgagggtagggaagagagggcacagggtgtcacaaacctggtgttatttaatagagtcttcacatttgtaccacacaagtcgaatatatcaggtgtaagacatcaccctgaagcatcacttctgagatctattgggaggaaaatatcagaactattgaaatatcacagctggccctgattttaactagtgccaaacacctgcaggctctaaaaggataccaaaacaaaaccccaccctgtggcagcaagccatcccttaacaaccctttcttaactttgcatcaccatcaaaattaatttaacattttctccagaaaccttattcttcctgtcccagaaggccattacaacccctttagcaaatcttttgtatgggatgaatatgtcatagaaacagagtgaagtcttgaaatatttgatggctgaaaattgtctgttttcatctcattatttgtataagcttttgaaattggagagtttattaatctctagactagctcatattatctgagtgattttgttttagcacattttggcaaaatatctgagcatcttattttttaaaaaaggccaatgttcatatagcaaacttcagaagcacccccaaaatacagttatttttcaaga

SEQ ID NO: 41881 - DNA, 1033 bp, Homo sapiens
attctccagctttcctcactttttagttattttaattttcatttgttagcctccaactaaatttaacatataattttagacttaatatcatcatagtatttgctttgaaggcataagaatttcgtattttaaaagtcctatatggagtacgtaattagcatgcattctactacccgtttctttttggcaacctcctaaatttgtattggaaggaaaagcttttactcaaacaaatgatttctatagtaacaaaatgaaaacaggtaataagttagcaactatcttttctcatacaaataatgtcagattttagggctttcaggcttggtttttttgagggagttgaaaagaaaaatccgaggcctagatacagaaaactatcaatattaaccttgattgagagacataaaaggtttgaatatatgtagagacgtagtcattcatggctgcaaacactgaatattgttaaggtatcaattattcccagattacttatcgctttaatataattgcaatcaaagtcctgttagaatatttttctgaaattttttagcaagtggtttttcaagtctaccataaaaaacatgtggacgagaatagcaaatattttgtatgtttaaatataagtaatgagaaggaagcaagcattatcatacataattaaatatattccaaaaccacaataatggggctagcaaaaaataaagagatagatcaatgaaacataaagaaaaactttaaaacatgcatagagatttggcatgtgataaaaatagcatgacaaataagaggagaaagggagacattttctgtttgaaataacggaaattaactgttacttttctcttaagattatatctatgctttatgcccagataatagaggtttcagagtttactgtagactatttttaattaaaagaaagtattcatgaaaatcagttagattttaagaaaaggaaaggttttctaagcatcaatgcaatagcagatgtcagaaagaaaagaaatcgataaatttggttagtaaaagt

SEQ ID NO: 41882 - DNA, 1050 bp, Homo sapiens
catatatatttttattcattcaaaaaatatgtttctgccacatgtataggcaagcctttcattttgtccttctgggtaaccatttgttcagaagcctgggaagtaagggaactagcctaaggggtgaggccaactgcaaggttggtctcatacagatgttcatctggggttggttaaaattgttttgaaatttcttcttcagaaataaggatccaatgctcatgaatgatttgatgtcttagagtgactcaaagtatcagaaacattttaagtatttagtttggaaccattaaaatgaaacaaatgaaaatttagccatgccttatactccttgagtgaccatcaggaagaaaatagtcattcttttaagtgaaaatttattaatgtggggttaattcccctaaggagaggcctaatgataagcattagataggtatctgtgtgtgtataatttttctggaatggagagaatctgtaggattcttaagacccagtaaattctgaaggattaagaatcacttcaagtctgacaccctgaactgagcaagtatgtctgtgtgtgtgtgtgtgtgtgtgtgtgtgtgtgtgtgtgtgtgtatttgctgtgtttgtggatcgccttggattacttttaatctgtagtgtgaggttctctagagttgattctaggtaagcaagcaaaaatttttagacattttaggttaacattaggcaaagaaggtttttcgtttgttttgttttttaatattaagaggggatgttcataaagtaacatactgattccattatgtcatccaaacaatagtatcaacactatgttccacaacagtaaagctttaggacctgtaaattaatgtttcgtatgtgaattatgaatacaatattttaattatgttgaaattaaaccaataccacatcatcagtctctcagctcacatgagtaaatagaaatgtgatctttaatttttattgagttgcttaacagtttctgctttgtaaaatctgtgataggctactaaatccctttataaacccttccttttaccccca

SEQ ID NO: 41883 - DNA, 1081 bp, Homo sapiens
gctaaattcacacctgtaaactagaaaaaacaaaatcctggagattcagagaagtcacaacttgaagagtttaggatatatttcatggagcgggtggcatttgaggtgtatcttgaagaatgggtaaaattttaaacagatactggggaggacagggagctgtcacaggtaggagatagtggaatatatgaagaaagccttccaccagggaggagggtcaggaccagcaagtgcttggcaatacagtggcaaggggcaaggatcatttaaaagagaggagttcactttggttggagcagagggtatgtgtgaagcaaagtaaagataatgaacagttatttagcactatgtgtcaggcattggcctgaatactttatgcatagtatctaattcatcctcacaaaggccatatgacatagacaatgtaatcataaccatcgtcatcatcatcatcatcatcatccacctcacagatgagtaaaccatgtctcaaagaggtaaataacttttcagccacaggtcctgcaaatcctagagtcatgaggaacagccgggtatagctctactccctttctccagggatacctcacacttttgaaaaacagggctgttctctgtatccctgtcaatgtagatgcagagggtcttggcgatgatgtggttaaagtagtgaaaactcagccttacactaggtatggatttaattatcccatagtactgattagtttgatagcaaaaaaggatatttgagaaggaagctgcccatattataaaggcctgcctatataataaaggcctttttgctcatgtgtgtctcattgaaatgatggagtggctgtgccaacatcaagctaaataaggagaaaacatttataagcacccttttaactctgttagagctatgtattctgaaatcccttcaagtaacaaatgggtaagaacaaaaggggcagaatgggcctttcgactgcaaagactgaggctcaagctttagggaaccctgtttatgacactgattcgatatagttaaactccgagcttctatgtagttaaacatgggggaaatggccatatctataag

SEQ ID NO: 41884 - DNA, 1043 bp, Homo sapiens
gctgtggctgtgattgcagaccttgtacctggctgagcttgcatctttcgttccctattcagagtttgagatgcttctggccattctcctaaagaatgggagtgaatgatctttgcatgtctgttgagcagaagatatttacttgcagaattaaaataatactgataaaaagtgttcaaaatggtaacaatagtttgtggaaatatttgggcaggtaataattacttttggacttgtgttccccattcaaaaacaaaataccttgcagtgtttctgagtttacttttgtcatgctgtatacgttctctcttcaaaatgaaaactgatgcattaaagaaagaatgagttgaatttgaggtatgggtgcaaattagggaactcctaggaattaactaagggttattctttcagaaaataacattcagatagtgcaaagggtctttagttaggaaaatgtatatgatctctggattgatgttgtctttaagagttgtatcatacagaatagacatggaaaattgaccgcgaatgatgtaacccttgatcaatgccattgcacttgcatgttttctctatcgagataatttttttattttttataataatatatgagaatttctccatggatttacagaaatcacagctaatccatgtgatttctttctaaatatagatatttatgtatttatctatatcgatatatgtccaccctctacacgtagactgataatcattaactgatagtaaaaagctaaaaatgtagacactttccacaccatctacctcgtttactaagctgccacattatgtgtgtgtgtgtgtgagtgtgtgtgtgcatgtgcacaagctgggctatgtttcaaatgttctgttttctttctcagaaactattgatgtgttttggaaatattgaggatgcctccaatgcgagtatcccctatatcagatagtggggcagccctgccctgggaacttagacaactcagatcagatcttcccagtgggctaacctggcacctaacttcttcgtgtttcatgttcct

SEQ ID NO: 41885 - DNA, 1468 bp, Homo sapiens
tttgtcatattcttaatttatgtcatatatgtcagtttctcatatattttcctcctatcaacagttgtacttttgagcctaacagatttttcctcttccagcatctctcctttctaatccattttgcaaaacttgacaatcatttacctaaagcatgacttctgtttatttcactcctctgcctaatggttcctcatcctgaccttaatgcctgtccccatcatcatacattcatgtcaccattctgcatatcctggcccatgaaactgctattccttctgcatatcctggcccatgaaactgctattccttcataaactatactttaatatattaatggtcactgctcaacagttttttctgtagtaaatatctggtgttctatatagtatttgacatatgatctcaaagtagtacggcctgccctcatcctcttttgaccagtcattttatgaggcagtgtgggtatttatgagcccccagagctggaccagttcccaaaggaaatggaagatcaagaactctgagaacttccaggaaatggatgggaggatggtcagctctcgatggtccaggatgcactctctgatcaatgaaacccttcctctttgtctttttttttttttctcactgattaggcctcatggaattctgagcctcaagcttgttcttcacaaaaggctgctctttggatgactgtcccttcatctagtctaaactcccttttcagtcctgggtgttattcattccagaccaggagtgtgtatgagtgtgatgctgggctggtgggtcccaggtggcctgatgtctagcgcttggttgagctttcacaggcccatgatcctgggtgtgatagaacagtatctctccaacttaagcaggcatcacagtctcctgcggagctggtttacacgtagcctgctggaccccacttctgagtgtctgattcagtaggtcttgtgtggagcctgacagtgtgtatttctaatactttttggggaactcatgacaaattccaatattccagtattctaacaatattgtaaggaagtacaatattgctgagtggtatgattatgaaagtgctcaataccttcatatctcggtgtggctgctcatgtttgaatggtcttgtaggctttccccaagtctttccatttacaacacctagatcaaatgctacatctttaatgatgtttttgtgactcctttaaccaggggataaaacatttgctgttactcttctctctaacttcttagcaatgtgtttgcccctcttataatatttatcaccatgtaccctacataaagtatgcctgtctttctgccaacacataatctctttgaaggggagtgtattggtctcattcatcttgcttcttctaatgcttggtacagtgccttagatgcaatacatattgtttgccctgtgcccagatcccttgagtccactttttgacctctgtta

SEQ ID NO: 41886 - DNA, 1032 bp, Homo sapiens
taacccagttaaaaaatggtgaaaggtcctggatagacatttttccaaagaagataaacagatgaaaacagatcaataagcagatgaaaagatgctccacattattagtcattaaggaaatgcaagttaaagcacaatgaaatactacttcacactcattgggatggctattccatacaaaaaaaaaaaaaccagaaaataaaaagttttgatgtgggtatggagaaattggaactcttgtgcagtgtaggaatgtaaaatggtgcagcctctgtgaaaaacagcttagtagtttctccagaagttaaacataaaattattgtaagatctattaattccactcctgggaattactcccagaagaattgacagcagggactcagatacttgtataccagtgatcatagcaacgttagtcacaatagccaaaaggtgaaaacaactgaagtgtctgtcaatggatgattggataaacaaaacatagtatacaatggaatattagttataaaaaaggaatggaattctgatatattttgcagtgtatggatgaactttgaaacattatgctaagtaaaataagtagggacaaaggacagatatcattaggattccacatacgtgaggttcatagaatgggcaaattcatggagattagaaataaactagatgttaccaggcttcggttggtggggtggggagcagagtgaggagttattgtttcatgagtaaagagtttctgttagggatgagtagaagttcaggacgtagtggtgataactgcacaacattgagaatgtacttagtgcaattgaattgtatactttaacatgttaaaagtggcagattttatgttatgtatactttaccacagttttaaaaaacattaattctagtcttgcattttgttattcttgctctgcctctgggacctggatatatgcatcactaatgctgcttttctctctcatgagggaaattcctgtgaattgtctataagcatttaaacaatatgcttggatagctgtgaatttt

SEQ ID NO: 41887 - DNA, 1023 bp, Homo sapiens
aaatttctctttataagagttaatttcaacttattctgttaacctgtcatgaaacagaatctcaatttcttttcctactggagatatgtctgtcctttacatcaccatttaatatcttgacaatgaagaaaattgtataacctagaaagggctgaatattactgagccctgggacctgggtcaatgatacttgtaatgtgactgtcttctaggaggggcttggcctaacttcttgtgcccactgatagaaggaatcagatctccctaatggcaactttccctttctgttagtgaactgggcactctaagagacgtatttattacttcagagcaggcttttgtatactgagaatgaagacaatttttctgtctccaaaatgcccaatatgatcctggtctaggtaaaaatcacttgctaactatgttctcatgtaagtagctcaagatccaatttcctgtaccccaggaagaatggtaatccaggactgataaccacatccttcaactagagaaactggattctgaagaagtactgtagatactaaaaatatgttgtggatgtgggcagttgttattaccagaattggctttaaggaacgttgaaaaataggcagaattcagcattattttattctccttttagtagcgttctctcaattttttaccattactcatgccttcttgagaatcaaatggaaaacttaccccctaggtctctttttgtccagacacttaggaaacctcctttctgttgatagttatattggccagatttgttagtcaactaatttgtggaatacactgatgacttgaagtggctaaattattatactgctcaggtatgttctgcaaagtaaagggaatatggctttgattaatggaataaaggtctaatggtagataagtttctgctggggcataggctatccccattatttcttatattaattcatcttttctttgattcaacaaatctttattgcacatcgtttatatactaggtattgttttcagcattgtgct

SEQ ID NO: 41888 - DNA, 1014 bp, Homo sapiens
ctctaggttcaaggtttaataccatcatatttaataatactgcaataatcctggttaatcttaaaatagtgtcactagggaacatgtaaattacaggatatgttattctttgaatgaatttcatctactattgtggaatttgaggtaatgaatctgaaaacagtttgaaggctataaagcacttaacaaatgttatttttttcttctttgtttttatctgtcatttgcttgccattttccttagaatctggagtaatatgcatacatttgcagagaaaactcatatctgatatttttgcttgctaggaaataattctgttttgtacaaataaatatataattatacatcaacatgtagcacattttcaaagtatgatctaattaaaataatctaaataaaattttttctaaactgatacaaaaccagtaattggtgtcatagcagcttgtcactctgtttagtaatcttgtagtattgtttaaatatgtacatatatgtgtgtgtgtgtgtgtgcttgtgtgtgtatccttaagactgtgagccaagacaatattttcttatgtacctcctttttcttcttataattccactttaaaatattatctttatctattttctgctactttaacaatgcatgagactgggtaatttataaagaacagaaatttattctctcagagtctggaggctgagaagtcaaagattaaggcaccagcatcttagggccagtttctctgcttccaagatgctgccttgatcagccttccaagatgctccctgccattctagagggtaggaatgccaagtcctcacatggtaaaggaccagaagagagcaaacggattccagaagccctttttatagtggctttaatccattaatgaaggcagagccctcaatatgtaaacacatcccattaggccccacctcccaatgttgttgcattggtgattaaattaaatttccagcacattaattttggggaacacattcaggccataacagatatatag

SEQ ID NO: 41889 - DNA, 1060 bp, Homo sapiens
ttcattttagaaacatctctcaggaaggtagtggatggatagagggtagaggaatgtcaaaaatagcaacaggaagctgtctaccttctgttggagcagaaaagacaaaagaagaaggacaaagagagtggggctcctggagaaaggattaacgggaaagctttctaagaggcagaaagttgattgaaggtggaggatgacaaagaaggaagcattgaagaagactgaaagtgtggatgacactgataacaggatgagctgagaaaggtttggtgctgcagtcgtgagtttcactttgggcatatggaaactgaagcgaccacgtgtgaggatacccactacacagatggaaacagggtcttcagctcagagagagaaaatgcaaaagggcgagatttgggatcctagagcatccaggaagcgtctttgtgtggaatacaggggaatagaggcaaatggagcctttccttgtttcctgcttcccttttacttaggagattaaagtgacagtttcattaactgcttttaccacattaaacattgttgaggatttggatttgggtaacattttgtcttaataagaaacctactaaaaagtaagtttttcaaaaaatgttttactcttacatgatcaagtctttatcatggaacctgtcagcgttaacatctaggatttaatgtcaaccaacgtaagcttttaaaaagccatattaaatcagaaatgacttaaaaataaactctagatgaacttgatctatttaagttaaaggattaagttatatacatgatggagcatcagagattgagtcctttttgggtgggccttggaaagggaaaatgcagaaagttctaatttgttttgctttcgaagaagaatcatcctttttatgtattcatatgcataatttgatcagaaaaatgcttgatattctaaccttttaattaggagggaggaatgtagagatcatgttgtaaaattgttttccaggtgaggaatctgtgcaataaatttgagaaacactgaaggctttattgtatgctttttctggatttttttttt

SEQ ID NO: 41890 - DNA, 1049 bp, Homo sapiens
gacctggttctgcactgtagactgtggtgtcagggctgaggcaattgtcaaactatccactacaggtaggcaagtttagaaagagataaaaacaatgaagcaaaacaaaatttcctaggcaagaagagcttacaagcccaagttttaaaacgcgagggaatttaaggcagatagccagtgcacccaacaaatgggaagcattaacacctaaggaaatagacattatcatgcattgctcaagttatttgaaaattattttataaatctttgaaaagataaaaaaggaatgagtatccaaattaagtagtaaaaagagattgtcaagagaaagcaaattttttgaaattaatatgaatgaatacagccaataactcatcacaaatcttgtaaataaaattttcatacagtttaaatgtttgaaaaagactctaattaggagaataaataatagatcgaacgcagttgaagtgacagttaatgaaaatgggactgaggctgggtgcggtggctcacccctgcaatcccagcactttgggaggccgaggcaggtggatcacttaaggccaagagttcaagatcagcctggccaacatggtaaaaccctgtccctactaaaaatacaaaaattagctgggcatggtggccagtgcctgtagtcccagctacttgggaggctaagtcatgagactcacttgaacccaggaggcaaaggttgcagtgagccaagatcgcaccactgcactccagcctgggtgacagagcaagactctgtctccaaaaaagaaaaaaacaaaaaacaaaacaaaaaaaaacacatagggattgagtcaattacataaaatattgcagaaagaaaaagttggatatactatgaaagagaagagcatcaggggatgaactgagacatgaaatacaggaatttcagaagagtgaagaaaagacaatatacaacagatgacaacagctaagaagtttctagaactaaagaaagtcatgagttatcagccagaaaaaacattgaatgctaatcaaattaaattaacacaaaa

SEQ ID NO: 41891 - DNA, 1071 bp, Homo sapiens
catatttgttcactgcgataatattgttgcagaactttctccttagttcagctaaaagcaggctcttgtcacacgaccaggaaagattaggctcgcggacacatagaagggtgaggaaaatggaatttattgggcgaaggggaaaaaggaaaacgaaccaaagcaagagagagccctgctagcagcttttctgactcacagattgaatcccaggtcaccacaggagctgaagacagcaagctcctcccgtgcacaaggcgtgaactccccgtggccccacccatttcccccagggcacatgtcgggctccagtccactgtgggcatgcccagacaagccctgggcaggttccctcatttgcacaaaagcttctgatgtaaacacttgtggggaaggttggagattctctggggacccctttttatctgtgtaggcatttggctgtctcaatatttataaaactgaaatattgggaacaatttaaacgcacagaaatcagtgattagttgaataaattatagcatatctatgtcagggcactgcccttgatatttacaaataacgctgtagatgaatagtaattggcatgggaagatcttcactgcatcgtttggttccaggattttttctaagaaaatatccatagacatagttatagatatatagatataaatacatagaaaaaaatatttggaactaaatttatattagaggtagttactgaaaatggtacataatgagaagtatattctcctcttcttctttattcacatattttagtttttaaaaattatctataatagcacaataatgaaaagttattttctattttaaatgaaagatatgtctttaataaactgataagattgacacagtaaagggagaatacaaatgaaagtgcttttggaataaaaatagaaactgtgctcttgattttggtcatttgtatcaaatcatatttcatgcaaagcaataagcattctgatataaaaactagcatctcccattttattgctgtgttgattaataacaaatcagttttctatttgtgtctcatatgtgtattaagac

SEQ ID NO: 41892 - DNA, 1032 bp, Homo sapiens
agacccatggggagaaggcacttcctcccctgcccggtggtaacaggcatgcctccccttctttgctggcgaggtgttagagaccaggggggaaagcctggactgttatcttccagcagtaataagccactcactctaccacctgctgtatccatgaaagccacatgggtaggagcaagaaggtccctgataccaccagagacccagggggaccctgaagttccacccctgcccagtagtattgaggagtcattctccctgcagcagggtatcgtggagaccaaatgggggcctgggcttccacctgcagcttgccataatgaggcaggaccccttccccggccagcatgcagtcaaaggaggcttcctaagacagaagattgaaatgagatccagagtctcataacactcaaaatgtccaggaatacaattgtaaatcagtcttcatatcaagaaaatctcagcttgaatgggagaagaaaaatcaatggatgccaacgatgagactgcacagacgttggaattacctggcaaaagttttaaggcagccatcatataaaagcttcaaaagcagttacaaacacacataaaacaaaggtgaaagtaggaagttttaacaagaaaatagaacatctctgcaaagaaacagaagatataaagaaggaccaaatggaaatgatagaacatgttgagcctataaagttactgttctcttcagatggatctctgtgtgggttggggtctgcattcaaagtccagacatttctcaagtctgtctcagcctttgctttccacatgaccctgtcatggctcctactcatggtagttcaggcaggcctgctacagcctcccctgggcaatgagggaacatgaatctactgcatcctcctggccagagatttcagtccagggctaggcacataaccaagtacagaacctgagaaaattcttggattctatctgtaattattgggaaaactatctctttttcagtttgtcacttaattgtttgaataattattagaattatta

SEQ ID NO: 41893 - DNA, 1058 bp, Homo sapiens
tactcttctgcagtttcacaaagcccagttggtttaaattctttgtccttccattgtccaaacctaataaggaagtcagtcagctgtgggttgggataaggaactggttggtggtaaggaagaacattcctccaagggccttttgatctttaagaggcaataagttgccccattccctgcttttatacaaaaatatctcttgtgtgtgtcattcagacagattgttttccttcccatgaatgtaattgttgtctcttggagattttatgagaaacagaattcaggccattccagagttaggcagaagaggaaagcatatgactttatcttgctcacttcccagacttgtccttttacttgttaatatttgtctccaggagtcatatatttcaatgacaaggcaaaatacccccagacaattcatgcctgttcctgactctgtacctaacgaactgtggaccttggtcaaacattttatactgttgggcctcggttttctcatctggaaacttgggaagttggactggacaagataaatttggcaggtagtgggttattgctatcaaaaacatggattttgcaaattaacatacctgattttcaaccctagttctgttacttgcaaagatgactcaaatgcagcagagcctcagttttctcttataaacaaggttgttatgaagattacataaaataatgcttgtgaagtgcttaatactacctgaatattgtaagtgctaagtcagctttagctcatatttggtgtttccatctatgatttttccttctgaagtaaactttacaatatctgttattttttaccatatatgccaatgatattttctattagtgtgggcaaatcaaaatgggcaatggtaacactatattttattctatatatacaagtgtgtgtgtgtgctctctctttcacacacacgtacacacacccaaaaaagtaacttatttttctaccatcagcagaatctagaattaacttaaagaggttactttaacctagtatggttaaagaagtaccatactaggttttggttcctcaa

SEQ ID NO: 41894 - DNA, 1040 bp, Homo sapiens
tgagaactaacagttcattacctctgggccagactttttctccttgggtcaaacaatcaagtgtttagagccgagtctgagccttaagaaaacaaggctgaccatggagcatttggacccatgaacacaatcttgctggggctggaggggtcagagctgctcacatctagacccacagaagcgagctgatgagactaattgggacttcttgtgcaccaggctgagggtaattgggtccctagacatgttgaccttttcatttattcaccatttaacatgagctcttagctactgtgtttggagcttaaactggtacatttaaagcagcagccacattcttcttctgcgtgtccattcatccttcttagcttcttttctttcttccttccttcagtctgcccttctttctggtcttttgaggaagatggagtggcctctgagtggaggtatttgccaacagaaggcaaaccttacttcttgtctaggcctctttctaggggtgatgggggtatcacttaataaggcccccagcctcagaaatggagttgagaatttgaatagcgtggttctgctccagctgccccttccagaccgtctcagcatgggctggctggactccctatttctctgccccacaggctggccaatggtctgagaagcacttgggcactggggcactgatctggcctttgtccccagcggtgttcttctttgccaccagctgcctgctaactcagtctattcctgtagtcagtagaggggcaaagtacccagtgcacacaggccaaggcccatggcattgcctgggcctcttatagctacagtattcgtatcgctgagaaaagaaggttcttgaaactttttcttggctattgaatgcaaccaggtggtctccaggaatccaaataagatgaatagcaggtgggtgcacttttgctcttttgtgctgtaacacaaccacttacaatagggccctcttactcctacagcagggtgacttcacctctcatccaggaacccctgggcccttccatcctgaa

SEQ ID NO: 41895 - DNA, 1032 bp, Homo sapiens
tgaatagttttttttttttttttaattatgtttgtgtatccccttcattataaaaccaaaacaggttttggatagaaaaattaaaacatgtaggccacaaagaggcaaaaaattataaaacttatattttactatggaaatgttaacactttgatgtatagcttcagaactctttctggggctgtgtataggtatgtttctatttataagatatttgaaactttttccaattttttttcctgaaatttacctaaagctccaatgttgaaattaaaaaaaaaaaaaaaaaaaaaaaaaaagcactaagatcccctaatgagacaaatagtcaatccctgagactagactccttatcccaagacttagtgagaggtgacagaatcctcacccccatggccaggcaccatcccaatgctccttccttcagagcctgtgtaagcagaggaagggagaagtattgagattgttggctttgtaagttatttagatttacagtaagaataattttgtgtgtgtctttttggctggtgaggtggtcatgcactttcctcttcaaagtcaagtgaggcagctcccaagagaattactgaagcagcttgggagtatttgcaacaaggaatgactggcctgtgctccaattggatgtctattcaggtggaggactggcttgcctgactctgcctaattggaaaaggaaatgaacataaaagagagagcagggtaccaagaggggatgtcagtggggccacttgcatctgcacagtggcactggcatgtcctgaaggcctgtgcctcctgtgtgctcacagggaaaccgccaaagggacctgagtagagctcatcttgccccacttagaaggggatccaggaggaaagcccatgtgattgagcatggtgggaattgacagggagtggaagggtggatctaccacatcagagaagtgtgcagttggcaggcgtagtgagcctctgctaggggctctggaagggtctgcatttggatacccaccccgtagagggcagtgctgtcag

SEQ ID NO: 41896 - DNA, 1037 bp, Homo sapiens
cttgttttccctaagatagattgaaagacaaagggaattcacttttccttggtgtcttatttaagatgctgattgtttgggtcacttcattatgttgacaaattccttatttgatatttagtatttggagttaggggaaatgagtatttcttttttcttttttacataactacaactgctgtgtttaagtaaagataccagattcaggttggctgaattctagttctagtttttctctaattcaaactcagtgttgcttgtcttcagtcttcctgttaaagtgaggtggaactagatggtgtatgatgacctcatgtagcctgaacatcctaagaaagttaaaatgtaagcattgctcctgtcagtggttatttgttcgttatattgcctcatgttaaaatacgtttttgtttattgttttaaagaacaacatagacgtttgtcctgaatgtggtcacctgaaacagaaacatgtcctttgtgcctactgctatgaaaaggtgtgcaaggagactgcagaaatcagacgacagatagggaagcaagaagggggcccttttaaggctcccaccatagagactgtggtgctgtacacgggagagacaccgtctgaacaagatcagggcaagaggatcattgaacgagacagaaagcgaccatcctggttcacccagaattgacaccaaagatgttaaaagggtaacttcacagtaaatcatttctcctgaaatagaggaagattctttatgttgttgtgcttgtttttaaatcatcagtatagtttaacacattctttctaagcagttttgtgtgggataatttgaagaatatattatgagtaaactccgaaaattttgtttatccaaaggctcaatggattatgtttctattatatacaaggttttaagtaaacataaaatttccagaacaaaaataaaaaatttaaaattcatagcaaaaattctgtgttttggctttggttttgtttgccagtgccttttcttagacaagaatacttaacacagataactccattt

SEQ ID NO: 41897 - DNA, 1056 bp, Homo sapiens
acttaattttctgtggtattggatttagggtttctccaccttggcactattgacattctgggtccaataattcttttttgttggaggctgccctttgctttgtaggatatttggcagcatctctggcttctgcttgctagtagcagctgcacccaccctaccctctccagttgtaacaatcaaaaatatctccagagttttccaaatgtcccatggggagcaaaattgcctctggttgggaaccactagattatatgtatcaatgccatcactgaaatattttggttataaggcagtatataatattttgaattaataataaggaaatgaataagccttaactggtgaaaaggggagaaagggaatggaacatttacagttggacctggaaattcgagtcttaataagttgcccaagcattactgtaacaattctgaaccactgcttgtctattcacctggtggttcttagatggaatttcactgaagtatcatgtctttaaagagagaagcttctgaaggggagaaatagaggatgtatgatggacaaggcttctttggggatgcccactccatgcagacaaggaagatgtgccaggctaatcaggagccagtggcagcagggcactggccaagccccatgtctgtgcacagacagctcatggcccattagtgtatggtgcttatcccagaatatgtggacatgaagaaatgaagatggaggacttgagtaggtggtgaagatcatcaaactgggatacaggaactaggttatttgccactttgggggtgccatattgcttctaaagactattttatggctgctttatgtggcagtgtatttgcataccccttgaggaacttgcctctggccagcagtgggtaatggaaattttgtacttttaacttttgttgtgaaagactattaaagttgtctgttatccaaggaaacctttactaggctttcaaagccagagctaaagaataataggtagttcccaggtaaatattttaatgtgcctattctgatttctctaatggtaatatgcatttaatc

SEQ ID NO: 41898 - DNA, 1028 bp, Homo sapiens
caacatggtgaaaccctatctctacgaaaaatacaaaaattagctgggtgtggtggcaggcacctgtaatcccagctacttgggaggctgaggcaggagaatcgcttgaacctgggaggtgacggttgcagtgagccgagattgcgccactgcactccagcctggctgacagaatgagactccgtctcaaaacaaaaaaaagaggatacagtgtgtataatctggaggttgacttctacagcaaacttgataatgtcccatttgaatttaggtggaaaggtagtttctttttaaatactagtttcctacagaaaaatttactcgtttcctacagaaaaatacagggaaaagaaaacaatgtggaagttttcttgttctcttttgaaagatgccaatgtaaattcattttatacacatttatcttttctcaaagatattaattttttaataccatggctaaaatggacactcaggacccagtagccacatggtacacagtggcgttttttgaaagcaagtatggacatgtgcacacccacacgctgaggtggcctgatgttaatgctgaaggttacctagttaaaacctttcatagcttgggtgggggcattgcttttccccttcagtgtgtcatatgcataagaagttcaaagatccttgctgcaagaaatttccaccttgcttccctcgggaacatttacaaggaagatatggcctccgcagtacggactttcactgggctaatactttaagtattagccatgcagaggaattcccaaaataaatgtttatgctgtagcttctttcatgtttggttttacactcttaactttgcaaaatcgtgtatctgttttattttttaatgatgttttactagtcttatgatggacttccaggaagagaaccccaatttaaatagcattgcacctataggaaatgagctttcagcttatgacagttgaacctgtgactattcaagaactaattaagtagcaagtcaaacaggttgtcagcaccatgtgtcatgg

SEQ ID NO: 41899 - DNA, 1033 bp, Homo sapiens
agtagttcctttttttttttttttttttttttaagatggagtcttgctctgtcacccaggctggagtgcagtgggacggtctcggctcattgcaacctccgcctcccaggttcgagcaattctcctgcctcagcctcccgagtagctgggactacaggtgcacgccaccatacccaggtaatttttgtatttttagtagacatggggtttcaccatgttggccaggatggtctcgatctcttgacctcatgatcagccccatgcccgcctcggcctcccaaagtgctgggattacaggcatgagccaccgtgcccggcccttaacccagtagttgttactgacatttctgattgtcgtgctggggggaaaacggtatgtgccactggcatctagtggggaaaggccagggatgctgcaaactgatatactgccaagtttatcagttgggaatcccaacagtgaaaagcataaaaatgaaaggaattttaaggagactttttatagaagagtgggcaggattggaggagccaacaagtgatggtgaggcacacagggaagagcttcagtgggcaccatcccctctctggtttgaaggggtagggaggggaccagagctgggaggagggggctggaatactgctggaggagccactcccttccagacctgctgtggccatcacagaatgcagccactgccagagcagcagcctgaggaaccaggcagggggagcacaagtaccctagcctctctctttctgtttcttgcctgccgatctcctccactggctaaacccagctggatgctaagagtacagtcagcctgcctgctgaggagggaccaccagggaccaccatcagcaagggatccaatgtctttctgcctctgcagaatgaaggttggggcacggggggcgctctacttcttagggatattgtgggaataaaaggaaataggcaaaaaatgtttttgaaaaacaaagcacatactgcgcacccgtgggccactactgcttttgacccctggctctgttt

SEQ ID NO: 41900 - DNA, 1056 bp, Homo sapiens
gccaggctttggtatcaggatgacgctggcctcataaaatgagttagggaggattccctctttttctgttgattgtaatagtttcagaaggaatggtaccagctcctccttgtacctctggtagaatttggctgtgaatccatctcgtcctggactctttttggttgataagctattgattattgccacaatttcagagcctgttattggtctattcagagattcaacttcttcctggtttagtcttgggagggtgtatgtgttgaggaatttatccatttcttctagattttctagtttatttgcgtagaggtgtttgtagtattctctgatggtagtttgtatttctgtgggattggtagtgatatcccctttatcattttttattgcgtctatttgattcttctctcttttcttatttattagtcttgctagcggtctatcaattttgttgatcttttcaaaaaaccagctcctggattcattaatttttttgaagggttttttgtgtctctgtttccttcaattctgctctgattttagttatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatgtgtcccagagattctggtatgttgtgtctttattctcattggtttcaaagaacatctttatttctgccttcatttcattatgtacccagtagtcattcaggagctggttgttcagtttccatgtagttgagcagttttgagtgagtttcttaatcctgagttctagtttgattgcactgtggtctgagagacagtttgttataatttctgttcttttacatcttctgaggagtgctttacttccaactgtgtggtcagttttggaataggtctggtgtggtgccgaaaaaaatgtatattctgttgatttggggtggagagttctgtagatgtctattaggtctgcttggtgcagagctg

SEQ ID NO: 41901 - DNA, 1072 bp, Homo sapiens
tcttccagttgatcgcattggctcctgaggcttctgcattcttcacgtagttctcgagccttggctttcagctccatcagctcctttaagcatttctctgtattggttattctagttatacattcatctaattttttttcaaagtttttaacttctttgccattggtttgaatttcctcctgtagctcagagtagtttgatcatctgaagccttcttctctcaactcatcaaagccattctccgtccagctttgttccgttgctggtgaggaactgcattcctttggaggaggagaggcgctctgctttttagagtttccagtttttctgctctgttttttccccatctttgtggttttatctacctttggtctttgatgatggtgatgtacagatgggtttttggtgtggatgtcctttctgtttgttagttttccttctaacagacaggaccctcagttgcaggtctgttggagtttgctagaggtccactccagaccgtttgcctgggtatcagcagcggtggctgcagtacagcggtggctgtagaacagcggattttcgtgaaccgcaaatgctgctgcctgatcggtcctctggaagttttgtctcagaggagtacctggctgtgtgaggtgtcagtctgcccctacttgggggtgcctcccagttaggctgctcgggggtcagggacccacttgaggaggcagtctgcctgttctcagatctccagctgcgtgctgggagaaccactactctcttcaaagctgtcagacaggaacgtttaagtctgcagaggttactgctgtctttttgtttgtctgtgccctgcccccagaggtggagcctacagaggcaggcaggcctccttgagctgtggtgggccccacccagttcgagcttcccggctgctttgtttacctaagcaagcctgggcaatggcaggcgcccctcccccagccttgctgccaccttgcagtttgatctcagactgctgtgctagcaatcagcgagactccgtgggcataggacccgccgagccatgtgcagaatataatctcctgttgtgctg

SEQ ID NO: 41902 - DNA, 2212 bp, Homo sapiens
tgggcctttcacccatatcttgtccctgtgtgtcagttttgcaaggcagtaatatcgaaaccaaatcctaaagcagtttataatttagcctgacacactgtgcaagccaggttttgtatgcaagtttgtgtgtatcattaactaatgaaatcttaaaaagcagtttggcttatttatagataatggagctgtttcttaaccttgtgccttttttttaagctggtagaagcatatcctggttattatctggaatgtagtaatacggtaaccttaagaatgccataaatatttaacctaataaggggattgctagtcttcttttcttgattgaaagggaaacaaatattaatatttgatcattaatatgtgttttggctgtacagatttctccagaggctgtcttactgctttttggtaattagaaattaccaaaaaaaaaaaaaaagaaaagaaaacaagactagtaacccaaaaaggacttacttggtgaaattgtcaattgtcagttgggcactgtggccactccttcctatactcttccctgacttccagaagagaagccaggaactaggtctcccagagtccccttttatatgtgaagtccactcccaggactcccaggaaacttgcaaggctgaagaaagagaggcagttagtcataggagacagttcagtcagatgtgtgagccaaggccagtgtatggtttagcagcagtggacagtcaggctctgtgaatcactcttcccaagctgcaggctgacagaggctgagatcctttccagacgtcttggcttctgggcaagttctggagaatctctcgcttcaatattgaattgtataacaacagtacaaggtctaggagaaaagaaatggaagtgtactgttgtcaggttctttatagtatatgtggaatagtgcataatattactttaaagtagactgtggtaagtaaaatatataatataaaatccttaacttctgaaaaagagttatagctaatagccaacaaatgggataaaatggaatcataataaatattctaattaatccaaaataaggcaggaaaagaggggaaaaagaacagattgaacaaatagcaggatttctatagaatttgaatggaaacccaaccatatcaataatcacaatgtaaattgtctaaacgtttcaactaaaaggcagagattgttagactgagtaaaaaaaagcaagacctaactatatgctgcctataagaaactaactatagctatgaaaacacatatagattaaatgtgaaaggttggggaaaaaatgtattatgcaacactgatcaacagaaattgggaatggattgttaatatcagacaaaataaattatagggcaaaaaatattaccaggaataaaaatggtcattttagaaagataaaggggtcaattaaaaaaaaggacataaccatcctaaacttgtatgtatctaataacagagttttgaaatatgtgggtcaaaactgatagaactgaaaggagaaatacacagttatatacaattatattcagagatttctctaccctcaataattgctagagcaaggagacagaaaatcaggaaggatacgaagacctgaacaacacaatcaaccaacttgatctaacagacttatagaacactccacccaacaatagcagaatacacattcttttcaagtgtgcccagaacattaaccaaggtagaccacatcccgtatcataaaatatctcaataaatctaaaaggattcaaatcatttaaagaatgttctctgaccacagtgggattaaatgagaaatcaataatagaaaaacatttggcaaatccccaaacatttggaagaaatcctggaaggagaagacaagagcagtgggcacaggaagaggggcagagtcagtgggaagtggtgacaactgggtacagaggtgaagaaaaggggcaaatctgagatgacattcatgtttctatgctcagaggcatccaagaagtgagtttaagggatgcatggagataatttttttttttttgagatagagtctcactctgtcacccaggctggagtgcagtggcgctatcttgggtcactgcaatctccgcctcccaggttcaagcaattctcctgcctcggcctcctaagtagctgggattacaggcgcctgccaacaggcccagctaatttttgtatttttagtagagacgag

SEQ ID NO: 41903 - DNA, 1027 bp, Homo sapiens
tcaaaaagatagtgtgatttagcactgaaaagaaaagcttttgtgaacacaggcacagaaacaggacaacgacgagtaaatttcataataagggagcaaatatttgttgttggaggaaggactggaatttcctaattccatgtcaagcaaccaaattcttcatagccacagaaaggaaggtaccacctaccctcaagttggtgagactgggtcatttttttttttctggaatacgtgcaaatagattgtgtatcatgggcctttgcagaataagtattcatggcttgaaagaaaactccaggaagagtagtagaggactctaagaattgccacattaccattgttttggaagacacagaggatgatattgtgtagacatcaatgactcagtgttgggctctgaatgggaagaaactttaggaatacctgaacaaaccagtttatttatttcacttgtttttccttttttttttttttgtattcatgaatgatacttaacaagaaacacacaaagctatgtttaagcctaaaataattcttttgataaaagtaattttaattttttaattttttgaaacagaatctcactctgtcacacaggcgcagtcttggctcactgcaacctccacctcccgggctaaagcaattcttttttttttttcccacaagaagaaaaagtacattttatttaatgaccaagtacacacacacattcacacacatgcatatgtacatataactaaaaaaaatattttttctcatcacatgggatgcattgtgaaatattctacattctttcatttaaagaaaaatgctggtcacgttttagtaaaaatctttcacaaatcactaatatgttacaatgcataactgctctagagcattaacaatgctaagctataattttagggaaatatatagtggtgctccttcttagaattagcccatgtggtattttaggtactcaactcagggaaaaaaaaaatgtaacatagccttgttaccatgtattcagcctggacatggt

SEQ ID NO: 41904 - DNA, 1099 bp, Homo sapiens
ggaacttgagcagacacaggtgcaggcagtggtgactctacaggccctgctattccgggcccttttgcaacgttgtggcaacaataaaattttgacgtagccatcctccatttggaagtctggtggctggtttgccgtggaaatgaccctgtttttatttccagaattacctctgggtttagagaagtggtttttaaacgagtgtgggtaaaaaaaattacctgaggtacttgtcagaatcgcagacttctaggtcccacccagctctcatcaatcagtttagtgagggtggtgcccaggactctgattttaaacatacccctagaaagattctgatacaggtagaggtgagaagccctggtttagaagcagctcggcctcccttcatggtgggaccagggccagcagggaatgtcagggccacccctgaccttcactgtgactctgctgcagagggtggcctggaggagatggtggaggagctcaacagcgggaaggtgatgtacgccttctgcagagtgaaggaccccaactctggactgcccaaatttgtcctcatcaactgggtatgtggagcctgtttcatctaggtgtgacccaggaaaccccattgtcttctttcctgttttgacttgacttcaggaacaaagtgttttactggcatgacttagtagatcaatagaacagctctgagctggtgaatgagcagaatagttgacagattcattgtggcccaaagaataactgtggctttgctatgcagaattcaccttccaagcctagagttcttcctgcaaaatggattaaaagcagtcacagggagtccttgctccgtgctcttgagggtggttgttctgatggagtagagagcctgagggagtgtttaggagcctgggagtacagggacagggcctccttgatcccttggtggggatcaagaaaactcttgaaggctgggtggggtggctcacacctgtcatcctagaactttgggaggccgaggtgggtggactgcctgagctcaggagtttgagaccagcctgggcaacatggtgaaaccccatctctactaaaatacaaaaaattagctgggcatggc

SEQ ID NO: 41905 - DNA, 1046 bp, Homo sapiens
tcagattattatttttttgctactgagttgtttgagttccttatatattctggtcactaattccttgtcagatggatagtttgaagatattttctcccattctgtaggttgtctgtttactttgttgattgtttcatttgctgtgcagaagccttttagcttgatgtagtccaattggttgatttttgcttttgttgcctgggcttttgaggtcttaacccaaaaaaaatctttgcccagatcaatgtccaggggcatctacccagtgttttctttgagtagtttcatagtttcaggtcttacatttaagtctttttaacccattttgagtttttttttaatatggtaaaagatgaagatttagtttcattcttctgcatatggatatccaattttcctagccctgtttatgaaggagaccgtcctttccccagtgtatgttcctgtcacctttgttaaaaatgagttggctgtgtgtgtgagtgctctgttagtttccattgttgtgtctgtgtttatgcctgtaccatgctgttttgcttactgtagttttgtagtttaatttgaaatcaggtagcatgaagcctccagctttgtactttttgcttcagattgctttagctattcagggtcttttgtggcttccagatggcatttaaaattagttttcattgattagaaggaaggcctttgatgcaaattatgcctgggctgtctattgatacacagcagggaacagctacagaaggaaccactggatagcacagtggaggtcaagggtctcacgtgaactgggacaagaatgaggggtttgctccaagttggtttgtttgagcccttgaggggaactcgtgcctcagttttcagcagccagacaggtgccttctagtttcctgattccagtcctgtgtggtatagtagtggcccgtgctgtatggactgacaggagtttggcccatctcctgggcttgcaaagcccttctttcaagtgctgctcctgctgcagggggcccatgtgaccatcaacgcacgggccgaggaggatg

SEQ ID NO: 41906 - DNA, 2008 bp, Homo sapiens
tcattagctatttgctggccgctgatgtgaatcccagttgccacccttgtcacagaacatggactctgagcagggaggtgggccaggcctggatgctggttcaccaggcgtccctgggtggaggccttggagaatggggtggaggccccctacggagcaggctggtgtctactctagccttttttgggaatgctctgtaggagggtatgccctgggggtgtggtcactggagccgcattgggacagggtgcagtgttggccaaggcttagcagggtggcagggatatttctgaggaggaaccagagctgcagcgaggtgtgctgcagcagtgtggggctgccgtgggctgcccgagcaggtgggatgtgggagggagcccctgatatgcatctgggctcatcctctttgcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaattcccagtttggtctacacaggctcgcagctctcacctgtcctgctgtagcctgaatgctcccatgtgggaatagcaccccaccacctgcccagtgtctgcctctgctccgtgtctggggtgagcaccctcaccctgagactgtggctgatgatgatcagccaccaggaagaggctaaatgttaagatgggactgaagttggagccttcctgcgttccagttcctctaggagaggccaagggctgccctgctcccagcttcagggagcctctgcctacatgggatggcccactgtgtggcgtcaggtacctggcacccactgagcatccggggaattaggtccctcctgtgccccagagctgctaggcagactgctaggcggttgactcaaggtgttacctgctagtgcctggggtgaaggctgcatggagcccaaccttgctcctggccttcctgtgctcaggcctctccccttttcgccagggcttcctggtgcctctcccatgaagagggaacttcccctccactcccatggaagacccaggtttgggctgttgccagctttgaggccccctgtgggcttgcctgtcccaacccaagaggcagggctcaaagtgccacccgggggttgcaaggacagcagaggaccacctgcc

SEQ ID NO: 41907 - DNA, 1022 bp, Homo sapiens
cccatgactgaaatatgaggggctcatgtcagggcacgtactgaacagagctggattctcttttcttttttgtccagcacaacaccatggagtctctgttagagcgaggtgagaagctagatgacttggtgtccaaatccgaggtgctgggaacacagtctaaagccttctataaaactgtgagtacccagcacctgctgcctcctgggtgttctctctagagagcagtcgcagcttgctgcttctggcactctccactatgaacgggtctttcttagactgttgaatcatggtggatgattccttgtgcggcaagagcctaaggtgagcgcctcaggcccaggtggttggaggcagttcacttgggcgccgttggagtcgatgcgggccgaggccttgttccactcctgcctctgctctgccctctgctgctctggctgatttctgaactcctactcccagtccaggaaggctggttcaagttctgatcaccagagatttactgttgaatcttattcctctttctgctgagtagacataagtctttaagatgcaagcaattcagccttcctgaagaggttcttaagcttttaatttccctttgacagaaaatatttaattgacaaggatgggtgctgctgactgccgctttctctcaggtcagtgctcatgtcttcctatgtggagatggcactgttggcccatggttggatagtcatagggacaaatttacttggtctgtccacacacatttgctttcatgtgcacattggagggagatggctaggtgggattaggaagatagtctgtgaccagaaagcaagagagaaggtggcaacagtggtccccacaaaccacatcccaagtgggaaccacatctgttgtcctcaggaccatcttctaggaagaaacaccaccgtggtggtcagatagcattgtgtgaagacaggagtggggcaaagttaagatattctgccaatcccatttgtattattggtcctttgtttgtacctggcctaact

SEQ ID NO: 41908 - DNA, 1041 bp, Homo sapiens
aagcccctaaaaaaaaaaagtattccataaatacttgctgaatccaagaaccaaacctagtacttagcttatactgaaagctttaattatactatctcatttaatccttacaacagccctttaattgttatcaccctattgtatataagaaaaaaactaagacctcagtaaaaaaaaaaaaaagaaaagaaaaggctctcttcctcggcgctgcctacggaggtggcagccatctcctcctcggcatcatggccgccctcagaccccttgtgaagcccaagatcgtcaaaaagagaaccaagaagttcatccagcaccagtcagaccaatatgtcaaaattaagcgtaactggcggaaacccagaggcactgacaacagggttcgtagaagattcaagggccagatcttgatgcccaacattggttatgggagcaacaaaaaaacaaagcacatgctgcccagtggcttccggaagttcctggtccacaacatcaaggagctggaagtgctgctgatgtgcaacaaatcttactgtgccgagatcgctcacaatgtttcctccaagaaccgcaaagccatcgtggaaacagctgcccaactggccatcagagtcaccaaccccaatgccaggctgcgcagcgaagaaaatgagtagacagctcgtgtgcacgttttctgtttaaataaatgtaaaaactgcaaaaaaaaaaaaaaaaaaaaagaaaagaaaactaaggcccagggagacgaaagaatttgtttgttcaatgccagacagcttatcagtgtcagagctagcaactgaatgcccggtctctagactccaagattcatactcttattccataacataatttttttaaaagggggaaaaagactagaatcaggaagtaaaaagataaatgtaacagtttcagagattaaaggagcaaaccacaaggcaagagacaggtatcctccttgctcatccactgggagagtctagaagcctgacaccacagcaccaactaacacagcaggcccagctcttggcttgtaat

SEQ ID NO: 41909 - DNA, 1034 bp, Homo sapiens
ttctccatgttggtcaggctggtctgaaactcccaaactcgggccatccgctcgcctcggcctcccaaagtgctgggattacaggcatgagccacggcacctggcctagctgtctttttaaaatttttattttttgtagatatagggtcttgctctgttgccaaggctggtctcaaacccctaggcaagctatcctttcacctcagcctcccaaagtgctgggattacaggcctttttttttttttttcttgtgtataatgcaccatttctctctggctgccttcaaggttttggttttttttgttttttttgtttgtttgttttttgtattgagttttctgaatttgtttatgatgtgtcttggtgtgcatttatttgggtttattcttcacggggttctttatgccttttgccagatttgggagatttgtagccattatttctttgaatgcttttccagcccctccttctgccttcatcagggactccaatgacattaatattagatcttttgttatttccctgaggccttgttctgtcttcaagttcactgatttcctctgtctttattctgccctttaacccatgctaaagcttttttcttttgcttagtgcatttttcagttctgaaatgtctgttttgttctctacatcttctctttgctgaaactttatttttcatttgtttcaagcatgttcatagttgctcgtggaagcattttgaggatgcctcttttagaatctttgtcagataattgtaagtctacgtcatcttggtattggtgtctatagattgtctttttttgtttgaaattatcccggttcttttggttcttttttttttttttttttttgagatgaagtctcgctctgtcgcccaggctggagtgcagtggcgcgatctcagctcactgcaacctcctgggttcaagcgattctcctgcctcagcctcccaagtagctgggattacaggcatgtgccaccatgccaggctaatttttgtatttttgtaaagatagggcttcaccatgt

SEQ ID NO: 41910 - DNA, 1030 bp, Homo sapiens
attctgagagctgataaaatgtgccattgtgtgcagatctgggtagtttgaagcgttctcatttcctgaggtgtgtcagaaagactgcgtgagaaaggggtcacagtatcttggatgtcatcttttcatgcagtaaaaagtctggtttccatgaatgtttgtataacaaaccacctcaaaacttggcaccagtgtagcatgtctcatgactctgtgggttggctaggtttccccactcctcccactgccagctcccttggagctgaggctcacaccaggctagaagccatgaaggcctctgatgtgtctggcagtttgtgctggctgttcactgggccctgccatcctccagtaggccggagcgattcctgcacaaagtcccagagtagctccagacagggaaaagaaaggctgtggggcctttgaggcctaggtccagaccgtacactgctactccccacgccattaccttggttagagcaagtcacagacaacccttagggacatccgtttggggagaggaaaaggcatggccactggacagccctccacagctcttttcataatgacctgatagagcagccacctttagtctagtgcagaatcccagcaaatatcattctgatatcagtagattccatagggcagagctgaagcagctgttctttgctaatcttggaagtttattgatgttttatttacacacctgtacagacagaagataatagagattgtttagaaatattctgtcacctataatgactaagcattgctataatggagcatgtggtttccttaattgaagaatacctaaatagaagcccattcttaactggcctcagtataaacagcttgtagtggcaggtcaccaggcctggatcacagtgccctaccttgtttttgcttcataggcagaatggtggtaagtggtactctggcctgggcaaggtctgagcaaggcctgcattgatggagggtccagagtccagctctaccatctgcacattttctttggagacttgtgcttagc

SEQ ID NO: 41911 - DNA, 1032 bp, Homo sapiens
tcagtgagccatcagccaccaggtgccacctttcagtgagtgggcttctatcccttccaggtgtctcttcatgctccatgggaattagatgggacatgctttgactctctcttccagaagctttctcttctttttgaaggggcttctgtttgcgctgggtggtcaatgactcagcctagtcttgatttatcccccaggatggggacagacagcaggggagagatctcaggttgagatgagtgtacagtaagggctgggagtatcagaaggggaaacgctctcccagatagtgacaaagctaagcgaccatgtgaagggagaggacaaacatcccatggaaagaagggtagctgccaggcctgcgggaaggaaggagcatgatgctggggcatgggagcaagtggacagggagggctctgcaggtcccctggaacctaaagccaggggttatggaaggcagatccagattcaggtgttcagaggatgaggcaggggtgggtagtttaaggagctggagaagaggtatctccttggggagtggaagatgttagagagatacagggttgcaggacaacagggaggtggaaagagagtgggggatggactgtggcatctgggccccaccaggaaggaagtggccccattggtgactcatacagggaggggtggggccagtgggtgcctgggagctctggtacttgggcaggtctggcttcctgctgccacatctgttgggaggtgaagcctgcaggccaaataatgaccttcattttcaaagcctttttgaataaataaacttttttgaggtttaacttacatatattaaaattcacttgttttaagtgtttagtgcagtaggttttgccaaatgtgtgcagtcactacactcgatacaaaacattctatcactcaattcaaaaaccttttagtatacctccaggtcttggcgcaaagagggcttgctgttgttgggtgtgggggctcacccagtcctggagacagaatgggctctttgtctgaaggtggggcagg

SEQ ID NO: 41912 - DNA, 1049 bp, Homo sapiens
gctaacatacacctcacttatggcatcttgacatggtctcatgtcttggttttgaagattgaaggagaaaatttaagattcttcatccttgccttaagcaaaatatcgacatttagatattctgttgtcttaagagccacttggctctgagttcttcagtggttgttgttccctgggggaaggagacagtgtggcttgcccaggactggagactagcccctgtcacagccctaggaagcaggcctgtttcttggggtctgagtctgacttcaaaggaagcacttgctggcctttctctgcactcccagtacagggagcatacccagtgacagcactctgagtgctcaaccatcagcttctctgtgtgcctgtgttactgcctaccttcctgaccccatcccccaggcccacaagcccagacagtaagggtcaggagcatgttttgtgtatccaaataaatgccttgatttcaccagtggctcagaaagctgttatgtatagtagaaatccgatgaaaagtttacaggtagaaggaagtgtacagctgtggagatgcagctgtggctcttgggttgttttcagctagcaagcacttctttcctagtttgccttcttgaaatgggagatcaaggaatccttccattctttagaattcttcaaaatcttacggtttagagtagtctgccacctgaatctagtgctgagaaatatctgctctaaaaattaggctttttcattttcttttcctcaattttcatctcaaagtagtgacttcccaggaaagtgctgttatccgccacttcttgaagctaaggagatgaggagctctcaaatgacgctgcctgatggctttccatcgtcagggtgctaacctcccctccttctgattcaccttattccagctgttctatgaatcatttccatgtttaataaaattgaccccctgaccatgtaacccacccacttctcccttgatgtgtgtgtgtgtccctgtgatggtgtctgtgctacctgttactgtggtaatggtgtagggttttggtgtttgg

SEQ ID NO: 41913 - DNA, 1045 bp, Homo sapiens
ttccattctttggctaataggatcttttgcagagcagaagtttttaatcttttttccccctcgtttcctacctcagcttctatgccctaagtttttaagcttgatgacatccagtttattaattttccttttatggattgtgcttttggtatgaagtctaagaactctttccttagccctagatccccaaaatgttctcctatacatttttctaaaggttttatagttttgtgttttacatataaatctatcatccattttgtgtaaatttctgtataagacgtttagatcaagattcttttattgttcattttatatttttgtgtgtagatgtccagttgttctggtgccattagctgaaaactctgtctttccttcattgaattgcttttgtacttttgccaaaaatcagttggacttattggtgtgggtctatatctggattttcagttattttcctttgtgtgtctgtttttccatcgataccacagtgtcttgattactgtagctactaaactttatttttcatttacaaaattgttttaactattcaagggccttttccttctccatataaatttgaggataagcatatctatgtctacatataccttactgccattttgataggaattggcttaaacctatagatccatttagggagaaaatacatttttaccatgttgtcttccaatccatgcacatagtatgtctcctcatttatttggatcactgatttttttaatcagctttttgtagttttcagcatatacattgtgtatatgttttgttatatttacacttaactattattttcttttttaaccttggtgtccacatattcattggtagtatatagaaatataattgattttagtgtttatgttgcattctgagatcccgatgaactcattctagggctttttttttttttttgtagattccttaggattttctatatagacagtcatgtcatctgaaaataggaagttatttcatccttcccaatctgtgtgccttttatttccttttcttgccttattac

SEQ ID NO: 41914 - DNA, 1022 bp, Homo sapiens
gctgagtggtggccactcttctttcctctctccctctgttcctctcatccttgtgttttgtttcatttttttccttctctctggactctgttagtactaagcctgccaggaaattctttcattcacacacattatagacagtggctaagagttgtggctctgctgttaggctacctgtgtctagttcttccatcctgggcaagtcatagcctccctcagtataagggtgacttctatgcccattgcagaggggagaatggatttgatgagaggtgcatgccaagagttggctattactgttacttaatgctgttcctggtattcagagctaaaggatcgaggttaaaataaactgaggaaataccctggaatggggaccctcagaattgagtatatatatcagctggggtcctgcctatcatgcagagtctgaatcctgacgtccctaactaacccaggttgaaccacactggccatcagggctctctgaggctgttcctctcatggctggacattagaaccacctggagagcttacagaactgatatccaggccacagcccaggtcccctaaatcagaagccctctagcaccccagggattaatgcttgctgccgcaagtgaattttaatttaaaactctcttgtcagtgtttccagttggctgcacagtggcttaaaaagatctgagtgtccaggccaggcacagtgtctcacgcctatagtcccagcactttgggaggccgagacaggtggatcataaggtcgggagttcaagaccagcctggccaagatcgtgaaacgccatctctattaaaaatacaaaaattagcggggtgtgatggtgggctcctgtaatcccagctacatgggaggctgacgcagataattgcttgaacctgggagcgggaggttgcagtgagcgaagatcgcgccactgcactccagcctgggcaacagagcaagactccatctcaaaaacaaacaaaaaaaaactgagtgtccagtgctggcattttctgta

SEQ ID NO: 41915 - DNA, 1040 bp, Homo sapiens
gaactcctgagctcaagggatcctcctgcctcagcctcccaaagtgctggccaacccactgttctctatctgaatattttctctgattgtgttgaaagtttttatatttgtaaaattctgagcagcagaaacagagtaaacatgggattttttttatataatttttttttttttttgagatggagttttgctcttgttgcccaggctggagtgcaatggcgcattcttggctcaccacaacctccgcctcccgggttcaagcaattctcctgcctcggccccccgagtagctgagattacaggcatgcgccaccatgcctggcttattttgtatttctagtaaagacagggtttcaccatgttggtcagtctggtctcgaactcctgacctcaggtgatccgcctgcctcagcctcccaaagtgctgggatttacaggcgtgagccatgcgcccggctggtatttttttttttttttgtctggagatggagtcttgctctgttgcccagactgtagtgcatgatctcagctcactgcaacctctgcctcccgggcccaaccgattcttccacctcagcctcccgagtagctgggaccacaggcgcacaccaccatgcctggctcattttttgtatttttttagtagagacggggtttcaccatgttgcccaggctggtctcgaactcctgaactcaggcaatccgcccgcctcagcttcccaaagtgctaggattgcaggcgtgagccaccgcacccggccgggatgttttaataatactcttgtccccgaagtctgagccaagctgttttgaaggctagcctggtgttacttgatacccagagctggccatgtctgctgtgtatttgttacacgtaacgtgcttttcaaagtgtgcctggtctgagcaaatacagggcatcagaggctggtgaaggggaagcatctctaacccttgaaagctgcgtctcctggcagcagtccctggcacagccctgggcccaggagagctctcagccacatacctgagagaaccagcct

SEQ ID NO: 41916 - DNA, 1025 bp, Homo sapiens
atggtgaaaccccacctctattaaaaatacaaaaattagctgggcgtggtggcgcttgcctgtaatctcagctactctagaggctgaggcaggagaatcgcttgaaccccggaggcggaggctgcagtgagccgagatcgtgccactgcactccagcctggtgacagtgagactcttgtctcaaaaaaaaaaaagtacattgctataagagaagtgcacacggatactagtagttaattcagtcacatctgtgaaatagcttataaaatgctacttttaaacaagctgtttttatgaaagggcttgtaaatgtttatggtatttaagctacctctctagccataacgtattatacattcaagaaaggttcaaaaccagatatactagaaaccaatctttattttttaccccactactaggtaaggggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgtcaggagcagttcttgggaattaaagtaattactgaagaagtattctagtgagaaaatgaatttatgactcagaagcccctaaagacatgggtactaagcaacaaaataagcagatgttaattaactgtaattttctcttacagctgtttgcagacaaggtcccaaagacagcaggttggtccattttctaagtttaacaaagatgttccaattgtgacagtttgtgtgtgtgtgtgtatatatatatttt

SEQ ID NO: 41917 - DNA, 1231 bp, Homo sapiens
aaaagttgccctggggggaacggaacaaacactacttttcttcaacctttgcttccacagactttttcatccctaagatactagaagaagagcatacataaacgacaaatatagccaatgtgatacagaatgtcagatactatgatagaaacttggcccttagctgggtggttgaattaggtgctacttttttgagatggagttttgctctgttgccaggttggagtgcagtggcacaatctgggctcactgcaacctctgcctcctgggttcaagcgattctcctgccttggcctcctgagtagctgagaatacagatgtgtgccagcatgcctggctaattttttgtatttttgtggagacggggtttcatcatgttggccaagctggtcttgaactcgtgacttaaggtgaaccacctgccttggccccccaaagtgctgggatttcaggcatgagccactgcgcccaaccaattaagtgctttttttttttttttcttttctcagactggatctcgctcttatctcccaggttggagtgcagtggtgccatctcagctcactgcaacctcctcccgggttcaagcaattcttctgcctcagcctctcaagtagctggaactacaggcatgcaccaccactcccagctaaattgtgtattattagtagagcgggatttaccatgttgtccaggctggtctcgaactcctgggctcaagtgatctgcctgccttgacccccccaaagtgctgggattacaggcatgagccactgtgcccacccaattaagtgctgcttttatgttactattaataacatgcggttggttgggttttttgtttctttggggtttttgttttgttttgtttgtttttgggggaggggggcgcaattcattctatatgtgtaactcttttttgagatggagtttcgctctgtcgcccaggctggagtgcagtggcgcgatctcggctcactgcaagctccgcctcccaggttcacgccattctcctgcctcagcctcccgagtagctgggactataggcacacgccaccatgcccggctaattttttgtatttttagtagagacagggtttcaccgtgttagccaggatggtctcgatctcctgacctcgtgatccgcccgccttggcctcccaaagtgctgggattacaggcgtgagccaccgcacccggcctatatgtgtaactctttaatggtaattgg

SEQ ID NO: 41918 - DNA, 1032 bp, Homo sapiens
ttgaacctgggaggcagaggttgcagtgagccaagatcgtgccactgcactccagcctgggcaacaaaagcaagactccatctcaaaaaaaataaataaataaaaaataaaaaataaaaatgtgttctcctttgacaaatatgcttttattgtagaaaattttgaaatttcagaaaagaaacaaaataagaacatgtaaatgattcagaatgctgcgtgctacacagagatattagtgtctagccttctgagtttttcctatgcaaaattttaaatgcaaatttacacatatatgggtgtataaatatatatatgtatatatatttgtattacataactaagatccaaccatgcatactgatgtgtaacatgaaatttttattttatgcacaggattagactgatcaaaatctttggttcatgatacactctcattgttaatccatttattcattcattcatttgctaataatgttttcataaaacttcttgaattaccagccaactcaagaactagaacactgacaataattcaaatctactatatgtcttccttccatattttattcttcccccacctctcaggtggccaaaatcctaaattatttttaaaaaatcatttagttttattttttaaacattataaaaagagaatcatattatacattgtattagtcagcgttctcaagagaagcagaaccaataggatatctatccatctgccttttttttttttttttgagatggagtctcactctgtcacccaggctggagtgcaatggtgcaatcttggctcactgcaacgtccacctcccaggctcaagagattctcctgccttagcctcctgggtagctgggattacaggcgcacaccaccacgcctggctagtttttgtatttttagtagagacagggtttcatcatgttggccaggctggtctcgaacttctgacgtcaggtgatccaccagccttggcctcccagagtgctgggattacaagtgtgaaccaccgagctgggtgtccatctgcc

SEQ ID NO: 41919 - DNA, 1056 bp, Homo sapiens
ccgccaccacacctggctaatttttttgtatttttggtagagatggggtttcaccgtattagccaggatggtctcaatctcctgactccgtgatccacccacctcggcctcccaaagtgctgggattataggcttgagccaccatgcctggcctgaagatggagtctttaaggaggtgattgaggtaaaatgaggtaattgtgtgggccctaatccaatctgatggatgtccttataggaagttattaggacacagagaggaatgatcattggaggactcatggagaaggcagccatctgcaagccaaggagagacctcaggagaaaccaccctgctaaatttaccttgatcttggactttcagcatctagactctaagagaataagtttctattattgaagccactcaagtctataatacttagtcctggcagcccaagaaggctaatgcaccaggtgattttgaagcaaaccctagagttcagtttgtagatagaagtgcagtagtaactcatcaagacagaagagtaacaagccttatgttgctggtcattctggcctcatctgctggctgccttagggtctctggggtgagttctgaggaccaagtctacactgtcaacatggccacggacgagctgctcagagtgacaggacaaccctcactgtgctgtatgtaaaccataaatcacagcacactctttgtggttgggagaacatgtatggtgttttgggagctggcacagtcagggatgtcattcatttcatctgggacaggctttgtgctctgggatctgtggcgggagcagtgagcccagccatgtcctctgcatgcatcgctgtgtccttgtgaacagtggatctttgttagcgcgcttcgcactccttggcttttttatctttcaatcaagaacagcaactgctcttcaaatgattctacaggtatgagggagtttacatttggatttgtcaatggaaccattaggattttttgtttgtttgttttgtaaaaataagaacttttttccttagccttgtgtctgtgccaaaaatgtg

SEQ ID NO: 41920 - DNA, 1139 bp, Homo sapiens
taaagagcattttgttacagcttgcttttttatctagtctgatagtttctgccttttaattgtgaagtttacataattgatgtcattatgtttaagtctatcattttgatatttgttttctctttccctttgtgctttcttcctttgtttctcctttttgattatttttaactctgttctattgctactggcttttttgctgtaactcctctatatattgctatatatatccatgtcttgtcacagattaccatccattaatatcatttctttcttgtacactgtaagaacctatcagcagtatcattccatttgtactccctcctgttttttgcaaactttttggcatatattttctttctatacgtgttataaatcttacattagattttttttttgctttaaacaatcgacttttcacctttttatattgaaatgatttaattatatatacgtagtagacttaaagcacacagagtatatacagagtacacagagccctcatacgccttccacccagatccctcaagtgttaacatttctgaaccattaagaataagctgtagacataatgccccatgaccctttaacacttcaactgtaccttccttggtacaaggacactctaaccacaccattctgacatcattaaaatcaggaaattgacatccatttgatcttgctacgtaattcatgaccccacccagacttgctgattgttatgatactttctttatatagctctaggatccatagattttatagattcaggatcatgtgttgcatttggtttgcatgtctctttaggctctttgaacttgaaatggttcctagtcttttcttgtctctgatgattgatatttttgaagattacagatcagttagtaggatgtctctcagttgggtctgttttttcctcatgagtttatgtgtttttgataggactgccacacagatgatgtattcttctcattgcatcatatcagggaaaataatgtcgatttgtcccatgttggtgatgttaactgtggttacttggttaagatagtcttgccaagtttcttcattttaaagttcttatttattcttattttacttacaagactgtagttctctagtatccttatttattttgaagc

SEQ ID NO: 41921 - DNA, 1024 bp, Homo sapiens
tactgtatttaaacagcagccctcctatggacttttaggttgtcattttgcttaaaaaataatgaagcaattaattttctaacctgtcatgtatgtaatgcatctgtaggattaattcccgaaaatgcacttgctgggaaacataagtgcatttgtaattttagtagatgttaacaaattgttttgtatggtagaaccaaggtttattctttttttctttacccacctctcaagagaacagtttttattaggtgaaagtggtatttgctaaaaattttgagtattttccaaaatgaacttgttaagttttcttactaaaaaatacatttgtatctcagaagaaagtagcaaaatatattatatgaaaaaaatcacacccactagaaacaactgttattagtctttcacgttgctttcctgtttgtgtatgcttttctgtgttagcagtaataatacagtcttattaccttggtatttatttcaaacacttgcttagtgcccactgtgtaaagagctttctggggagctgtcactgcctgcctgaatctccctcactgtctgagggtggtcttagtgctcatgaggtcgagaatatcgagtgctgtgtcagaagggcagaggtcaggtggatttaaagctgttgcaccaaagccaggtgtggcgacatgcctgtagtcccagcctactcatgaggctgaggtgggaggatggcttgagcctaggagttagagaatgcagtgagccatgattgtgccactgcactgcagcctgggtaatagagcaagaccctgtctctaaaaaataaaaaaaataataaataggctggcacggtggctcacgcctgtaatctcagcactttgggaggccgaggcgggcggatcacctgaggtcaggagttcaagaccagcctggccaacatggtaaaacccccgactctactaaaaatacaaaaattagccaggcatggtgacacatgcctgtaatcccagctactcgggaggctgagacagggagaattgcttga

SEQ ID NO: 41922 - DNA, 1054 bp, Homo sapiens
tcatacttatcatttagacctctccagcaccgaggaaaggtcctttttccattggtaggcaccaaagcacttaaaaaaaaaaaaagctaatctgtcaactgacactgcagggagtgctggaagtttgtggaaattcacataggcaggggtgcaatgtgggtgtccacagaggagttctttgtcatggagcttgtaggaggggatttgtcgtagtgcctcggatgtgcaccttaggcagtgtgatttatgaggatggcaggtgtctctctgggactatagcctatcactgtccagctggacagaatcatcgctccaggttccactgtcttctcagacccaggcactgagtttggtgcctcttccagtcattttccctcattcctgctgggccctcatgtggctgtgcagttgcggtttgtctgtctccctctttagactgggggttccctgggggcagggacggtggcttctacagccccagtgtctggcgcatagtgaatactcatgagatgtactgaatgttggccttaaggatacctaggcctttttataatactttaaacatctttgttcagaggcggttttgttttattagataaaacccaccttgtagtttattcataagggttaaataatttgcgcaaatgaaaatgcctgaaccctgtagcagagacatgctgggtactgctcagtgtgactaagtgttcttctctttcttccttcatagactttttagcactttctccagagtaatactgagctcaatgttttgcatggagaatgcagctagaaggtatagccatactatttactttggtccccaagtagaggccactgtttcatgagtctgcttttgctggttcttttagtggattcatttctccttgtaaattaataaacaggtgccctgacttataagttagtttctgagaatttgttgagcagatccagttactccagatcctgttcacccaagtgagctgataatgttgagcttcagatttaacaaaactcaagacccgcagttggcatctgagggccagccttgcccaga

SEQ ID NO: 41923 - DNA, 1054 bp, Homo sapiens
agccccatcatcctcagcgagaacagcagctaccctgcattccgtgctgaatgggtaggagtggcagagggaggctgcagcagatgtgcaaagatgcatttctttacttaatagtgttaatattccactttctaggaaggcttacccatcaattaaaattatttgagacattaaaaaaagaaacttagggtagctgctattgaagactaaggactagggccagagagacgcctgcctccaagtagtccacagaatctgcttgttaaaatgttcgtgatttggaggcccaggtagaaggggcaggttcctctgaagcgccttggcatgccctatctttggcgttccggggtcgccctcctctgctagtctgtgagcagtcagaaggttgtatctcctgttcattcctctccttgtctcttgctgctcagaacagcagctttaagaacagggtggctgagccctaagtgtacctttggagcatcctgtgtgtcttcagcattgattgactgtttttactgtggatttaatttcagttactttactctggtcttactacttcggcttgactgtgacatcgttgagggcaggggctgtgtcacctctaaccaaagggcctccccagatgcctagcctggtccaagcgttccatcaagagtcagtaccagcgtttattgctgtccagtctgtgcaagctccatgctggctgctgggtaagagccaagggcagccaggcctaatggctcatgcctgtaattccagcactttgggaggctgaggctggtggatcacctgaggctgggagtttgagaccagcctggccaacatgttgaaaccccatctctactaaaaatactaaaattagccaggcatggtggtgggtgcctgtaatcccagctactccagaggctgaggcaggagaattgcttgaaccggggaggcagaagttaagtgaaccaagattatgccattgcactccatccagccttggtgacaagagcaaaactccgtctcaaaaaaaaaaaaaaaaaaaaaaaaaaagagcaaaggccagagg

SEQ ID NO: 41924 - DNA, 1093 bp, Homo sapiens
aaaatgtaatccatcatattaacaagctaaagaagaaaaatcacataattatatcaatcagtggcagaaagtttatttgacaaaattcagcacccattcttgattaaaaactcagacaaatggggctgggtgcggtggctcacgcctgtaatcccagcactttgggaggccgaggcaggtggatcacaaggtcaggagatcaagaccatcctggctaacatggtgaaacactgtctctactaaaaatacaaaaaattagccggacgtggtggcgggtgcctgtagtcccagctactcgggaggctgaggcaggagaacagcatgaacccgggaggcggagcttgcagtgagcccagatcatgccgctgcactccagcctgggtgacagagtgagactttgcctcaaaaaaacaaaacaaaacaaaacaaactcagacaaacaagatatgtttttgaacaatgaatatgtggatatcaaaattaaatcaataccattcacaatcacttaaaaaatgaaacacgggtataaatcttacaaaacatgaataagatttgtatgctgaaaactatagaacactgatgaaagaaatcaaagatctgaataagtggagagacacactgaattcatggattggaagactcaacctaattagtatgttacttgtccctaagttgatataaatggaccaactccttgaaaagcacaaactactactacaagtcatccaatatgaaataatttgaatagcttgtaactattaaaagtgaattctacaattcctatcaaaatttcagcaagaattttttgtagatataaacaagactattcttaaagtgcagtggcacgatcttaaatttcaagctattcttgaaatttaaatggagaggcaaaataagtagaatagctaataataattttgaaaaagaagaaaatgagaagagtcagcctgtctgatttcaagatagatcatactgctatcacaatcaagactgtggtatctgcagagggactgacacagagatcaggggagcaaaatgaactagaaacagatccacacatatatgcccagctgattcttgacaaaggttcata

SEQ ID NO: 41925 - DNA, 1798 bp, Homo sapiens
taatattcaaaacagttgtattcatagtagcccaaaactggaaacaactccatgtcctttggtggataaatggttaaacaaaatgaggtccatccatgccacagaagactattcaataatacaaagggctgggcatggtggcacctgcctgtagtcccacctactggggaggctgaggctggaggattgcttgagcccaggaagtccaggctgcagtgagccatgatcatgccactgtgctccatcctggatgacagtgagaccctgtcttaaagcaacaacaaaggaacaaactacacagcaacctggatgggcctccagagaattatgttgagtgaaaaaagccgttcctaaaggtttcacactgtatgttcctttctgtaacatctttgaaatgacacagttgctgaggtggagaacagattagggtttgctaggggtggagagaagtaggtgtgcctataaagggcaacaggaggggtcctcacagtgatgggtgctctggctgtgtttacatccatgtcctggtgtgatgtgctgtagttctgcaagatgtcactgctgggggcaatagggtaaagggagcgatggatctccctgtatcatttcttataataagagaatttacaattaccttaaaataaaagtttaattataaagaaattgcaatttgactactacttggcatgtcagtgagagaatgtagataataaaatgatgtaaaaactaagtaatgattaagaaaaattatctaagttgtaagaaaagagagggaaagtgggaatggtgatacaattggaagtcaatatcttaaattgataagcaataggaatataagcccattatttagaaaaatggctctagatcctagaagaatcagaagacttcagtgtggctgcctcttggaagtggtttgtggatggggttgtcccagttagtaaaggagattgttgttgttttgttttacaattttttgaactttatttgcctttttaaactgtatacatttcataaaataaaaacaatcacaataataaaatccaccagtgataggagacatttaatcccacatactccagtgtggtgtttatgggaagtattttgtttttagaatgaacattaatgaacaagttgagagggatttaatagtagcttctgttttggaatgcttactgtgtgcagcaacactatttaacattttaaatatatttttctcatttaatcttcacaaaaccttcataaagtagaaacattcctctgggaggccgaggcaggcggatcacgaggtcaagagatctagactatcctggccaacatggtgaaaccccatctctactaaaaatacaaagattagctggatgtggtggtgtgcacctgtagtcccaggtgcttgggaggctgaggcaggagattcgcttgaacccaggaggtgaaggttgcagtgagccgagattgtgccactgcactccaggctggtgacagagcaagactgtctaaaaaaaaaaaaaaattctttctgtagtttccatcacaagctgacattttccccagtaggatttggtgcagtgcaaggctcacgtgggctcacctagtgactatgaatggactcatagcaggcttgctgtgtggttttaataatgggacagggtaattaatcacatttgtgataacaaacccaagaagctcttctcagatttgttattattttttgagacagggtctcactctgtcacccaggctggaatgtagtgacacagtcatgactcactgcagcttcaacttccctgggctcaggtga

SEQ ID NO: 41926 - DNA, 1032 bp, Homo sapiens
tgagtttgtgtaattacactctgtgatgttcactcaatgatgaaattgcctaatgacatatttctcagaatgtatctctgttgtcgagtgatgcatgactgttacacaggaggagtgtaggttatgtgcaactaatactgccatattgtatgaggaacttgaacatctgcagattttggtatcccaagaggctcctggaaccaagccccagcagatactgagggacaactgtacctgtttctccaccctctgaggaacgcagtgtttattcaaactttttggtctttgccagtctgatattcttaaaatgttttctcattatagtttgtacttataagtgaggttgagtgtctttcaaatggtcaaaagtcaggtctctttcagactacctttctagatccattgcccattttttctgttgggttattgcttcttttcttatatctttgcagtagctctcagtgtgtcgggtaagttagtcctctgctgtaaagttagttttaaatgttttcccctagtttgtcatttgtctttgttcatcattgtcttcaattggttctcttgcagcagagcctgaaactggggatcatgttccactgatctgtaaagggcatgctcaagagaaagagtgaagggggtagggtagggcagaggggaaagatgcctgaaaatcatagactcgggttaatttcaacctgatcatgctctaaagcctagaatgccacagctcggtgaagacagaagtagctcagggtgttacccatccaccctcagagcagtggggggatcctgggtgagacaccactgcctgtactacactccaccctgcacttcctcatccacatatttctcacgttaagttcattctatccagactcagcttctccagaggcatttggtcatgatttctggaaacctttccagatgaactacagccctgactacttcagtgggtcccaaggcctcattccacccactggggacatagcaccatgtagcaactattggtttagatgtatactgcatcctaaa

SEQ ID NO: 41927 - DNA, 1066 bp, Homo sapiens
ctacactccagcctgagtgacagagtgagactctgcctaaaataataataataacaaagaaatagtcaatcattgtaagtcagtaatacgacaggagaaattggaaatccttcagggtgaagattttattttagtaacatgctttattttagcacaaatgcataccatggacttgctggggatgggttggggagggatgatacagtcgttatagaaaatcatatcatattttattcattatgcttattcattcatcacatggtcactttgaattcttaccattccttatatttccaagatcaaatttgtttcttattatgctaatatccctataaattcccagtctccaggaggtctgagttggttctattatgacttattccacctgccaggggagaaactgttcctgagaaatgaagggactttcccagggcttcagggttagagagtggctggttttagacaaaccggtgctacccatactgttaacccaacacaggcatgcttataaggaaaggttaaaaaaagtaaaaggaactcggcaaatcttaccccgcctgtttaccaaaaacatcacctctagcattaccagtattagaggcaccgcctgcccagtgacatatgttgaatggccgcggctttctacgtctctaggggctgtggagaatacgtgagaagaccgcatcccctgctcacatgcagggcataccctacagtggagctgtatggggctgcctggaagccccctcaccccaggtagagaagtaactgactccatgactcctccagtagcagcctccaatgtgcagggaggagaggcactgagcacctgtgccatccctggcctctcatccagaacccagccccagggatgggagtgctccaggcaataagtggagaaaagcagttaagttaaactccctgggagaggctggggcaccgtctcagccagctggggctcatatgatggaatacaatagctgacgtggcttataaacggtagaaatttatttctcacagttctggaggctgaaagccccaggtcagggtgccagcactgtggggt

SEQ ID NO: 41928 - DNA, 1053 bp, Homo sapiens
aggagcctgtgaaatctgtccataatgagctctgcagtttggtgcttgagatggtgaagaagacagcacacgcatttacacagcattgatgtttctgctgctcttcactgctttaccatccactttctattcagacctgtgccactgtgcagtgcagtcactcgttgacagcaccttgtcctccatactgagttttgggcaggtagtagccatgctgggtgtggagtggatgtcccaaagaggatgaaaaatggagtgaatgaacgaaggaatctttgcaggggatttccctcactgcatacatagcaggatgctgcttcagagtctgagatctccacagtgatctcctggtgctgagcccagtgagttccagagtcgggttaactccatggggcaaaggagctccctcccttgaatcccacccctttctctgagacccaaatgccttcttatcaaggatagccctaaggaggcctggaaaaagcctgcgctttctgaggcctgggttcaagtccctgctctgagctatggagaaagttcttgtgttttctttccagagcctttgcccctccaaagcaaggctctcagggttccctgcagcattcattgttccagttctggtgcacagggctctgggaatgcagcctgggtgctttggggcatctggttcctctcctgtaaagcccaagctgccccaggactctggggggcagaggagagaacgctgaaagctagtgtgcatgactattagcacaggtggaattgagtagctagggcttagctcctcccccggagaagtgcttgatgctgatgtccctgagcagagaggtctttaggggaaacagccttgttcctacctgggccggcactgagggggaggtatccataaatatgtgctaagtggccagaactgagttcctttcctctcccagccccttgcttttgggtcactaattgtacctatatgacatacaatccatttttatttagccgagcacctgtcagaactgaaagcatcctattcaagacatccttggctgctcacagtcagta

SEQ ID NO: 41929 - DNA, 1459 bp, Homo sapiens
gcctggttactcctcatcccctgacatgctgtctcacagccgcccggacagggtgaggacgagctcctgcccggctgactccctgtgtccctggccctgcgctgtgggtttggcccgggcggcgtggcttttggagagctcttgctatgctctccgggcggcctaggccctctttgtgtgtgtgggatgtcaggctccacatgttgcctccttctctccctgcagctcggtgccaatgccttgctcttcgtcggtgtgaacatgtatggggtctttgtgcggattctgactgagcgttcacagaggaaggcgttcctgcaggcccggagctgcattgaggaccgactgaggctggaggatgagaacgagaagcaggtcagtggcttgggccagtcagcctagaggggttggctgtggggctggggaggtggaagaagctggcttcctgagcctcagtttaccccgtggtgacatgggccacaattcccattggtacatgttggtatttgaggctgtggaggagatgccctgaggttttatagttagcaaatggacaggcaggctgagtttgctgcccatgggatagtgttgggatggggctgctttggggacagcatttgggcgcacggacttccggttgcagctggaataggtcagctgcccagggaggacgaggcaggtcctggctgggcctcggatgaatgtgaccgtgcaggtggccctgatccactggcctgaggcttccaccagctctgcccttggctcagtgtggccgaccccagagcacgctggcacttctggaaggcagagatgcccttttgctgggagttgtagaggggtcacagtggtcatgatacagcacccacagcccttggggttcctccagtggccggcatcaccccattttcaggatgaaacagccgcgagggaaagagcagtggcttggaaggagccatgcctaggttcccaccgccctctatgacccatcttctgtgctctctgtctgctgcgcggggcctgtgcccagcatgtgggcttaggaaggaccatctgggagcccttgggataagcctggcacattccaggtgccttcactggaaggatctagattcttcccctagccttggggcttacaggcctctgtgacaccaaactgctcatgtctcaggcctgtagctgacatataggatctctttctcaacgatgtgaatataaggtattataccaaatataaatgtaaaaactcacaaacacatttcatgtgtcgacattatgatccctaatagttacaataaaagtaggatatacaataaaagtaggaaatagatcacatatgtatgtttaggtggtgtgtgcattgccgtctatgtgaacacgtaggagggcgtgtccatgtggatgttatgtgggcagtggtatgtgtctgtgtatatgtacatgtgcatccctgtggagatgc

SEQ ID NO: 41930 - DNA, 1032 bp, Homo sapiens
acagatgttttaggcttacaaataactgagctaaaatgctccaaaggggtgtgaaggttcttttaacagagctttttctgtttctgaacaaaaatgtcaaaagttggttctttgaaatagaaaagcattaaagagactgatcaagaagaaaaagagcagacacaaataaggagcatgagggatgagaaaggctgcagataaagcagggattaaaaatagataatagggaaatgctgagaataattttatgccagtatatttgaagagagacaaaatggccaaatttccagaaaaagtgtgagttaccaaagatgatccgcaaagaaaaagaaagcctgaaaaatcctataattattaaaaagattgattcagtaatttacaagctcatcaaaaagtaaacagcaagcccagatggttttacagatgagttagacagaacttcaaggaaaacgcgattgcaatttgatcagtcacagcatagaaagctcgctctctgagcctaggtcgagctggctggtgattatggaggacggagctcggattcccacatctcacaaaggcctgtcacgtggacggcaggaaaagcctctttctcagtcttgttttcattagtggtttggcttcttggtgccgaagtggattgggtgggcgtcaggtggatgcttggtccctgccctgctgctgtttcatgcaccaggttctaggagcgaggggcagggcatgctgcctggtcggggtgacatgactcctgtgtgctgtcagccccctgccattgccaggacacctgtgcaagtggaactgaggtccagggtgtttgtggtcagcatcagaggctctagaatgctcccagctcccaacttgttggtcatatggcctcctggagcagcccctgcccagcctccttcctgccttgaatgccagcatctcttctgaggaccgtcaaaagtggtgtcgggggcatccccctcctgcgtggatgtcacacatctggctccatgctgaggcgtcttgttcccctgtggctggcacagc

SEQ ID NO: 41931 - DNA, 1104 bp, Homo sapiens
ccacagactgggtccctgcaaaccaacactcattcattggaaatgagttgaggtttgtgggtccatcagagtcagtcatccttgtgtgccaagccagtatggctaattgctgtctggttgagagctcagcagtcactgttctgagcacacgtgttcactgcccattgtcatgctattaagtaaggaccagtgttgtcctccttctgcagaggaggatgcttaagcaatgtggggtgaaggcccaagtgggtggaaagtagctgaagagccagcatttgagcccagcatgactgcagaatttatgctgagaacctctctgctagatacttggttctgtttaatatcatcatgcttctgtgaactgctggcattgtcacctccattttatagatgaggaaatttaggttcaacaaagtgaaaggtatgcaggactccctggccagtgagtggcaggctgggacaggaactgggattagctgacactaatatctgccttgacttttgtcatttcactcactgcctcttgttacaaaataaggacatgacacactgacccagtcccctgatgagaagaacagaccaccagaataatccctggaatacctcgaggggagccagagcctctccatactgcaggaaaggcatcaaaagtcaagagccttttgacagctagagctggcagacatcactgaccctttcccctgctcagcatagagtgaactgatgaagaatctcagctctaagcttctctctggggagagaaagagtcagtgtgaccactgccccaacttttatggggctgcctgaagaacaagcctctatctctcccctggatctcttgataggtcttgtacagtctggccaggagagaacagaggtggtagtctggggtgatagataccataacttccccctactcacccccttcccagcacagaatgaacagacaaaaataacagctgcctgcttttccctcaggagagaaagggttggtaaagcaccagaatctgtggctgattggtgagagtctcctcctgtacaggaccggtccatgaagattgggagaggtacctgctttgtctaaatctcagacaccaacacaga

SEQ ID NO: 41932 - DNA, 1066 bp, Homo sapiens
ggctgtaccttccctgggacaggacacggtcctttctgtgagcactgactgtggttccaggccatgtcattgctgcagtgacagtaaccatggtgccagccactgcacagagacccttgcccagatcatcactggtcctccaagcaggcatatcctgacccctttgaaacatttggacacctgggaaacagcactgtggggccaagcagcctgcccttgggtggagtggacctacctacccagctctgaactcatgctcccgggcccctgccacaggctcatgtcagctgcagctcagcctgctgggggatgagggcaggtgggaaggcccccttctgcagatgaggaggccagggttctaagggctaagtagttgtcacagtcatgcagagatggaagggaccctaagtggccagaccctggatgtctttgtactgtcaccagcctctctgtgaccagctccctgtcagcaggaggagcctgccgggccctcacagagcagacttggaccctgggctttacaaggctggcctcagtgtccatctcacagactgaaatctctgatcacctcctccccttttctcccgtccatggtcttggagtgctgagggaggctcagtggtggaaggagctgggcagagagccaactgtatgcccaacagcgccccctcctctgatgctgggcggtggccagggccatctctcaaggtccctgcaacgccaggcctgagggcagctcaggacaacagcagggtcatcagctgtctgctcagctctgggaagatacttccatggacaggccattcagctgctaggccaatccctgctcagcctgggaactggggctcccagcggtcggtgtggcctgtccctgtcctgactcactctgtgctggccatggttccttttctctaagaatgtggggcacagatgagcacaggggtcatgagagctgatgattctcattccaaatgcacttgtgttaactcagcattcgacaggacctgcagggccccagtcatttgtaagaaaccaaaggatcacattaaatataagccaccgatgt

SEQ ID NO: 41933 - DNA, 1049 bp, Homo sapiens
acccagatgggtgagaggtccacccttcctggggagaagcagctgctggggggaatctagcacattccagagggctgtccgtgatggtctgcatggcggttaagggaggtgccgtgggaataaagggagttggggaagatgccccatggagatggcattccagccggaccttgaatgatcatcctgtagggttggctcagtgaagcagacaggagggatggacccccgaaggggaaagaggccatgagcgaggtatggggaaagggagaaggagatcaatgtgagcctggtcccagccctcaagactgtgctgaccacgcaagggtgtggcctgggcgggaaggtggtggcccaggtgcagcatgtcttgccagcgctctgtggccaccagtgtctagaggtggtggagccagcagtggcgctcacagcctctgtagcgctgtctcttaccatgtgccttgcccttccctgaaggagaaccactgtcgccgcatcaagattctcggggactgctactactgcgtgtcgggcctcacccagcccaagactgaccatgcccactgctgtgtggagatgggactcgacatgattgataccatcacgtaagtaccccgtggggctgagaggagtggcctggggcatctacacattgaaatcctagaagctgagccaccttctgccccatgtgggctcccctctcagggtctcgctttgtcctgatgggtctgtctgaggctgcagagaatgatgccagcattaggaggatgctgggttcaggaaagcatgaaaggatgcttccgtgattccctgcctttacatttcgtgtgtggctgtatttctttgtccacaggaatcctgcatattgtcaggtatgcatgagtcatacaaaaataaattagtctttagcttagccagataagacatacagaaaggtttggccccaatctagctgaattctctattaaaaggaagtaaatatgtgtgtttctcttcactcagcaaggtaactgggtctcagatgctctctgtgtggggagacaggcttggga

SEQ ID NO: 41934 - DNA, 1001 bp, Homo sapiens
caggcccagcggcaggccaagaggctttctcaaaaggagaatagttacctgcaaaagatggcaggatcttgctctaaaatcctgttcccaggcctgtggtatggctcccgcatgggggcctgccagtggctctggtggcctcccttagcacaccgagctcacgccaggtggaagcgggggaagcagatgatgggaggctgcagtggggatcaaggacttgcacctgcgtcttgcccagaggccaggttgggactgggagggaagtgcagtgattcacggtcagtaaagtgtttgagcctcacaccgctgcagagcagcggttcttctgagatcagcagagaccactgggttggtgaaatacccaatggtatcttgggacttgggaaacctagaactggatcctagatccataacccaccagctgggtaagctgggacacactgccttgtccttgtccatagaagaagtgatgctggactgggtggatttgtgccacctttttctcaactgtagagcggagttagtaatgatctgacctcatgtgggggttaaaggaataaccgtgtagccggcgaagggcaccccgactagtcggggactctagcagggtgagttgttttctgtaaggtccctgcgtattaattttagtttatatttatactttcagaagtgttaagtgtaaaaaggacttcttttatccgtgaaatcactttttgaagatttcaaaatgtctgtataatacatagatttaaaataaaatttctaataactctataaaacctacgtgaacaaaataataaaatttatttagagcatatcaaagaagacacaaatgaatggaaatttgtaccatttctgaaatggaagaattcaatataatgaaaataccaagttaatctatccagttaacttcagtgccaatcaaagttacaatgcaagtggaaggaagggaagtattattctttgtaatttaaagacttcaggtttctttttttaacttt

SEQ ID NO: 41935 - DNA, 1251 bp, Homo sapiens
gtcctatggtttgagaagaacacagagtaggagctggcaccagagtgacccctggtaggctcaggttctgtgctcactgcagccgctgaattgatagaaaaaaactggacaaaataaaactgaactgtcattctgtgtttaaaatacagtcttttgagcatacagccagctgagtaccaactcatggtgtgaggcctggggaggtggctgggagccctgcatttggctaaagccctgcctccagccagtgccctgcctgggagaagccttagccagcttgctgggctcagcctggacatccaggcagagagggaccttcaaaccagtcaccagtaagaggagtgaccaaaggaactgaaagtaggatgtagggtgagggcatttcagtccttccatcctggtacagctggcctctggagcacactgagggcagaaccaaggcctctggacaaaagatccagggagggagattttcattcaacgtatgttgtccagcggcttgagggtttgaggttgggtgaagctgacatgtatagtagtgagtcccccatctctgtgaggtgttcaaggaaacgcagataactgctcaaggagattaggtagactggattcattaattactttaggggtaagattacctctaaaaatgcttcttggaatactgatatttgagggacatatcaaagcagcctcccgagcagccagggtgagagctgcggacaaggtggagaacgtgtggtggttgtgcacctctgctgggggacgggagggtgggaggctggtagttggtaggggcacatcagggacctaactacatgggagggaaggagagtggaaagtgggaaatactccagagttcagccctgtagagttgctgcctactcctggtactctgaggtcgggctaggttgcgcagcagtcgcaggccttctgagggtgccagtagtgttcctcagataggacgagttctcttctcactacatgtctgatgcagtacagcaagaggatcatgtcatccttgtcctccaagatccaggccagtggacaccggagcttcctcagtcctgcagcacagaaggggggctgtgaagtccaggctggccactgagggtccagccagaagccccccttggtctctctggttatcaagggctgggactgcacaatcctctttgtccctgaaagtcagtggtgagcattagggacttctaccccagagccctgcagggaggagagaagccactggcatcc

SEQ ID NO: 41936 - DNA, 1024 bp, Homo sapiens
gcctctctgggaaggtcacaaggcctggggttgttcacaccacaggcacaatacagagctgtccactcttgaactggaccgtctggggagaattgagaagctgcctctcactgcatggatagtggtggctgctggctttcaagcgtggttttttgctaagagccagaggcaggtcttctggagttctcaggggggccctgtgaccccctctccacaaccatggccagcatcggcttcttgctgcacctgtgcattctccacccctccgccaatggcttccagctcctaaaacacctggacattccccatcctgcaccggcactgtgtttgttcagagaaaacgaagggtgtcatttcttcttttccctgtggcatcgtggatcctttacatttagcaacaacagtgtgaggctccacttctgttgaatatgagcggctgtcacacccatgagcaagtttccttgatggaagatgctgtttctccggcagaaccaaccctccaggacgaagtttcagaattggctgatggtcgtgagtgcaggtgtccctgttgtaatttgcagggaaattgactgcaggtgatagtgttgacgtctgacgtctgacaacctcctatgtgcatgtctaaatagtcacaatgaagatgaaaataaggatgatggggacggggtccaggagggccactgggaaggcactatccagaaatagtggacagaggtctggcatgtggaaaccttggatctcggtcacagggaggaaggcagctagaaatgggagggaagcttctgggtaggcaccatagtaggggaatgtctaaagacccactgctctgagatgtggtcagagaggtttctgtggactgcagatgaggcctgagccctgcctatgctcaaagccagcagggttgggggtccgcctcctcactgctcctcaacagctgtaaccctttcctgagggccccgacttttcagaataggagcagagagaagcccagacttccttccctggagtgtagacctgtgtg

SEQ ID NO: 41937 - DNA, 1910 bp, Homo sapiens
cgaaacctgtcattgcgtctaatttcaaatatacagaatctccttaagagctgttgccttatttttttgtaaagcctctctgacatcaaatggggagaaatggtggcacctccagacaccctgaaactacacaccatttcttccctgctcagcttctgctcaggagttctgtgagctatgggaaggccattggttgtatttgctacttttactttcatcttcctctgctgtagagccatttaatgttattgtcatatgctgctggtgaggtaaaggtgggtccgggtgccttcccaggggttagaggatgttcaaagggccgatttcagcaggagttcagagggcttatgatggatggtgagagatttgacaaccaccagagcacatgtgctctgaccctctcctgggcattggttcctgctggtaccgggcggttcagaccttcaaataggttgctttcaaaagagctttcaggcacttattgagaattaatgtttaaacagacataatagcctagatgaactcccaagagatctattaaatcttgtgggctgaataaatatctcgtgcaggactgtgcaacagtagcccagagcatcctgcctgtgggcatccacctcccaggtgagggcagtgggaagctggcccgacggcagccagaacttgtttctcacctcccaccagcaaccccccacccaactctgggccccaggcacacgaagcacaagtctcaggggaccattcccacattgggggatcctgagggagcccatcaccgcctcttgcatacaactgtccactaggaggcacgcccagtgtgggagagatgtatggtcttgccttccacctgtaaaaactgcacatatgcaagccatttgcactctggaactgcatgccgtgaaaactcctaatggtgtggaacttagtttgaatttgaaatcacgccgcatgcacaaagggacaggcccaggcccgacctcaggtcatccgcccgctggctgcagagcatccctgggagccaaggcgaggcccgtggagcctgagctttgtgtagctcgagctttgtgtagctcgtgcacttattatgcaccacctcccttcagtcaccactcctcttcctccgccatcctcatttatactgattgcacaccccccgctcaaacaacaatgtccttattatgatgaccatctcgtagtggtacattccattcctatttaaggtaagcccaaagcccacttttggattttctcgactgtccgagaaaagttgtgtaagcgcctgcgttcttctgggtttggctagatagggttgtgtccctctatggaatggagagtgatgtgggcaagggtgtcattttctcgcacaatacaactcactgaggatgcttctgtagaagtgagaaacacgatgagtacattcagaattacaataactcactctcactgggtaacttctcatgatagatttgtatgatcaatacgggtctatttttatgtcaactgaacactgtagggtaccttccagtctttttcaagattgttaaattgagacaagtaattgaataatttgtcctatttttattttaaaaaaagtgaatggactgaaatgttaaatgtgaatgtacatttcttaattgcaacttttctactgagtgtttgcactatactttctggaatcttatttaacaaaaataaagggaaaaaattgcttgactaaactctgtggccatttcagttgaaaaataaatggttatgtggatgttttgaagacattcctgcctgtttcacataacttctgggggaagttttattattcaaagtattaaatactacgtgaccccatttagactaaaccacacatgaactgttatccccccattacatactattcttcttcttcttctttcttt

SEQ ID NO: 41938 - DNA, 1033 bp, Homo sapiens
attgctcagtccttcaattcacccactctttttaccttctctcccccaaacttttgctacagcattgctcctttgtggtacgctctttggaagatttctgttgaaactagaatgaaatctcgactctcatgtggtcaacaggcctggctcctgcctgcctccctccctgctccctgggtgtcctagacccatcttgcagcatgttcctccctcagggtcccttcccagccctcttcagagaggccttccctggtatgtccctgagggaagtcaccctcctcactctgaatcatcaggtcccagagatttctttttaaagtacttacatcattttatatctgtacctgcctttgaaatttacttgctttgttccctctttgtctgttccacaaagagttcagcaccacggggagcccatctgtccaggacactgtatccctagcgtttggcatgggtgggctccagaaactgcttgttgagtgcacgaatgagagtgagaatactggagaacatccccctgtggccaggggcttgtcccctaagccagccagctctggctttcccaaggttacgctatgtgcaccaatagcgtctgggtgccatcctttcctgtctcactgtggtgaaatgtgggttaagaagaatgaatttcactgggtgtggtggtttatgcctgtaatctcagcactttgggaagctgagacaggtggatcacttgaggtcaggagttcgagaccagcctggccaacatggtgaaaccccatttctaccaaaaatacaaaaattagccaggtgtggtggtgtgcacctgtaatctcagctacttgggaggctgaggcaggagaataactagaacccgggaggcagaggttgcagtaagctgagatcgcacgactgcactccagcctgggtgatagagggagactccgtctcaaaaaaaagaaataaataaataaagaaaaaagaacaatgaatttgaggggtgtagtctttgggctgggccctgaagggcacatgggatttgggcccaaga

SEQ ID NO: 41939 - DNA, 1062 bp, Homo sapiens
catttctattggacagcagcgctctagacagtactatgggtagtatctgtggggaggttctcagaaacatgtcgcatgctcttttagaaccttaaagtattcctagtctcctctacttccagcccttggctcttgggcctcagtctttttacttttgcggctgtgtttctctgaaggcttggcattagtagattgaaaagaataaccatctagggaaatgtgaattcagtttctttctgacattctgctctctacaaggggatattatgtacacataaacctacttccaaaataatgaagtgaggcctaattccttactcttcagagagcccactgtggaagtgtcactgaccttgtgtatgggctgcccttcatggctctgggagtcattataaagggcagcatttggcgtggtgcgtcctaagccagtgtttctcggctctgttccttagacatgtgttagtgttaatagatgttcttggaaaaaaaaaaaaaaaacagcattctgaggtcaaacatgctcagaaagcttggaatctgcactacgcttctcgtacacatttcatattaaagattttggaaagtcctgcaatacagagccctgtctaatattgccacaacccacaattgctcaaatgtaaatagatttgagtttattcacattcagatcacctcttaaggccccacctcccaatgctgtcacaatggcaattagatttccacatgagttttggaagggacattcagaccacagcaggggaaagcagggtacttgctgctttgcaagtgtgtccacatctaattaatagtacagttcttactcttggtgtgtccggtgatattaaaaattaatgtgccttatttagataagtaacataaaaatcacaaaatgtatgccttagatttatatgtatttataactagtctatttcctgaaaacagttgagacaccttgtaaaagttaccggtacgatagggccattccaacaaagctgtaaagtggtgataacacagtcataaagaagaggagatagctctgggagaaaaggtggcccagaaacc

SEQ ID NO: 41940 - DNA, 1052 bp, Homo sapiens
acattaaataactaatcatttattaggaggatgtgcttgttttttgctaataaagatgataataaaaaaatccttagaccccccctcggtttgttttcagttaggaattagggatatttataagaatatctttaaatgacacatgccttgctctgggacgaggcatctgcatgggtgacacatatgtgttgtgtgtacaggctcccagcatttccagggccctgctcagaatgtaggccttactgattcttacagagttacaagcgctggtgaggttggcgaagtttaggtaaacacagctgggaatgccccatggcctctgggtgactttggacatcactgaactttacccttagagatgcatacctgcatcttttttaccctgatagggccttccatgatgctttcaaagtgtttttgtctgcttttcggttaatagactttcacagtagccaattgaatatattggttaaatgcatctctttatacacagactggattcaaactgaggttgtgtctctccctggctgtgtgacgttgggtatgatccaagtgtcagattactcaacttcaaaatgaggacagagcctttcccttctagggctgccaggaacattgaatgagagagtgctggcagcttagtacaggtgttcattgctcttgtatggtactgtctgtggcacggctagataaaatacagtagccactgattcaaatttcaactgaggagtaaaataaactgaataacttagaaaagttttcttcttttgaatgactctaagaatttaaggagcatgtgagtgttgatggctctaaaagggtaacagagcccaactagctcagttctcagcatgaaaatagtcatatggcacagactcagtggagtgggtgcacttcaataactggaagcacagatgccctacagcagcatcaaagatggcactctaaactactttcaatcctttaaaataaatggaaacgcacatttagtatgcatatgacaacacgaaggacttcgattttgctgatgcaatacagttttacaggatttt

SEQ ID NO: 41941 - DNA, 1029 bp, Homo sapiens
acagcccagagcggtgccaggaagccgcctcgacgcagccgtatcttgaggctccagccccatccccagggtaccacgccacgtagagacactatttttcacttcgtgtttgtcactcctaaagcatgtgtgctagctgcaccaaccctgggatgcctcggtgcatagggtttatgtgcgtcctcctccttccctctgagctggtcccccgtggggaactgctgcccagactgacctgcgtccttccgcacgtgcaggaaaatgtccacgtgcacttgtcagggtgggggccacacgggcaccaccactgatcatctgtgggatcgagttactgcccatgcagatcccacgtgcagggcccagtcgctttggtgagagagtggacgctgtggtgactccacggtctgtggctgtgctcaggaggacagagaggggacatcctgagatggtttgggcagcccgcggatcctgtgcatgtccccagagcgtccactttctccatggagcagtggagtggcgttgctgagacagaaagttcaggttctccactccccatgcagcccccactcccctgtctccggccaggcacgcgtctggggtggagactcccggtgcccggggccctccagacctctttccccaccccagggagcaggcgggtacttctattccgtttggcttcagaagggaaaagagaacgtaagttcagggagttctcgtccattcctctcccgtgggccgggcaggcagcagggacagccttcaggagccaggaggggctcgagctgcgaggccctggaatgaggcaggcatgggctgaggctggagggaaagccccgctaaggctgggcgggggcgggaaaacttaccaccaggggactcgagatggggaaggaaaggtcagaagaggagaggccaggcacggggtgtgggcggcctgcagagctggagcaggtgctccgcccagagccaggcatgcacactcagagtaggtggcctgtgcagcggggaagaggggcgggtcggcgt

SEQ ID NO: 41942 - DNA, 1047 bp, Homo sapiens
actgctcacaactgccctgtgaaattcgccgagctggccccatgtcaatcagagtacactgagcactgagacccagcatgttgagataactggctagagatcatcccataatggtaccatcacaatcttcacactgtagaagtttgatgatgtcactggaagcatattccacagtcccttgtgaactggccttcctgtgatcagaagcatcagtgaactcccaagagggtgggaactcccaagaggtattctcactctacttagtgtatattttacaaatcacaagcttggctttggattcttttaatggctagaaggagaatcatggggttggaagtccaccagtttgggtattctgttccctaactcaaaataaagagatgttattttcaagtcttctgcttgttaacttaattagagatacatgagtttgcagctgtgctgggcatgccgcagcttggcatgtttagtccagaaggcatattataatgtacatggaagattgtcagaaattcaaaaggactttttgagtatcacatgtgtattttcaagttccaatatagattcacattcagtttgacaggtatctttggatgcctatcagttaagaactatttattagttgtggaataaaatagggtaaaataaggaacaactgaggaaaaaacataaaatttgctttgtgaataaaagttgtcttcaaaattatgactttttccatcccacaaaagttttgattaaacccacaatgaaaatttaaataagtgtatttactttggtttaaccacttatttcattatgactcacaactataggttttctagtttccattattacaaactattgtgtggtttaaatcaatttcatagactagtctagttctatagtcacaatttataaaatttttttatgtggtaaattgagtgtcttcatagatgtacatgattatttctcaatttttaaggaatgtattttttaagatagccttctttagccttctttaacactgatttttgtaaattttttacagatttttttaaatttttg

SEQ ID NO: 41943 - DNA, 1048 bp, Homo sapiens
gtttttcttttacctttcctttttaaataagaaataatgcaagacagatacaaagtaattctttttaatttccattttcactggagagtgttgaaccccgtgaggcatgagagcacagtgttccagaacaatgcttactgctcattatcacaggggtcaaaggctaacgtgcagggattgttgcagatcgtggacatgctgcctcctgtgtccatgactgcaatcgtctacctattttacagttgttgagcactcgtgtgcattagggttcaactgggcgtcctagggctccctggacccattttagaccttgagttcttgagttcctcaaaagagaaatcacgcatttatgttttctcttcttagaccatccaggaggtggctggttatgtcctcattgccctcaacacagtggagcgaattcctttggaaaacctgcagatcatcagaggaaatatgtactacgaaaattcctatgccttagcagtcttatctaactatgatgcaaataaaaccggactgaaggagctgcccatgagaaatttacagggtgagaggctgggatgccaaggctgggggttcataaatgcagacagcagttccgatggctcccagcgagcttgtcactcaattccacctcggagaaggcttttatttttacccagtacacgtgcactgagtgccggctgtgtgtaagatactgcaggggaagttactgagaagatggcagatactggaatgggaagatttaagcggggtaccagtgtttacatggacatgaaaaaatactgagagatagtaagaaatcgtaaagattctgagtaaaagagagtatgaccaaacaagctgagcaggaatcgtgaatctatgtgtgtaggcagtgaataaactgccagtcttattacctggacctcaaggataaaagacatacagtaaaaatcaacccacattgaggacagtttcgagagtcgcgctgctacacagaaagccctgtgtaagttaaggatagagaatgaggtgttctagaactttgaatttttgtgagcag

SEQ ID NO: 41944 - DNA, 1033 bp, Homo sapiens
acttttctgggttttttttgtttgtttgttgttttttttttttttttttttgagacagagtctcactctgtcgcccaggctggagtgcagtggtgtgatctcggctcactgcaacctccacctcccaggttccggtgattctcctgcctcagccacccgagcagctgggactacaggcgcgcactaccacctccagctaatttttgtatttttagtagagacggggtttcaccatatcggccaggctggtctcaaactcctgacctcatgatccgcccacgtcagcctcccaaaatgctaggattataggcatgagccaccgtgcctggcttgcccacccttttcttctgtgcttgtcttcctgttaattgcagtaggaactcttaatggggaaaaatcttcagggagcaacagggcctgcagaacccaactgaggcagagactttgtcatgtcctgataactttgcttgctgtcagttgtcttctgtgcttttgatgagtttattgctgtggttatgatcttgtctctcaaacatccctgacaacgatagagtactgactcttctatcaggccagtagagaccccataactaaacattgcttcaggctgtgcttggcttgagcataagcctagggcttcagcctagcctgtggcctaagttctcttccctgccaagcgcacagccgcctctgccaccgcctcctcctccttcttctcctcctcctccctcctctacctttcttcctgcccactgttctcctcctcctccttctttcttcttcttttaaatttaagctttctttattctgcaaaactacaaaactagtaagtcaaaggatatggattagaatttagatatcttagactggaaaacctatatattactttttaaaattttacttcagattctttttatgtctaacctactgcctcatgttctcactcactaaaggaaaccaggaaattcatacctacacaggattaaaactttttctagttattgtctttgtttattgttgttgaaagtaaaac

SEQ ID NO: 41945 - DNA, 1021 bp, Homo sapiens
cttcactccagactgggcgaaagaactaaacttcatctaaagaaaaatacatatggccgggcgcggtggctcacgcctgtaatcctagcactctgggaggccgaggcgggcggatcacgaggtcaggagatcaagaccatcctggctaacacggtgaaactccatctctactaaaaatacaaaaaaattagccgggcgttgtggcgggcgcctgtagtcccagctgctcgggaggctgaggcaggagaatggcgtgaacccaggaggcggcgtttgcagtgagccaagatcgcaccaccgcactccagcctgggcgacagagagagactacatctaaaaaaaaacaaaacaaaactgtttctgggtggaggggggaacgaaaaagaaaaaaactgtttctggactaacctggacagttcttgtgacaaaattcatgtggcatcataaccaccagaatatgagactttggaatttgcttttcaggtgaccaaagccacgtaatgtccgtagttcgctcatccgtccatgccagatggattgtggggaaggtgattgggacaaaaatgcaaaagactgctaaagtgagagtgaccaggcttgttctggatccctatttattaaaggtgagaaacattcttgtttccgggtggctttggtaaatcaccaccatgtcctgggtcctaagcaaaaaaacatttatctctcagtaaagatgtcttgtctctcatctgctttgagccaggcattttgctggtctgtaggtataacacggtttacacattccaagaaaacagttaatgtcaatccactctaactgctgtagtcattctgtatgcaaagtactggccggatgaggtggctcacacctgtaatcccagcactttgggaggccgatgcggttggatcacctgagatcaggagttcgagaccagtctggccaacgtggtgaaaccccgtctctactaaaaatacaaaaattagctgggcatagtggtgcgcacctgtaatcctagctactctg

SEQ ID NO: 41946 - DNA, 1016 bp, Homo sapiens
ctagcatctttccaccccagccttctgagtagctgggaacacaggagcgtaccactacacttggctgattttttgtaaattttgtagagacagggtctccctgtgttgcccaggttggtctcggactcctgggagcaatctgcccatcttggcctaacagtgctgggattacaggcctgagccactgtgcccagccggtttcctttatttcattcaaaggaattttgaatttatcttagaacctttattttgaaggaagaaagtcttttttttttttgagctggagtttcactcttgttgcccaggctggagtgcaatggcatgatctcagcccaccacgacctccgcctcccaggttcaagtgattctgcttcagcctcctgagtagctaggattacaggcatgtgccaccacgcccagctaattttgtatttttagtagggatggggtttctccatgtttgtcaggctagtcttgaactccggacctcaggtgatccgcccgcctgggcctctcaaagtgcttggattacaggcatgagccactgcatgtaatgaccagccactggtcagaattctttcaatcaagctgtgttaataagaatattgatgtgtggaaaataaaattttacaattctgtgccacttttcttacatcctaggctagattaaataggtgtaagttcctaaaatctgacacattaagttgtaggacttctcccacatgcatttgggatggagagtgagttttgttgctattcattaatataccacgataatttagattttgacttaaggaagcattgagcagtatatttccgttttctggcccctagaaagagaataggggactttttttttgagatcgaatctccctctgttgcccaggttggagtgcagtggcacaatcttggctcactgcagcctccgcctcctgggttcaagcaattctgcctcagcctcctcgagtagctggggctacaggagtgtaccaccacgcccagctaatttttttttg

SEQ ID NO: 41947 - DNA, 1045 bp, Homo sapiens
cgcggcgctggcccggcctgcagggccctgaccggcgcgacccgtggccagggacagggacagcgcgcgcctgaggccgcaggccccggacgccgtctgctgggtcctcgccggaggctgttccaagcctgagtggctgcgtctgccgaggacgttggtgaccctggtctctgaggtgccgggagtagggaataaaagagtaaagcattgtcccgggccagctctccgcggagcgtaggggaagttagagcttggaggaggtcaaatcacttaacgtcttggagttgaaatttaaagccggccgtggatctaaaagtacttagagttatcagcactaagttcaggcgtggggctcttgtttaaacttttttttttttctaacttcagtggattggacgtttggttgtccaaattcatcaccttgatatttgcatgtgctgttttccacattcaaacagcaaagcctatcctgacttacccagagttgctttctcgtattcattgctttgggtagtttaaattacctaaggaactgtgtgttaaactcgccatgggccagggaggtttcagtaacatggtttattattattattattgttgttgtttatttatttatatttttgagacggagttttgctctcgttgccccggctgaagtgcaacggcacgatcttgtctcactgcaacctccgcctcccgggttcaagtaattctcctgcctcatcctcccaagtagctgggattacaggcatgcaccaccacacccggctaatttttgtatttttagtagagacggggtttcaccatgttggtcaggctgatctcgaactcctgacctcaggtgatccacctgccgcggcctcccaaagtgcagggattacagtcgtgaatcaccaggcgcggcctgatctttttaaaaagatgagtctgacttgggagagggggcagaattaagggtagtggccagctgagtggaccctggcactgagagttgagagtttgcagagagctgttctgccaaaatgtgagtgcctaccacgtgcca

SEQ ID NO: 41948 - DNA, 1070 bp, Homo sapiens
aggggttgaagaccagcctggctaacatggcaaaaccctgtttctactaaaaatacaaaaattagccgtgcacggtggcacaccatgtagtcccagctactcaggaggctgaggcgggagaatcgcttgaacctgggaggtggaggttgcagtcagctgaaatggtgccactgcactccagcctggcaacagagcgagattctctcaaaaaagtgtgtgtgtgtgtgtgtgtgtgtgtgtgtgtagaaattgttcagatagttcagaaggttatacaatgaaaagaaaaaacctttactcccaccccaggcccagtcatgttccccagatgtcatcaccctttaacagctcactctgtatgtgtatatatagtgctgttctgtgccggcttttttacagaatttatcttggagatgtcagcacatcagtgcacataaatctacctcattctttttatcgagtgcatattttctgacggggagtatttcctaatttacgtgaccagtctgcattaatggctattcaaatggcctatgccaggagataactggaaacaagacagcaatgaatatttgtatgcattcaactttgtgcacctgtctaaatatagctggccgtaggacataaccgcaagtgtcattattgggctgaagtcatacacagtttccattttgatatggatgatgccacactgccctcttgggaggtcaacaaatttgtattcctattagctggcatatgggagttcaacatgcacatagatatttgtgaagtagggccaattgcagtggcttacacctataatcccagcactttgagaggctgaagtgggagcattgcttgaggccaggagtttgagaacaacttgggcaacatagcaagaccccatctctacaaaaaatttaaaaaaattaaccatgcaagatgacgtatgcctctagtcccagcttctcaggaggctgaggtgggacgatcacttgagcccaggaatttgaggctacagtgaactacagtgagctatcgcaccaccacacaccagcctgggtgacagggcaagacccagtctcaaa

SEQ ID NO: 41949 - DNA, 1037 bp, Homo sapiens
tggtactgcttgtgttgtctgcctctgtcttgaacattactttcctccctttccatcttccttatttcttctgtgttcttttctactattccccgtctctcattcttctgtctttggaaccaacagaatgttttttggtgatgtcgttttttttcccctcaaatggaaaatagtagacccatagctcccaaaatcctgggacctttggtttttctttatcatcattatactgattgaacaactcttctagatagttggggtatcagaaacctaagcttctgatcagcagggtgttggaatacaacataattcagctaaaaggttaactccacatgccgttttatcatgatgttctaaggtcagttgttagaacacagagtaggtggtctttttcctgttactgatcaggtgctgtccacctggtcaaattttgctggttgtttaattagtgttgctgtttcttctctttaagtcaagaggtgttgccaaagattcacgaagataaacactacccttgtactttggtggggacttggaacacgtggtatggcgagcaggaccaagctggtaggaagcgaagtctttggaataaacacttcttccttaagccttatgtaacacttaagtaattttctaatttaatgcttgttcttatcatcaaagctttccaagtctcagtctaattttatgattaaagtagtttcttcaacaattcattgcgaaaatggttttaaaattgtttttaatgtttgaatctattattgaaccattatgatgtaactcataggccaaaacatggggcattacagtttttttgttttttgagacagagtcttgctctgttgcccaggctggagtgcagtgatgagtatctaggctcactgcgacctctgcctcccgggtttaagcgattcttctgctttagcctcccaagtagctggaaatacaggtgcccaccaccacacccaggtaatttttgtatttttagtagagacagggtttcaccatgttggccaggctggtctggaactcctgac

SEQ ID NO: 41950 - DNA, 1057 bp, Homo sapiens
ggtggctcatgcctgtaatcccagctttttgggaagtcaaggcaggtgggtgacctgaggtcaggagtttgagaccagcttggccaacatggtgaaaccccatctcttactaaaaatataaaaaattagccaggcatggtggcgggcgccggtaatcccagctactcaggaggctgaggcaggagaattgcttgaacccaggaggcggaggtttcaggagctgagattgagccactgcactccagcctgggtgacggagcaagattctgtctcaaaaaaaaaaaaaaaaaaggttttttgaagttagttttgtcacttaatgttttttctactgctgtttgctatttctgtattttttttttcacagaagaactaacaaaccaaatctaaatctgttttcagccaggaaccatgattgaatggggcaattactggtgagtatattactgaatggtgattttttaagtcttgtgaatagattagtttaggccatagtgttaattctagggaaaaaaatctgaggatagtactgtgacttaacactgcactaatgtttcgtttgatgtttttattatgagatttttcaaacatacaaaactagagagaataatggggctccccttccacatccatctcttagcttcaataattaacacatggccaatcttgtttaggcctaactccttcaacccagattgtttggaattaaatcccagacagcattctatttcattcataaatatttcagtactatatatatttctaaaagataagcaccttttttttaaaagcaaaaccaatattgcataaggttagtttacatacttcttggatatcatcttttctgaaacgttacttttgtcatatatacacaccatgtcaataatggtttcttctttttttccttgctagtttgagtagaaaaataacaatttttccacaagttgatatgtagattcagcagaatccctatcaaactcccagcaggctttagaagtgcaaaagactagccaggtgcactgtggctcatgcctgtaatcccagcactttgggaagc

SEQ ID NO: 41951 - DNA, 1117 bp, Homo sapiens
ttttcagacccttggatgttgtaaattttacatcattacctgtttttgtagatttctatattctctgaaaacttattacacaaataaaatttttttctaagctttccttttccatcagaattgttagtatcccaaatcagaacttaatacatcaattaaagagtgattttgaaattagataaattaaacttcctgtatgtacagtatgtatctgggtacataatacatgcatgtgcacatacataagtatattatgaaaccctgtttgcttgatttttaaaagaaaacagttggctgaatgtaacccagtggcattggtagaggtaatcagtaccagccatgttgcatggcaagtatatttcaggccgggcgcagtggctcacgcctgtaatcccagcactttgggaggctgaggtgggcagatcacctgaggtcgggagttcgagaccagcctgacgaacatgatgaaacctgtctccatttgagagactgaggcaggagaatcgcttgaacctgggaggtggagattgtgccactgcactccagcctgggtgacagagcaagaatccgtctcaaaaaaaaaaaagtgtatctcagcccctatactaccaagaaaataaaagagtaatttgtcctagaaagtaggtgttaccttgtctttcagttcaagagattatataacatataattacatgttataattatataattgtatttgattttgctgcttacgcgaacgtttgagaaatcaccatttctcctcacagtatggacttttcctacctcccacaaataaaacaaatatccaggtaggatctgttttttttttttttttttttttttttgagacggagtcttgttctgtcgccaggctggagtgcagtgacgcgatctcggctcactgcaacctccgcctcccggtttcaagcgattctcccgcctcagcctcctgagtagctgggattacaggcaggcgccaccacacccagctaagttttgtatttttactagagacagggtttcaccctgttggccaggatggtctcgatttcctgacctcgtgatccacctgcctcagcctcccaaagtgctgggattacaggtgatctgcgcccag

SEQ ID NO: 41952 - DNA, 1093 bp, Homo sapiens
tacccaataactgaaaatgttttaactcactctcatttgtaagcagtccacatagtagacaatgggttttccaagctgggcaaggtacatttaatcagtaaatcagtttcacatcatgtattgtgatgtttcaatgtgagacacaaaaacaatggcttgaaacttgtgtatcatatgtgattttgaaatgaacaccttgaatagcactaatttttatttgtggtatttttctataacaaaacaagtagctctaggaaaagaggttttattttgtaaacgatcatttgtgacctcagacactctctggctaatattttaataagctcacagcagataattctgagatcatgggtgaggggtggtgcatgttgagatttaaattggcataaagctgcatactttttgtctagctgtttgatttcattttttaatatagtatgccaattttgtgactgttaccatgtgaaagtcctgttgaaatgaacaattgtctgccccacaatcaagaatgtatgtgtaaagtgtgaataaatctcatatcaaatgtcaaacttttacatgtgaatgattttctcaaagaacatagaaaagtcaataaaatcctcttaatttccacatatcacgtttggattttcttttttaatttgttctgagattgacaaacattgctgtgaatgaccttgtcactcttgcaaaatagcttgtcacaaaagattgaaggaagtgaggaagtcagctggcttctggggaaaatccctccataggaacaaattacgaggccctgggcaaggtcatgcctggtatgtgctgagggcagcagaagccagtggcagaagcagacatgagggagagtgtggtgggacacgagctcagaggtcacagggctggatcccttgagtgttggaggccattagaaagaccctagtggccgggcccagtggctcacaccagtaattccaacactttgggaggccgaggccagaggatcccttgaacgcaggagtttgagaccagcctgggcaacatgaatgaaacctcatctctacaaaaaatcgaaaaattagttgggcatggtagcatgtgcctgtagtcc

SEQ ID NO: 41953 - DNA, 1039 bp, Homo sapiens
atgattccgggggagggtgcttatcagactcgcgtgtggccccacggcacctagggcaccgtcgagcacacggtccgggaagctccaatgaaacggaacaaaccgcgagatcaggggaggtaggaggcccaccctacgccctgcccccgcggagcacaagccccgcctgcgtcccgagctcccgggtccgcaaagctgggccccaaagagctccaacgccggaaccaaggagcacggaatgccgggaacaagctcctcccgtgcgcgatgacgacaaggccgaggcgcgaagggtgggaccgcaggagccgtgcagccgcggaccaatgagcgggcgccggacgacctgtggcccaatggcggcggcgcgcgggcacgctgggggccggccagacgggccgacttttccagaagacccggatagttcctcccggccacgccgcgccggctctgggcactcagcatcgtttccttttcctccgctggagcagctatggcggcggtgaagaccctgaaccccaaggccgaggtggcccgagcgcaggcggcgctggcggtcaacatcagcgcagcgcggggtctgcaggacgtgctaaggaccaacctggggcccaagggcaccatgaagatgtaaggcggggctgaaccggagggccgggcgggcaccgcgcgccgccgcgctcctggcgggcccgggaccgcggactggagcccgccgcctcggggctgcgcagccgtccttctcggcgtcctccggggtcggtcctgtgtccctcctaagccccaccgtcccggccatttcttcccgcatcgatgcagtctccgcggagaacaaagcggctctagagcgcggcgttccccgccctctggggcttccaggcaccctgaggactcggcacaatctctgcggggacggggtgggcactacacctgtcctccatcctgctggacataactagccccacatccctggctccctaaaatctgggaaaagcccgttttctaatgggacttttagttatcgttgaaaaagtcatag

SEQ ID NO: 41954 - DNA, 1047 bp, Homo sapiens
gtgatcctcccgcctcaggcttctgagcaggtgggaccacagacgtgtgtgctaccatgactggctaatttttttttttcttggtaatttttgtagaaacaggttcataattgtgttgcccaggctggtcttaaactcccgggctcaggctgtccttcaccctcagcctcccaaagtgctgagattacaggcatgagccaccgtgcctggttcatgaagtctttagcagaaaaattaattgaaattcaggatcagatttttgtttatatacattttgaaggtttatgtgtagtaatgggaagccattgatggggaaaatcacatttcttttatgtgatttttcaaaaggagataatttgctttaatgtgatcaagtttgttccttattaatatgctacttgtcattctctgtaagtccctcttctctcttcactctgcacaaatcctgtttttgaaaatcatattttttctacacatagggagaagagaagtttacctttattgagaaatgtaacaaccctcgttctgtcacattattgatcaaaggaccaaataagcacacactcactcagatcaaagatgcagtgagggacggcttgagggctgtcaaaaatgctattgatgatggtaagatcctcactgtatttcaattcttttatattgttttgctggtctgaaaggcatggccgaatactgtgtttttatcagtagtttacacagccagacaccatgcaaaagcagtcttccctttagaatgactgatggtatgctaaggtttttcatagcatatcattattaaaggtgaatacaaataaatgaactaatactgatctgttgaaagctgccagtggctagtgaagccattctggttgaaccattctcctatttggtatgttagtcacttgtattttgtcatagtaaatttgtaagaaattaatggctttcatatgtatattttgttattcataattagttctgcagttttcttagcatttttccttttcccccatccaacaggctgtgtggttccaggtgctggtgccgtgg

SEQ ID NO: 41955 - DNA, 1601 bp, Homo sapiens
caggagttcgagaccagcctggccaacatggtgaaaccctgtcactactaaaaatacaaaaattacctgggcgtggtggcagacgcctgtaatcccagctacttgggaggctgaggcaggagaatggcgtgaaaccgggaggcggagcttgcagtgagccgagatcacaccattgcactccagcctgggcgacagagtgagactccatctctaaataaatacacaaataaacaaacaaataaaataaaaaattaattaacctcacagaactaaacactgaagagagtgaattttactgtatgtgaattcgttgtattctaatttaaaagaaaatcactcaggcttcaggttaattccttggcaatcatgaacactctgtggtgtataacttacaggacagggatatctgaagtttcctggagcaggagaagatggggtgggcacagaacctcaccagctgaaccagctgaactatgtctttatagggattttgtcagggagaaaaagtatcggacagaagctgagatgtttggatggagctttgtctttgaggactttgtctctgatgagctgagaaacaaagccacccagccaatgaaggtgagagaacctggtcttgcagctgaggggataggagtgggacctggacagggaatcctgtgggacatgggttacctgggacacagtggagaatcagacctgagaggtggaggcagaggggaagcaagagaaactcaccatggagcgtcagatcagtacacactcccaggaagttaaccctgaacccaagttagctcttgcctaaatgtccaagtcaggataggatccaaggaacttgaatcaagagatcaccttggtgggccgagcgtggtgtctcatgcctataatctcagcactttgagaggctgaggtgagtggatcacctgaggtcaggagttcaagaccaacatggcgaaaccccgtctatactaaaaatacaaaaattagacaggcatggtggcacgctcctgtaatctgagctactcaggaggctgaggcatgagaatcgcttgaacctggaaggcagaggttgcagtgagccgagatggcgccactgcactccagcctgggtgacagagtgagactgtgtctcaaaagaaaaaaaaaaagagagatcaccttggcaagccaacctctaataagggtggtaagatgggctctataaagattccagtctcagctgggcgcagcagctcacgcctgtaaccccagcactttgggaggccgaggtgggacaattgcttgagcccaagaattcaagaccagcctgggcaacatagatcccatatctacaaaaaaaagaaaaaaaagaaaattagctgggcatggtcatgcacacctgtagtcccagctactcaggaggttgaggtgggaggattacctgagtccaggaggttgagactgcagtgagctctgatggtgccactgcactctagcctgagtgacagagcaagatcttgtctcaaaaaaaaaaaaaaaaaaaaaaaaaaaaaatcagccacaacctcacttagaccacctgagtctcagcctgacgtctctgttctgcgtcctgtggctca

SEQ ID NO: 41956 - DNA, 1033 bp, Homo sapiens
ttctagtccatctcagactgatataaaataccataaaaattaataactggaaaattgaaagaacagacataaaatattttattggaaattccacagacatgttacatttcaataaatataactagagcaacatagcataaggaaaaagaattaccaagactacacacttctgcctctggggtacagagattaatgttaagagtcactgtttgcggccgggcgcagtggctcacgcctgtaatcaaagcactttgggaggccgaggtgggtggatcacgaggtcaggaggttgagaccatcctggctaacacagtgaaaccccgtctctactaaaaatacaaaaaaaaattagctgggcttggtggcgggcgcctgtagtcccagctacttgggaggctgaggcaggggaatggcgtgaacctggcaggtggaggttgcagtgagccgagatcacgccactgcactccagcctgggcgacagagtaagactccgtctcaaaaaaaaaaaaaaagaatcactgtttgctcctaactcggtcatttgtcattctgcaatcctaattacacaaaaagttaggacagcaaaaagcaactccgcacattaaacccctctacacaatctttcagtgaacaccaggtacatcagtgatcaaagttttttgttttttgttttttgttttgagacagtctagctctgtcgcccaaggctggagtacagtggcacgatctcagctccctgcaacctccgcctcccgggttcaagggattctcctgcctcagcctccctagtacctgggattacaggcacctgccaccatgcccggctattttttttttttttttgagacagagtgtcgctgtgtcgcccaggctggagtatggtggcgcgatcgcggctcactgcaagctccgcctcccgggttcacgccattctcctgcctcagcctcccaagtagctgggactacaggcgcccgccacctcgcccggctaattttttgtatttttagtagagacggggtttcaccgtgttag

SEQ ID NO: 41957 - DNA, 1029 bp, Homo sapiens
ctggcctatagtgaatgttccaaataaatgtttgtgaattgaggccgttcgtggtggctcacacctataatcccagactttgggaggctgaggcagatagatcacttgaggccaggatttcgagaccagcctggccaacatggtgaaacctcatctctactatacaaaaattagccggatgtggtggcacacgcttgtagtctcagctacttgggaggctgaggcaggagaatcgcttgaacccaggaggcagaggttgcagtgagccgagatcgcatcactgccctccagcctgggcgacacagccagactccggctcaaaaaaaaaaaaatctttgtagagatggggtcatgctctgttacccatctctgtaccagagtgcagtggtacgattatagctcactgccggctcaaccacctgggctcaagcgatcctcacaccctagcctcctgagtagctaggactaaagtatcccccaggctggagtgcagtggcacaatcttggctctcagctcactgcaccctccacctcccaggttcaagcgattctcctgcctcagcctcccaagaagctggaattacaagcacctaccaccacgcctggctaattgttgtatttttattagagacagggtttcgccatgttggccaggctggtctcgaactcctgacctcaggtgatcctcccaccttggtctcccaaagtgctgggattaaaggcgtgaaacaccatgccaggccctaatatttaagttttttgtagagacggggtctccctatgttgcccaagctagtctcaaactcctggcctcaagcaatcttcccgcctcagcctcccaaagagatgggattataggcatgaaccaccactggacctggccacaatttccttttaaataggccactcctgtagcctctccttatctccccttgttgtgactgtgttctctgaaaacacacccccttctaggacaggcttcctgcactccatcccactgctccttcctcatgtttttttgtttgtttg

SEQ ID NO: 41958 - DNA, 1029 bp, Homo sapiens
agaattaccagacaggatataaacacaggaggtacacacaaggctttagttcagagaggcttttctctctttggcttgccccaaaatctgcaggcagaatatttatctgcctatttttaatacacagtcccttccagagcacttcagccagatttgtagaaaaatagcttcacagcagagcaatcagccattccagccccatctttcaatgcacttggcaccttcagacctgaaagtaattcaaacaccatgggaccctgaatcccaaatctttagccaatgggctaatgttttgtaaattttatcttttcaaaaaactaacttttcattatgtttcttctgaatttttgtttttatattcatttatttctgctatagtttttattttttccttctaattttgggtttggtttgctcttttctagttctgtatgatatatcaatagtttatttggagattttttttttaactttttttgatgtaggcacttactgctataaaccttcttagtacttctttcattgtattcatagttttgttatgttttcattttcatttgtttcaagaacattttaaatttttttcttaaattccttattggcctactagtcattcaggagcatattttaatttctctgtgtttgtatagtttcgaaagttttttctgttagtgattactagttttattctattatcatcagagaaattacttgatataatcttatttggggggagattattttaagagttattttgtgacctagcttatggtccatccttgagaataatccaagggctgaagtgtagcatttgtattctgtagctttttgatgaaatgctttgtaaatttctattaggtctatttggttcatagtgcagattaagttcaatgtttatttgttgattttactatctggatgatctgtctactgtttaaagtctctgttgcactggagttgatctctctctctttagctctaatatttgcttcatatatctgagttctccaatgttaggtgcatataaat

SEQ ID NO: 41959 - DNA, 1034 bp, Homo sapiens
ccattattatattgctgtctatttttgcttcagttccgtcaatgtttgctttatgtgtttgggaaaactgtcttgtatttataggttctcagtgaatgaaccctcttattataattgaatgtcctactttgtctcttgtgaattttgacttaaagtaaattatatgaaatatgaccattttcaacttaataaattgttgcctcttctctcatttggttaacacttgcataaaatgtatttttcatcctgccattttgtcttttttttttattagatctaaagtgaatctcttgaagacatgatatagttagatcttgatgtagatcttgatatatgtcatgatatagttagattttttttttcattttggaagatacttttgctggatatagtattcttgcttagactttttttttttccagtgctttaactatgtcatcctgttcccttcttgcctgaaagatttatgttcttaaatttactcgtaatcttgcagaagcatgcatataaataacacgtctctttcttcttcctgaattccagattctcttcttgtctgcgacttttaaaacattgcttgtgttatgtcttgttagaaatctctttgtgttatcttagttgaagtttgctgagcttcttgattttcttatattttttactaatgttgaagtgcatattagtctttttttgtagttctactacacaatttttatttctttctgtgctttttatctttttgttggtttcatttttgttatttcattttgtttttttaatttccattttactcattgagcatcattgagatgtaattttgattttctagggtaatttatttttttcttttaaaaaatagatcaagactttaattcaaattgtctcacataatttttacatctcctttttttaataattgatttctggatattcttttttttctttgagccatattatcttgatgttttgtttatgttgtaatgttgcaatttgtataataaaaagccacatgtcaaaatctgtattaagtgactttt

SEQ ID NO: 41960 - DNA, 1034 bp, Homo sapiens
gccctgctaatttttgtatttttagttgagacaaggtttcaccatgttggcctgtctggtcttgaacatctgacctcaggtggtccgcctgcctcagcctcccaaagtgctgggattacaggtgtgagccaccactcctggccattccctatgtttcttattgagatcccttagtcacttgctatacccattgtctgtctatgatactgaagtctttcttctcttgtaacagtcatttacctttggtctcagctgtccgaaactgtcagtgcataccacctttcctttcaacactgtcatggaatatagaaattagtctttggtaaggtctcaataagccagaagcatggacacatgtgccactattttatttatttttggagggggtagacaggagtttggagtctatagttagagtcatcataggatgaagaatggctgtggtgggtaaatatgaaatacttttattacacttctatgtggttcttggcgttttgctcacttggtgtgccgcaaatgcttaactggttcttagacttctcacaaaggcattttggtcagtatatttctgttaggtttatatgtctataagaatatagagcctgtggtattttattatcgttttattaattgctttgtataattatatatttgtgaagtatattcacctgagtctaatgagggagaattttattttttttctccagctggttcttttcattttactgcagagatattgccggatcatgacataaaagattcatttcaaaaagtgattctgagaaaatatggaagctgtgaccttaataatttacatttaaagaaagactaccaaagtgtgggtaattgcaaggggcagaaaagcagttataatggccttcatcaatgtttgtcagctacccatagcaaaacctgtcaatgtaataaatgtggcagaggttttcagttgtgctcaatcttcactgaacataaagacatttttagcagagagaaatgccacaaatgtgaagaatgtggcaaagactgtaggttgt

SEQ ID NO: 41961 - DNA, 1722 bp, Homo sapiens
aggattgcaacccctgcttcttttcctgttttctatttgcttggtaggcttttctttttccctttattttgagcttatttgagatgggtgtcttgattaaagcataccattagatcttgattcttttttcagcttgccatctgtgctttaatttgggtatttagcccatttacatttaaggttagtattcatatgtgtggattggattctgttattaggatcttagctggctattttgcacatttgtttctgtggttgctttatagtgtccacagtttgtatactttagtgtgcttttgtagtgactggtaatagtctttttcttatttaatgctttcttcagaagctcttttaagacagatcctgtggtaacattttctcagcatttgcttgtctgaataggatcatatatattttttacttctgaagcttaccttggtcagatatgaaattctgtgttggaattctttttttaagaatgttgaatattggcccctataatctcttttgacttgtaggatttcagctgaaagatttgttgttttcctgatgagcttctttttagaggtgacctggcctttctctctagctgcctttaacatattttttctttcattttgaccctggagaatctcatgattatgtgtcttgaggatgaccttctcctggggtatcttactggggttctccacatttcctgcatttgaatgttggcctctctaggttggggaagttctcatggatgttatcctgaaatacgtatttcaagttgttttcattctccccatcactttcaggcaatctcttgcatcatagatttggtttctttacataatcccatatttcttagaggttttgttcattcctctttattcttttttcactgttcttgtctgtctgatttcagaaagccagtcttgaggccctgagattctttcctctgcttggcctattctgctgttaatatatgtgattacattataaaggttttgtattgtgtttttcagttctatcaggttggccacattttttctccagactggctgttttttccgtcagttcctgcaattttttttcctcccttgcattgggttgcaaattacttttgtaactcagtgaagtttgtttctacccatattctgaattctacttctgtcatcttaggccttgctggaaatgtaatttggtcatttggatgaaagaagtcactctggctttttgtgtttttatctttgcactgattgtgtcttatctttgtgggcatatctttgaggttgctgacctttgggcttttttttttttaatcctatttgatggtcttgagtatttgattgtggtataagatggatgcagccaacaggctttgttcctgggaggttttttttgttttgttttgttttgttttgttttgtttggtggtggtggtgggtgggcaatgctcagctcacaactcagaggctgcatactctaactccgggggacttgttttgagccccaactgtgttctctggctccttgagatttggagtttgcgagtttgtgggatgaaggtgccatagctggagcagagtgctagtggatatgggatttctgcctgtctttgggtactcacctcagtggcaggagcaaagcagctgggaagggagtgggggatacctgctggaggctgtgtgctgttgcactaaaggtggtgttggcttggggcaggatactggccagtaa

SEQ ID NO: 41962 - DNA, 1100 bp, Homo sapiens
agtaaactgaaacctaagacacacgaagaaattctaagtggaaaggccacttattagtttacagcagtatcgtaagtgacaggatgataggagtgtggtaagtgatcaggataataatctgcttagtaagagaaacaatttgaattttagaaggaaattgccttaccatttgcaaattaaggtaattaaaatacagtgaatttcaaaatgcctttttaatgacaatgtgtgaacttaatttgttttaataaaccaaaattattgttattgtgttaaggctattttacattgaatgtgtatcttgccactgatgttaacttatcccatcttacccaaggttgtaggtaacaatatactattgggtgacagtggactaacatctctagtgatccctttgtcagtggtctttaacttaaaataatttagagaatatggtttctacaacttacatttttgtttacttgtaactacagattattatgatggttgtaatgaagattatgagtataattggagctatatgtttctgaattctgaacaactatttataaaattttatcctacttttttctgttgaacatatgacttctctggtctgctaaacacatacagacctttagttttggtttacatggatttaaatatatagatatatcactgtaaaataaacttcaggtgtaacagatttatagagaaagtaatcatatttgtttatggttgtgtacctactttgagaagaaaagaaaaatattagaatgaacagataattttacaagtgttgatcacttaccagcaaaccagaaacttcagagattttgaaagcaaatctattttctctgctgtgtattaaattcatttatctaaaatgttattgctcctggcttagaatcatcttgtgcaaattctttttttgttgtttgtctgtttgcctgttgctcaccatagacataattttcttttcataaaacattctttgtataatcacctcagagattatgaaagtgactttgataaaatttaatggtgttcacaaaataattttcacgtgagtaatttcacagtgcgtgtattgtatgttatttagtgtattttatattttg

SEQ ID NO: 41963 - DNA, 1037 bp, Homo sapiens
tgatgttaacattctgcctagattttttgcccacagatgggattatgacatataccttgcttgagttcaaaagcatgattatcaagcttatattgggattcagccaataggagatactttgccccctaccactaggtttatgtcaataggtaaggtccttcattgcatatttgtacaaagctcacagaaatttacaacattaactcatatcataaaaactttttgggtggtacagagagtttcataacagggcccagcaaaaagttaagattgtgactctcaactacacactcaggtgaaagtaaaagttgttaccatcctacatttacaaagcccattgttgaggtcctgaatctaacaagtgaagacagcacaaagttggaattgtgactttcttaagtgattctggtcacagttgggatggtgactcatttctggacccagctcataggcataataatgttctcatccctgaagccaacccaaaggagagatgttgactgtcatacctgggtttagggtatgtgtccacctcataggttatgtaactctcctctctggaatgggccctgcacaaaggaaggatagtgacatattgcaaggccaggcacagagatgagagtactcttttgccagagccatgcccaaagcagggcattgtgacatatttctgggcatatcacctaggttatacgactctcctgcttgggccctgccaatctggagagtgacatatttctaggccaggcacacaggtgatggtactcttttaccagggctatgcttcatggaggacactgtgacatatctctgggcctatcacctaggtgaagtgattccctccttggaccctacccacatggagcattgtagcatgagcagagaacctgtacccaggtgatgtaactctcttggctgggtgctgtcctaagagagccttgtgacctgtctcaggacccagcacccaaatgatgtggctcttctgcctggtctctgcccacatgttacattgtgacatattcctagggaagcaccta

SEQ ID NO: 41964 - DNA, 1004 bp, Homo sapiens
gaaattaaagcttatgcccagtgattccaagctaaggctaatattgagcctgcaaagggaagggaggttattaaaggcccagttagttctttcttggaagcctcccctgctcaccccagccatggaagaagcctttattctgagagaagctacagagccctggacgtcgggggacccacaggcagatgcagttaacgttaagatggaaggggaatgagagagtcttactaaagatgaagttgttatcgttttgaggcagtattttactttttgtaaaaacagaataaggtttctgtaaaaaaaattctgaattttaaaggagtattgcaacagaaggaaataccaactaaaagatctttaagaattgcaaagtttaggcagacaaagacttttttttttagggaggagcaaagaaggttagaaagaaggtcacaggggaatggcaaatggagggtgaaaaaaatcaaatactagattagaacacttttatcctgaagtcatcaagtctttaggagggacaaaaaatggggttgtatgttggctcagactgagggtacctcaaagttcaggagcctgtggaaaggagataaacttaagtgaagtttgattaagaagaactttcttttgaccactgaagaaaaattcagctaattttttaatatgaaaaagaaaatatgcagagtgagtgtttggttattaaacagttaagaaaaagagtaccatctaagtcataatgggaagggtgtttcttttcataaactgttcctggagaacacaaaggatggggacttttattaatcgcagctatttaccaggattatctatgtgcttcatctttccccatctcttttctttgtcctatacattttttccatttgaattttcctgggttgtatcttgtatagtaaactggtcgacataaccacagtgttttgcagagttctgtgagtagctttatcaaattattgaacttgagggagttatgggaattctaaattttcaaa

SEQ ID NO: 41965 - DNA, 1071 bp, Homo sapiens
tccatgtaggatacaagcctttggctcgcctcctagagccccttatttctttctcatcatggaagtccgtccttaaacaatcacttcttaatgttctgtctgccactccaaggttttcttaggccccctccttccccagcacatcaggcctgagggtttactactacacaagattggcaaattgacttcactcatatgcctcgtgtcaaaaaatataagtacctcctagtttgggttgataccttcaccagatgggtcgaggccttccctactggatctgaaaaggctgcagcagtttttacctctcttctaacagatattgttacctgtttcggcctccctacttccatccaatctgacagtggtccagccttcattagccaaatcacccaggcagtttcccaggcccttggcatccagtggaatctccacaccccataccatcctcattcctcaggaaaggttgaaagagccaacggcctcttaaaaactcaccctccaactccgaaaggactggactgttctcctaccacttgtgcttctcaggatctgagccaccgcccatgaacctaccaggtatagcccattcgaactcttatatggtagtacttttctactggggcccaacctcatcccagacaccagtcctccaacaggctaggaatgaaatctgtcaggctgctaaccttcttttacccacctcagatacccagccatatgaggacactctggccagacagcccatcctgataaagagcttaaccccctgatctctacaacctcagtggacaggacccttcctggtcgtttatggtaccccaatggctgtctgcttacaagatcctcctcagtggattcacccttccagagtaaagctgtgtccatctgacactcagcctgacccttcttcctcctcttggaagtcgcaagtactctccccgacctcgttaaaactcaccgaaatccctgaagaaacttaaatgtcctgctcctgtccgccctgcttcttcaccctcttcctccactctatttgccaagacatctcctggtttcatccccaaactcccacct

SEQ ID NO: 41966 - DNA, 1017 bp, Homo sapiens
aaagagaatggttcaaagaaatgatccaactttatttcatcagtgttgatatccagttctcaacattattttttgaaaagattatcttttccctcttttgtactcgtggcaactttgtagaagatcatttgattatatacagatgggttcatttctggtctcttctgttctttcatctgtttatctgtctgtgtcagtaccacattgtttttgttattatagcttttaattgttttgaaatcaggaagtataatgcctctttgtttttttccatgggtgttatagtttataataaaaatttaaaattttaaataatatttctgtaaaaaattgtgctattaagatttttataaaaattatattgaatttgttcaccactgtatgttatattgacatcttttaaaaattaaatttttttacccttgagcaagaatatgttgaacagtgtgttttattttaatatatttttgagttttccagctttacttttgcttttaattagtaggtttattcagttttgtcagaaaacatggaatgtatgattttggtcttcttaaatttatttgttgttgtcattgttttgagacaggatcttactctcacccaggctaaagtgcagtggtatgatggcatgactggctcactgcagcctcagcttgctgggctcaagtgattcttccacctcagtttcctgagtagctaggactacagacatactatgggaccaccatgtctggataatatttttattatttgtaggaacagggcctcactaagttgtccatgctggtctcaaacttctggccccagtaatcttcccacgttggtctcatgagctcctgcagttcactggtatttttaaatttcataagacttggtttgattcctaacagaatacgccaggtgcaaataagaatattgtacattctcggccgggcgtggtggctcacgcctgtaatcccagcactttgggaggccgaggcgggcggaccactaggtcaggagatcgagatcatc

SEQ ID NO: 41967 - DNA, 1055 bp, Homo sapiens
tcccgacctcaggtgatttgtctgcctcagcctcccagagtgctgggattataggcgtgagccaccgcacccagcctacctctttttttgggaagtctttatttatattttgtgtttgaagtaaaataattttgaattaagtcttactggttaaaatttttttattacatcaaaatttgggaagttatccgccttttatgtcttcaagtaacctttctattactttttttctatattcttcttctaatatttctttcttgaatatattgacatacttgatggcattcgataagttttgcattccatgctttaattttgttttgcaatttaatatttttatgttatatattttaggatgtgccacctcacaccagttaattgtattttgatagtttatattttaattgtgtatgacaatatttaactctgcaatttaagacagtgtggagcaaaatcaactatgaattaaccatattcattgtctactgccaatgtaattatctgtttgtataaatattatccctgtatttttttatgatttgtatttttctggcacaggtttgttgtgaatggttgttcaattttgtctaggtgagcagtcataaaaattctcctaatttcaacatttagttatatttgaatccatatttttgtgtgggagcaaaacgtttagattgaaagataatttgaaggctaaagtgcagtggtatgatctcagctcactgtaacctccacctctcaggttcaagcaattctcctatcttagccttctgagtagctgggattacaggcacccaccaccatgcccagctaatttttgtattttcaattgaatggggtttcaccatgttggccaggctggtcttgaactcctgacctcaggtgatccacctgcctcagcctcgcaaagtgctgggattaaaggtctgagccaccgtgcctggccaaaagtttgtctcttgattttatagatatttaaataaagtgaattatatatatatttaaataatcttctgaaacagaaagacttgctaacgttattgtttaatttgatt

SEQ ID NO: 41968 - DNA, 1029 bp, Homo sapiens
tataaatgtgaagaatgtggcaaagcttttaaccaatcctcaaaccttactacacataagaaaattcatacttcagagaaaccctacaaatgtgaagaatgtggcaaatcctttaaccagttctcatctcttaatatacataagataattcatactggagagaaaccctacaaatgtggagattatggcagagctttcaacctatcctcaaatcttactacacataagaaaattcatactggagagaaaccctacaaatgtgagtatggcaaaacttaattgatcctacaagcttactacacataggaaaattcatactggagagaaactacaaatgtgaagaatgtgttaaagcctttaacaagtcttcaactttttctgcacacacgaggtattttatactggtgagaaaccttacaatgtaaagaatgtggcacagcttttaactaatcttcaaaccttactgaaagttgagaaaattcgtactggagagaatcctacaaatgtgaaaaatgtggcaaatcctttaactgatcctcaacttttactaaacataaggtaattcatactggagaaaagccatacaaatgagaagaatgtggcaatgcctttaatcagtcctcacacctttctacacataagataatttatactggagaggaactctatagttgtgaagaatgtggcaaagcttttaaccaatcctcataccttactatacagaaattcatactggagagaaagcctacaattgtgaagaatgtggcaaagcttttaaccttccttaacccttaactgtagataagaaaattcatactggaaagaaaccctacaaatgtgaagtctgtggcaaagcttttaactgattctcaactcttactacatgtaagagtatttatactggaaagaaaccctacaaatgtaaaaaacgtggcaatgcctttaactggtcctcacaccttgctacatataagacagtttatactttgagagaaaccctgcaaatgtgaataatgtggcaatacttta

SEQ ID NO: 41969 - DNA, 1028 bp, Homo sapiens
acttcagaaagattgtacaaatacaaggaatgtggaaaagccattattatctgctcagattttactcaacattagagagttagtacgtaataaaagcattataaatgcaatttttgtcaagagatctttcagaaaatataagcctttaaagtgaagaagaggagccagttgtgctggctcacatctgtaatgccagcactttgggaggccaaggtgggtggatcacctgagggcaggagtctgagaccagcctggccaacatagcaaaaccccatctctattaaaaattttacaaaaattagctgcgtgtggtggcaggcccctgtaatcccagctaattgggaggctgaagcaggagaattgctcaaacctgggaggcgaagattgcagtgagctgaaatcacaccactacactccagccaaagcaacaagagcaaaaacttcgtctcaaaaacaaaacaaaaaaagagtattcattgtgaggacaaacaatacaaatacgaagagggttgtagtacctttacttgtatcacagatacttttgtacccattttgcactagaggaaaaccatgaagcagttgctcaaatgttgttcaacaccagaaaatttatattggagaaaagcactgtaaatgtaatgcatttgtgaaaacattttttaaaaaactacagcttagaaaataccagaggcctcatactaaaatatatttttgcaagtgaagtaaatataaaaataatttaatccaaaattaagtctatataaatatcagagaattcacagtagaaatatctaaggtactgacacttcagacattgctgagtatagaatcagaatgctgagtatagaaaataatttaaaactaaagttggtaggtaaataatgtgtatataactttaaaagaagtagaatttttttgtagatgtataattacattcaaattatattttttcttgaaaaattagtttttgaaaagcaaatgatgtaattcaactcaaattcatgctcttcattcctattgtattcaca

SEQ ID NO: 41970 - DNA, 1054 bp, Homo sapiens
atgaaaatttacttcaattatttgttcatttctaaatcaagttattcaactttatattctttttgtttgtttgttttcgagacacagtctcactttgttgcccaggctagagtgcagtggcatgatctcagctcactgcaacctccacctcccgggttcaagtgattctcatgcctcagcctcctgagtagctgggattacaggcaggtgccaccacgcctggctaatttttgtatttttagtggagacagggtttcaccatgttggccaggctggtctccaactactgacctcgtgatcctcctgccttggcctcccaaagtgttgggattacaggcatgagccatcatgctgctctttatttggttttaagagttgtttatgtattctgaatataactcctatcacatgtgatttgcaaatattgtctttttttttttttttttttttgagacagagtctggctccgtcacccaggctggagtgcagtggcgcgatctcagctcactgcaagctctgcctcctgggttcacgccattcttctgtctctgcctcccgagtagctgggaccacaggtgaccaccaccacgcctggctaatttttttgtatttttagtagagatggggtttcaccgtgttagccaagatggtctcgatctcctgacctcaagatccacccaccttggcctcccaaagtgctgggattacaggcgtgagccaccgtgcctggccaatttgcaaatattttcacccattttctaggagaccttatcactctattgaatgctgtatttaatgtgcagagatattgaagtctagtgtagttcaatttttctgttcttttctttgtttcacatgcatttaatgttgtgtctaagaaagtaatgccaagatcaatgtcatgtttttttcttacattcatttctaagagattaacagtgattttttaggtctaaacattttttttaaaaaaatattttttgtatgtggttcgagaaaatgatccaacttaatttatcagtgttatccaattttcaacattacttttccaaga

SEQ ID NO: 41971 - DNA, 1054 bp, Homo sapiens
cctatttttggttatagaaaaggggcgacgaaatcatctggctacttcctgctgttaaggggtgtcactggggagagggcctaaatcagaggttggcagttggacgtaggggtgaagtaacatctggttgaaagtgaccctggtgatttcttgtatccgctggcggagaaactgtactaggattggggcaaaacacattattatacagagaattataattgggataaggaaagggagcatctgttgaaccacaggtgaaaaccaccaagaaggaccagggtggagagggtcctaggaatgttttaactcctcttggatcttttttttttaaagtttgtaaattggtctcaactacccctgacacgttgagataatagcagcattcttcctgtaagaataaacatgtccctcctttttctgctgtaagcaagtctaaggcccgcctgttctgtgctgcgacctgtgctaccgaagtgatctgtcgctgtagggaggccagggactcggccgatgcctcaatggccaactgcaggcgagtagacagatcttgagatgtttggattgagtgggtgagggctccttttcctagccctgatgccactaaggaggaggctaaggagatgcctagtactaagggtaggaaaatagcccgtttgcttttattttgcagccttggctcggtccaggctagcagatggctaagttcgtcctgactatatagggtcaggctagggatgagagagacgagtaagcacaaggtgtgattaccagttgagttaagaactttagttagtgtggagttacaccagaagtagcctccgggtggtgccagggcgctggtaagcatcctggtctggttacaccaagaggcatttggggtagagtaacagaacgggaacttgtgtcttgtagggtctgagaatagtgggacctgtccttttgggaccggtggtataggggtggatgaatttcttgtataattaaagggggtagggagaggaactgctactaagggaggtcttccgagggctgcacagaggaagcagtgggagag

SEQ ID NO: 41972 - DNA, 1087 bp, Homo sapiens
tacaggatcttttgtggggtatcatataaattttagatatatttaatttttattaagtatgtcactggtattttgataaaggttgtgttatatctgcagattattttctgtaatatggatatttaacaatattaatgccaattcatgaattagtactatttaattggtttagtatttaatttcttcctttaatgttctttagattataatgtaaggtgttttaactttttggttaaactgatttcaaagtgtagttattacatttattgtagatgagattgcttttaatttcattttgagatagttaattgttcttgtgtagaaatgctactgactcgtgtgttgattttgtattttgcaagtttaataaatttgtttattagttctaagtgaagtcttaggcttttctatacctaagagtatgtcatctgtaaacagggataatttaactttttttccaagctggatgcctttgattttattctctaaattttctgacttggacatttaatactatgtttaataagactgatcgaagtgggccttcttgtcttgttctagcttttagagtaaaagcttacaacatttccttgcttaatatgttgttagctgtgcattttttttggtatatctggtgtatattggcttgaggtgcatttgtcctatacctgttttattcagagatttatcatgtatttatcatgtatgttgaattttgccagcgcttattctccacctattatttatttatttatttattgaaacagagtctcactctgtcacctatgctggagtgcagtggtgtgatctcagctcactgcaacttctgcctcccgggtgcaagctattctcctgcctcagcctcccaagtaactgggattacaggtgcacgccactatgcccagctaatttttacattttagtagaaatggggtttcgccatattgacgaggctggtctggaactcctgacctccagtaatccactcacctcagcctcccaaagtgttgggattacaggggtgaatgcataaacagttatgtagatagtttctcttagtttaacaagataaaagtaacagttaaaa

SEQ ID NO: 41973 - DNA, 1027 bp, Homo sapiens
cagctcactgcaacctctgccttccagcttcaagtgattctcctgcctcaggctcccgagtagctgggattacaggcacctgccaccaaaccctgctaatttttgtatttttagtagagatggggtttcaccatgttggccaggctggtgtcgacctcctgacctcgtaatctgccctcctcagcctcccaaagtgctgggattacaggtgcaagccaccacacccagcctaatctgtttcttatgttatagatgcacataaaatttcatttagaaaaatgttcttgtactacaatatttaaagctattgaattatgattcataagttttattttgtagttagcatctctaggggaatttcagggacactgttggctgtcttgtgattaccgatccttttaaaaactcgttgtatttgagaagtaaaatagtagaatatatatgacaaaatcgggaattaaagtagacagtatactcaattccactgtgtttaaagagtttgattaatttctatacattgtgccagtggttaagatctgggactctagagtcaacctgagttgaaatcttggctctgtcacttgatctcttgtctcagcttcttcctccataaaatgagggtagtaatagcgttaactcataggattattgtgaatatgaagtgtaccagtacatgtaaatagtcctggtgtctggcataaaggtactcataaaacatagttactattattttagaacatggtttagatcttcctgtatgtttaatttgtcttttcctcacttaacatatcacggcagggcacggtggccataatcccagcactttgggaggctgaggcaggtggatcatctgaggtcaggagtttgagaccagcctggccaacgtggtgaaaccccatctctacagcctggccaacgtggtgaaaccccatctctactaaaaatacaaaaattagctgggcatggtaatgcacactgatggtcccagctacttgggaggctgaggcaggagaattgcttgaactgg

SEQ ID NO: 41974 - DNA, 1265 bp, Homo sapiens
tatatgcttcttgcctatggaaatatctgttttctttcagggtttttatagttttgggttttacatttaagtctttaattcatcttgagttaatttttgtatatgatgtaaggaaggaattgagtttcagttttctgcctatggctagccagttctcccagcattatctactgaacagaaaattctttccccatttcttgtttttgtcagctttgtcaaaggtcagatggatgtagatgtgcagcttgatttctggccctctattctgtttcattgagacaaagaagggcattacataatggtaaagggttcaattcaacaagaagatgtaactattctaaatataaatgcacccaatccaggagcaccaagattcataaagcaagttcttagatacctacaaagagacctagactcgtatatgataacagtaggagagtttaacacaccactgacaatattagacagatcatcgagacagaaaattagcaaagatattcaggacctgaacttagctctggatgaagtggacctgatagatatctacagaactctccacccaaaacaacagaatatacagtcttctcatcaccacacaacacttactcaaaaattgatcatgtattgtaagtaaaataatcgtcagcaaatgcaaaagaactgaaatcataacagtctctcagaccacagcataatcaaattagaactcaagatgaagaaatccactcaaaaccacacaagtacatgaaaattgaatagtccgttcctgaatgacttttgggtaaataatgaaattaaggcagatatcaagaagttctttgaggctgggcgtggtggctcacgcttgtaatctcagcactttgggaggccgaggcgggtggatcacgaggtcatgagatcgagaccatcctggctaacacggtgaaaccctgtctctactaaaaatacaaaaaattagccggtcgtggtggcgggcgccagtagtcccacctactcgggaggctgaggcaggagaatggcgtgaaccctggaggtggagcttgcaatgagcggagattgcgccactgcactccatcctgggtgacagagcaagacttgtctcaaaaaaaaaaaaaaaaaaaaaaaaagaagttctttgaaactgagaacaaagacacaatgttccagaatctctgggatacagttaagaagtgttaagaggaaaatttatagcactaaatggcctcatcaacaaactagaaagatctcaagtcaacaacgctaac

SEQ ID NO: 41975 - DNA, 1050 bp, Homo sapiens
ttctgacattttattttccacagactttatttcaagtgcatacagtgtggccgaggctacccctcaggtgcctgagtccagacttactggaattcaaatacccatgagtttaagaccaacttccctggacttggctgttgaaagcataagtacaaattagaaatataagacttaattttccaacttgaaagtaagagtagaaaatttgctctccttccttaaagcatttaattcagaaaacttttatatttaattttttctctgcctctttgacatatgtgttaatatttttaatggctgaacagtccttttgttatttttttctaggaaaagtctttctctaggacctggaaatgattgctcggaagtgtaaacagcaaaaaagttagagccctatcgcacagcttgctccaagtttcaaaattaccttctgtccctcctggacttgggaccattatttttccttcagatatgccagtcagcaaccacagatggcctccccaattaccaggtgaatttaggataaactgtatatgacacatggtgctgtgaagtgtcctacttgaggactaattatgtctttcagtctgttatgaggttacctgtaatttaaatcagattctggtctaactgtgtaataataatttgctttctattctactttggcgagtgtttgggggagttggagacaattaagttttcagttacattttatgaacactgtccagaattgccagacacactataaacatatgaggtgcccaccaggcttcacactagaggggtcctttccactcagtaactcacagttgtgcagcaacatgcatgctgcccccaaaatctgcaggtagagtggtgtctctgcctatttgggatccacagtcatgtcagagcagttagagcaggtttccacataaataacttcagaggacagcagtcagccagtctacctctttttatgcccttggcattctttatacctgaaactggttcagagaccatggggcctcgaaacccatccaggctcacacatgtgcaataagtagcttt

SEQ ID NO: 41976 - DNA, 1331 bp, Homo sapiens
tatagatactatgcaaatagttttcccatactgtgggtggtctcttcactttgttgattgtttttttttgcagtgcagaagctttttaacttgctgtaatcctgtttgttcctttttttttttttttgagacagaattttgctcttgtttcccaggctggagtgcaatggcacaatctcagctcaccacaacctctgcctcccgggttcaagtgattctccttcctcagcctcccatgtagctgggattacaggcatgtgccaccatgcccagttaatttttttatttttagcagagatggggttttaccatgttggccaggctggtcttgaactcctgacctcaggtgatccacccacctcagcctcccaaagtactaggattaaaggcatgaaccagcacgcccagccctgtttgttcatttttgcttagttgcctgtacttgtgaggtactactcaagaaatttttgctcagtccagtgtcctggagaggttccccagttttctgggattttttagtagcttcatagtttcacatcttagatgtaagtctttagcccattttgcttttatttttgtatatgctaagaaatagagatctagttttatttttctgcatatggatatttagtttcctcagcataatttattgacaagactgtccctttttgccaatgtatgttcttggcacctttgttgaaaataggttcactgtagatatacaaatttttttctgagttctctattctgttctattggtctatgtgtctgattttataccagaaccatgctgtttgggttactatagttctgtagtataatttgaagtcaggtaatgtaatttctgattttgtccttttgctcatgatggctttagctgttctgggtctattgttgttcaatataaattttggaatctttttttctatttctgtgaaaaatgtcatggtattttgatacgaattgcatcaaatctctagactgctttgggtaatgggaacattttaacagtattgcttcttccagtccataaaaatagaatatctttccattcttctgttttatagttttcattatagagatcttcttgtttctttggtttagtttattcttgggcatttctttctatttgttgctattgtaaatgggatgacatgcttgatttctttttcagattgttcactgttggcatttagaaatgctactcattgtttttgagatggagttttttttattattattattgttattttgagatggagttttgctctgtcacacaggctggagtgcagtggtgcgatctcagctcactgcagcctctgcctcttgtg

SEQ ID NO: 41977 - DNA, 1030 bp, Homo sapiens
actttctgtagctctttctttttcttcaatctgttcattataaatttagcttagtgtttctgtttgatcatctctttaactcactttattgcatcaatagttgtattccatagctctcgctggtatttgataggttcatttctacgtttttcaaattcaaattaactatccactgtaagctctttaccagctgctttctgagtggaatgctttggtccacctaattttgcgaggattgcacttctttttaaagtttttatgacatttagatttacgaaatctgaacaccttgcaatcattgcggatgaacatcatgccatggccagggtaggtgggccccaaacagaaataacatatctcgacatgcatgtcgaacccgcgggtccctaccgaccgaatgccaagcttgagaggaagttgaatgatgtttttaatgtgttgttgaatttggttttctagtattctcttaaggatttttacaatgatgtttatcagagatattggcctcagagatatgtcagttttccctgctcttgcacagcctttctcacctgtcactatgtaagatgtgcctgcttccttttctgctgtgattgtaagtttcatgaggccttcccggccatgctgaactacgagtcaattaaacctcctttgtttataaatttcccagtcttggccgggcgcggtgcctcacacctgtaatcctagcacttttaggaggctgaggtggatgtattacctgaagtcagaagtttgagtccagcctggccgacatggcgaaatcccatctctactaaaaatacaaaaattagtcagtcatggtagcgggtgcctgtaatcccagctactcaggaggctgagacaggagaatcacttgaacctgggcggtggaggttgcagtaagccaagattacaccacttcaccccagcgtgggctaaagagtgaaactccgtctcaagaaaaaaaaaaattacccagtctcgggtagtatgttttttgtttgtttgctttgtttttgagatagggcct

SEQ ID NO: 41978 - DNA, 1045 bp, Homo sapiens
gttaatgctggaataaattaagactttggggaactgttgtgaaggcatgatttgttttaaaatgtcaaagagatatgagatttgggagaggccaggagtggaaggatatagttaggctttgcatccccactcatatctcatcttgaattgtaatccccaggtgtttacgaagagaccttgtgggaagtgatttgattatggggtggtttcccccatgctgttcctgtgatagtgagtgaatgctcatgagacctgatggtcttataaggcagttttccctgttcttccatgctctagctcacctgctgctgtgtaagacatgcctacttctgctttcaccatgattacaagtttcctgagacctccccagccatgcagaaccgtaagtcaattaaacctcctttgtttacaaattacccagtcttggttagtatttttataacattgtgggaatggactaatactgtctgttttgttaaaagactaagtttcaattgggagccaagatgactgactagacacagccaggggaaacaactgacaagacactgagacattgaaatttccatcccattctgagcctatcttcagatgaaatgcattgcaagtgggcagagggaggacacagatgctggaaacccttcatggtgtaccaagtactaggaacttaagtccactttttctgagccctgcaaaacatcagaacttgctcagggattgccatcattgtgatctagactgccggggttttttgtgattttttttttttttttttgagacggagtcttactctgtcacccaggctggagtgcagtggcgtgatctcagctcactgcaacctccgcctcctgggttcaagtaattctcctgcctcaacctcctgagtagctggaattacaggcatgtgccagcacgtccggctcacttttgtatttttagtagagatggggtttcaccatgttggtcaggctggtctcgaactcctgaactcgtgatccacccgccttggcctcctaaactgctgggattacaggcttgagccacc

SEQ ID NO: 41979 - DNA, 1055 bp, Homo sapiens
ggaagtcatattggagagaaacattgcaaatgtaatgaatgtagccaagtggttaaatcttgctctaccctttctattattaagagaatttatgctgaaaagaaacccaacgaatgtgaaagatgtggcagagtctttaagtggtcctcatcccttactcaacataagagaattcatcctggagagaaatctataaatgtgacaaatgtgacatagtcacagtcttcaaattttactaaacgtgtaatactttgtagtggagagaaaccctacaaatgtgaagagtgtggcctttaaattgttgctatactttactcaacgtaaggacattcatactgcagtgaaaccatataaatgggtaatatgtggcagagcttttatatggttttcataccttactagacatcagataactcatcctggagagaaattctacaaatgtgaagaatgtggcaaagcctttaatcagagctcacaccttaatgaacataagaacattcatactggagggaaaccctgaaaatgtagagtgggacaaagcctttaacactcaaatcttgctaatcataaggcaactcacaccaaatagaaaccatacaaatgtaaagaatgtgccaaagccttttaccagttcttacaccttactgtacatgaggaaatttaaacctgagaaaaattttacagatgtgaagaatgtggcaatgtctgtaatacctgttatcttacttgatatggaagagttcataccgactagtagtgttataaatgtaattactgtctaaagacattttacaaaatacaagccttagattgcaaaaagttttagtgaagaacaacattgcaaatacaaagacgagttcaatgccttcacttatatcattgatcttcttgtacacaggagaaattatactggagagaaatcctcaaacagttgctcacactttattcaactttagagaatttgtattggagacagacactacaaatacaataaatgaagaaaagctgttctaaaaatatcagaagacatcagagtgttcacattaaatgatgtt

SEQ ID NO: 41980 - DNA, 1120 bp, Homo sapiens
gcgcgatctagactcactgcaacggcgcgatctagactcactgcaacctccgcctcccgggttcaagtgattctcctgcctcagcctcctgagtagctgggactacaggctcgtgccaccacacccagctaatttttgtatttttagtagagacggggtttcaccatgttggtcaggatggtgtccatctcttgacctcatgatccacccacctcggcctcccaaagtgttgggattacaggcgtgagccactgcgcccagcctggcagttactttctaaaataaaacaaagttagaattatgtaaaaacatttgaattccaaaggagtattgcaacaggaggaagtaccaactacaagatctttaaggattgcaaagtttaggcagacaagggctttctttcataggagcaaacaagattagaaagaaggtaggcggggaactgcaaatggagggaatcaaactttaggcctggcatggtggctcatgcctgtaattccagcactttgggagactgaggtgggcggatctactaaaagtacaaaaatcagctgggtgtggtggcgggcgactgtaatcccagttactcaggaggctgaggcaggagaatcccttgaacctgggagatggaggttgcagtgaactgagcgttactgcactccagcctgggcaacagagccagactctgtctcaaaaaaaaaaaaatcagattttagatgagagaatgttttaccttgaagtcagtatattcttagaagggacataaagtgaggttgtatgttggctcagactgaaggtagctcaaagcgcaggagttggtgggaaggagataagtaaagtctgattaagaagtatttttggccgggcgtggtggctcacacctgtaatcccagcactttgggaggccgaggtgggcggatcacgaggtcagaagaccgagaccatcctggctaacatggtgatactccatctctactaaaaatacaaaaaagtagctgggcgtggtggcgggcgcctgtagtcccagctattcgggaggctgaggcaggagaatggtgtgaacccgggaggcagagcttgcggtgagccgagatcgtgccactgcactccagcctgggcg

SEQ ID NO: 41981 - DNA, 1023 bp, Homo sapiens
tttaaatgttacatacagaggtacaagggagatctatatataaatagcacgatataaattgcttgaatctttctttttagagttttgtttggatgtggcttcagagcagggattagtcaattcatttttacttttttttttggtggattctcattctgtcgcccaggctggagtgcagtgtcacgatcttggctcactgcagcctctgcctcccaggttcaagcaattctcttgcctcagccttctgagtagctgggactacaggtgcctgccacaacacccggctgatttttttttttggtagagacaggctttcaccatgttggccaggctggtcttgaactcctgacccaagtgatccacctgcctcagcctcccaaagtgttgggattacaggcatgagccatcgctcctggcccttgttttacatttttaaattacagtttttatacctattcaaaagtagagaaaatagtacagtgaacgctaaaatacccattcctcaatttctgtgatcattaagattgtcccacattttgttcttctattcctttacctccctttgcaggaatattgtaaagcaaatcagtcatcaccatcattttatctgttcagtgtgcatccccgaacagcattaacattttcttacacagctactatctcatcacatctgacaaaattacaatgattttttggtgtcagctcatctgtaacccttagttgagtttcctcactcttttttttttttggagacaaagtcttgctgtgtcaccctaggctggagtgcaatctcagctcacagcagcctctgccccctgggctccaacaattctcctgcctcagcctcctgggtagctgggattacaggcgcacgccaccatgcccagctaatttttgtatttttagtagagacagggtttcaccatgttggccaggctgatctcgaactcctgacctcaggtaatctgcccacctcgtcctccccaagtgctgcgattacaggtgtgagccaccatgcctggc

SEQ ID NO: 41982 - DNA, 1047 bp, Homo sapiens
actttgggagactgaggcgggtggatcacctgaggtcgggagttggagaccagcctgaccaacatggtgaaaccccatctctactaaaaatacaaaattagtcgggcatggtggtgcatgcctgtaatctcagctactcgggaggctgagacaggagagttgcttgaacccaggaggcagaggttgcagtgagccaagatcacgccattgcactccagcctgggcaacaagagtgaaactccgtctgaaaaataaaataaaataaaataaaaagtaaaaaagcaaaaaaaaaaaaaaagtgcatttagaatatttgagagaaaataagcaaaaggaagaaaatgtaaattatctataatgcttacacccaggacaataatccttggaatagagtgtctcactttgtgtatagaaatgaaacttttaaaatgccattttattttttaattaaaattttttctttccttttttttcctcctcagagttagaaaggataaaaatgttattgattagtaagactgtagctttatgttgatattttgaaattttaggctagtgcttgtttgttcatgtaacatataagcacattcagtactattagaactgttgcattatgcaataacatgactgcctaatgcatatatcaggattagtacatattgtaaagtttttattttttaccaaaatgtttacgactaccaagtattcattccttaacactattacataattaatttagaaatgttttacttttaaaacttctggacaggtgtaattaaatccttagatagcgttaatgtactatttaaaaaacacacacaaaacattatcattggcaaaacatgctttatcatctattcatctttgtgaatccggtttttcttgataccatgccatcaaaacaaaacaaatttgacataagactgcccaatcatccataatttaaagttggtgttcgtcagaagaattttattgttctcattatacatgttatacatttgagcttttttttttttttttttttttggagatggagtctcactctgt

SEQ ID NO: 41983 - DNA, 1102 bp, Homo sapiens
actttggccactatacatgcgtttggcctgtttttgaacttcatataaatgggctcagacagtaaggactctgctgtgtctggcttcttttgcccagcataattttttttttttttttttgcaatttatccaacttggtggtggtatgagttactctttttttcttgctgagttctgttgtatgattatattaccctttgtttattcattttcttattgattgtttctaggttttggctattgtgaattaagctgctatgaacattctcatatatactaatttctcttgtgtatatatctaggagtggatttctgggtcatgggataggtgagtgtttaactttattagaaacaacagaacagtttcccaaagtggttgtactaattaacactccactttggttttaatttgcatttccctgattactaatgaggttgaccagccttttatatgtttttcggccatttggatatcttctctgtgaagagctcattgaagtcttttggctaattttctggttggtttgtataagggataaatgtattgatcccctcccctccctgccccatacctgtgttgcatgtatctattactagctagtggctggcctttcctttttattctcttaaaggtgtctcttcactaacagaattttttttatttttgtttttaattattatggatacataatagccatacatatttatagggtagatgtggtattttgatgcaagcatagaatgcatggttatcaaattagggtagagtaccccatcacctgaatcatttatcatttcttcatgttaggaatattccaattctagtcttttagtcattttgaaatataaaataaatcattgttaactgtagttgccctattgtggtactgaacactagacttactcattctttttaactgtatttttgtgcccagtcaccaatccctctttatttcccacttcccttcctgtcctttactctgtctacatgggttcaattttttttctttaactcccacatatgggtgagaacatgcaatgttcatctttctgtgcctggcttatttctcttaacataatgtcctccagttttatccatatt

SEQ ID NO: 41984 - DNA, 1033 bp, Homo sapiens
tgccaaagtgccatttgaagcctggtttatgacatgtttctccttttgtcatctttgggtgccacccaaaatgcaggctcaaggccgcagcctcttgactctgttcaacagtttccccccttggcttattgtccaacattggcctactcttccaaatccacctctttatcccaggaacaagctgcttctatgccaagggcatggcttcctctttgcagattgtctcatatctctgacctggaaaaaagggggtttttcattctgctagctttttagtgctgctttgagatcattattctagagccctctgcagtaatgttttttctcatggattgaaattcattgtttccagtaggatttttgactagacgtggaaacagaaggacaaattgaaatgactctgaagcttatgggaggactgagtatcattaactggcacagagggagaaaggcaggctctaggtggaaggtatgtgacttgcttttgaaaacagtggtgtgagattctggcctgtgaaaacagctggagttacgagatagaaatggggacttaaaaaatagcttcataccagacgtggtggctcacgcctgtaatcccagcactttgggaggctgagacaggcggatcatcttaggtcaggagtttgagaccagcctgaccaacatggagaaaccccgtctctactaaaaatacaaaaattagccaggcgtggtggtacatgcctgtaatcccagctactcgggaggctgaggcaggagaatcgcttgaactcaggcggcagaggttgcagtgacccaagatcacgccattgcactccagccaggacaacaagagtgaaactgtcacacacacacaaaaatagctttgtgcgtgtgtgcatgtgcacgcacgtgtgtgtgtgtgtgtgtgtgtgtgtgtgtgtgtgtgtgtgtgtgtattgaaaatacagaaaaatagccaggtgtggtggctcatgcctgtaatcccagcattttgggaggctgaggtgggcagatcacaaggtcaggagat

SEQ ID NO: 41985 - DNA, 1061 bp, Homo sapiens
cacattccgtatctcccatattctctgttgtatcatggccatagtatactagatgctcaataaatttgtcaaaaaggccaggcacggtggctcatgcctgtaatcccagcactttgggaggccaaggtgggcggatcacctgaggtcaggagttcgagaccagcctggtgccagtggtctcaactactcgggaggctgaggtgggaggattgcttgagctcaggaggatgaggctgcagtgagctgtagtaccactccactccagcttgggtgacagagcaagacattgtctcaaaaagaaaaaaaaaaggagtatggtgaaatttttagtagtataaagttaggtctaagagttttatttgcaaagattaccatgtgggagtaatctctagacatttttgacttactggcctattttgtaagacccccaaaggtggagaactggatcagggaaacaagcagatcttgaatacacactgcctatttttgagaggaccacaaattcagaatttgaaagaattggagttattcctttccttaattacactttggccctagggacccagaaatgaatgtgagttcctcttctctaggagtccagtttaatgctagacatacatggtaataagcagagtccgtgcaacagaaatcagtggcgtgaaagtaaaggggaagagatccataattcatggttgacttgacgttttccactgaggggccagcatgggttttatgcagaatgaaggacatttgagatttcattttggggccataggaggctataacctgggatgggtaaaaaaattataaagcagtgcttacgctcaggttggggaccttgaacttgtactggtgctaattatgggttttttcctagtagtatttacagcccctatacaagggtggaaagtgaaactagtgtatttactcaaaataggtgacttgaaggaaaatgggatggagcaaagtagtgctttataatcagccccagttttaaggataagactgctagagactcattacttttcacattataatgtgaaattaatcattaaaactta

SEQ ID NO: 41986 - DNA, 1511 bp, Homo sapiens
ttgtgttcttccttagattctcctgtaccttcctgttaccgttctctctcctggttctcccccgcttccagctgttttccatcaccttcatgggtgctttccctcctggttggtcctttgcttaacttgtggtgttccctagtactccatccgtaatcttccctttccctcatattctccctgaacactcttcttcatggctatcatgtttagaaccatacttctaaatctgcatttcagatccatctagaaaccttcaggtttttattttgggctgcttattggatggagttatctgtgtgacttggaggtatgtgaaaagtcaacatgtcaaaactcaactcagtcatctgttcttcctcctgtgttctttgtcccttgaatggcctcactatctattcagtcatcctggaaacccgggagtcagtcattcttcctcaattcagccagttgtcagatcctgtcagtcttacttcttcaatcttcggatccatcttcagtgctctaaactgttacagtctccgagttggtctcactctttccagttctgaccccttcaatctgtgttgtataccaatgccacagtgactgttaacccctcaggcagaattcagcctcttcatttgagtccataggtacttggtgtatttagtacattatattatgtttcagagtatgatgtttttccctgttctttaagcttcttgagggtaggggctgtcattcagtcacaagaaataggtgttggaagcagtaagggctttgaggttctctatatgttaggttggtgcaaaacttcaaagcctttactgcttgtaacacctattgcttattatataggatttgataaaatttgagtaagtgcattttagattccaagataaacataatagatttaatgcacgtgcttatttctatacccttaggaaaccccaaggaaatgagagtaaaggaatacaagaaattgtataaaaccacaggacaaaaagaatgagaaaataggcagagtccaagaacactggcagccaagcgtcttcattccaatctgtaccctagaagtaggaggctggtggaaatgatttttctgagagaaatatttttttctagaaaaaaatatgtacagatattgacctttggggaccactaatgatataattaactctgcttaattattcacctatggtaacatctgtaattattcacctatggtaacatatgttgggtgttgacaaagccacactcaataagaattctattctgcctttaaattttaatgaattattattattattattattattattatttgagacagagtctcactctgttgcccaggctggagtgaagtggcaccatcttggctcactgcaacctccgcctcctgggttcaggcgattctcctgcctctgcctccagggtagctgggactacaggcacccgccaccacgcccagctaatttttgtagttttagtagagacggggtttcaccatattggccaggctggtcttg

SEQ ID NO: 41987 - DNA, 1044 bp, Homo sapiens
agtctgatcatgacgctaaagaaatgtgtctttaaaacattctgagggaaaattgtctttttttttttagtttttatgtttttgtgacagggtctcactctgtcacccaggccggaatggagcgatgtgatccttgttcactgtggcctcgaactgctggactcaagcagtcaacctaccccagctgcccgagtagctggggctacaggtgtgtgccaccacacctagctaatttttttatgttttctagagatggggtctcaccatgttgcccaggctggtctggaattcctgtcctcaagcaatcctgaacctcccaaagttctgcaataacaggcataagccatcacacctagccagaaacttatttttaatgtataattacatacccaaacaatcaatcaattatgatagcagaagaaagatatttttagatgtccagcatctcagaaatttgacctccagtgtgtattttctcaaggaaagaaactattagaggattgtgccaccaagtaaagtaaaccaaggagaaatggaagacaccaaatataagaaatggaagattcagtgtggggaagagattggaagtcttaggacgacagctgcagcaggaccagagagtagccagcctgacatgtcatccagagtgctccaggaaggcaagggctccaagagagatgtcttcagagaaagatgcaaatcatagattccttcacatggttgatcttgtttaaagtattgctcagaaggggttcagaagaccaataatagtgacatagaaaactaagcaaacaaaatataaattcataactccatgaaaagcaatttgtgctcaaaaggaaatatgatgacagctaattatagatatttttgtgatggacagtataacatgtccctggaaaaatttattttctacggaattgagccctaaaaataccagagcaaggaacctatagcttaagagagtcctaaacaacatatcaagtaaaatagaatgagagtggggattaaactatatagtgtctaggaatgctcacttgtcaa

SEQ ID NO: 41988 - DNA, 1020 bp, Homo sapiens
ttttttgagagttttgctctatcatccaggctggggtgcagtggcgtgatctcggctcactataacctctccctctcgggttcaagcgattatctgcctcagcctcccaagtagctgggactataaggcgagtgctaccacgtatttgagtagagatgggatttcaccatgctggccaggctagtcttgaaatcttggcctcaattgctccacctgctttggcctcccaaagtgttggaattacaggcgtgagccactgcgcctagccgtattgctgtttcttcatccggctactgattcacgcatgtgttcagctcatagaaattaactgaacttcatacacctgtactttatgatgtataatgatgctccaataaaaagtatttttaaaaagtaccagaggttatgggacaggaatggagcagaccactcaaaaccaatgtaatcttgggaccagaggatgaaagcaatgatatttctagtaaaactactgacagagtttaaagacttgttggccggatgcagtgactcacacctgtaatcccagcactttgggaggctgagacgagcggatcatgaggtcaggagattgagaccaccctggctaacacggtgaaaccccatctctactaaaaatgccaaaaaaaaaactagcctgacatggtggcgggcacctatagtcccagctacttgggaggctgaggcaggaaaatggcatgaacccgggaggcggagcttgcagtgagccaagaccacgccactgcacaccggcctgggtgacagagcgagactccatctcaaaaaaaaaaaaaaaaaaagacttgttgaatttttttcttttcttttctttttttcttttaatcgagatggagtcgtgctctttcacctaggctggagtgcagtggcgcaatctcggcttgcgtcctgggttcaagcgatttttctgcctcagtctcccaagtagctgggattacaggcgcccgccagcacatctgcataatttttgtatttttagtagag

SEQ ID NO: 41989 - DNA, 1663 bp, Homo sapiens
gtggggtagtggcaggcacctttaatcccagctactcaggaggctaaggcaggagaatcccttgaacctgggaggtagaggttgcagtgagtcgagattgtgccattgcactccagcctgggcaacaatagtgaaactctgtctgaaaaataaataaataaaaataaagataattttaagattattgttttaaagaataaatgttgatattcttaaggtggtaaaagcaagataatggcatatttattagtaacaaaaatttaaacaacaaagaaaaagcaaatgatttccaaaatatcaataacaaatcagtaaataaaggtaatcagaagtttaacttccttgtggctgggcacaatggcttgtgcctgtaatcccagcactttgggaggcttcagtgggcggatcacttgaggtctaaaaactacaaaaaattagccaggtgtggtggaacatgcctgtggtccagctacttgggaggctgaggcaggagaatcacttgaatctagaagatgagaccagcctgggcaacatgatgaaaccctggctctaccaaaaataaaaaaaattagccctgcgtggtggtgggagcctgtaatcccagctactttaggaggctgacacaggagtctcacttgaacccgggaggcagaggttgcagtgagccgagatagcaccactacactctggcctgggtgacagaatgagactctgtctcaaaaaataaaaataaaagaactaaaagtaattctcaagtgatgagtatgtagaggtggagatgaaacaagaaaggcgtaattattgaagctgggtgatgggtacctgggttttttttgtttttttgtatgcgttttgtttttatagtaccctttctctttaccatagcaaaataatacatgggtgtttattacactcttgtgctcactttgtgtatatgcatttgaagttttctataatttttttttttaagaaaaagcaatatttggctggccacagtaactcacacctgtaatcccagcatttgcagaggccaaaataggtggaatgcctgagctcaggagttcgagaccagcctgggcaacatgatgaaacctcatctctaccaaaaatacaaaaattagccaggcacggtggtggatgcctgtggtgccagctattcgggaggctgaggagggaaaattgcttgagactgggaggtggaggttgcaatgagtgcagattgcaccactgcactctaacattattgacagagtgagaccccgtctcaaaaaaaaaaaaaaagcaacattctggcttaccatattagcgagtcaaaagataatatttagggctgggtgcggtggctgatgcctgtaatcctagcactttgggaggccaaggcgtacggatgacctgaggtcaggtgttcaagaccagtctggccaacatggtgaaaccccatctctactgaaaatacaaaaattagctgggcgtggtggcgggtgctagtaatcccaactactcaaaaggctgaggcaggagaatcacttgaatccaagtggtgaaggttgcattgagctgagattgcgctgctacactccagcctgggcgacagagccagactgtctcaaaaagaaaaaaaaaaatagcaatgtaaacatattatttagaaatgtggaagtaa

SEQ ID NO: 41990 - DNA, 1015 bp, Homo sapiens
ctcattatcaactacaaacgactagtttacttgaacgaggcctggaagcggcagctgcaacccaagcaggactgacgcccgacagactccaccctaacagtctcaagcccctttccattcagtttattttgcagcaggtttttattattattattattattattattcacaacagacactttccctaagaatctcaaactgatttttaaaaatccggtaaattagaaggggccctcgctattttctgtgtcagtcttcattttaaatatggatacaaaaaggatacgccgagccaatcaaagacaagctttaactttactttgaagtgtttctgaaatgataaaatgtagccctagccccctgccctcaattgtaaagtgagcaaccattgctagtaattctttaatgtgtataaattcaatttcaggtataacaaatgtgatcatgacatgaaaatattctagaatagatactgtattaaatattgccatgtttacaatatgtaatatgtttttagccgatggatttaaacatgtagattcaactagaatccatttgtgatatttgtaaataaaggtagaaatattagatccatttctgcagaacttactgtacagtttagttggagtgtagcactgaagaactgtcagctcagcgttgactgaggagatagtgaaaatagcctatacacagcatcttgtgaaaagtactggcagccgtggttgcagcaaataatagggcaaaaaaaataataatagggtggtcggttccctttcatctccctcttctgaaaggaaaaaattgaattggaacgttcaagtccagtttgtgttcagtcataaaactgggccagttgttaaccttacagaatgagtcatgtggccagaccttcaagtccaaggccttcagacactaaggatgggaaaatgggtatttttctttggagaaaagctggaaatataaacatggcatttttaggtaaagtttcttccactagttgaattttcatgcagat

SEQ ID NO: 41991 - DNA, 1045 bp, Homo sapiens
cacccaaatgaaattgtgacaggatgtttgtatggttaacatctgatatcagaatgttaaaagtgccttctgtcttaaatctcaaaccaaatattttgtgtgttgaccttgggcagaagaagtgtccttccctcctttcttcaccgtcaggtagaaaacctgcactctgcagaagggtcctgtgtgatcacttaatcctctggttgagaagcagcagtaatgtttttgcttccaacctgattaatcattttatgttgaaaatagtcaatgagaccagtatctcttgagtgctttatttgccttctctttgaagggaggggacgggctctgctctgtaaactcaaatgtgtagagtcagcaacaattccgtagcttccaactgactcagaattgatgcaacgtaggtcttctggcccgaggcaggtatcaagtccaaatcataatgaacttttcaccagtttcaaccagtttcttaaaagagagcttaagtcaagatttcatcaagacttgtgttttcccatgaatgtgaatctttcaatggctgttggagtatgtatgtactgttcttgcattctgaagtagttaaagaactctagaaagtactgattggccatctggtgtctatggagaaagaagtcctcacgtttgagggctgtacagtgaggccatcttgtagcagcgcatccagctctaccaaggcagtcctctggttcttttttctaagctacagtggaaatggcctaatggttaaaactgtggtatacatgacatcggttgtgctaaacaagttcctcgtgtcccaatatccaatggtttttcatcctattttgtatcaatcaacagagtatagttaaagcttgtcttgatgttgcattcttgcaaatgtcttcaactcttacctgagaaaacatggcaaaatggtcagccagacccttccagtttttcctttgcttttctaagcctcggggaaaccactgtttcagttgtataaaaacttttgccacattcctatggcccagtcgaattaataccctttttctcactg

SEQ ID NO: 41992 - DNA, 1028 bp, Homo sapiens
gtaatcccagcgcttttggatcacctgaggtcaggagtttgagaccagccaggcgaacatggtgaaaccccacctttactaaaaatacaaaaattatccaggtgtggtggtgtgcgcctgtaatcccagctactcagaaggctgaggcaggagagtcacttgaacccaggtggcagaggttgcagtgagttgagattacgcaactacactccagccctagtgacaaagcgaaactgtgtctcaaaataattaaaatttaaaaataagaataactaaaagtatagattttgtttgtttgtttgtttgtttttgtttttgagaccaagtctcactctgttgcccaggctggactatagtggcacgatctcggctcactgcaacctctgcccctgggttctaagcaactctccctcctcagctccagagtagctgggattataggcaagcgccaccgtacctggctaatttttttttttttttttttaagtagagatgggggtttcaccatgttggccaggctgatcttgaactcctgacctaaggtgattcacctgcctcggcctcccaaagtgctgggattacaggtatgagccactgcacccatcctagattgcttataacacaaagggtaagtgcttgaagggatggataccccattttctatgatgtgattattacacattgcatgactatcaaaacatctcatgtaatccataaataatacacctactatgtacccacaaaaattaaaaaacaacaacaaaaaaccccacaccactacctcactgatgccataatgtttaaccatgcctttcacttaaagaattccaggaaataagccaggtgtgtggctcgtgcctgtaatcccagcactttgggaggccaaggtgggtggatcacctgtcacctgagctcaggagttcgagaccagcctgggcaacatggcaaaatcccgtctctactaaaaatacaaaaaattagctgagtgtggtggcatgcgtttgtagtcccacctactctggaggctg

SEQ ID NO: 41993 - DNA, 1621 bp, Homo sapiens
aacactcgctcttggaggaaatagcgagtcgatttttaaaaaagagtaaaatacgtttgactttttaaaatgataaaagcattgtcattggccctgtactattcttgccacctttgctctgatggtctcaagcctggacgaatcagtcagctttttctgctcctgggctcccaaggcagactggcaaaaatcatataactaaactgctgggtgctgtttctgcacttctggatcctggagatcctttgacttaacctctagattcctcttatgtcctaaaatctaaatggctgtttatggatctttaccatttttctctgactctttgtcctactcttgccttctcttcattgcttattttgccacttaacttcacagaataaattggtgggcatcagccctgaactcttaaggagaggtcatttttgtctgtgcctgtctgtacctgatttctaatatcctttcctctgatctcagaagaagaggggtcttactttcgaaagctaacgtctttgatctcttcccatattattattttttctgttggatggtatacatcctcaggtttccaccattcagaccaaaacaaagcttttcttgatgcttcccttttctttttttattcttctcagattaacgtggcattccttagggtttcatttttgttcttttctctaatttccttgtgtgattacacttcctttcatggcttcaaatagcacctatatatttatggttttcaaagacgtctatttagtccccgtttctcttgaacctcaggttctaattttcatctgcctactgcatagctgtatgtggatgcttgattacttcaaatgtggttaccttttccttccctttctctccacccatagccccctttaagcacatatacaaacattactattttaagatctttactctagaaaccttaaaatcatcttcttttctcctcacattaagtctagcatagatcctattgttgttgctacctcagatctttttttttcctctcttcataacatcttttttttttctctctcttcattgccagaagactggttcagaccttggttatgctttttctgaacctctgggtcctgtagtctacttaatcctccacgttgctgctggaattggttccatttctgaactatcaatctgatcatgctgcttgttttctttaaaaattctcatcagctcccaaacccttagcatgttgagccagtccttccaagccttctgtagcatgggcgcatccccttcctgggccctttgtgatccagagaaaaaagcagtaaagaaacagaccattcactaccgtaaaatcaagactgtgacagagatgactacagggtgctctgggagcatcaccctggtgagagtgaggacaagtttctgtctacaggcacctaggactttttctgactacccctcctccttagtttgggttaggtgacttttctttgtgtttccacagcaccctgtacatacttccatctccatttttaccacttataccatttttagttttttttttgtgacacagtcttggtctgttgcccaggctggagtgcagtggtaacatcttagttcgctgcaacctctgcctccagggttt

SEQ ID NO: 41994 - DNA, 1031 bp, Homo sapiens
tctgtttggaagcctgcagaatttttcgtgcttggaattgccaagatgtgtccagattgggtctgttaccatttgttttgctctatggatgtatagatccttacatctatagtgtctgtttacattcagggaagttttgtttgtttgtttgtttgtttgttttttggagacggagtctcgttctgtctcccaggtcggagtgcggtggcaggatctcagctcactgcaagctccacctcccgggttcatgccattctcctgcctcagcctccccagtagctgggactacaggtgcccgccaacacgcctggctaattttttgtatttttagtagagatggggtttcaccgtagcaaggatggtctcgatctcctgacctcatgatctgcccaccttggcctcccaaagtgctaggattacaggtgtgagcctccgcgcccagccggaagctttctttttttgaatctgtaatatggttttactttctttaaccaaaatgttattgtataataggatcgactcttctctgttttctacattattctcttttcttgccattgtttccttttctttctacctggctccttttgaattgaacattaggatatcatcttaagtgtgtcttttaacataatggatgcaatgttctgcatagatttttttttttttttttttgagacagagtcttgctctgtcgcccagactggagtacaatggcgcgaactcggctcgctgcaagctccgcctcccgggttcacgtcacgccattctcctgcatagacattttaatgctatattgccaccaattatcttaatacttttttctttgcagttttttcttattaagctgatattttaatctcaacctagtctttgtgattctttgttgaagctttatatagtgcctggcacaaaactatgtgctcaaacatatattgaatgaatgattaaaagagtatacacatgaataaataagaaccagttcttagttggtgtattctactgagactgtcaaagtacttctctagtaa

SEQ ID NO: 41995 - DNA, 1052 bp, Homo sapiens
tttctaaattaactgatacctgtcttaggttttggaagttcacatactatatataaattacacttcaataaagcttttttaaaaacaagtgtgcacacactttataattgttttcatttttaagcatggctttctaggagttgccttcctgtctgcatagcttagtgatcagtggtcacccagtgcttggacagtggttgcctcagacatcttgagccagtaaggcatttgtcctctgccagtagatctctgtgggtagggagcacatacaaagtttaggctttttcagatctgctgtcttttactttccacccagtcctttcatgtctcctctgtgcctgcatgccacttctgggttggccaacaaatgtgccccacccagactgcaacctccaccttctagagctgttcaccctctcactcgcctcccacctgctccatcacttactctgacagtgcaggtggtcatgtgcgttcttccccactccaaactcagtgaactgtcagtcctaatggtttgccttgccctgctctgccttgcagaacctctgtacctactgaatgagtagatgaggtgggagtaaccttacacagaccctcattgttcttacccaccttttagcagtttttcaagcataaatgcttctcaggttgttgtattcttctggtggatttccagagcactgaaagggttgttttgcccatttcacccagctttatcattggtttttggggagaggaattaactaccttctcactaggctgtagctggaagtcttccctctcagaatgtattttttagtgtagttagtcatttccccaggtatatttactgtatccttagggttctccagaaaaacaaaaccaaacccctgtgttagggttttacagaaaaacaaccagtagtcagggtaaggcaaaccattaggactggctgctttgctagtgggttggaagggatctcactgaatttagagtggtgggtaacgcgcatgcccactctgtatatggggaggggtcgggggtagggagagaaagagactgattttaag

SEQ ID NO: 41996 - DNA, 1029 bp, Homo sapiens
tttcctagagcccctgttgttgagtcgcgaggacctattaggcacacccttaatttctttaaagagccctttgtatgacagaattactgggaaccattttccaagtagcccaccacaaaggttgtattttgtcaaattgaaggagtcatctgactttccttaatcataagctacaaatataataagctacattaatagattttctaatatttatttaactttgaatttctggaaaaaacccaacttggtaatgatttatcatctgagctttgtttttggctttggtatgctaatttttggcttaggatttttatatctatttcatgagtgacactgacctgtaattttcccttttcttactctctatgtctgtttttttttaatatagttatgcttcccttacaaattacttttgattgtcttttccctcaattttggatcacattttcctgatgctctcatttgagtaattttggagttatattttgtgtttctaagtcctgttaaaatccttggaagaatgctgattttatttttgttttggtagactgtcaggctggttaggttctaaaccacaagttttctcacctgtgaatagtatttccagtatcagttcaaagactgtgctatgctactttgggtctttcctatccacagaccatttattagttagtttggagctttggcaacagtttatattttaatttattctcagagcctttgctgtgcttccctgaatctctcttatgtgtgagctagaagttgtgctggttcatgtgcaaaattacgggaaaccctttctctggctcatcttttcctggattccccacatctctctggctcacagaggctcctttcattgttattctagtcagacgtttggatttctttcagagctttagctgcctgcgatgcgtttctgtatggctggtgccacccttagggtgaagagctcagaaaaagtgttaaaaataatgagaatgattcttacgctccttagaccactgtggtctttcccaattatttttg

SEQ ID NO: 41997 - DNA, 1163 bp, Homo sapiens
agtgtaaaattttacccttccataagagcgacagaagaactggcaacacctgtcagaatcaactttttcagaactctagaaattaaccaaagacttgaaaaaaagtgtgaagagtgctcattcacaaaaaatggctgaatcttagtaagaatagtgagcttacccaagccccattccctgttccatgtgtcagctggggctgaaataacagcctgtgtttctgtactggagggagcagaacagacctcattgtaagtatttgttttgccttcttaggtggatccctggatgaatgacttcaaaaccttgtctctatttctcctgactcagaactgccctacttctgagatcggggaggacagtagttatcaagaaacatttacagacaaataatttagtcattgcttcctgaatcaagaaataacaatgggggcaaacagtagactaactaaagagcctaggagcagagattgggaatgagatgtctatgagagctttgaaaagcttcacatattcccaagaatgtagaaggccacatgcttggcaaggactgtatgcatgcccagggaagacttctacctctcgctgatcttgaggctctgtgaaagcaggaagtgaagcctaaggcagagttagaagctacctggctaagtagtgaaggtgtatcccaaacctacccagagcccttctgcaaagacagacaggttttttggttccaagcatttaaggcagtctgttcagttgttagctggccattaagctaacagaatagagactccagtgactgcacataacaaggaatacagattttacagaattagttttgataagtcttgaaacaaacaactacaacaataagcagcaacaaaaaattctggagaggggagagaatctgattcccagagttgccacattataagatttaaaatgtctagtgtttaacaaaaaagtgtaagatatgaaacacaacaagaaaaaaagccatgaatagaaattgtccctgaggaagcccagacgttagaatttctagacaaacactttatattagctatttaaaataattcttcaagagctaaagaaaaccatatcttaaacaaaacaaaacaaaacaaaaaacccaaaaacctaactgaaagtttgagaacagtgtctcaccaattgag

SEQ ID NO: 41998 - DNA, 1026 bp, Homo sapiens
tagaacacattttcacaaagttgaatttctattgtatatacattttaaaatcttctttcacaagacatgacctgagcattttctaatagtgaaagtctttgaaaacatggtttttaatggtatttcattacatgttttactgtaataaacctaaccacttggattatgtactctttcactcattcctttttgcatatctgttccatcccctatgctttaatatggaggatttggtttcttgtagtagttgctgggtatcataattcagacctgtggtttggcagtcagcctggctgtagtgtttaactgagtctcgtggaagatccatgcttaaaatgaatgtcgtggagaattgtattcacctcagtcattcaagactttggcatagaccccattccttgaggaggagttgccgccactgtgactgccacagacggaaggaagcctgggcagttgggactggggagaacttgctgagtcacagatatcttgtctcagtgtgcatgggccgtgtgtattgaaatgtaccagtctgtgaggcactatgttttgaggtctcagtaagctaaaggggtgtagaatggtatctagttcataccgtagtatgctttagatctaagtgttggttaattctgtaaggactgaaggaataggggagatttaatgagctccttgcagtctgcaggttattatcgagaaaagaaaattaggctctcagttccaggcccatttccctctaatcactgtgtccttttgaacaaaagttggcaaactttttctgtaaagggccagatatttttagctttgcaggccatatgatttctgttgtaagcattgagctcttctgttatagagcaaaagcagccataggcagtacaggaacaaatggccatggttatgttctagtaaaactttatttacataacaggcagcaggccagattggagcaatagttgtcaactcctgctttgaaaatgttttggaaactgtgtctccgtctgttagtggtcattatcctcagtctct

SEQ ID NO: 41999 - DNA, 1053 bp, Homo sapiens
caaacagccagttggtgtagcagtcagaacatacacaacattgattaagttaattatgttatatgggcttaggatcgtggcaccccaaaacaattacatggtaacatcaaagatctctgatcgcacatcaccgtaacagatacaataatgaagaagcttcaaatattgcaagaattaccacagtgtcataaagagacatgaagggagtgcatgttgttggaaaaatgtcaccaacagacttgctcaccacaggattaccacacaccttcaatttgtaaaaaacacaacatctgcaaagcacaatgaaatgaggtatgcctgtactcatttgcttcttcacatgtcttagaagttttaactgcatactggaccttttgtataacagaggggtagagaatgaactaggtaatactttttgttttatttttgttaaagagagcagttctttcctccagcaggtagctaaggtgatcactcaaatttgacagtgaatcaagctgagctggggctgagcagtagctttaattgatttcagtttgcctctggattcaaatgagattaaggaaatttgacttttagcccaaccttagctttctatatcatttagacgaggggttcatttctttgattttagcaagattgcagctgggaggcagttgggttgaagattaaattaatttactttacctctggattgcaactatagcagggccctggaacccaagcaccacacagcattgggagatctctttctgtctctcactgtgctcccaccagcacttactaagattctcttgtagtattacatgtaattgtcaggtcaagagatttgtttttacacttgggactctttcagattctaattaatcataccagtccacagtctcactaaaagtttggcttgtttcagcaaaatctttccacctatgggagacctccttttctgcccacttgtacccagacaggcaattgattcaaggtagctagaaacaggcttttgtttctctgtgaagaactcatccttctccagaaattggctcagttagacttctt

SEQ ID NO: 42000 - DNA, 1031 bp, Homo sapiens
ggaagagaagggattacttcccaactcattctacaagggcaacattaccctgataccaaaaccagacaggatgcaacaagaaaatgacaggccaacatccctgatgaacacagatgcaaaaatcctcaacaaaatactaacaaaccaagtgcaacaatacattaaaaagatcatcctgggatacgaagaggggaagaacagacttacttgagggtggggggttggaggaaggagaggatcagaaaaaatacctattcggtactatgcttattacctgagtgatgaaataatctgtacaccaagcctctgtgacacacagtttacccacataacaaaccagcacatgtacccctcaacctaaaaaaaaaaaaaaaaaaaatcatcatgataaagtggaaatccgagggatgcaaggatgattcagcatacccaaatcaataaacatagtacattacattaatacaatcaagaccaaaaaccatatgatgatttcaatagatgctcaaaaagcattcagtagaattcagcatcccttcttgataaaaattctcaacaaacggtatagaaggaacatacttcggtgaggtgtagtggctcatgcctgtaatcccagcaatttgggaggctgaggtgagtggatcccttgaagtcaggagtttgagaccagcctggcccacatggtgaaaccccatctctactaaaaatacaaagcctgggtgatagagcgagactttatctcaaaaaagaaaaaaaaaagaaggaacatatctcaaaccatatatgacaaacccacagctaacgtcatgttcaacagtgaaaagctgaataatgaataatttttctctaagattaggaacagacaaggatgcccactctaaccacttctgttcaacttagtacttgaggtcctagcccaagcaattaggcaagagaaagaaataaagggtacccaaattggaaaggaagaaaccacattatctttatttgcagataacatgatcctgtatttagaaaaacctgaagactcctcc

SEQ ID NO: 42001 - DNA, 1086 bp, Homo sapiens
tccctgatatacggtgcctttctcctcccttgtttcattctcttcactttcttcttccagatgctcgtacacccagtccccctacctgggaaatcacaacctcattaagagctcagctatcttaagtcctatttcctcatgaagtctaactcaactgctgcaacttccgagtagcaattaaatcagctccagcataacctcttttttcccttgtctcctgtgttagtattatgtcactaactttgtggggacaaggtcatataacactctagagcatatcagaatgacagaacatcttcagctataacctacctagataccaatatttgcccccaaggcaatgtttgatttttattccccattatgagaaacaaactcacccctccaaacccaaagaatggactcagagacctggagaacagcgaaagtgagacttttaatgatgctcttgtaatattgggtgtctggcagcaggcacacccagcacagtttcaacaagcaatttatcccctagtgcacaggtgcctcccccagttcctcatgggctgtgtattatggggtcacaatcttcccggacattgcctattggtcgttgggtaggggcttcgggtgttttctttagggttgtcctgctgcgttttgttgcagcccacaatgcattgcaatcctagttagctcaggggctcttcaggtatttgacttatgacttaagtagctggggcaggctgataagaacaggcaacacgagctattttgcagctagtaaactttcatcttagactaaacttctttggttcaggtgagggtaactaagggggttgggggggggtgacaagcaggcattggctgtccaagcaggagcctactgtatcctgttttcttctgtagtctactgacctaagttgatttaaggcactttgtcttggaaatggaccactgtatacatttccttcacccagctaagttttaaattttttttgtagaggtggggtctcactctgttgcccaagctgctcttgaactcttggcctcaagtggtcctcctgcctcagcctcccagagtgcttggattacaggcatgagcca

SEQ ID NO: 42002 - DNA, 1058 bp, Homo sapiens
gtgttgggcctgtagacggaaccaggaggaggagcttgacctgcagaggccatcatgaggcagaggcttggcctctataggccaacgggagacaggaattgggccaggagtggctcacttgaagataatattggagaaagtgacagagcatcaggcattagattctcatagggacagcgcaacgtagatccctcacatgcatggttcacaatggggtgcatgctcctatgagaatctaatgctgctgctgatctgagagaaggcagagctcaggcaggaatgtgagcaatggggagtggctgtaaacacagatgaagcttccctcattcaacaccattcacctccggctgtgtggctccttacagttccatggctctggcgttggggaccctgcccaagtacatccagaaggacccttccacaccagtcttcatagtggtcaagtgcagcagccacttagctcccaaggcatatgccacagctggcatttcatcacaatcaacactaagtggtagcttgagtcattgtgaggtcacttcctggaaatcaacagcatcccatttcccattgcaaggagctcagcacggcccctaagataaccaaactgatccccaaatcccatctgtgtgggtctgtctcctgggacccttcccagcatcaactctgtattagtcagggtccaatcaggagacataaaccactcaaaagcccaaagtgctaaaatttaatatagataattattcattataacaggggaacagcatgagagattggctagcacaaagtaaagagaattctagagaatataggactagccaaagtaaggcatggtggctcatgccagtaatttaagaagccaatgcaggaggattgcttgaggccaggaggtagagaccagcctgggcaacaccctgtctctatccaaaaaaagaaaaaaattagctgcgtgtggtggtgcatactcataatcccagctactcgggaagctgaagtaggagggtagtttgagcctgtgaggtcaaggctacagtgagtcatgattatggcactatagtcaa

SEQ ID NO: 42003 - DNA, 1083 bp, Homo sapiens
ggctaatttttgtatttttagtagagacggggttttaccatgttgcccgggctactcttgaactcctggcctcaagtgatccacccacctcagcctcccaaagtgctgggattacaggtatgagccaccgggcccagccgacatcccctgccttgatacggatattcacagcttcctgcttgaggaaatggtaatggaccaagaacacagtccccctgttccttggagagttcagagattgaaaacaatctcaaacaccaaacacgacttaccaaaagctgccttgagggagatggataggtgaggtcaccacattccttgtctttctgacaccacagagcagcttccactctaaggaagcagaaacatgagctgttgctttctcttaaggtttgaaactcagatgccttattttcccccaatatgttcttccatcagtaggtagtaagcataaagcaaaacaaaataagcaactacctgatcctcttttgaatggcaagatctttcatctcatcatcagtagtttctggacagaacacatatttatagagatgagtcatgatgtacttttcaatctgatccatttatcttctcaactcattctggaggcactgaaatagccaaacagaaaagctcaagagagtatatatactccttgtactgatagtaagtaagccactccttgtactggcagtaagcataaaagtactcacagattatattaatccttcaggagagtaaaacccatccattaacattatttccagtatccactgttgcaggatttttccttagttcagctaaggacggggtccttgtccgtctcaaggccacaaaaatttaggcttacagacggtttgaatggtgagtaaggcagggttttattgggactctcacaaggccagagtccctgctagagtgctttctgccagcagctagaataatgggttttacacagtaagaagaggtgccaggctcctccccgctatcaacggtgcaaacttcaagttccaccccagtgcacaggccagctggagtttttctggggaccccttcctacctagtggtgtctcaccatgacca

SEQ ID NO: 42004 - DNA, 1038 bp, Homo sapiens
ctgcgctccagcctgggcaacagagtgagactccatctcaaaaaaaaaaaaagaaaaaagaaaaaaaagaaaacactgcccaactggctggccgcagtggctcaggcgggtaatcccagcactttgggaggccaaggcaggtggatcacttgagttcaagagttcaagaccagcctggggaacgtagtgaaaccccacctctacctaaaatacaaaaatcagctggttgtggtgttaccctcctgtggttccagctacttgggaggctgaggtgggaggatcactggaaccaggaagttgaggctgcagtgagccgagattgcaccactgcataccagcctgcacgacagagtgagactccatctcaaaaaaaataaataaataaaaataaaaaataaaagaaagatctcaaatcagtcacctaactatacactttaaaggacctacaaaaagaagaactaaacccaagctagcagaataggggaaacaaagattagagtggaaataaataaagaaaaggaaaagaagagaatagataaaattaaaagtttttttacaggtcagcaaaattgacaaatttttagctagattgactaagaaaaaaaaaaagaagactcaaatatccaaaatcagaaatgaaaatgagggcattaagctgggcacagtggctcacgcctgtaatcccagcactttgggaggccaaggccggcggatcacgaggtcaggagatcgagaccatcctggctaacacggtgaaaccccatctctactaaaaatagaaaaaaatcagccgggtgtggtggcgggcgcctgtagtcctagctactcaggaggctgaggcaggagaatggtgtaaacccgtgaggctgagcttgcagtcagccaagattgtgccactacactccagcctgggtgacaaagcgagactccatctcaaaaaaaaaaaaaagaaagaaaaaagaaaatgagcacattactgtgattttacagcaattaaagtgattataagataataccacaaacataggtacaccagca

SEQ ID NO: 42005 - DNA, 1046 bp, Homo sapiens
ctttgggaggccgaggcgggcggatcacaaggtcaggagatcgagaccatcctggctaacatggtgaaaccctgtctctactaaaaatacaaaaaattagctgggcttggtggcgggtgcctgtagtcccagctactcgggaggctgaggcaggagaatggcgtgaacccgggagggggagaatgcagtgagctgagatcacgccactgcactccagcctgggtgacaaagcaagactccgtctcaaaaaaaaaaaaaaaaaaagaaatctacaaaggaatgccgggtttggtggctcaagcactttgggaggctgaagctggtggattgtttgagtccaggagtttgagaccagcctggcaacatggcaaaaccttgtctctatgaaaaatacaaaaattagccaggcgtggtggcgtgcacctgtagtcccagctacttggggggctgaggcaagacatctcttgaacctgggaggttgaagctgtagtgagccaagattgtgacactgcactccagtctgggtgacaaagaccctgtctcgaaaaaaaaaagaaacctacaaaggaaaatccatgctactaagcaagttcataaaatttagtctcaacatctaatagcccacagaaaaaggtatggcccttgcattctccatctacccatgagatgccttcttcctcaaggcaattctctttcccctgcccctcccatcctgctggtatttttagaccaaaatatttggggagaagagaaaaggtaatccagtaggccgggcgcggtggctcacgcctgtaattccagcactttgggaggccgaggtgggcggatcacgaggtcaggagattgagaccatcctggctaacacggtgaaaccctgtttctactaaaaatacaaaaaattagccgggcgtggtggcaggcgcctgtagtcccagctactctggaggctgaggcaggagaatggcgagaacccaggaagcggagcttgcagtgagccgagatggcgccactgcactctagcctgggtgacagagtgagagtccgtc

SEQ ID NO: 42006 - DNA, 1052 bp, Homo sapiens
gcaatgtcgtgatctcggctcactgcaacctgtttcctgggttcaagtgattctcctgcctcaacctcccaagtagctgggattacaggcatgtgccaccacgcccagctaattttgtatttttagtagagacagggtttctctctgttggttctgctggtctctaactactgacctcaggtgatccgcccgcctctgcctcccaaagtgctgggattacaggcgtgagccaccgcacccagccatacttttgttttatactctgttgtaccctcagcctagcacacattaggcacctaggaagaatttgagaaacgaatcaattaatctccactttaccaataatgagcaagaacagaaattagggccgggcgcggtggctcacgcctgtaatcccagcattttgggagaccaaggcaggtggatgatttgaggtcaggagtactagactagactggccaatatgatgaaaccctgtctctagtaaaaatacaaaaattagccgggtgcggaggctcacacctgtaatcctagcactttggaaggccaaggcgggcggatcacttgaggtcacgattccaaaccagcctggccaacatggtgaaaccccgtctcgactaaaaatacgaaaaaattagctgggcatggtggcgggcgcctataattccggctactcgagaggctgaggtgggagaatcgcttgaacctaggaggcggagtttgcagtgagccgagatcacaccactgcactccactctgggtgacagagcgcgactgtctcaaaaaagaaaaaaagaagactgaaaaattgggcaacctgtccaagaacaccacagcgacaattagcaaagctgggattccaacccaggtctatctaagagccacagcattgtattttcttttctttctttctgtgactgcacctttcaccatagatggcatccaggactcagagcaatcagcatgtagctactgtttttaatattccttacatgggaatcacataaagaaagtaaacagtatccaatttgtgactcaaccattcatacttt

SEQ ID NO: 42007 - DNA, 1030 bp, Homo sapiens
ctggagtgcagtggcgagatctcggctcaccgtaacctccgcctctggggctcaagcgattctcctgcctcatccaccagagtagttgggattacaagaacgttccactacgtttggttaattttttgtatttttagtagagacggggtttcaccatgttggccaggctggtctcgaactcctggcctcaagtgatccacccatctgggcctcccacagtgctgggattacaggcgtgagccactgcacccagccttgttcggtaaattcttgctctccctctgctccaagcctgcagagagagcagaaggatcaggcacatccttgctctcaaagaggtcccaatgcagcgggggacaccgtggggcagcggtggcatctggcatggtaagtaaagggtgccacgggaatgggaaagatcctggggagcttcaccaaggaggagtcttttgacttggcaaggtggtttgtggaatagtgaaggaaggttcattacaggcagcagtgatggtcgggagaagatggagcgaggatcagtgaggcaccgttaggagtgatgaacccggggagttggacggaacataaggtctggctggaaaggtgggaaaggaccaggccacagagggcccggcggggcctggagggcagtgggaagccagcaaagggcattgagctaaagaggggcacggtcaggtttgcatgagaaggagttcatgcaagcctttggctccctatggagaaccagctggaggggcagggcccaggagctagtgacgtggatgtcacgataccccggccaaatagtgtgagtttagggtgaagccagtggcagtagggagagaatgaagtcggaatctcgtggattggccttggtctaccaatgggacagagggtggaggggagggggagggcggagcctccgatgatgccagcatcactctctgggtgctttggtaggcgtcagggcccttctctcaatgaggggaacaacggggctgggggatcagttagccctggacttaggggtgtg

SEQ ID NO: 42008 - DNA, 1050 bp, Homo sapiens
gaggcaggaagagagaccgtcatgggcaggggctttgacgcaagaggttccacagtggcttggcccacatgtcagggaggaggagcgaccattcagtgacaagagttgctgcagcccctgtctgtccatccatctggggaggactggggacaaaagccaggctggagagagttttggagagagtgggtcgtgagaaagtgagggattagaagtgtagatgactggctgggcacggtggctcacgcctataatcccagcactttgtagacaactggccaggcgcagtggctcacatctgtaatcctagcactttgggaggctgaggcaggaggatcacctgaggtcaggagtttgagaccagcctgggcaacatggtgaaaccctgtctttactaaaaatacaaaaattacaggggtgtggtagcgaacgcctgtaatttcagctactcaggaggctgacgcaggagtatcacttacatctgggagtcggaggttgcagtgagctgagatcgcaccaccgtacttcagcgtgggtaacaaagcgagactgtctcaaaaaaaaaaaaataaagtgtagatgactctttgaagcaccttggctggggagagacagagctgggtggggctggacgtgggccttacaagggactttaaaatatatatatatttttttcttgagtcagggtctcactgttgcccaggttggagtgcagtggcacaatcatagctcattgcagcctcaaactcctgggctcaagctatcctctcgcttctggcccccaagtagctgggattacaagtgcctaacaccatgcctggctaatttttatatttttgtagagactgggttttaccatgttgcccaggctagtctcaaactctaatctcaagcaatctgcctgcttcagcctcccaaagtgctgggattacaggtgtgagtcatccagtgtggccaagggacttttaaaactttttaaatgagagaaagtggaccgtggggctgggcgtggtggctcacgcctgtaatcctagcactttgagaggccaaggg

SEQ ID NO: 42009 - DNA, 1043 bp, Homo sapiens
tagactcagagctattgttattgtttctgtctaatacatagtgagcttttattgtatgccaagtaatccacagagcactcctttatgtttttctagctcttaaagagcatctgtacaagtcttttggcatagataataggctctactggaaccagcttaagaaaaaacgacaaaagtagttaggggaccagggtgtatgactcagaatctgaggatgggcgtgcacgtaaaccttagccagggattggaactgggagattgaaatcattcaggacgtacaggaccttctacttttctctgcttcttggggtatgtctatttcattctgtagactgtcctgatactcagaccacttgatagaaggatcatgtcacacagctccatcattcaagagaacagccccgacttagtcccatttccaaaactcgaagcaaaagactctaacacagttggaggcaatcagctgtgatcctgaattgggggaccattcaccttatacaaatatagctgctgccagcttatctttgtggattgagaggacagtttcctgataacatgggaggttatgtgctaggcagacttcccaaactatgttcattttagtaacattgagtagtactatcatacttatagtacaaaatttaaaaaaacttaattgatctatacttaaaaataggtatcttccttttgcccatttctcttggaagggaagaaaagggacatcaggatgataatggcaagattagctcagactttcaaaataatttgaaacccaggacttggcatactaagtataggcttacttgagctcaggagttcaagaccacctgggtaacgtggcgaaacaccgcctctacaaaaaaataacaacaattagccaggcatggtggctgagtggtggagtattgcttgagctcgggaagtcaaggctgcagtgagctgtgatcacgccactgcactctagcctgaatgacagaccctgtcttccaaaaaaaaaaaaaaaggaagcttagtgcttagtgatgtctctgccacttactacc

SEQ ID NO: 42010 - DNA, 1072 bp, Homo sapiens
ctgaggcaggagaatcatttgaatctaggaggaggaggttgcagtgagccgaaatcgtgccattgcactccagcctgggtgacagagcaagaccctgtctaaaaaaaggaaagaaaagaaaaaagattgattacatgattaatttgaagttgtttcttggttggctgccagttgtagcaattttatctctacgaaaaaggggggaaaaattagtacctgccagagattaaataagaatgtattgggctcatgatttatttattaggaggtggaatagccaggtagtaaggtgactttggagtcactcctggtttgagccctagctttgtatttaccagctttgtgaccttggacagactaacctctccgagtcctgtccacactgagggacaataatacctaccagaggcacgtgatgaggattcagtgagttaatgcatgtaaagagcttagcacagtgcctgacacacacagtagatctccagtaagtgttagctgttttaaaatgcaagttattcttctgatagaattatcttgcagggagcacaagggcatttgctatgaagaatactcattcctatttagcttaaggtctgtttcttgatgatatgtagtgaaatgataagtatttatgataacagatgaaatagtaaaacaagtataaaattatcagctccaatagcctcattttgcagaggacagtgtgaaagtccataaaggttaactaatttacccaaggttgcacaatgagtttgtgcatgagaactcatgtctcctaattcctgggtcaatatttttccattatattcctttatccaatgtgtatacttcagaagcccaggttatttaatatatatcataaataatatatatatatgaaattaagtttctgttacttaagtacataattgtcatttatatttgctaactctccttggtggttttaaaaacctgtgtcccaaaagcctctgtacagtgtgcattatactattgaaagaaaatttacaattcaatgcagagtctgtactttaaaaagaaacatttctggagctgggtgcagtggcttctacct

SEQ ID NO: 42011 - DNA, 1221 bp, Homo sapiens
agtggcccagatcaatactattgtttttttttcttgcaagcttttctgctaggctatggcgtaggtcatgactactctgccccccgcaccttttgctcggggaaccccataagaggttgaaggtggaggccttctaaaagcctgaatatggacctgggacttgtgtttttcctgactcttactagaaagttcaagatcagctggtttacatttagagtgttctatgagagttttgtccaagccaccgtagcctttacggcctgttgctaatagggaagtccccagccttcctggcctctttcacccaagtagggcatggttcactgggcgacagctggtagcgagtgtttgtgtgacccatcagtggtgaaagtagaggtgggtggcccaagggatcaggaaagcatagctgtgttccatgaatagtgggactcgataggagaggctgcccgttaagttacacagtgtgggtcacgttcttctagggcaggaggctcatgttctgggctgacaagtaacaaatacgaggtctgttgaagagaactgcataaaattttgaaagtcatcaagtcctctgccctgaggtcgaacactctttaggacttctgaaaggaagagtgtgccaccccaggaaggggatcagagagtccatcatcagctcctcttagctccaagagtttaggacaaggagagtgtcagggcctgtggctgatggtggaagtttccctttctttctgttttgtttaatttttaatttttatgtgtacataataggtgtatttatttatgagttccgtgagctattttgatccaggcggataatgagtggtaattaccttaggggaaatggggtccatcctctgaagcatttagcttttgtattacagagaatcctgttatattctcttaattactttttaatgtacaattaaattacttttgactatagttcccctgtcgtgctagcaaatactaggtcttattcattctttctaacttttctggtaccccttggccatccccactatcccccatgccctgcattacccttcccagcctctggtaaccatccttctggtaaaacatccttcagttttaagtgtttagctcccaccaatgagtgagaacatgtgatggttatctttctgtgcctggcttatttcacttaacataatatcctcctgtttcatccatgttgttgcaaatgactggatcccattc

SEQ ID NO: 42012 - DNA, 1055 bp, Homo sapiens
acggtacagtgcctggagctgggctgttttgtcttcagagtggtgcctggtaaccgcgacttccccgccatgttctgtgtgttgctggctggagaagggtggttgacaaactctgacccagcacggtgtttctgtgggtcaaaactagaaaactatatccgggcgccgaggtgaaaggatcccttcaggccaggagttaaagagcagcctaggcaacgtggcgcgaccccatctctgtagtcccacctcagcttcccagatacttgaaccccaaagttcaaggctgcagtgagctatgatcccatcacagcactccagcctgcgagactgaggtaaaccctgtctaaaaaagtaaaaaaactatccaagtgtgcaacagggagggactgcttaaagaaaacagaattgtatgttcaaatacttttaacaagtgcaaaatgtataggctgaaataaatagagctggccgagcgcgtttgctcacgcctgtaatgccaacattttcggtgccctaggcaggccatcacttgaagtcaggaactcgaggccagcctggccaacatggtgaaaccccatgtctactaaaaatataaaaattaggccgggcaccttgcatcgtttcagggggctgacacctccctaagggcccggtaattgaatccctcggatttgagagtgagaaaccttggctcagttcttcccagggggatcagcccaggggtaagcgaggagaggccagaaagcaggacccatgagaaggaccccctcctggagtttgaggcccattccttcctgcccctgcgtctcctctttccaggactcctccctgctctgccgcactcctggggccatggccatggggggctgcatttgggtacaggccccagcggcaaccctgggcccaaaatgggcgggctcacctggaggggatcagagtaacatggcaagaagcaggaaaagccgcgctggaaccgcacctctctgccccctgatgtcagtgggtgcactcttccctcacctcactcaggcagcggcatgagttccatgggagcactg

SEQ ID NO: 42013 - DNA, 1066 bp, Homo sapiens
ggctcagcctcccaagtagctggcatcacaggcacctgccaaaaggtctgcgtaatttttgcatttgtagtagagttggggtttcaccatgttggccaggctggtctcaaactcctgaccttaggtgagcctcccaccttggcctcccaaagtgttgggattacaggcatgagccactgcgcctggtcatatgtttttttataatgttgttttattttaggaaagtaaatacaatgagtaggactcagctccatcagctccacaattctcttactgttttttttttgtttgttttttttttgagattgagttttgctcttgttgcctaggctggagtacaatgctgtgatctcagctcactgcagcctctgcctcctgggttcaagcagttctcctgcctcagcctcctgagtagctgggattacaggtgcctgccaccttgcctggctacgtttttatttttagtagagacgtggattcaccatgtttgctagtctggtctcgaactcctgacctcagttgattcacctttcttggcctcccaaagtgctgggattacaggtgtgagtcactgcacttatctgtaatgggatatttcactgcagactttgatgaacagaacattagcatttttggtggtgtttttattttactcataatatttttctttggactcaattacagtaacagaagtaaagatcaaattataaaaattaaagagcaatacagattcaataattattcttttctacatattgtgtttaaatgatacgcttttttctttttgtctttatagctcaagctgtaaaagccaaaggtccaccccttttttccagtctcaagctgaagatctttatgtagaaggccttccccacaggaattttttttttttttttttttttgtgacagagtttttactcttgtcgcctaggctggagtgcaatggcatgatctaggctgcagtacaatgctgtgatctcagctcactgcagcctctgcctcctgggttcaagcgattctcttgcctcagtctcctgagtacctgggattacaggcgcccgccact

SEQ ID NO: 42014 - DNA, 1052 bp, Homo sapiens
tggcgtaggcccctgggggcacggcctctgccccacagtggcccctccgggcccagctcgtgcctcggcttggccgcctcaggcccagctcctgcctgtgggcggcctctctccagacccggctctcgcctcccggcatcctctccaggcccagagctgtttccagttgctagaccatttttgtgcctgcctcgttgcagcatctccaagcccagcttttgcttttctgcagtttcttgaggccgaactccatttttcgaatggcttatttaggcccagctcttgcgtttgcattgtcccttcaggcccagaactttctcacgtcatcgtcaccaggcctagcttctgcatctggtcagccttttaaggcccagcttttgcctcataaactcagctcctgtttaatggcggcctcccaggtcccaccttctgccttcctgtgtccactccaggcccagctactgccttggtgctctttttaagtcaataattttttccagtcgacctctccaggcccaacttgtacctctgagtgtcctctaggatctcagcttctgcctaacaatgacctctttagactcagctcattttcactgctacatcttcaagccattctcctgcctcttggcaacctctagtggcccagcttctgcctcacagcagcctctccatgcatgcctagctcctgcctctttagggaacttacaggcctaaaactttcttaatttgggcttctcaggcccagctcctgccttctgttggcctctacaggcctggcatcatcctttcaacagcctctttaggcccggcctctccaggaccaaaacatccttaagtcaacctcaccaggcccggctcctgtctccttgcggcctccagaggccgagcttttgcctgccaatggcctctctagccccagcttttgcctgccaatggcctctctagccccagcttctgcctttcatcggtctctccaggcttagctcctttctcttcacggcctctgcaggcctaaaacttcctcaatttggcatctccaggcccagctcctg

SEQ ID NO: 42015 - DNA, 1020 bp, Homo sapiens
aaaattatactttaaaaattttcattttcattttattttatttataaatagagtcagagactccctatgttacccaggctggtctggaactccaggactcaagcgatcctcctgccttggcctcccaaagtgctgagattacaggcctgagccaccgcgcctggtccaaaattacatgtttatcagcagtgattaatatacaagcacatcaacagacacacgcatagcacacacatgagcatgcacacgtgtgcgcactccctacacatctacgcatgcacacacccataccatcacacaccacacacgcgcacacagatgcacatacatgcactcactgcacacaccgttgtacacgatgcacactacaagccacatacacgcactacgcacacacgcacacgcacaacaccagaccggcacacagacccataaacgtccatcacgcactccacgcacgtccgcatgcacgctacccgtcccggaagcgtggtctccgccgcctgcctctgacgaagcttgtcccggccgcgccaccgtcggacgcccggggtcggaggtcacggcggcgttggaggtggcgtggttttttttttttttttcacccggaaaccgcggttgccggagcccgaactgaggcggcggcgggagcccggttggcgtctggtcttcgcgtcggccccgcggagccagacgctgcccccggcgcggggagaagatggtgcctagcggcctcgggcccgccacgcgccgccacgagtgagcccagcgcgaccgcgggcgtccgccgagcagctggcccggctgggcccggggcgcgcagctgcccgccggggcggggtgagccggggctggagggcgggctggggtcgggcccagtcggggctgcccgcggggccgggagcggggagcgtgctggtcgggagcggctcctccgccggcttttttcaccgcttctcagggtgcagaccccgccccaactgctggcgggggtcgcccagcatcggccgacctcggcct

SEQ ID NO: 42016 - DNA, 1047 bp, Homo sapiens
gttcaacatgggaggtggaggtttcagtgagccgaggtcacaccggcctgggcaacagagcaagactccgtctcaaaaaaaaaaaaaaagatgatatagtttggctgtctccccacccaaatctcgttttgaattgtagttcccataatcctcatgtgtcatgggagggacccagtgggaggtaattgaatcctggagattgttacccccatgctgctgttctcatagtaagagagttcccatgagatatgatggttttataaggggttttccaccttttatttggcacttctctttgctgccgccatgtgaagaaggatgtgtttgcttccacttccgccatgcttgtaagtttcctgaggcttccctgaccatgctgaactgtgagtcaattaagcctgtttcctttataaataacccagtcccgggtatgtctttatcagcagcatgagaaaggactaatatactaagagtttagctcatttgagaagataggcttaaaaggagcttatgtgctttgcatcacatgtgagaggactgtaggctgaattctgaaggcaaaaatccaacacccaaactcctaaatgtcaggcacctatttatttttctgttatatttttattttttaaaaaagaccctcaaactaaaatataatggtatttatctcaaagaagcatgaacgtgtaagttacatttttcctttccatgtgtgttgccgtgttcagtgttttaccagctgctgtgggggtgacacaagtgaatgactcaggccactgagcacgtgtctttcctcctcctcttctcctgcagacagccaccgcactgtgttcctgacacgtacagcaacgccacgctctggtacaagatcttcacaactgccagagatgccaacacaaaatacgcccaagattacaatcctttctggtgttataagggggccattggaaaagtctatcatgctttaaatcccaagcttacagtgattgttccagatgtaagtgagaaaaattgtgtgtgtgtgtgtgcgtgcatgcatatgcacatgtg

SEQ ID NO: 42017 - DNA, 1445 bp, Homo sapiens
ctcaaaaaaacaaaaaccagttaattctgtctccgcacagtggttccagatgggccgcgtcttgcaggagactttgagatttctagtaatttcttcctaggtgagattttctttttagggatttagtaacttcactgtctggttgatatgtgcaattagtgtggcatcctggtctttgggtaggggctgagttacctaggcttcccttttttgactggtttccctggcttgctgtcttccaggtggctttggctgaagcctaattccacagctccttgttttttgagagagactgagagaaccataatccttgcctgctgaacccagcctgggcctggatgctctgtgaatacattatcttgcgatgttgggttattccagccaaagacatttcaagtgcctgtaactgatttgtacatatttataaaaatctattcagaaattggtccaataatgcacgtgctttgccctgggtacagccagagcccttcaaccccaccttggacttgaggacctacctgatgggacgtttccacgtgtctctagagaaggattcctggatctagctggtcacgacgatgttttcaccaaggtcacaggagcattgcgtcgctgatggggttgaagtttggtttggttcttgtttcagcccaatatgtagagaacatttgaaacagtctgcacctttgatacggtattgcatttccaaagccaccaatccattttgtggattttatgtgtttgtggcttaataatcatagtaacaacaataatacctttttctccattttgcttgcaggaaacataccttaagttttttttgttttgtttttgtttttttgttttttgttttcctttatgaagaaaaaataaaatagtcacattttaatactactctagttaggacagacttgtgcttttatcctgactaaaaagttaaatatttaagtcacatacatggtaaagatctaagtttcattttccacatggatgaccaggaacctggtcttgttggagctggcataggaggttctactgtcttgtcgtccactcttgtccctcccttctgttatcaaagttaaagcgcctcttcactcaaaagggcttcaaaatgtaaatggctctagagttagagtgactgtttgctcttctgctttctggaatgcagatgacagtatggaaagaaagaataatgattctatctaataggaaaggatttcttctttcttttttaaagagtgggtggattttctcccttttgttttgcttttattttcatgctactaacatatcttcagaaggaaatggcaactagtagatcagtaaaattacgaaaacgatgcctgcaaaatttgaaggaatgcaattctgatttgccatttatcagggaaaactgaaagcatttttcttataactttttttctttttctttttttttggagggg

SEQ ID NO: 42018 - DNA, 1053 bp, Homo sapiens
aattttgtgtttagacttgatatatccccaaggtacatcattatgtatatgcagatttaaaaaaaaaaaccaaaacagaaaaaaacctctaaaatccaaaaaacttcccatcccaaacattttggataacggatacctagcctgtattttgtatccccgggatttgcaacagttctgtttagataatggtgccaagtgttaaattactttatgtttaaaactttttattgctttaatttattagataattttttagagatctctctgtattttttcttttcttttcttttttttttttgagatggagtcttcgcttcgttgcccaggctggagtgcagtgtgcaggggtgtgatggtggcccactgcagcctctgcctcctgggctcaagcagttctcctgcctcagcctcccgagtagctggaactacaggcacccactaccacgcttgcctagtttttgtatttttagtagagatggggtttcactgtgttgcttaggctggtcttgaactcctgatctcaagtgatccacccgcctcaacctcccaaagtcctgggattacaggtatgagccactgggcccagccaacatccactgccttgatatggatattcacagcttcctgcctgaggagatggtaatggacctagaacatggttcccctattccttggagacttcagagatttaaaacaatctcaaacaccaaatacaactcttattgggtaagcaaggtcaccacattccttgtctttctgacaccacagagcagcttccactctaaggaagcaggaacatgagctgttgttttctcttaaggtttgaaactcaggtgccttattttcccccagtgtgttcttccattagtagccaccgtgcctggccatctctctgcattttttccttttttttttttttttttttttgagatggagtcttgctctgtcgcccaggctggagtgcagtgacgtgatcttggctcgctgcaagctctgcctcctggattcatgccattctcctgcctcagcctcctgagtagctgggactacagg

SEQ ID NO: 42019 - DNA, 1028 bp, Homo sapiens
tcagatatgtaaattttttttttttttttttttttgagacagagtcactctcttgcccaggctggagtgcaatggcacaatctcggctcattgcaacttctgcctccagggttcaaggaattctcatgactcgaccttacaagtagcctgaattataggcatgtgccaccatgccccactaatttttgtatttttagtagagatggggtctcaccgtgttggccaggctggtcttgaactcctggcctgaaacaatctgcctgcctcagcctcccaaagtgctgggattacagacatgagacacttcgcctggcgtagatacgtaaatattttgtttaatgccttgccactcaggaagcttattaagtttttgaactcttaactatgcctctgataactcctgttcctcagcttaattgcttcatatcacagtgaaataaattactgagtttaggaaattacgaatcttgccaaattgattacattttcattttataactgagtaggcttaggccccataggctttgttacatttttggaactcatttattttgttaactcctgttttgttcttatcatgatatagaatggtaggtttcaaatttttttttttagtcattaatccttcatttgataaagggggtttgtttgtccttttgtttaaaaaaataaatctaaggcagaaaagtagaatacataaaatgaccctcttctgggtcaaggctggagcttgaaggcttgaaggtcattttgccagcaatttcctcttccttagcggcagcccatgaccaggggcctcggaaggactttgggcttttgcagagcagtctggaaaaccctgatttagagaaccgtgcttttagcctatctatcttttcctcacaggttggcaaaaatgttgacaagtggctctggatgcttggcgcgcatcgtgtgatgagtcgaggggagggcgactgcgacgtggttaaaagcaagcacggcagcattgaggccgacttcagagcatggaagaccaagttcatctc

SEQ ID NO: 42020 - DNA, 1029 bp, Homo sapiens
tccttcttatctccttctggaacttttattatgcatatgttggtatgcttgatggtgtcccccagctcttttcaatttgatggtgtcctaaggctctgttcaattttcttcacacttttttttttctacttagacaagataattccaaattgatttgtcttccacttcactgaggtttttctttggcctgttcaaatcttctgttgaaaccctctagtgaagtcttcatttcagttattattctttcacatcttctgtttggttccttcttatcatttgtatctcttcattgatattctggatttgtttagacattgttttcttggtttccttcatctctttgtccatggtttccattagctctttgagcatgtttaagatagttggcttaaagtatttttttagttggtctaatgcctatgcctcctcagggagagtttttccaatacatgctgggaatacacacttgtttctttgcatggtttgtatgcaaagaaatgttttgttgaaaactgtatattttggcctggcacggtggctcatgcctgtaattccagcactttgggaggctgaggtgggcagctcacgagatcaggagattgagaccatcctggctaacacagtgaaaccctgtctcttctaaaaatagaaaaaattagccgggcgtggtggtgggcgcctgtagtcccagctactcgggaggctgaggcaggagaatggcgtgaacccgggaggtggagcttgcagtgagcctagatcgcgccactgcactccagcctgggcaacagagcaagactccgtctcaaaaaaaaaaaggaaactgcatattttgattattagaatgtgttaactctggaagtcagatttttctcactcttcagggtttgttttttattgcttgctctgggttttgtttgtttagtgagttttctaaactatatttgtaaagattttattctttgttttatattatctctgaagtctgtgtcttaagctcaggggtcagctaatgatttgacagagatttcc

SEQ ID NO: 42021 - DNA, 1032 bp, Homo sapiens
tgcttgatctgaatgtccatatctctccccaaatgtgggaagttttcagcttttatttcattaaaacctgtttacttttccatgccttttcccacctgttctccttctggaattcctaaatgcaaacatttgttcatgtaatggtgtcccatcattcctgtaggctttttttcctacgcctcctgctgctgctcctcctcctgctgttcctcctcctctctcctctatcctttcttccttctcccttctctcttcttcttcttttcttctttctttttctcatcttctcctcttcctcttccttcttcttttccttttctttttcttttctccttttattctttcttcttcttccttccttttttttggtctgactgggtcatttcaaaagtcctgtcttcaaattcagacattgtttgttctccttgatctagtatgttgttgaaactctgagttgtatttatttcattcatcgaattcctcaccttcaagttttctgtttggctgtttttttgtgatatctatctctcttgaatttctcatttaggtcatgaattcttttcctgatttcattgaattgtctatgtgtattctcttgtatctctctgagtttccttaagaccattattttaaattctgttacaggcctcgattttcctttttctttcaggtctgttactggagaattattgtgtttctttgggagtgtcatgttttcttgctatttcatgtttttgttttttactacattgatatctgcacatctggtataacagtcaccccttccatttttatggagtagttttcgtagggaaagactttcctggagaagtattttatagtgttggttgagtggggtgctttgacttgtcctctagacgggtacagtagtgtagtagtatagtagtgtacatgtgatttctttggccataatcggtgcctgtggttcctatgagtgcctcactggcctggactgtgggtgtttgtggaggcagtggcatgactttgctaggggcagtattgctgggcttg

SEQ ID NO: 42022 - DNA, 1075 bp, Homo sapiens
tttgttttgttattttcctacaggatttttggttgggaatcggttgtttcaagcaaactccttcctccagcactttctagaaagaaagatgctagaactaaaagttattctaggcaggtccttggaattcccacttacttgcaagtcatcccttattttttggtactctttttattctaaggctagaaatccctttctaaggacaagtatagaagattttaagccaggcatggtggctcacacctgtaatctcagcactttgggaggccgaggtgggaggaactcttgagcccaggagtttgagactagcctaggcaacatggcaagacctcatctctttaaaaaaaataaataaaataaaagagaaaaaaggaaaatttgaaactgtgctttttaaaagattgtatttgacagcctacctaacaggaaacaattccattgggcaaaatgcttttaagcacaggaatcaaccttagttggagtggaatgattcaacactatgtggccagtttaaacaagactctgggaggtgtggttgggtgacttggtctgcgtggctgagcattacatcttctctatgtggaaagattggtgtgtatggaggtgtggattaagacctaattaaaaaaaaatttgaggtggaatggaatctataggaggaatctatgaagacgccctgcatcagacatcctgtccaaagggcctagttttctcatctctgtggtgcttagtaagtgtttctctaaggagacatcacagccactgccgaaaacaacctcatcttagcagcagagagaggcccacactctcacaccatgcacctcttcctcttgatcccagagtaccgaaaaagagttttggactaagaaacctgggaggttgctaccgatctggactaggccttgtgctcttgttaatgcttaaagtgactttctgagaatgggctggccagctacctccttgtggctaagggcttgctttgcagacaccccacacttcacagagaggagcgaggggttccatcccctgtgaagcctaggcagtgtcctagcaagccatctgtatgatgcccaca

SEQ ID NO: 42023 - DNA, 1067 bp, Homo sapiens
tctgtatcaccatctctgtctttccatccttctgtgcatccatccatccgtcatctgtctatccatccattcgtccatccatccatccattcatcatctgtatgtccatcagtcatctgtcatctgtttgtctgtcgtctgtccgtccatccatccatccatccgtccatcatctgtctgtgtctatctgtccagctaatctctgtctattcatccatctatcaatccatccatccaccttctatcatctatctatccatctgtccatccatctatccatctgtccatccatctatccaaccatccatccatccatccatccatcatctgtctgtctgtctttctgtgtctgcctgcctgcctgtctgtctatgtgtctatatcagtgtgaatgcatgaatatttattttttacctagggttataatccagtactaccttatttcttttgttgctcaaattgtcccagctttggccattcggatctctttcagttggctcctgtgttactttgccatacccccatcaacattgtgtgtgtgtgtgtgtgtgtgtgtgtgtgtgtgtgtgtgttttgagcactttctttctggcactacaagattctccaggattatctcacacacagatggtcccaacttacagtggttcaacttgcagtcttttgactttatgatagtgtgaaagcgatacaaattcagtggaaactgtacgtatgctgccatgctgggcactggcagtaagccgcagctctcagtcagccacgtgtttttgacttattatgggtttatcaggacataaccccattgtaagttgaggagcatctgtattttctgcctcagccatggtttattggagaatggtgttagaaatcaagctctggggaaggtatgctcattgttgggctgtctttttaggccttctcagctgacagagcagagaaatacatgtgtgtatccacatttctatatttctgtctatacctatattcaagtgaacacactgatgtctctaatccatctccccatgggtcattctagcctcctccccttgctcatctgtaaattc

SEQ ID NO: 42024 - DNA, 1035 bp, Homo sapiens
ccacctcagcctcccaaagtgctgtgattataagtgtgagccaccatgagtggcctcaagatttaaattgaacaaagatattttattgtttcaaagaaaaaaaaaaagcaaacctcttacctacagaatgaaccctcctgattccattaacttttttttttttttgagacagagtctcgctctgtcgcccaggctggagtgcaatggcacaatctcagctcactgcaagctccgtctcccaggttcacgtcattgtcctgcctcagcctccccagtagctgggaccacaggcacccgccaccacgcctggctaattttttgtatttttagtagagacggggtttcactgtgttatccaggatggtctcaatctcctgacctcgtgatctcaatctcctgattctcattgatagatgagtgtttttctttcatcccagaaaatattgatgtattgattcatatttaaaataacagcactttaagcccagttcacagtcacaacagaacatttgaaatgtctaaggaaaatacaatgcaatctacatgaaaacattcattaagtttgctgaacagtataaaagtgggagagaatgggaaacctgaatgttctaagaaggtgatctgttggcaaaataacatcccaagttctatcagaatttctttttggagcttaagaaaatgattctaacattcaactgaaaaattagccaaacagacaatagttaagaaattttagaaaaaataactattaagtgaaagttggtttatattaaaatatgctacctaaataattaaaatgaaatgagatcagttccaaaacggcagagtgggggcctcagtgaactctgtctccctctaaaacaatgaaaatatgcgcaatacatctaaaataaaccaattttagaattctgataataaactggaatttcaccacaaactgaaaatcatctatcgaatgaacttcagtaaaattagctgttgacttctcagcagaaaacatggatgccagaagagaggatgaaatagatggttagc

SEQ ID NO: 42025 - DNA, 1037 bp, Homo sapiens
acaaagtcagggtccccagggattaatgaaacctttagggcaaaagtcagtttgcttacctcccagggttgctactacacctcatttttggactatatgaaattttacctttcattctagttcaccagtacattgtgaaagatgttttaaatgttttacagaagtttagatggttcaactgggaagatcatataggatttctgttctgttatattgccagaagtagaagtcatctgtattttttttttactagtctttggtagatgagtggctggatagctacaagcaagaccaggatgcaggatttctggagcttgttaactttttcatctgatcttgtggatgtaaaggtgaggaaactgctccccctttctaattcccagccttttgttcctatgttatgaattctttctccatttagataagtaggattagatatttcctaaataaaggaagatagtaaagcattagaaaaattttacttatttaggctgggcactgtgactcacacctgtaatcccagcactttgggaagctgaggcgggtggatcacttgaggtcaggagttgaagaccagcctgggcaacatggtgaaacccctactaaaatacaaaaaattatctgggtatgtggctcatgcctgtagaattgcttgaacccaggaggtggaggttatagtgagcctggatagcgccactgcactccaacctgggcgacagagccagactgtcttcaaaaaaaaaaaaaagagagagaaaagtttcacttctttaactaaattttttgttgataaatacgggaagtgatccagtagggaaccatgttggtttagagacaagaaactttggggaaaaagaagtaatcatgcttatgttatggcacaaatttgaggacaccttttagtctttctagatgcaataatctgttattttcttactctttatttcccagctactttgcccatatttctcctctgtagctgtggtacccccagaactcttactgccatggcttgatttattgggacagatggtctc

SEQ ID NO: 42026 - DNA, 1224 bp, Homo sapiens
ctgtaaatgatcacagcatcctgttattttcctcgtaagcacctcatatccttcattctttaggcactgtgagccctgagatgttcaagaagatgtccaactcagagatcatccagcacctaacagagcgtttaatgaggtggaagaagatgaccaggatcctcttacccctcttatttcaaaacacaatgcctattatccccttctttttgattctgtgaaatagggtagcttttagaaggtggagttcagtctcttgggggtaaaagagatctgaatatgcctctcaaactggggagacagctaggaaatgaagcataacagatatttttactagactgttgggttttgacatccaagcccctatgacttcatatacctggtcataactttcccatccttttcatacatccttttgtaggactcgggggactatcctctgacagctccaggtctatcctggaagaagttccagggcagcttctgtgagtttgtggggacattggtctgtcggtgccagtacatcctcctccatgatgacttccctatggacaacctcatctccctgctcactggcttctcagactcacaagtctgcgccttctgtcacactagcaccctggctggtgagcattcattttcattccggacattcttctggggatttataggactttcctctgttctctgattcagggtcttctttcctacctgtgtcttggctcttcacttcaaggccatgcctcttttatcctaaacttcaatccagtttctcactggtggagttttgagaaggggtagatcacagcaacaatttccaggcttagtatttttgtcagagctcaccactagggtatgctgatggttaaaagaagaccacaagggttagagggaaacagtccactccaggacaggcagtcaggattttagggtcacctacctctggcttctcatttttattgcccttctttccttctatttttccttctactcatcctctctcctctgacctcagtaatgatttctttatctctttttccttactcaaagctatgaaactgatgacctccctggtaagagttgccctccaactgagtctgcacgaagatatcaatcagcgtcagtatgaggctgaaagaaacaaggggccagggcagagggcacctgagcggctggagagcctgttggagaaacacaaagaggtgaggagtgttccctgcttct

SEQ ID NO: 42027 - DNA, 1062 bp, Homo sapiens
ttaagctttgttgtttcatttatagagcataggcagagtagatttagcataattcttaagagccttaggatttttaaaatggtaaatgagtattggcttcaacataaagtcaccaactgcattagcccctaacaaggagtcaggctgtcctttgacgctttgaagccaggcattgacttctcctcaatagctgtgaaagtcctaggtggcattttccaatataaggcagtttagtccacactgaaaattcattgtttagtgtagccaccttcatcaatgatcttagctagattttcttgataacttgttgcttctctatcagtatttgctgcttcaccttgtacttttatgttatggagagggcttcttttcttaaacctcatgaactaacttctagcttcaaacttttcttctgtggcttccttactttgctcagccttcatagaatggaagacagctaggatgttgatctggattgggctttggccgaagggaatgttgtggctggtttgatcttctgttccgactactaaaactgtctctatatcagcaataagactgtttaactttcttaccctttgtgtgttcactggagtagcgtttttaatttctttcaagaatttttcttttgcattcacaacttggctgtttggcacaagaggcctagctattgattggcctgtcttggctttcaactaagcttaatcatttctttttttttttttttttttttgtctttttgagatagtgtctcgctttgttgcccaggctagagtgcaatggcgtgatctcggctcactgcaacctccgcctcccaggttcaagcgattctcctgcctcagcctcctgagtagctgggattataggtgcctgccaccgtgcccggctaattttctgtttttagtaaagacagggtttcgccatgttggccaggctggtctcaaactgacctcaagtgatttgccacctcggccacctaaagtgctgagaatataggtatgagccaccacgcctggcctctaagcttaatcatttctagcttttgatttaaaatgagaaaca

SEQ ID NO: 42028 - DNA, 1049 bp, Homo sapiens
ccactagcaaacacgtaattcattctgcagcagatactagctgggcatcctctccttggagacagcatctgatcccataggttgagaaatcagcccccaagactactccctactttgatgccaatcacaagccccaggttgttttatctgtgcttctgactggtgactataaatcagggttcccacaactccctctttgggtttgcttaatttgctggagtggctcacagaactcagggaaacacttacatttactggtttattataaaagatgttccaaaggctacagaggaagaggactgtgaaccccgagcatttgagacaggtctcggtaaatttagaaagcttattttaccaaggttgaggatgcacacccatgacacagcctcaggaagtgctgacgtcatgtgcccaaggaggtcggggcacagcttggttttatgcatttcagggagacgtgagacatcaatcaatatatgtaagaagtacattggtttggtctggaaagacaggacaacttgaagcaaaggctggaagactgcaagcagggaggaggcttcccggtcataggtgagagaggaatggttgcattcttctgagcttctgagtagcctttaaggcagtcagatatgcatctatctcagtgagctaagggatgactttggatagaatgggaggcagatttgccctgagcagatcccagcttgaaggagctcaagatattttcctttcacaggtgcatagggtgaggtatggaggaagggatggagagattccatgccatccctgggtgcaacacccccccacccccactaggaatctccacttgttcagccttctggaagccccctgaacccagtcctttagggtttttatagaatcattacatagggcatgatggattaagtgactggctgttggtgattcaggtcaccgttgagcccatctctcctccctggaggttaggggtggggctgaaagtcccaaccctctaatccttccttggtctttgggtgacttagcccctatcctgaagctactcattaaca

SEQ ID NO: 42029 - DNA, 1043 bp, Homo sapiens
tgagagactgagtaccatgaagagctagtgacttgcctgaggtccctaaaggaaatcaaattccatcctgcacctcctccaataatactggcttccaggccaggcgcggtggctcatgcctgtaatcccagcactttgggaggctgaggcaggcagatcacgaggtcaggagttcgagaccagcctggccaacatggtgaaacttcatctctactaaaaatacaaaaattagccgggtgtggtggcacgtgcctataatcccagctactcgggaggctgaggcaggagaatcacttgaacccgggaggcggaagttgcagtgaactgagatcgagccactgcattgcagcctgagtaatagaatgatgactctctcaaaagaaaaaaaaaagcaaaaaaccggcttccagcatttgtgaaatggcgtgatcaggtcaagtattagttcaggccatctccagggtctcttgtttgtttgttttgagacagggtctcacactgtcatgcagactggagtgcagtggcatgatcatagctaactgtggcctccaactcctgggctcaagtgatcttcccacctcagtcacccgagtagctaagcctacaggcatgcaccaccatgtccggctaattttatttttttgtaggggtggggtcttgctatgttgcctaggctgatcttgaattcctgggatcaaggaatccttctgctttggtctcccaaagtgctaggattacaggtgtgagccactgtgcctggccaaaggggtgcattttgtgtgtttatttttatttttattttttgagacagagtttcactctgtcgcccagtctggagtgcagtggcacgatctcagctcactacagcctctccctcccgggttcaagcgattctgccacctcagcctccagaatagctgggactacaggtgcccaccaccacgcccggctaatttttgtatttttagtagagatggggtttcaccatgttgaccgggctggtcttgaacacctgaactcaggtgatcagcctgcctcggcct

SEQ ID NO: 42030 - DNA, 1071 bp, Homo sapiens
aggaagacaatgggaagcccccgtcctccgccccgtcccggcccagacccccgcggaggaagcggagagagtccacctcggcagaagaggacatcattgatggatttgccatgaccagctttgtcacttttgaagcgctggaggtaagggggaccccccttcccccgggttccctttatgcacgaccccactcggctgcgcccggctctcctgcctccctcgccgcgctccgggctgtctgtctgtctgtctgtctgtctgtctgtctaggctgaggtcttattgttggtggggggagctgggggcgcgggcagacaggcagcaggagggagtcgcaaagccgtgcctggtctcgtttcctcgctcgcctttcccctgcgccccctccctgcaccccctccacagcagatgggcagaaagaaaggggttcgggcatcacaacaatgcgccccctctccacagagagctctgcccccactccttcctcctctccctccccaatcatggcttcttggctggtggaagtctctttgctgggtttggggcgcctgtggacggttctgtgtgctttctacagagtcatatgttcgtgtgtgtgtgtgtgtgtgtgtgtgtgtgtgtgtctgtgtagtatatacctttcccgggtgtcctcgggactggagactgatggggttttgtgatttctttgcgcctccccccattacccccccatattctttttttttttttttttttggtgaagctggggaagggggcgttttctcctggttgggagaaaggagggaggaggggagagaagagggaagggtggaatagctctctgtattctgtatggggttctgttacagaaagggttaattataatattatctatacacatacataggcacatgtgtgtgtgtacatgagcaatttagttaaaggacagaaaaaggtacaccagggaagactggtgggagggaagaataaaatcctagctgctatctgaagggcttgtcaccaattgtccctctccctttccttttttgtgttttcttttttttctttctaagtgattggctttgtgtg

SEQ ID NO: 42031 - DNA, 1051 bp, Homo sapiens
aaatagaaatcatcatatatgtctggttctttggcaaaaggtagttttgttggctgtgtgctatcacattgtgtccatgctggatggtcagaacatatgtgttagtgattgttaaattaaaacctctggtggtccactctattcagtctggaagatttattgaactatcaccaagaaatgtgagggcttattgggaacaggcaactaaactatgagcttggacaaaaatgtgtgttgggggagtgtttgtaaaagttaagaattattatagatgctaagagttatcctaaatacgtagtatgttttcgggccttgtgtttagaaatgaaatcagttgtcaccacatgtcattaaggctgctgctggtatgatattgtgaaaagaaaccagaaatattggcttgcacagctaggtttatagcttgtgccagttcagagcaatagctggcaaacagtggagtagcatactttgtgtgttaatggacacattatttgactccatgattttgttctgagtagctggttttggacttctcttttaaaaaagaggctcctaactcattatgaaatgtgctaatataaatagttccagttcaactgattttactgatactggagtaaaagtgataacttgcctaatgagaacctgcatttttatcttgattattttttgctgttgttggattcttttttgagatgatgaaagctttaggggtagtttgacaagtctcacattttataggcagtgaaactggctgaaacagtttcatattcacagggacacttctcttgagtaattgtgccctgaagttcaagtgtatgattatgaagagcctcatgatagaagataagagggtaggcgaggaggctaaagttgaacatggtgttcttttcattatgcagttgagaagcagaattaacgttggtatatagtatattgtttgtttggatattcttcgagtgacaggatgagagcaaaaatccccagataagatgtctagttttcttaaaaagtggcttttagcaaagtataaatgggaatgttggggtcc

SEQ ID NO: 42032 - DNA, 1556 bp, Homo sapiens
gctcccctttcctgcctgacatctgcctttttactgattgttaccaaccccaccaggaggtgaatattggtgagtggttctcattaatagctctttcagtgtgatgatactagcccaattctgatgccaccaagctgcccttcagccaatgttttatcctctttgtcccttctggtttcatatattgctgctctttggcaacctgtaaaaaaaggttggttgggaaaggaggttgacattgatgttaaaacaacgatttcaaattatctgcctttggcttgctgtatatgaagtggtagttcaaaaaagggtcagaaccgctcttttgctgttacatagccaggaaaagctgtggaactgtgtttctgttgcatttttcactttcttttttggaaaatttggccatgggactgtaaaataaatgggtcagttccagcatttgacttctgaaagtatgcatagctttaggatctgagaagggatgagagaatttggaggaaaggaagggtgtgaatagtgtgtgtggttatgaattcaagtattttactgtacttactgagtttcattattttactttataaggcagagcatcacttgaggagtatttatgtgagatgtggttgaacgttgtgatatgatgattccatgcagcttttgttaattgtggagattaactacttgcaccttttttttggaattagaatgtaaatgaatccgtgaatttaaaaaatgaattatgaggttaggaattgagcctttgatcctgagagtagtgttctgtagttctcactgttgaaaaagggttaagaaaacagaacagtaaacatgattcaaggagtgttgagggtgatagattctgagactcttctacaccacagttttatgtattatcaaagataaatggtgattatttagttttaaagaatgttaggattagaaatgaggtccccagatggacacaacaatagttgaggctagctattaggaataatttaggtctaagagctacgagatttggaagcctttggacgagaaggtctgtggcatttcgggtgtttgtgtatgtgtgcacgcacctgtgtgcacgcaaagggtgaaggatggtgggttagtggctttacattttattttattttacccctatcctgtatagtagtcataatatactaaatgcagcctaactttgtaaaagtgtttcatgctgtttttttcctcctcaagaagcaacttttttttttctttcagaattaggattaaacccaatatgctgcagatgtaggataaagaacctagtaatgggagagcaactgttaattttagaaagttctgaaaagattcaggtagatttgaaaacttagatcattgaagtttagaagagcaatatgataatgaatttggtaaaacttgagacaggagaagatcaaaaataattagtgagctggggcagaactgttttctcttatataatcagaacctgttccatgaatgtagacttttttcccctctgggaggtgaagaggacatagaatttaagactggtgagaccctaagtgtgt

SEQ ID NO: 42033 - DNA, 1033 bp, Homo sapiens
tcgtctgcagcacaaaatctcattttaagtttttgtaaagtttctgatggcagtaatattttagaacttaaaaggaggaattaagagattacagtcccatattataagtatttcttagttgttatgttgaagtagacttcttttttcttgttttcttctagatctctttgttcagttatactcgttggctaaaggttgctggttaaatgttgtttagcgaaatattctatagttaaaatctttacaaagaaaaaagtaagaatgaagatgtggatagcacaataattgaacattagattattacttgttttctagccacatgatagaaattgcagtgacttccacccattctgtctgtacatgttcagttggcaaagagaatgaaggtcctggaccgtgcttttctaagaaatgattttatatagttgacattatactttcactggagcaaaaagggaaacaagcatttgattagtgtgtcttactgcatattgtggtctgctccctcatttgttacggtggtcactatgattgcttgacaattacagttttgagattaatatgcagagctaaatctttaggaggtatcctaaagttaggacctaaactttttcatagcagccttttgatccattttattccagccattgctagttgatgtgctttctaagccgtgtggcatcagaggcacagatgttgtctttagtgatgtagttctacctctcattttgcaaatgaaaacaacagcccacaggggttaattgacctgttcaagatcacactgggagttagaggctctcactgttaccctatgaatctaggagtctgcttcttgtaagttagtactggggagtcccaaggattgggaaccttggaaggagattttttaaaaacaaaaagtcttactacaaatgtggatgagcacccatgattgtaaagcttcccatttcagctaagaaatgttctgatttacacaatatcaagaacctttaaaaagcgttgttctctccctgcgctctctcccagtgtatca

SEQ ID NO: 42034 - DNA, 1050 bp, Homo sapiens
gtctgttcattgctgaaccagaacatttataacaactgtttctcatgtgtatgtattcatagccattcatataatgaaaagaagttttcatgggattgtaataacatatcaagatggatgtaattaaaacagaagcagattgacaccctgaattaaatgtaaaccataaaccaggatacctgagcattgtgccttacatatttgctgtagggggcagtcagccaaatatgcaaataaaaagacattgatgaatcttcctgggtgtgtatgtggttgcagagaacccaactattttattaatcttttatcaagcattgtttagatttgcagcagccatggaatgtattaatttggcagaccaaatagcttaggaccagaaagtaggaaataataaagggaagacatgattgatacgctgtcctataaataacacatgcgactgacaaaggggctgagtaatctttagatctgtgcttcatttcattaatggagttgttaaaccaggatgtttgagttgaacttcaatcagagaggctctgcctcccatttaaaatgcaggcctacctctactcactctctggactgatatgttgacaaaattggtgtaaatcgaatttttgtaaattggatcaaatgcactaggggaatcttgctgtgaaaaatatgagtcctttttatcaactatagtactcctcctctctgcagggaggctgggattttggtggagtgagtctcttcagatgggcattgcttcctctgagacagtttcctgcacgtgttcccggtgctctgttccccgtgctcctggaagacagtgactgtgagatttgcattttttcttcaggttttatacctcacttggtcggtgcttccaggaataattggtggtgatttgaataagcccgcatcattcagatttcagagcttggttttcaagtgcttgctaaggagggctcccagctatgaatatggaatatgatttccatatctgttccattggggagtccaggcgtgtcataaccacttcagagtcatgattgtatcgagaca

SEQ ID NO: 42035 - DNA, 1022 bp, Homo sapiens
atatacaggatggggttgccagcagaagttacatagtgataataacatatcagcttcctttttagggaagatattgtaattgtgagaaaaatattcagaaaagccttggccaaatattgtttgtagttggtaagagaatactcagttattaaagcttctgcgaaccttttccaaataattacactttttccctaaaggaatcctcccacctcagcctcctaagtagttgggaccacaggtgctcattaccacacctggatgggtggatggatggagatatatatatatttgtagagacggagtctccttatgttgcctaggctgtgttacattttttgtcacacatgttgggtatggagaatttggagtaggtagtttcagatttgcacatcacaagttcttgccttgtgcagtggtttctaaaccgagttgcatatctatactccatggtaacttggtaaacatactgattcctggaccctgtgtctgatctactaaacattaatccctgctctgtggctctggaacattagtgttttgttttctttttggggtttgtgacagggggacaaggtctcgttctgtcacccaggctggaatgtagtgggacagtcatgactcactgcagtctcaaactcctgggctcaagcagttctcctgccttagcctcccaaaaagctgggactaccaccaccacgcccagcaatttttttttttttttttttttttttgcaggggtagagacagggtttcaccatgttgcccaggctggtcttgaactcctgggctcaaggaatctagctgcctgggcctctcacagtgctgggattatgggtgtgagacactgtgcctggcctggaacattagggttttttgtttgtttgtttgtttgtttttaacatcaagttccagtatagaagtttcagaaacactatttcttaaaatatttttgagtgttttcctggggcagtggtaatggtgatggtttacaataatttatttctatgctatgtaacttttct

SEQ ID NO: 42036 - DNA, 1044 bp, Homo sapiens
taattgaatttcaattaaggatgttctcttccttttcctcctcctcttctctctaagttgtactcattgaattcatgtttcaatggggaacaaaaatttttcaaatattgttgttctggtaatgctgcattttaggatctggagagggcagtcagtgggattaaatgttatcaaataggttaaattatttggccatttactttggtatagttcctctggagctcaggaggatgttagaggtctttgttgtcagtgaaatcttgtaaatgtatttttaggctgttcaaatgtctggatcacctattttgaacttttgcatataccaccttacattacttatttttataaagtggacattttatctttataaggttttgccttgctggacagtgattatgtgttctaggtctttatagctttgccattacccggcatactgagcacataacagacactcaataaatatttgattaattggatatgttgattgggtacccaagaaaccagaagatgaaataagtctggagttagaacttgatacatgcttagaaaggtaggaacgtaaaagtggattatgaggtctatctcttaggctgacgtgctctcctttctccttccccatccctctccaccccctctcctcccttctctcttccatcctgcctctcctctccctccccctctcccctctcccctctcccctctgccttctcccctctcccctcttccctctctgttttctttctctttcctttccctttctctttccttaattttcttttctttctgttcatatataggtagtagagccagctcacgtttgctagttctttaaaaatcttaagtatttagaattccacagttacaagaattttatggtagagccacaacactaagttttcatttggaaaatgttaaatgtagtgaaccttgagagaggtttttattagttattgcttttatttatttttaaaataagtttcattgtgtatttgtaagatatataagattataggatgcatagagatagtaaaaaggttacta

SEQ ID NO: 42037 - DNA, 1050 bp, Homo sapiens
ttgtagagacaaggtcttgctttgctgcccaggctggtctcaaactcctggcctcaatcagtcctcctgcctcagcctcccaagtgctgggactacaggcgtgagccactgtgcttagcccatccagttttctaattaaagacatagaagttcagaaagatgaagtgacatctttctcaagactaagttaatgatcacagcagaagttgtagttctctgtatcaatgtatttctgagattctcatagtactagaattgtatgtttttcccttgatatggtactttgtatgattaaatttcaaaatcaatagtaaaattttaatttcaaatgcagtataagcacaatttccctaactcctctttttttcctctgtttggaaatagcctcagtttttgttaaaattcaacacagtcttaaacttgcatttcttttttccttactttctttctttctataatattttcacctatcctatttcattcacagtggaggttttaatttacttcaagcagtattgccatctggatgtcaaaagacattgaattgacttcttatctgtagatcccaataaaggtctcacctgcctagaaacaaaagatttagtcaggaattgaggaggagcaaagcaaaggcttcaccagaggcccaggtgctacctatctgcccacttgttctttgattgacagtggggcacagaggtgccttgtgtttctctaggaagtagcttttgcatacagtgtttgtttggaacttttcaatttgctagtgctgaataatgtctgcagtaaaagttggtttagggtaaacccggagaaaggaattaaagagaagttttaacatttctattgtttttcttctgtgactttagcctttcccccttcttagtgaattattatagagttttattaaaatgtaagttctggaaattagacaccatggtatttagaccagcatgggatactgtactcttaggttccataatatttcatagtacatctctttattgtatgttaaatgatagcgaagtataataaaatgcacctagagag

SEQ ID NO: 42038 - DNA, 1031 bp, Homo sapiens
gatagcagggactggctggctgttagtgagccagggccagtggcatttaattgcagtcattcccattctttgctgagctttggtcataactatttgtagaggacccctagactttttttttttcttccaggacaaaagtgatccaaaacatactgtcttcagtttttgagcattggactaccaaacaggaacatttaaggaaaacaaaatgttgctgttgtaaagccttgatggtgggaagttatgtagtgaattctcaatttcttcttcctgcatcttgtcttaaaaaaaaaaaaaaacttttaaagtttttgtttgttcatcattcattcattaataagtcaagatgtagagggctcagtagccttcccctagttttctacatttctgactttggtaaacttcctttacttctgcaatttccctaattgtaatattaacatatatctaaaaagaatacaatggttatgtaaacctcctagcacttaataggcactcaagacaatatgacttaactgtataagaatgactaatgtgctatgtttatttatttggcttcattcattttgccagcaatggtgtagtatatatgtagtatatattaaaaatctcttgagtaagagaggtttggaatgggaaaaggaaccaagaaaatctcaccatctttcttctgcttggcagcaagtcttgaattctgttttatttttcttaagagacggggtcttgctctgtgcccagactggagtgcagtggtgctattatagctcactgcagcctcaaactcctgggctcaagtgatcctcctgcctcagctacctgagtagcggagactactggcacctaccaccacacccagttaattttttttttttttttggtagagatgaggtcttgcagtgttgccctggctggtgtcaaacttctgacctcaagtgatcctcctgccttggcctccaaaaatactgagattacaggcatgagccactgtgcctggcagagtcttgaattcttcaacagggcttttgaatatt

SEQ ID NO: 42039 - DNA, 1035 bp, Homo sapiens
ttttccaaattaatttagatctctgacccagagagacttagagtgatgcacagtcatgtagggggaggatgtgtatgtgtgaagggacctgttattgattatacgtcttacattcttgcctttcttgtgggattttgtgaagattaatatctgccagataggtttaagtttgcaaaatgccttgagttccttgggggaaactgttacataaatgtaaataaattatgcagcacctgaatttggttgttcatcattttttatagtgtgttttaattaagaacttagtgctatttaagttggatggctggggagagggtttaatcactccaagatggttaagtaagtaggtaggagcaacatttaggctggaacccatggaggaataaatgaacaagactggagaccagtcattttccatggcatttgctgagcggagctgtggattaatgtctcttcttgtacgtgtgtacatggtgctgttagaaaatcagccagtttttcactacactttgtctcggacctgtagataccttggacctctctggttttcctgagtaagctggaaaccctaacaacagccaaaacaaaacaaaaacggagtttgtcttacagtctaggtacttggggagcaagaggcatccagcaaactgcattggcttttggtacactgtgtttctgtagtccaatgagctgggttccaaactacctccttttgcctgttacatacagctttgtgttccagtggatgatactgttccttaactcttaaagagtggacatacgaaacagttgccaacaacccgtggtccagttgtgcctcctttgtttgctgctttgtcagagtctcactgtatgcttttttttttggcctttggcgctgtgagcagagtcacctcatcctcctttccgtggccaactcaaagacttacaacctttctccctcattcctatgtatctacagaacactcactagttgctaactagtggatacatgtgaattatgttttgatgccatagggctgtctagtggaggat

SEQ ID NO: 42040 - DNA, 1037 bp, Homo sapiens
attataggtgctagttggctcttgcctgtttctacaggtgcagtgaccatttttctgaagcaaaatattcttgttgtcacaggcttttcctcaatttgtgaatttatggacctgcaaagttttacaaacacatgaattatgtcaaattttgtaatgtcttttgaaaaaaagggggaaaagtgtaagaaatttagaccatgtaggtctgaaagtatgcttactacatcgatagtgggggctggaggaactgtgaaaaaagtaatagtaaatttccttttttagatctttgccaaaggtagttttgttagatataaacaacttcaagacccacaagtgactactacacactggattggccttcagagatactgggattttctttccaagtatctttaaaaatgaggttcgtagtgctttagctaggaggctgagtgcccactattaagatcctgtgagttaattggtttggttcacaaactaactcatattgcagtgtatctggctgttttgtggctgggagaaggttcctgcattgaagggactgaagtgacactctgaccttgggacttccagtgctgttgtggagtggggacttccttcttcatgtgggcttgctggctcttcatttattgtcccacctgggctctgcctgttactcttctcaggccaagaagtgagttaggttccttatttaacttttctaatggggcagctctgcatctgtgtcctgtccccaaagactaaagagaaatttcaggtgtgggccagattatggagcctgaagaacagttttatgattgattaatggttttgatttgcttttaggaagaaaagtgcaactagcccattggatgaagatagtatctctctccagcactcctgtatcaagtgtacagtgttctcttcctgtatagcacttgtattttcaagagctagggtcattgagagaacacttctcactcatgagtttcagagcgtagcagagtacacacacctgaagcaagaaatgtaattttctctaagtgtactaagaatta

SEQ ID NO: 42041 - DNA, 1508 bp, Homo sapiens
agggaatggcatgaacccgggaggcggagcttgcggtgagctgagatcgcgccactgcacttcagcctgggcgacagaggaatagtgcgttttcactttttaaccttagttgcacagggtatgttgaaagctactgttggcttcaccatgtcattgggaagtgggaacgctgacaatcaaagcagctaaacaagaagcaactcaggaattatgacattggcggcaagtcttttgcccctcttcagaggtaacactactagatctggagagagttctgtacattcagggaatcttcctgatctctaaaaaatttgagaggactagagaggagtaaagactggaacctggatagattgatttgtgagggacaaagattcagagaagacattttcttgaaggtgatgaacctgctttaccaaaatgttgtaaaaattctaaagaaaagttaattggatcaagttgacaataaatgttagaagggaaaaatcttaaagggtaaaatttgaaagtagaaagtttgtcctgtccacagtgtttgccatttcatagaccaaggtggttgggggaggtggggcaaaattactgtagtttccagtgatcattgccttctctcggtcctataaatgcaggcactatttagcactgaaaccatctggtgttggtggttgtttcttatgtcgtatgacctgcctctataaatacattgtgtataagcttaactgggacagtaattggtgtgatccttttctttttctgatctctaaggtctgaggcccatgaccaagggaaagagaagtgctttttaaaaaaacggacacttttgttgttttggtctcatggtttcactgaggtagtgttccacagtgtaagacaggttaggattgtatgttccagaattatgaacaagagtatccttgggaatgataaaaaccatgctgcagtgttgcatgtgtatttgtgtgttccatgtggaagaccttctgggctgtgtctgtctttgctatttatttatcacctgaaatggtgctgctcaaccactctgtgacagtgttattttaacttgaaatagcatgagggttaggagaaaatacctcatgaatgtgaagggggattctcctgggcgtatgtaattgcaatgatttgaaatgctttcacaggtttgtaggagagggtaatttttcttctttatttgctccttttatcttgttctaaagccagtattacctcctctcccaccgcccatgtatacttcttattcccttctccttccccctccctttctcccactctccatgtaaagaaactctttcctaataagaatcataggtattcagagctttttttttttttttaattaacagttgatttgactttttagtactgtgtaggagatgggaaaagtcagggccatttgatagtaattgcttcctggaagagccgaccaacttattataagggtgaggagtgtttggaggcattattttctggttccaggtgtgttttgagta

SEQ ID NO: 42042 - DNA, 1046 bp, Homo sapiens
agaaaatctaatctatttggatgtcttgttaaatggagctttttgagtataagggtttctgaagaaatataggctgtcagagctgatagagtttagagagtctctgtgtaccattctttataaataaagacagccaaaagcccagagaagtgaggtgcttgatgttaagatttagttagtggccccctactggtctctgagctgcccatcactctaccttgactaatagtgataactgatgtttctggcaacaaatccaaggtacaagttttccagggtcttcaaaggaaagctacattatattaaagttcatgctgaatatcttttattgtgttctgatagtttgaaaattggttatttttgtactgttgtaaaactatagtgcttaactggaaaccccagcattaacccagcctttgccagcgtttcccttctataggatgagaaagttgttgaagagtgaggaaaaaagatggtatcttgtccttaacaaaaggtctacgtggatgaaaggagaaactgacacttattgttagggaaatggtaatgcttacatgatgatctaatctgggtttgagtttcgtttttgaagtcaccagtttttattttggtgtttttcagatattcttatagccttcctggggagatttattttttggagacatcgctcacattgtttactcctctaggttaaatgtactaggccatctgttgttaattttgtagttgtattaaattccatcctttggctggattttaagcaccaaaagcaaacttagacagaagcaggagcatttgcaaattacatagctttgagcctaaatggtggtttttataagtgcagttttcaaatgggctgagattctattttgagttttgggatcagtaatttaaacacagggacctctacgagttctctggaaaagcccattttgagaccctgaacagttgttatgccaaagcaagctcttggggtaaggttggcagtgatgctgctgataaattacttttaagatgcttggggctgaaggacaatgattttgtaa

SEQ ID NO: 42043 - DNA, 1050 bp, Homo sapiens
tacatagatactacattttttagttagatgtgttttggaagagcattgactttttttcctgttacattggaaaaatttaatggcacgtgtatgttattcttatcatgaagtgggtttaggcatgctgccttatactaaatagaaatcctatagtagttgtttttcagaagtaatccattgattcaagtcattcattgattcatttatgaatacttaagtatggttacataggtagggattgtcagaattggcttttgagcattttgtttagcagttataatccaggtggcaaatatactgtctgattcaattacttgcatgaaatcactttaaacagctacttaagatgagttgtccctaggcctgtctttatctacttattgtgcatgtgtgctagcatacacgcattatcattgttgttttttattgtgttaaaaaaatattacaaagtgtaccatcttaaccattttaaagtgtagatacttcagtagtgttaagtatagtcatttcattgtgaaacagagctccagaaatttttcatcttgtgaatatgaaactctataccccttaaacaacaactcccctcccttgttccctccagcccctggtaagcaccattctcatttctctttctatgaatctgagtattttattttattttttattttttgagacgggctctctgtgttgctcaggctggagtgcagtggtatggtttcggctcactgcagcatccatcccccaggttcaagtgattctcctgcctcaccctcctgagtagctgggattacgggctcgcgccaccatacccagctaatttttgtatttttagtagagacagggtttcaccatattggccaggctggccttgaactcctgacctcaagtaatccgccagcctcagcctcccaaagtgctgggattacaggcatgaaccaccacacccagctgaatttgagtattttagatacctcatctaaatggaattacatagtatttgtctttttgtgactgacttatttcacttagcacaatgtcttcaaagttcat

SEQ ID NO: 42044 - DNA, 1177 bp, Homo sapiens
catccttttgaagctgtataccacaggttgttggctagttttccaaaagcaattaaaatgcccactgttataattaagcctgttactagttgtatgttctagttataaaatatatttggcaattaaggaaactgagattgaggcttttggcttggctctttgagatgcagtagactggcttccaccttgatctgttaggatgactggtgcggatgcctggatgatgggacatgtcttagtccttgagtacctatctttatgagtaagagcaaccacaggtttttacaagaaagctaaagttagagaatgtgactcgtgtcctcacatatgccgattatgtcctacttggtatacaggagtcaaaacctaaacttctaagttgcagtctcttagctgagaagtcctttttaaagaagcattcccttatctttaagaagatggctcgactctgactgtgaacatttaatctgttaaactaacacctccattgcgctgtttaaatttctgtctggttgttgaaaagaaggtgtgggagaaatgttgcaggtacatgtggttaatgtctgtttctgaactgtatttcatttaggagttgttaagctgtgtgcccaccatctcagagacagatttgtctgaactggcctgtggaggaagatctcattgtcagggctggtctcaatggcagatacagttctcagtggtgtgctttgcgtgtcgtgtcttttattcttcctttcctcctgctcacccttaggaatgtttcctttttgtgccttaacaccagaacggtatggtggctgagaccatgggacaaatgcgtcacttagtgggcagatagaaatcagtatttaaagtatgattgaggtttttgtgtttattttgaaattcatttagtacacagggaagaaaacagcacttggcttatgtggttctatcccattgctttgcctgtttgtgcccccgtgcaattaacatgaaaatgatagtttaagaatgagctcattaacatttagaactgggtaggaacagggcttcataggatgttaaaatcagagaaaaagagaaaagagcaggtgctttgtaaatactatgtggttttgagaaatagtagaaagttgggtcttattttaaatttccttttttccagagtccctttaaagttgtgattaatgatata

SEQ ID NO: 42045 - DNA, 1197 bp, Homo sapiens
tctttgagagttcagcttcagtttcttttgcccatcagtgtattcccagtacctaatttatataaaaatttgtggaatggatttttagggtatctcttgcctatcacagtgagaagagctgagaatgaagaatacaggactcagtccttgtcctgtgttatgcaatgtattacatagttatagtaagtataacagcctgagcacagagtgctgtgagctttgagaaataagctagagatggtcatcacagaactggatcttgaatgataaagaggagttttgttctgtggtggagacaaggaatgatcttctaggctatcaaagcagggtgagtgaagttggagagatgtagaaatgagttttgtgtttggatgtcattgagtgattttgatttggctgctagagcacaggtacatgggaaagcatgacaaaggggcctgagaggtagggttggggaggacatgtgaaacatatgttgagatctgattggtaaagttattgataggcgtttggaccttgtcttttgggaagcagggaagtagcaatatccaaaagagagtgcttaaggatggattggaagagggaagattatagaggggatagagagcaaagcaggatgtgactttcccagccttgaaatgcatgagaaagtttgggatcctcacaatgaagggcaaaaaaaaaaaaaataaaaagcaattctgtttatggatgtatagcaatatattgtgtataggtggtggctattagaagactagtagttcttggaactgttcctttttttctcacaatagtagttaagctgtgtcattgggatacaaagggaaggagaaggctatttccattcttagaatagaaaaattggaaaatgccttggcaaatggaggtattcttattctacattttttttttttttttgagaccaagtctcgctttgtcacccaggctggagtgtagtggagccatgtgagctcactgcaacctccgccttctgggctcaaacgctaccacacccagctaatttttttatttttgttttttaagagctggaaatttgctatgttgcccaggctggtcttgaactcctgggctcgagtgatccgcctgccttgtccccgcaaagtgctgggattacaggtgtgcaccactgtgcctggccataccttacaggttaagcagctatgtggccttgtgcat

SEQ ID NO: 42046 - DNA, 1044 bp, Homo sapiens
ttttccctacaaatgatatccacagtactgctgttgtcttgtgctctctggatcagcacttttccagagaaatgaaaacactgcacttttaacggcacagaaagcaaaattactgtagcatcaggattcaaggttacagaattggttaactttctggtttgttttgctgagctgaatgaaaaagatttgatcgaatgttactgcttagggataaatattaataaccacaaactctcttagtgatcattgtccccccttttgcagaaaatttcaaattatggtctaggacttagattgtgattgtcagctgaatatgggcgtgaaaaatgtggaataaccagataaaggacccttaattggttgtagaggaacaactttttggggatccatgtccagagagggaattggttctggattattgatttgtatcattactttgattaagtgtctagcagttgctgtagacctttataacattatataatagaaatggtattagaaaaaagtcatcaaaggtaggatttttttaaagatataagaaccgaagtttttaatcttcagtccttcatagagaagaatttattaggtttgagagttctcagtaccaagtaaattctaactgcagacttaaaacatatgaatacactcacatatagtcaccccatcctctggcctggttttgttctctattatagttgactttgctttaggggaaaggagggagagtattggtattaatttatttgaaaaattagcaggagtatatcaaacacttactgtatgccaggacttaccatgataaataagaggtggacccctgtccttatggagcccacttgaatcaaaaagtaaacatatgagcatgcaaatagatggctgtaagaatgtgatgggcatgccattttttctagcaggttgcctaccacatagtctatatgtgttagagatacacattaggtacacagaagagggtccatttgtggcatagagagagattagaggaatcttcatgaaggaagtgacatgatgatgatgttttgaatg

SEQ ID NO: 42047 - DNA, 1075 bp, Homo sapiens
tgggaggtcgaggctgcagtgagccatgatcatgacactgcactctagcctggaagacatagcccaaccctgtctcaaaaacaaaacaaaacaaataaacaaaaaacgtgggctttgacagagagacttgtttaacttaattaaacaagtgccacttaagtgatttggggtgagtaattttagctctctaaactcagtttcctccactgtaaaatggggataatattgatgagtggtttaattaagaaaatgtatgtgaaatattgagcatggtgcctgacccatagcaaatgctaagtaagtagtagctgttattacttttattaacaagtaacatttgtataacatttatgacctacagagccctttcacatgctgtttcttatttgtgaactgagtgttttatacagaatgggtttttaaatgttccataggctttttattcatggcttcaagaggttgttccctttttgggacctgtacagcttgtgtatactcagttggcatttgtcacgtatcttcatgccagtgtctttgtatctgaattctaaaactgcgtgaacacaaaggttatgtcttttgtcttattcatctgggttgtcactggaacagagtcaggagacattcctatttattatgtgcgtaatcgtaggcaagtcaatctctggcttgccaaagctgtcctttcctcatctgtaaaatgggtaacaagtttcttgtgaagattacgttaaataatgcattaggaagcactttgtatagaaaattacaaatagttttttgttttttgttttttttttccgccatgcctcactagcctagtatcacagtagatgctgtaaggttggaggttgttaggaaggctatagagccaagtcttaactttagtgtcacaatacctttgttaaacaatgaaattcagtctttgggggctagttgtcatgctgggtgctgtgccaggctaattaatactttggtaccttgcctttaaagtacttactgctgctgtctccctccctcccctttggtattcattatttatagtataaaacatttgctgcttgctgttgtaaag

SEQ ID NO: 42048 - DNA, 1102 bp, Homo sapiens
taagggcatgactggcatgttgaatcttgggtataaagctttctgcactataccctggggacaaacaggatagctcaactggagaataaagagcttgcaagctcaaaagaaaacaacaaccaaaaatacctcaaccaaattctgctcttgcttctatcctactgtttctttaggtgtttaaagggctgtagttttaaaaatctcccacccacctcatctttttaagtaaatgtcacaacagtactatgtcaatacagttgaaaataagtatttgagttgaaagaattggctctttgaggctttaactatcagatttgtgctaattctttactgtttccttgacatagtatatgcagtctgtgctaagagagtatggatgttgtcgtcggtgtatagaatggtggctgttgtaaacttctgtatgttggggaaggattgaacctgctgtctggagaattagaaaccagcagcttgacttaaatccctcagtgtcacaaccagctaatgaaggagaggactgctaaactcccagtggtctttgtggctacgaggacttactcaagtttgagactatctttagtgggccaatgacgtaggaacacaatcagcagaggacatgtagtttacagcagcctgtaatgtgccagagacatgactagctgcctctttggccctggggaagtgtgtctggccctgcttgcatcctctgtgagtgggaattgtgccagacaccagctagacatgaccagctgcttcttcgatgttctgtggacatgattggctgtagcttttgatcaggacagtgttcctaatgaagtgtgaccagcgtcatttagacaggaaagaatgacagctgatgtgcaagaatttttcttgattggcagcatttggaactagtaaccagagaaggtaggtggggggaggagaagccagctctgattgacaagagcttatctttatttaatctacttctgaggcactgaagttgaaatcttaggcaagtgaaagaaaggaagacacaattgtgaaacataattaaagattcttgacaaaaacatacttaaatcagaaatgtcttttttttttcttttttgagatggag

SEQ ID NO: 42049 - DNA, 1797 bp, Homo sapiens
caaataggcttgggaacttggcatcctggattcgaatctgggcaccaccattttccagctcattccttcttattcaactccaccccacctcgaaccccgatttggttttaaagattcacatactattgttttagtaattacccttgaaataaagtcacatatacttttaagtctaaagttaatccaggacaggtgcggtggctcacacccataatcccagtactttgggaggccaagttgggcggattgcttgagcccaggagttcgagaccagcctgggcaatgtggcgaaaccctgcctctactaaaaataaaaaaattagctgggtgtggtggcatgcacctgtattcctagctacttgggaggctgaggcaggaggatggattgagcctggaaggcagaggttgcagtgagccatgatggcaccactgtactccagcctgagcagcagagcaaaaccctgtcttaaaaaaaaaaaaaaatccatagcctaaccaccttggataatacaagtgactaccctatatctgatcatactgccaccccaacctaaatccagtatttgttttgccttttttttttttgagacagggcctccctctgtcactcaggttgaagttcagtggtgcgatattggctcactgcagcctcaacttcacaggcttaagtgatcctccccacttagcctcctaagtattaggcatgaagcaccacgcttggctaatttaaaaaatttctatttttgtagagacagggtctccctatgttgcccaggctggtgttgaattcctgggctaaagtgatcctttccacctcagcctctgaaagtgctgggattataggcataagccactggtgcccagcctattttacctttttttttttttttttttgaggggggagggcagatggtcttttagatttacctatgtatttgacaatttgtttgttcatatttctttcttgtgtctcagaccttccttcaggtttgacttttctttagaatttccttgagcgagtgcctattggtagtaaatgctcttttttgtttatcatagatgtctttcttttgcccttcatctcaaaaggtagttagctggatacacagttctagggggaaagattttcttctctttgagtcttgtaggtttgttgtgaagattacctgggttcatatctaaagcccttagcactatgcttggcatgtttgctctgtaaataacagtggctgttacattctcagaaaaatactggaacagttggaggcaatgcaggcttggttgggatgtccatactttgactaactttttacattattttcttaaaactttgatttcattgagattggggtgggagtacatttaagcatcaaaactaactttgaagatagatttgattgaactgtgagttctatcactcgctagttgtatatacctttggtagattatcttacctgtcctaagaatcagtttcttcatctatacagtgatcattgtaatacttcctatttctctgagttgctgggaaggttgcatgagaacacatttaaagctcttctccaagcctcacatagtaggtggctagttgtggtaattatttgttgcctgtaaaccacttttatgacttttatgtagagatgttaccaacttgtcttttttattgttgttgttctagctattctgtttttatttgctcttccccagatccacagaaaagatggggtatctcctgcacaattaactttctactctactgatggggaaggccttctgcagagttggtggctcttgcttgga

SEQ ID NO: 42050 - DNA, 1060 bp, Homo sapiens
cgccccacacccggccttaatgcccagacagtgcccctgtactgactaaggagcctttcttttgagttcactggtctggcactggctcctagaagtgctgttttccagtgacagcaggatatttggaccactgggagagtcagtgggctggggtgggcccttgctctctgcagaggtgttctttctcccagtgggaggaaacaccacttgtcagaacacagctttggcttgcccaggttcctgttgtgcagatggggcctagagtctctctgggccccttgtcatggatccaagccaaggctgtcgcttgctgagccaggaataatataggaattagtctttttcttctttatactaagcactaatcaatctacagttaactctgtatctaatttctgaaccagatgccgtgaataactgcccctgaatgtgtttttgccaataaaaggataagtttaaggcttttaatcaatgccgcttgcactcagtatttaaggtcagaatcttgtgtgcgacttattttgatcaggataattgttgggttaaaaaatgaacggtttttgaaattgtgacactcgcggttgactcgtgggtgaattaatctttgagaggatggaaaattgtcgagttcataagagttctcttgctctctagttgtctttcaggtcacttatggaaaaatatgacttttaggaggaaggcattctttttcaatgggaaaggagataagagactaatagaaatttctaaggagtcagtgatggaggctcaggggaaattggaaatgaagctgggtgttttggatctgcggtgagctgagggactggaacagcagctgtgtatgttctaggtaatattaacttgttgtaattttatgtctccagcatacctttttcaaaggaactcatgtttcctgaccaacgactgtgtactgtctagaatgaagcatagtgtttagaaacatctggggtttagatattggcttcactgaatggcctagggcaagtcactgagcctctgtgccctcagtttttataattataaaatgggatggtaatag

SEQ ID NO: 42051 - DNA, 1070 bp, Homo sapiens
gtgcagcgtggaaacctgcagcagtagaagtgacaaaaggtatgttggtagcacggaagatgcagtgctagttccgtgtggcaaagggtgaaggtgtcttagaggactccttggtcaagaagagtttggaggacaacagggagtttgcctagtagacaataaggcagattactggggcagaggaacagtggtctcttggggagattaggagctgggaatcaaatttcaagatcaggtttttttatttcggttcagtctcatacctgctgcctgtcatgtgaccttttttttttttttgagatagagtttttggtcttgttgcacaggctggagtgcaatggcgcgatctcggctcactgcaacctccacctcctgggttcaagcaattctcctgtctcagcctcccgagtagctgggattacaggcatgcaccaccacgcccaggtaatttttgtgtttttagtagagatggagtttctccatgttgatcaggctggtctcgaactcttgacctcaggtgatctgcctgcctcgccctcccaaagtgctgggagtataggcatgagccaccccacccggcccgtgacctgactttttttactgagaagaaacagaaatggggatccttatgtcttcattccttttgtttggcataggaagctggactgcatccaaaattgttaccttgtgcaatttctggataactgaagcttacacagcctgaagtgtacacaactggttaatgacagatccggttcaactcagaaattcacatttgtccagattcattcagttgccctataatcttaagtgttttttctgatgttggattcattccttctcttacttgttcaataaatgtttgccaagtatgttataaacaactgtgcagtctgatagaggtataaggtcctttctgtcagggaacttaaagtctttttgtttgtttgttttggagatagggtctcgctgtattgcccagactggagtgcagtggcacgaacattgcaaccttcatctctcagacttaagccatcctcccacttcagcctcctgagtgacttggacta

SEQ ID NO: 42052 - DNA, 1061 bp, Homo sapiens
gatagggccatgctccatccacaggtcctgggaaggatgatgtaactgtggtctaacagcattgtctgaatttttggcctagggcaaagaggaggagggcgggtaaagaaacctgatcagaccatttgatgctaatttcacaggtgactggtcactgtgtgcctggctgttgttatttatagagctgtaagtggctggagctacacacaggaacctgaaaggatggtctgtattagagtgtggtggtagatagaagcacagcagtagaatctagggacaaatggtcactggtgagtgtcattgctggagttaaatgagactcattagtggctgttatgatttccactcttacttcattgctattcctgagtctttttgaaagcaaacaacaaaatagaccgaaacaacctctgatagactctccgttatttttaattgaggttgataggattttaatcaggtcaacttgcatactgatttcaaccaccatttaaagagctatccacaaagctataaattagaattatagttcaaaaggtctgactgttttaacctactgctcctattccccaaattattgatggggaaactgagatctagcagggttaaaaaaccagcccagtttcacagttagcagtgatgctggagctgtgatctggatcttaaatctctcagtttagccttttctgttttctaccgtattagtcctacaatgaaaatgcacttctctgtctttaaatttcagacgttgtctccatggcctagatgaaggttatcctttgttatgatattttctcagaattactttgaaaaatggttccattgttatttcttaaaatgaaagtaatatgaaaacaaattccttctattgataatacatttgcccactactgatagttttaggaataatgagaaaagagggggccaatttatggtattggccaagaaggagcgctcagcagcactggactgctatgtgtgggctggaggtaccagcagataacactcggaggcagtgggtcctgtgaatcacagcttggcctcggcataagctctggaga

SEQ ID NO: 42053 - DNA, 1046 bp, Homo sapiens
tcgcggcccggctcacacctgtaattgcagcagtttgggaggctgaggtgggcagatagcttgagttcaggagtttgataccagcctgggcagcatagtgagaccttgtctctactaaaaagagagatcagctgggcgtggtggtgtgtgcctgttgtcccagctacttgggaggctgaggtggcaggatcacttgagcctgggagatcgaggctggagtgagctgtgatggtattactgcaggtggggtgacagagtgagaccccatctctctctcttgttttttttttttttgtttctttttaaaagaaccttcattacattaattgacttccaaggtctcatccagtcatgatggtttttgcatggtccctaccagtagaagatggatttcagaccacagggaatttatttgtagctacagtcaattttcaaattatttgccttacaaatgttttcaatcccagagacctttttcccagctggttcctgggttatattgccaaagtccctggttggtatgcactcgagaactgaaagataattttcttcttgattttaagaaaagataattaaggagggaaatctaccattaaaaaaaaaatcagacattacaaccaagtataacttttagagcagatcctctattgggaaggagcaatatgttatgttaccttgtatttgagcagttaattagggtcagatgtagttagttctcatgctttggccttgcaaaagtaatcccctttttggaaaggctttgttgagtccctaggaattattttaatggtctctaagtatgtttaactcagtcataatattctagttgtttggatttgttgtgtattgacattgacttagatattctcccctgctctgggctttacctcttactcgtacccaaatccatggtccacatgctgtggtgtcccctgggcatgcccagccttgccatgtgtgcaaggtaatccctttgaccctctcaagagggtgctgctcatcttttttttttttttttttttttttggcttcacttatcccacttg

SEQ ID NO: 42054 - DNA, 1052 bp, Homo sapiens
aagaaggtggaagttactttgccaagagtagcaggcttgggggaaactaaaatagaggcttcaggggaagggcagcagcatggtgtcagagattacacttggagtttgtgaagtctgggcaggcttcaatctaaagaaactttatgcacaaaagcccaaatccagggaaataaatgaaagtgattattcacttttctaaagtccttacagtagcgttcctctggtattgtttgaatacagtttaacctgaagggcacttggtttttgtgcagctcttcaagaacagaagcatctaagtaagtagaaagtctgagaaattaacagagaagattccctaaaagtcagccttcattacttgaccattattcataattctgcatttgtctattcctccagtggccttgaagcaaaattaaaaaaaaaaaaagacacttctatgccccttaaaaaaagaataatcaaaacttgcatagacagaataagaatcaaatacactggggaacaaatactctgattagctgtccggttcagctctgacgcgtctagcactctgagttataagggaaacgataggacacttggtttttgttttccaacaacaggaaacatatcaggtttctaagaagatgtaaagtctttcttaaaacccaattatagaaggaatttatgcaagtctttaggcaaggagtattaaagaaattaatgtttaatgccatcaacaagttttcaagcagatgcagaactcctagtgtgggtgactttttggtgtttaccttatatcaagaatgcagcatttaaggccactttgacagagtgcagctaagctttttgggtttgcttgtgtggacaatttccattcagcaatggctctcaaacttcaatgcacatcagaattacgtgggggcacttaaaaaaaatgtatgcccaggctgcatccagaccaattcagtcagaatctctgatggtgagccccaagtatcaatattttgtaaaactgattccaaaggttagctaagtgtgaatcagtgcgttagatgatctttaacgttaat

SEQ ID NO: 42055 - DNA, 1055 bp, Homo sapiens
tattgtgtccagaggtttggggctgtaatttcataatgaaattgaaaaacatgagattaaaaacctgaatatagcacagtaattatatttaagtatcacaaatcatctccctgtatttagttaggtgtttgagatttggcctctttgtggagtgcagtcacgtcgtttcatacatctgcaaaatggaaggcttctaatttatggctaaaatgtgggaattgctttctcttaatgggaaggtgaggagaatggtattgaatttgaaggagctggtttgcttcattgactagagtcaagaagggaggttgtacaatagctgcttaaggtaaagaaatgtttgggtcttttcatggtttaattcccagatacttacacatgactatagtctctccctttagaaattaactgacataggctggcctgggaaattctacagtcctgcagcaaatggtgcagttgcagaagtgtgaatctttacctaaggcagggtttctggtatagataaagacttaactggggtttgtttcccacaggtaagttatggatgagctgtgcctggcccatttccatttactgtctgagaatctgcatgtggcctgcaggctctgtagttgggctgagtcctcctggagtaggaggctggggaaggtgttggtggtggctgtcgataggcattcctgcaggatggtgggtggagagttagggtgaggggtgttctttaataaaggaatagaaattagagtggaaagtggtttaaagctagtgatacctccttctccttgatttctaggaactatcaagtatgaaatgaacatagaaggaagttatgaaaggaatcattattattgtcagtgattcttgattatctactataggcaaacacgttaagttgttgttttttttttgttttgtttttttttaagacggagtctcgctctgtcgcccaggctggagcgcagtggcgcaatctctgctcactgcaagctccgcctcccgggttcatgccattctcctgcctcagcctcccgagtagctgggactacaggcgcccacca

SEQ ID NO: 42056 - DNA, 1038 bp, Homo sapiens
atgagagaggacagttatatcttcctttaaactcttatttggtgcagttgattgtcagatgcagagtgctgatgtgaggatggactgtgaatatgatccactgtggcagtgtttatagtctcagcccaatgccttgttgacttaagtagcagccttgataacaggagataaatctgcaaagatactgtgaggttacatggcaaggcttttaaaatacaccaacattacatttgtggcaagtgctttgctcaatgttggcatttttgaagtcaccctttacctctgccccctgcccagaaatttccttgtgagaaatgtttttacgttagacaaactgccatgggggaggatagtcagaaagaggagacaaataatacgcagaggcagacttttttttacatttgttgctcagaagaaaaaaattccaatgaagaatgaaagaggcttcatatcctgaataaagtaaatgatctgggtaggatggtacaggaatagaatgtgactataaaaaagaaccaaattgtgcagacaagaaaatatgaaggaaaaaagaataggaaaaagacagggaaaatgcaaattcttatggaatatttttgcaaatctgtgtacagaaggaaccaagcaacgcagatcagttcttctgaggctgggagttctaaaaattatgcagtatcaaggaaggctttcttcctgagtcaagtgtaggaagcagaaccaacctttatttctctatgaagatgtatattgtgatgtccccagtgagcaataagttaatattggatgatagtatttaggcagcagtgacagaaagttttctttctcctgactgaatctcacaccaaggtccctttttatttttaattgtttagtttaatttttgttttttgttttttgagacagggtcttactctgttgcccaggctggagtgcagtggcgcgttcatagctcaactacatcctcaaactcctaggctcacacgattcccccacctcagcctcctgagtagctgggactataggcacgtgacaccacac

SEQ ID NO: 42057 - DNA, 1046 bp, Homo sapiens
aatagtccaggacccaaatcccagtcttttgttggctgaactatatttgttatttaaagattcttttagcagtggaactcttctttaaatggagatattactagatagcacaaccaaataaaaaaagtggaaacttagctgctgtggtttaagtgggataggccaggcattgaccatgcattccctttattcagcccttgctgtggcttctgagaaagccacatggagcatagttttattttatttattttaatttttagtccctacaacaagactcacagtagggatatgattttaaaccctggctctagttagggatatgagctccagattgctctcttttgggtcacaattaaaatcctaaccggcaacagatatttttggtcagatctggtcattctctctgcctccgtacccattgggggcaaactatgaagcttttgtagctgcattattgtagatttgcaggatttctgttcgtaatcagaatcgggtatgtgttagaaaaaggccttcctgagtgtatgaacccctttgcctgctgacagtctctgggctggagttaacattaacatctgcatgcccagaggacagtgaattgctaacttttcactggctttctttttgcttggacattttacagtgctccagggtcatcattctgggcagtacttaccttgtaagtacctgattttggctcttttctcactcactagtctgtgatctagtcttctctctgtgtctgcagagttcagtcccatttctggagcaaagcagtagctcagtaaatgtcagtggagttttttgaatcactttttattattccagattataggcatatatgtatagatcaagtaggctgaatatgacttaatccccaagtttcttctataataggaccttattttatctctccaagtaatggaataaagggatggaagctggtctagttggggttgtagatttataaacaagacattaatctgaagcttatattcttttagagagttacaagaaaacccaagatctccccccatccccaatta

SEQ ID NO: 42058 - DNA, 1055 bp, Homo sapiens
atattgctgtaagtgagatgaaagtgaaaaaggattcaacatttaaattctatttggacatcagttattatatctaagtgatatatgaaatcatgttgctctagaacaatattaacagattttatgaggttcccttataggaatgaaaatttatacgtgtactctttctttctctttgacaccactctacccttttctccttctctaacatattccattaagaaattttactcaaacttatgctttgcagttggaataccctaataccgattataagtcctgaatcatttattaagtaccttgtaattgcccagcactgtgctaccaatgcctttcagtgactttctaaattcaccctgttaggtataattatcttactgtgtagctgaggaaacagaggcttagagaagtcaagtgatttgctaaggtcacttagctagggagtgttaaaactgggacttgaatacaggtcttagagtttaaagttcatgctcttaacctttatgttttacttcctccctgtattctcttgtacttcatcaacctgaattctttagagctttttgatctgttgggacctagtttgaattcttaagcattttattatttttatttgcttcaatgaaaggtaaaagatataacctagattttatccattgctagtttcttttagtgccatagtggttttatctgtcagcgtgtctgtgtgtttcttaatgttcctagcaaaatttaagatgtgatctagtaactgtattcttccaattgattcatctttagtgtcactttaattttatttttgaaaaattaacgttatcttctcatttctctgttggagtgtgattgagtgattaattcagcaattatttatagagcctactgtgtgataattattgtgcgagatgctggggatattcagtaattatgtgtttctttgttcttgtaattgttctgtgactttagttacatctttcttcagaatctttcaattcacaagtcatctgtaagatttcactcattttctatttctagagtgtagtccagaaaccatatgt

SEQ ID NO: 42059 - DNA, 1050 bp, Homo sapiens
gaggttagaaccataagcagggtcccagtcatggaaggctttatttggagattgaaattgattattggatagccattgaacattgtaagcaaggaagtggcatgcttaaacttgcactttggagatgtcacaatcctacaacaggctgaaaggctggagacatggaggccacttgggatgttgttaatggaagtccagatgaggaggtctgaattaaggtagtagcagtgtagtcacagtgaggtggacaacagatggcggagattaagaaggtggaatttgtaggtgtcagccccaggcattgcatctattttttttttccaagttgtggagacggagtttatctctgtcacccaggctggagtgcagtgacgcgatctcggcttactgcaacctttgcctccctggttcaagagattctcatgcctcagcctcccaagtacctgggatcataggcatgcaccaccatgcccagctatttttgtttgtttgttttgtatttttagtacagacggggtttcaccatgtcggccaggctggtcgcgaactcttgacctcaggtgtgagccattacgtccagttgcattgcatctgtttgatgttgggtatctaggatgtacatctgtcaactcgtgatgcctccctgaaccttcgatgattatctattgactataatctacccccaaccctttttttttttccattttcatctttcactgaattcctctgtggatccattgatcacgctttgcatatttattccttctcccccaaccccattcttcctggatgagctttttgctctcttttaaaccattgcacttgactgtctaggcatttgccagtatatcaaataagtatgtatttgaaagtctaggtgagcctttcttaaatactggatgctcagtctaaggtatccattgtgtttatggaattactttctctcctgtgtatctaaatggtactagtttgatacttttctgaagataattgagaaaaagtaactttgatctttttttcttctgtggttcagaagagaaattatttgtt

SEQ ID NO: 42060 - DNA, 1066 bp, Homo sapiens
gcggcaaaatcccttccttaggtgcttcctccactgtggtttttcgtaacaggtggagaagatatccttggtgggatgctgaagtggttgtccaacaaagctgtgtgcgtgcctttaaaagaatctaaaacccaatctcagctctttctatgaggatttgaaacttcagcatggtgccctttcagtcagatgtgctttatgcaacaaagcttgatgctaagtggtactggtatttagggcagacctgtcttaacagttgtcaagatggactggcttgcaggggagagatctttgcaattaggataaatggaacaggtggatttcatcacatacattgtgcatctcatggttctaaggtgctaaaatgattgcctgtgtgtgagaaatgccttgctaagatttatattttccggggaagctcagatattgtggcatctgggagggcaatggcaaaaaatgaatttgccttttggtgtcttagttgttctccataggctataattcaagactatctttgtgatctgttgattgtatgaacgtctgataatgaggcttactggcctgttaataattaggtttcaatgatccacaagaaagtatggctcttggcatttgggaagcctttctgcctgtggaaatccccacatgagatggattaataatgagatatgaagctgtttatagcagtttttctgcacaaatccagaggcttcagtgcctgtcaagttagttacctgtgtcctgggtgtgttttatttatttttggcaggaccattgggtaggattgactatcactgaagaaagcagaggaaggaattgtggtgtacagagcaggtgctgctaattagaggtggaataggtaatttttggtttgcagatgtttctctgcagaggcagggagatctgggatcaaacaaaacaatggttcccaaaccacacagatcttgagaatcatataatgagagctactaaacctaaatttctggcccctctttaggacctaatgacatttgtagttttagaaagtttcctatttgaaaacagtcagcctggttggaagtcactc

SEQ ID NO: 42061 - DNA, 1050 bp, Homo sapiens
aatgctgtaccagttctctaggtattctttaatccagtcaagttgataccctaaattaaccaacacagcacattaactaccacctcataaaataaaacctgcagagagaaaataagctgaatgggaaaaggaactgcaatgaaaagaatgggccataattcagcttgggtgatcctgatacctacaggagttgttccataaaacagtgaccttttatatttcccaaagtaagaaaattttatatgtgtatttgtgcatgcagaactttattaagggccatttaaatcccatatattgatagaggagttaagaaagataaagtgacaggagtgattctcaactctggctcccataaatttctacaatgtcagtgattgaagaatgagggagcacatctttcctttaataaggcctagccagtacacttttggtagttgatgagggtaggacagaactccctttctttatttgaaactgtgtatttttgtgctgattaaattttacatttttccctcttgtgatgatataaagttatctgcatgtggccagatctcagctaaagaacatgaaataagcctctgtacattctgcattctaatctctgttcacagcaatcttgtatccacacaagtctgtacatgacaggtaatgagtgggaagtgggaggagatgggtgtctgtgtggtttgcactggtggtggtggggaactgagcagatggttgtgatagccacatgctgcgtgattcccgtgggagttgatggtggtgacaggcgactcacaatgtgctatttacagtttgggtttgcagtctttcggtgacatctgaatgctctttagcaactgctttcattactgcctttcgaggagctgttaattgaaaatgaaattgtgggtgggctttaagacaggcagacgcaggcaattctgtgtggtaaatgttgcttgagaactgttggatgtcttcatgcccaatttgtaattcattttctaagactgtaaaagccaaaggtgcatttggagattcagttatgtatatacataggcagag

SEQ ID NO: 42062 - DNA, 1129 bp, Homo sapiens
cctggacaccttatgctatcctctttggaagaaatggttccccctctgttttttgaatgatgagatccttctagtcctttaggcttgaactgaaatgtcatctttcataggggcttttctcgaccatatggtttatttaactcaggatctgccatttgtcttctgtgttttgcactcacctttttaacttcctaacaccacatttataattatagatttttctttctatgtccttccttatgtctgcaccttctgctgcactccaagctctactgaggagagatatcacctccaccacagtgtttgtagcacattgcctggcacacagaaggtggcactcaataattaaagttgagtggtttgaataatttttgcaatggatgacattgctaattccacactcctgttacattccaactttaattggctacaaaaaaaagcacacacacagacacagacacacacacacagacacacacacacacacacacacacacacacacacacacaaacaatccagaccccaatacagtatgactgttgtcttctctctctggggatatgcaatgtaaaataagatactgatgagcgcatgctgcacaccaagcaaaaatttatcccaagcaacccctgcgccctgcgtggaccgtgtctgctgttctcccatggaatctatcagcagtttgtcttcccagggttgtagcctgtcaggatggtagaattgctagtgcagccaggaaaagctgacctaggaaaaccatagccttccatctttttagaggtaatccaaaagagactagacaagcagaaagacggagaggaaagttggtgggagtgaggtgaaattcactgagtactcttttatatgcaaatatttgtgtggggctctacttttttaccatgagtacaaactctttttagtatcaatgcatgaatagcgtgtcttttcactgaaaaattattgtcccacgtgccctcggtttaaaatgttttgatcttagaaaacagtttatttccttttaaagtggcccaattaattcattttccacatatttgctcattgagcaaacatcaactgaacatcgtttgtgtgcaaaccttatacaagaaactctgacataacagggag

SEQ ID NO: 42063 - DNA, 1056 bp, Homo sapiens
aaatgctgtttattcaataacattcactcctccaaggatactactcactgtcccttgacattcattcattaaatatttattgttcatgtactgctatggacagacataattttgggtgcttatattagtgaacaaaataatgaatacatctgccctagtggaagttacattctcttcatatattaaattctcttagtagtatacagcttccatttaaatgtttaacccagacctttcttctcaacttctagattcataaactcagctccttatcagagttttgctgcctagatcattcacaaacatttcaaactcagcatatctcactttgaaatctataatggtggtccccaaattgctcttcctcctcaatttccttccttactgtgtgcaccatctgctaagcatccaagccataaatctgttcatactagaaacctgcaagtcaaactcctcttcccctcttccccccattcttacatcctatagatttttatcctatgtatttcttatctgaccctctctcttcaatgttttctatccttcctgcgagtgcagtagttcaggttctctttctcttggaggtgtgatgactagcttctcatctgacttctcagcctctaatcttgccactgttaaattctgctcctcaaattcctccattattgtgttcttgacagcatgcaaattgaatcgtgtcatttgtttcaagagttttcattgactttacttataggttaatttcaactttctttatatggtatagaagcccacacatttttttgttttgttttgttttagagaggatctcactctcttgcccaggctggagtgtagtggtgtgatcatagctcactgcagcctccacctcatgggttcaaaatgtccttctgcctcagcctcccaagtagctgggactaaaggcatgtgccaccacacctggctaattgtgtgggtttttttttctttctttctttagagatggaggactcactgtgttttctaggctggtgcccacacattttaatgcctttcagagcattccctttttttttc

SEQ ID NO: 42064 - DNA, 1733 bp, Homo sapiens
tttaatttgagattgtgtgaattgctttcctagtctgtacaccagaaagaatgcttctctccttacacatttcgacacttcttagtgaagatcatttacttatagagtgtatgcattatattagcatatggcctgggtaacttcagacttgttaacatagcgtgggaaaggttactgaaagcatgaggaggcagtatattatctctcagttgattttgtacaccattttgaatattttctgtacattccctttcctctagtgttggtttcttatacttatagtaaagggaaactgatgttgatattgttcaaaaaagaaatgaagtgaatttttgtatttttaaagaataaattaacatgctttaaagtgcttaaccagttgttacaatatcagttatcacagattggtatgcgttggtccatgttatgtatttgcctgaatcaaccctaagactggttggcttatttctgccttttcttttccaaaaggtatacttgacatgaagtagactgtgcctgtttgattttaagttttgaatatggtgggaggtatagattaaagttaatttcttttgcatatggatattcaatttttctgaaggcatttttgaaaaagctgtccattctccacctttgcattgcctttgtacttttgtaaacaatcagttgtccatgtatgtgtgagtttatttctatactctctattctgttcctttgatctatttgtctatctttatgcctatactatactgtctttattactgtagcttgctttgtagtaagttttgaagtgagataatgttacatagttttggctttttaagattcttttcactagcgtatgacttttagaatcagcttgtcaggttctataaagaatctggccaagatgttggttgagattatattgatcgtgtgatcaatttggggagaattgacagtttaaaatattgagttttcaactctcgaacaaggtctatctctctatttagatcttacttatttccttcagcaatattttgtacttttcagtatataagcctttcatatattttgtcagatttattcctatgtgtttcatatttttgatgcagtattaaatggtggtgttttttaactttagtttccagttcactatcaatatgtagaaattcactgatttttgtatattcacttgcattctgcaaccttgctaaactcacttattagttctagtagttttttttgtaggtcttactggattttctacatggatgatcatatttttagtgaatagaagcagcttatttctttcctcctaatctgggtatcttctctgtctttttcttgtctgatttctctgtcaggaacttacaggatcatgtttaatagaagagacaagactggacactcctgcccttttcctgattttagggggaaagacagaatcttttgccattaattctgagcttagctatacgtttttcatagtgccctttattaggttgagaatgttccattctaagtttgtcagaattttaatcaagaatgcatgttatattttgtcaaacaccttttttttgtctatcaagatgatcatatgatttttctttttttgtttattaatatagtaatacattgattggtttttaaatgtgaaaccaaaatgctttccttggtaaactctatttagtcatgatatattaacttctaaatagattgttggatttgatttgttaaaaatgttttaaaga

SEQ ID NO: 42065 - DNA, 1042 bp, Homo sapiens
gaatccatctgggcctagagttttctttctgtggaaaggttttaaatgaaatattcatgttctttactaaatattgaactatttatgttatccatttcttcttgagtcagctttggtaatttatgtcttttcaaggaattttttcattttatcaaagttgttgaatttattggcataaaattcatataatattccttcattatccttttatatctatagaatctatggcaattctatatctgttgatagcctcctttcctcccctcttctctctctgtcatatcagtatgactgggagtttattaattttattgatcttcttgaagaacaagctttattttcattgatttttctctgttgttttatatttcattgatttccttctttctgcttactttagttttactttgcttatttttctggcttttaaaagtaggagctgagtttgttgatttaagatctttcttctcttctaatatagccttttgatgctataaatttacccccaaatattactttagcagcaccccaaatattctgatctgtggtattttcattttcattcagtttagagtactttctgatttcccttgtgacttctaattgaaacactccaaatattttaggggttttccagggatctttctagtattggtttattacattaaatcagtcaattaattaattaagagacaggatctcaccctgtcatccaggctggagtgcagtggcgtgatcatagctcattgcacccttgaattcctggtttcaagtgatcctctcatatcagcctggcttttaaaaatcttttgtagagatagtgtcttactatgttgcccagcatggtcttgaatccttgctctcaagcagttttccctccttggcctcccaaagtgttgggataacaggtatgagctactgaacctggcctggaattggtttcttatttaactccattgtgatttaagacagacaaacactttaactgggtatggtggtgcgcctatagtcccagctgcttaggagatggaggtaggaggat

SEQ ID NO: 42066 - DNA, 1027 bp, Homo sapiens
gttctctcttctctttcccccttttttcttcccctccatcttactttcccttctctctcttctcatttgatataactgacagatttgagcagaactgtgaggctcttaggagctgtgtgtgatgtggagtggccagatgactttatgtgagtatgcacgagggactgtaaagaggctgtccagaggccagcctccctccaggttgttcctaaccctggagagtcatcatatgttatttctcatctcagactgccacagaattgaggagggagattgaaggcagctcattaaaccactttggccacagataagagtgttaagagattaagaagtagatttatctgggggaggggtttggtcccggatgaagccttttcctgccgtcggaaaccaaagatttccttgtctcttttgttctgatccatggaatggtgtggcttagctgcctctaaatctgttttggcaaggttgtttgtaaggagacatggcagggtctgtctggagggaacagaaaagagagtacatattgaatgtagatgcttgaaactagatcatagtttacctaattgcagaccttgaagaaactcttggggccacttggatgggggtgcttctggaagtttgtctctgggggtatgtgagtatggacctcttccacactgagaagagggcagagcccagtcatcagttttcatgtccctgagtacaatattaggcttctttttattattatcattatttcaactggtaacaatgtttcccctcaggaaatgtctttacctctctgaagagaagaccgtgatgccagctgttagtttgagaaatgctgcagggtcctctcctacctgctgtttctgtgctctttccatgtgttgtggtgaagcccctacctctccagccatggggccttgttcttcatcatttgttcctatcttcagtttgggatgtggcaaggagaggcagagtgcactagagaaatctgatactgtaatgtgctaggagacagcatgatgagaggttttgggtg

SEQ ID NO: 42067 - DNA, 1032 bp, Homo sapiens
aactgggaagtgaagatcttctgcaacacaggagtttctaaaggaaaaacaattgggccagactggatgaactggttagattaaatgctatcttcctgactcagggttattatttttggttgcttattttatttttaattgttgaagatttattgtaccatgctttgctcaggacagtgtgtaaggtatttagggaaagacctgaaagagacaggaagcatgagcccttccatcaggcacctgaataactgatggtggacatattgagaatacgtagaaaatttgtatcttatggtcatattgcacttcagacttttcacaatgcccttgtatctctgttacttgattctagttttcttggctcagcatgcacagttgttttctttacttgtttatggtctgtctctcccacttaaatatcaggtccttgagagcagatacttgttctcagctacagcccagcacctagatcaatacctgacatattgtgggcactcagtaaatcttaggaggataaatgaacaaaaaacctatcttctgaatatcagtgataatcatataaaacaggcttggtatgctaccatttatgtacttctgattttgtgttttgacaggttttcacctaaggtttgtagtagttggttttcctcagagaagtttttgggctatttttctttttaagaaagggtgagtgatgtcattatgaagttgaagctataggactaatcatatacttgccctgcatctatggtgacttttttttctactggaaagaaagcccgctattaaataattattacttccaggtctgagggagactgtccagcatctgcaagagttttgctaggatgcagggctttgttcccccactgggctgtgattccatccatggagtaagctgcattgtggtagcaagtcatcttgacagtggcaagtatagcatatttcaactggtgatttctgcatgatttgcatgaatttctgtatgacaggagtcacaacaaaactgttacgtgacttgtgtctaaagct

SEQ ID NO: 42068 - DNA, 1034 bp, Homo sapiens
taagtttctacttattttagatactgtaatataaaattataaacaaggcccaattgttgttacccactaggcagatttttttattatccaagtttctgtttcgggccatgaaacaagttaaaatcaaaactttcgctggttgccattttaaagataaatttgttatataggctttctaagcttggttgccttgctccacaaagacaaaacattaataatagcttacatgtattgagcagtgaatctgtgctaggctttgtgttaaccactgtatatttggattatctcattgatctaaggtaggtacggttgttattcccttcttataggttaggaaactgaggctcagagagattaagtaacttgcccaatgttacacagcttgtaagtggcatttctgtttaaagcttcccattttataaagttttgtgtttttaaatatgctttagaattttaagtttttactctgttattatttcgcgaagtcctatgtctacatacacatcaaagcaattctgtggttcttagggaattatttaataaatgaaatagccatagactgtaattacattatgagtggcatcttttagctgtgcccagcggtagcccagttgctaatctttatcccttgagtagtcaagtagataagaagtggataagcaagtggagtggtggccactcaagcaggcctccaccagaataattccaaataacttcacacagtgaattgcaacccactcaatccacttcactggatagcattgctcaaaagatattcttttactcttttatctaccttgttggcaagcatccccaagaggtcttatgcctgtggcctacagatcaaagatattttctcaaatactgggaactttgctgctagttagaattaagcaaataaaaacatacacctccagaatgtaagcaaactagtttaaaacactccagccattgtattacttatgctttaaaagtttccccacaaaacctcattaatcatataaatattttgacaaacagaaaggggacagagc

SEQ ID NO: 42069 - DNA, 1031 bp, Homo sapiens
tatatagtctaaacttagatttgattctgtttagaaacacttaatgttcctaatgttatcaggaaatttgctgttcattttttcaagatctgagtagaatgtcacattctccatgaactttccatgatgctcttcttccaaatgtttctgtagcacctggttgtagcctggctcttaggattcccctgtctgtgctctggacttctttagaagcaccttgtctggttcagttactgcctttgtttgtattgctggcacattcctttgtgcttggtgcatagtagataattaatagatatttgttaaattgaactggatgcttaataaatgtttggatctaattatgatcttaactctggtgtgtacttcaggtacttcaggaaggtcattgcagcattagatgactatggagaccctcagtgttttagactgagatgacttgccattcctacaagagatcaattgaatgaataattggggctgatttttccctaagtattgcttagaacatatactgttttttttctcctcaaaaattgccagttatattgccatactggacaaaataaaactgttagctatatatctatatctatacctatataaattttaaaaacgtagcacaaagtttctgcaccatactttgtgagcagctctgtgtattccaaggctcagaaaatcagactttcaaagctaaattttaccaatatatatcccattgaaatttgcatgagcaagcagaaataatgtggatgttggagttaggtaaatgaatcaaatcctggttcagccactttctaggtatgtgattttgggcaagatatttaatttttttcaacatagtttttttatttttaaaatggaaaagttatgcactggcagatttggaggatgaaataatatgttgggagacagtgtgttaagttacttctcaaaaagttctattataattataggttgctaatttttggcatattttcattttaaaacttttattctaatttcattcttaaacagtgtaagcatattca

SEQ ID NO: 42070 - DNA, 1047 bp, Homo sapiens
gtagttttctctcaagggctaatatttatatttttttgcttccaaaaactgttaaagtctgaaagtgtaaatttatatttgtggtgtttactttgtcctttaaatgtttttgtgtacccatactttttgtcataaagatggaaaaatgatattaaattaaccaaatgaaagtaattaatgctgaacattcactaaattattaagatgttaatgtgattccaaatgcagatagttcatgggcagcagcatgtgtcctgggactccccctcaaaggttggcaaggtttgggcaattttgagggagggagttaattcttaagtagtaagctttttcgtttacctctactatttataagctaatatgcaggatcattgtaaattagtgaaaagtgcattccattgaactagtagttgtaatactgggttaaatatctaagttgtgtgactttgggcatgagtttctgcctctgtgggtcttatttttccctgttatcagaactgtagcattggactagatcatgtttccttgtgtgttttttggaaaatgtgacaatatactaggacctacatgaagtcacagtataaacacccaagggacacaacaggcatatcttcctgcctttcatatctattcacttgaggcttttggtaagacattaattttatacttaagcaaacatattaaagactgaaaggaactcatatatcttcatatagtgttaaagatattaacacaaaaatgaaagaaatattgtccatacagcaggccacagatagatatcccttgttttgtgatcagtcttttctgctatggagggcactttggacacatttgaggatcactgcattagatgacaggaaatgtgtttcttcctatgctcaagttgtgtagccatgacatttgaggatatttacattttgaatttccctcctccctcccctaaattagtggcatgttctagagaagggttcatgtgctttatttacataaaacctatctcaatgttgtttgataagaatctgttaagagatcttgtcctaaaaggat

SEQ ID NO: 42071 - DNA, 1049 bp, Homo sapiens
acaaagggctaggagtccagagactgacactgtgtggccttctctctgggcctgtttcagatagtcactctgcaactacaagatggcactggattagtgattctcagacgtttttctgcaccaaaatcacctaaaaggctggtttaaccgactgctaggctccacctccaaggtgtctgagtcggtaggcctgaggaaggcctgagaatgtacatttttaacaagtcctcaggtaatgcaggtaggcagtatgactggattgtttttgtggttgcctgcctctttttggcattggaaaggggaaagccagagtattccttgaggaatgacatttggagagaaccaaattttagatgcttctgtgatatgtacaccagagctattctggactagattgtaaattctcacatttcacctatgcaaaaggaaatactttctggtctcctattagtaatcagttgtctcaaattttgcccgttacctctggaaattctggaccctcaagtgatcagtcttttaaggcagtgtggaagaacagcacctattatggcagttgatttttcatggtctctaccctgtccttcctaatataactgctattctttaccttcctgtttttcaaaactctcgtattgttcctgttgtgttttttctaaatattttcttggttacaataaagtgctaatatttaaagagcttttgggagcctgctggtgccagaaactattcaagttacttacagaatactctcattcagttctctcaaaaatccttggggaagttttatttttctcattttacaaatgagcagtaattacaaatttggagtcagagaagctaagtaatatgtgatctggacaatttcaatatctatgtatatcaaaaaccaagcttcctaggtctttgacctcctctccagtatccctcaccttcacctgctaagtatccattctcattttggatctcggactttgttatcacctaggattcgcccaggatttcactttctcggatcatgaccttccacatcatactgtcactgcatctca

SEQ ID NO: 42072 - DNA, 1791 bp, Homo sapiens
gaaatactattagactgttaaggtgagtgtagaggacaatgcttcttcaaaattattacagggaagtttataataatggtgactgacttgaggtaggggtagggtttttcaggagggtctttcagtggtaatcacgcctaaaattttgaatgcttaaatgaagctgctgcttagctcaatgataagtaatagcagcttctttttccatgaggacatttattaaatgatgttttaggtctcagcaaatgttacgccttcagacaccttggctcaggaaagcctgatgtgcctccagtgaaggatttgtaggtccacatcttcgatgcttctgcaacacagagttagggaaatgaaacagtgggtcatacatgctcctgatccattgccaacagcaaagggacttgagcccccacataccttttgacccttctggtcatgataaagccacccactagctataatgctatagtcagcagtagaaataagagggagcacaaagcaactgaatggtaaaatatttcagacctttttggaccactttggaagatggaagctgataacatcatacatccaaattcctctgcattgctgtctctctctttacaggtggggaatagtttacagcaatcagtagaatctacttttgattccaaatgggtcttaattattttgtatttgggaaatattttttacttggcaatagagatgtgccataatattatttaatattttggaaatcactgtttcccatgtgcctgaacatctcgagcacatttaccctgagcgtggcagtgcctgggtgtctcacatccatgtatgctcaaaccatgctccttgatttcacccctttctctctgtttctttcatctcgtaaactgagtgctgatgccatttcacactttttcttggaagtttaatgagttagtagtagtataacaaaaataaaaatattttctttacgtttctgaaaagaaatatgtctataaagcgtcaatcatttttccaagctgttagttcctgctgctgagtactaggagctgttctgtcagcaagaccacgtaagggggaatagtaagagaaagctgtcccaattttctttctctggtacaaaaggttagaagatgttgtttcagctggagaacttaagatggattcttattcactatttgctaaagagactggactgtttttagtgtgataattttctgtaggcgtggagaaaggtcacctcctgatcttgttttggagatcatggggttaaatctgtggcagtgtccttttcctagacacagcctcttgtcaaaataatgtttggccaggtgttaatctgtgtcctgaggggagtgctggaattcattattcatcccgtgggagtaggggtcagaggagaaggttgtccttctgggaggtaccaggggacatagcctgcctcctgcctttactgacatgtgccatttgtgaggagggcagttgaagtccatttgaggaattctcttgtcagccggccaacacagaaacacagagggagtgggagggagggagaggcaggcagcttggcaaggcagtcctggagtgcagtttccggagcaagatcacacacagtgttttaggagctcagggaaggtgtgcaggaacataaaggggaagggggccaggtttgaaagagtggatttttcctattttttccaccttttattcctcctgtctttgaatacttgtcatcctttggaaaactcagcatcggaaagaagcctttgctgacacactgctttttctccagcgctatattgt

SEQ ID NO: 42073 - DNA, 1157 bp, Homo sapiens
ctgatatttggggaaaaatgcattcagtcttttgctgtttagtacaatgttagctgtaggatttttctctatgttctttatcaaattgaagtagttcctttctattcctagttttctgagattttttttatcatgaatggatgtagaattttgccaaatgctttttctgtgttaattgatataattattaggtttttcttttatagcctattaatacggtagagtacattgcttgattttcagatattgaaccattcttgcaagcctggaaaaagttctatttagtcaatgtgtataattctttgtatgtatcgctcaattttatttacttatattttgttaaggacttttgcatctgtacttacgagaaatactggtctgtaattttctttttgtaatggttttattatgaggatattactggctccataaaatgatttaaaagtgttcactccttatttgtttgctggaagagattatgtataattggttttcattcttctttaaacattgtgtggaattctgtagtggaaacccatctgggtctggaaacgtcttttttagatattgttaatttaagaaattaaattttcttaatttaagttattgggctacttaaattactgtttttcatatttggtgggttctggtagtttttctttgtaaggaagtggtccacttcatctaagttgtcaaatttaagtgtgcagaactgttgatagtattctttattgacttcttgatgtctgtatagttatattccttgtttcatccctgatattgataataatgtctgtgtcttttttctgtgtcagtcatactagatgtttgtcaattttattgatttttttcaaagaacaagttttgtgttccattgatttttctctcttgttttcctgttttcaacttatttttttctattctgttatcttaattatttcttccatctgcaagctagaaaaccaggaaagctggagagtgtagttcagtctgactctgaaggcctgagaatgaggggtccagtggcgtaaatctcttttcaagactgaaggcctgagaaccacaagggctgatgttccatctccaagggcaggagatttggatgtcccagctcaaacagagagtaaatttctccttcctctgcctttttgttctgt

SEQ ID NO: 42074 - DNA, 1056 bp, Homo sapiens
taatggcgtaaccagatttgaaccttttcttccattctgtactaggttgtcttttctttgttaggaaaagcctattataaacggaacattgacatgaattttaatttttgcatattttcttacaacatttgcccttactgcattttataactaattgtatatacttttatattttcctttttgtactcatgattctaatgtttctatgtggcatttctcacaatctctgtggggttttattataatttgctaaattattcccttgtttgggggcatttatataaactttttttttttttgccatgaaagagaaagccacagcaaacaatgtatatatgtagctctttattctctcaagttattgtttttgttctcatcatctgagttattgggggtgacttcattacagcagtggaaaacacatggtaacctgccagcatcagaaggtgtcgctttgtactgtgtgtgtgtgtgtgtgtgaaggttatgtgggtatgactgtgtaggaaagaaaaaaagtgctactctttgtagatcaaacaattgatgagtcttaatgtaggattacgtgttgcctgttaaattgctatttctgctgagaaagataaaggcatttttattagtgtagttgattagctttattaatgttggacaaaatcaatgttatgaaaatgaaatctatagttttggggtaaaataaaatttaataggtaggtgacccattcatacacttatgtgaagtaatttttgaaatgataacatgcatgaaaatttactatctatactaaatgtatattcaaagatattcttcctctagggttctagttataaacccttataaacccttataaaatactatgattcacatatacaacttataaaatactgtgattcatcagacagctctagtttcattttatctattgactctgatttaaattatcactcttttttatgcaggaatatgtggtaacaagttatatggtaagaaatttaaatgtaaagattttgacctaacgttgattcagattgtagagctgtcagttgaaaagggaa

SEQ ID NO: 42075 - DNA, 1156 bp, Homo sapiens
tgtaaaggaaaatgaccctctaactaaatgggaaagtaaggtttcacagatgagatagaagttcaaggtgaaagaacagtctataaggtaatacctgcctgtctgcagagaatggattcaaggctcctgatgcaattgaattatagcctcattgtcatatttttttttttttttttttgagactgagtttcactctgccaccaggctggaatgcagtggcctgatctctgttcactgcaacctctgccttccaggctgaagtgattctcctgcctcagcctcctgagtagctgggattacaagcacgcaccaccacgcctggctaatttttgtatttcaagtacagatgaggtttcaccgtattggtcaggctggtctcaaactcctgacctcaggtgatctgcctaccttggcctcccaaagtgctgagattacaggcgtgagccaccacacccggccttcattgtcatctttgagttaaatgcattttggctttaataaaaacaatatgagtaaattctgaacctataatttgagtcccaatagtatttcctaacaagtgatataagtaaacactgagaaaagagtatagtgcttacagaatgacagcatgaattcagcaattcctgtttagcaagaggtctgggccaataacttggggatgtcatagacagaatgcatttggctttcagcaaaatttttggtctgctctcccataatctctttgtgaacaagtagaaaaatataggcggggtggcattatgattatcagtattcataattaattttataactttttccagtggtgattaaattttatttcactctagagatgactttctaagattatcataaataatctatccttggctctatcttatccagatttttgtcttagactaggatgaagatacaattttaaatggtaccaaaacttcttgggtcataaatatggtagatgggaggaacaggacacatatagattttaactcttttggcagtggcgaaaataagatttgctaggactaaaagtgtgattatgtttgaaaatccaactgtgaaaatagagaattgatagagatgagacttacgatttttagacgacacttacagtgagtcagcagcatgtagttagctggcaataaagctaatggta

SEQ ID NO: 42076 - DNA, 1113 bp, Homo sapiens
aagcacccagactcagcatcagaaggcccatatccaaacctcagtataacctcatgattgacttgtgacatgaccgcatgtaggcttaaatgctgtcaggaaaattaaaggaagtaaaacgtgaattgagaaatttggagatttctgaaaattttgaaaattgagattttgctgttaatatcacagccgtatcactaaaatttccacaatcctttgaatttgtgaaatctatataaacatgatttaaagtacttatgatattgtcctttttttcatattacccaaagtatggaatttgtggcaaataaataaccaggtatatatggcccatatagatatggtttttatcctgcacttcttttgagatagctgggggctttactagagagaagaaataaaacaagataactttggcaagtatagatgaagtttgagaggtgtcttatttcattttgtgttgctataaaagaatacctgagagtggctcatggttttggaggctggaaattataagagtatggtgctggcatctggtgggggcttttttgctgcttcattccatgggagaaggtggaaaagcaagagagcatgagagcaagaggaagcagaactcactttaataacaacccactctcgcaataaccaacccaactccagtgtgaatgacgttaattcactcatgaaggcagtgaccccacgatctaatcacctcctgtttggccctacttcccaatagtgttgcattggggattcagtttccaacacacaaactttggggacatggttaaaccatagtaagagggaagtttaacatttgtttaacgttggtatcgaaaggaactatttacgttgcagccccgaaaagactacaaataatattggttaaaatagaagtgggctgtattcttttgccattgcagcaagccttagtagtgacctagattcaaaatgttactttgattttatttaaagcactgaagtattgcatttttcctcgtggttttatgcacctactaagtgcagctaccaatgacaaagatcttctataataaaaatgatgtttccttatttttgggtcttttttcaatctgaaaaatgtttctttaatcggat

SEQ ID NO: 42077 - DNA, 1026 bp, Homo sapiens
tatacccaaactagatattctccagtatcaccaaacaggatctatccattctacagtgctcaccagattgcttctgtcatacttcacctggacatctgtggattctggatattagaaattggaaggaaaagcttgtaaggggatctcagtgcccagggtcaaagcttcattgttgggcagccaaggaagagatttgcttgacttacttgagtaatttttgacacatacttgatttggtcatcaggcataaaggatggccagattactagtaacttattggagatacacttttaaaataggagttaaggctacttatgtgttgatctgaaattaagaaaagggcaagatttctccctgtggcctgattttcaaccatgactaaataaagcctgaggggagccactgaggatggaaaaggtcactcagtcttttttgctgatgaaaaaatcgagttgtctagctctggattgacatccagcactgacatgctttaggaaacaaatcttttgatggcaaaactctcactagcctcacctctcctctcctttcctctctcctctcctctcctctcctctcctctcctctcctctcctctcctctccctcatttttcccttttctactctcccacttctaccctcatttacttatttctcaatttagctcatcagggctttttgttacaaaaaaatggtgtgtaagttacttagctgtaacttggaaactgttttcccatgaatagatgacagaattactacatgccaaattatcccagaataggtggcttaaccaattgtataattaagttactttaataattaccaagagggtcctgagccccatggaaaccttcactgcttggaggatgtataaatggaaggtgggcagcatgagtcttttggactggtggccggaacaagcagttcttagctttttttaaaatcatctttcatatttcagagcaattctttgcataatccagattgcttctgtcatccttcacttgatcatctgtggattctgagct

SEQ ID NO: 42078 - DNA, 1058 bp, Homo sapiens
aataagttaatgaaaagtcaggctcttagaatagtgctgggcatatatgaatgttcattggatattatctaatattgtggtcattatcagttgatttcttcttaatttaaaaaattttcgtatgtgatttcatgtggttttagggaatgataaatgtaatttagactttttattccattgggtctgttacagcttttttctcaatgaaactgatttggttacctcagttctaatgctggctttgcctctgctttttgatcacatttagaatacagcactcagttctgggtatgtccaagatagataggggagaaaggtaaaagagaatattaatgcaacttgattgtgcagctgttctttccacaaatatttattgaatgactgctgtttgtcacatgttgatgcatagggacacggtgcacacctgagattccattcctgtagacaggacatttgcctgcttcctggcacttatacctctccccaaattgacaccaagcattattttagaaaggcatttagtagaatgcaatatcagcaaatgaaaattgtagagttgtatcttgaagaaacttgaccccaccccccactctcacctgcatccccacatagagccaggacatctcttaagacccaccttcctgggtttgctcatagttggcacttaaaacattctattgcagttacctatttttgatggactctgcaagagagagactgtcagttcacaagggcactgatgtttggttcttcattttatttacagtatgctatacaaagggataggtttttgttgttttgaatatatcttgagtactcctttggaaggatagagtccaaaggcatcttacctgagccagaattcataggggtggttccctaccgtttcttctttcctgtacacactcaccaccctcaaatttccgctcagtagaggatgctttaggaccttttttcttctttctttctttcttccttttctttttttcctttttctttttgaggtagggcctcactctgttgcccatgtagtggcacaatcatagctcactgcagcc

SEQ ID NO: 42079 - DNA, 1082 bp, Homo sapiens
ttgttgtatatttcacatgacagtgatacgagggataattgattatttgaggtattgatttgacctaattcagcataataatttactgattttcattcagtgcatgctaagtactaaatccagtcttgctgggtacagagaaacatacattcattcaaacatcatctcttctctcaaggagctcacagtagaacctatttaaatttaggcagtggggagcatgaggctgcagagaaacaaacatccaactttatgaaaagacaaaattatggagacagaaaaaatgatcagtggttgctaggagttggggagagggaggaatggataggcagagtggagaggatttttagggcagtgactctgtattacagtgggtacatataattttacgtacgaccaaacccatagaatgtacagcaccaagagtaaaccctaatgtaaactatgaaagttgtgataatgatgtgtcagtctagactcatccattgtaactatgtaccagtcctgtggggaatgctgatagggagattgtccatgtgtagggacaggaagtacatgggaactctgtactttctgcccagtttttctatgaacctaaaactgctctgaaaaaagtattaattttaaaaagtggtcttactgctttggagcacaagtaaatcatactaagaagacgatgtttaaattaatatactacagatacagtttgctttactgaaatgcagtatatgatgttcaaaacatatatctttaagtaatagccattttacaaaggaattgcatgtttttacagggaggtttcactggcctattagggcatgttggcttggtggtacagctaagatctaattccttctgccaccaaggagctttgtgaccgtgggaccacccaggaacctctctggctgtattctctgcagaaagacttaggacaacaacatggcatgctgtgtggacatgatttgctttgttgggcaaactggtgggattggtggggtggatactctctaatggaggttaaaggtcctgaagccactgcaggttaccctggggcgccatttctgtgctctggattaattctt

SEQ ID NO: 42080 - DNA, 1046 bp, Homo sapiens
gaaattttgggtgatttagacttttaactgaagaaaatgtcagggtaagatgaccagattcaactgtattccatgtagacaactatgtcaagagagaaatgttttctggttggaaatgaagacaatttgacttaaccggagcatgtttttaaagaaacccatagcatgttttttttttttttaacttagctctttttttcgaaccttatgtttggccctacagagaaattaggtgatgagactggacctactgaaagtgttaccggacctattctgcttggacacgctagacttgtgaactgctgactggtatatttcagttagtacagttaatgttttatcatcactgccattagaaggtattacatagatgtgatctttttcattgtagtttaaagaagatagttaatcctggggcaaagtttatgaaggaagtgtgtgaacagagcaatctttttagatttactttaactacaaaactggatatttgttttaaagctgtgctgtttaggattgtagacactagccacatgcaactgttgcgcatttgaaatatgaccagttctaattgaggtgtgctgtaagtctagaatacacacttgattttggagcttgagtatgaaagcaagaatttataggtcctctttaatcatttaaattaattacacattgtaataattatattttagatacattgggttacataaactgtatcatcaaaattaattttatacctatttttaccttgcttttactttttaaaatgtgactcctagaaaaaccttaaaattgcaaatgtgactcacatttgcaactcacattattttattatattatattttattttattttatttattttcaagatggagtcttgctctgtcacccaggctagagtgcagtggtgcaatctcggctcactgcaacctctgcctcccaggttcaaacagttctcctgccccagcctcccgagtagctgggattacaggcgcatgccaccatgctcagctaattttctaccttttttttttttttttttttttaagt

SEQ ID NO: 42081 - DNA, 1047 bp, Homo sapiens
accaaaaccctgatctttttactttttccatagtttcgccttcgcaagaatgtcatacagttggaatcatactatatatatgtagcctttcagattggcttctttcacttagttattatacatttaaggtcctccgtgtcttttaatggcttaatagctcatttcttcttagcactgagtagtacattgcctggatgttccacagtttatttttccattcacctaatcttggttgcttccaagttttgtcaattatgggaaaaagctactgtaaacatttatgcgcagatttctgtgtggagatcttaacattcacattggttactttttttaaatttcagatttatcaatattacagagctattgcaagagtcatatgagaatcgaggatctggaaattctgtatgaaagaggtgccatctgagtagggccttaaaggatgcgctgatttggacacatagattggaggaggtacatcgtactgtggctggcacagtatgtgattttctgtttgattggagttcatggtaaatgtaggaacacggtgttatgttttcgatgccttcgatgctaggctaaagaagataggcttccttagtgaggccataggaacccatggcagatttttgaggtaggaagtgataagtaatgtcactcatttatttaagcagctagtcaagctcgcttagttccaaatagctgcttgaccttgcctagttccaaataattgacttaaaattaacaagttgacatttattaaacagtactttttacagtttaattgttcaccactttagactaaattttttctacaggtggtgcaagttaattagattttcttataatgagaaagaaaagcatttcagtacagtgtcttctgttctgatattcaaggtcatttcctatataaaagtaaaattctacacagcataaaaccatcctttttgacatttagggaccataggttttaataacattgaacaaagggttaaattttttaaaaagtttttgtacactctttctttggtatgcttcatctctttcatt

SEQ ID NO: 42082 - DNA, 1025 bp, Homo sapiens
ctttgtttctaaaagggcaccaggtctttcagaaagctgtggttctcagcagcaattttagttaggtttcgtttcatgttttctggtattctgggcctcccaatagccatttgtgcctaaaagagagagaggatgaggagatttgggttgcttgtactgccagcctggtggcactctggggatattagatgtgttctgaggatatatgtgtttatttaaatttaaacagaaagtatttcaatggatgctgggcgcagtggcctgtagtcccagcactttgggaggctgagttgggtagatgacctgaggtcaagagtttgagaccaacctggccaacatggcaaaaccccgtctcttaaaaaaaaaaaaaaaaaaaaattagccaggtgtggtggtgcatgcctgtaattccagctgctctggaggctgaggcaggagaatcgcttgaacccgggaggcggagtttgcagtgagcagagattgcgccactgcacttcagcctgggcgataagcaagactgtgtctcaaaagaggctaggcgcagtggcttacgcctataatcccagcactttgggaggctgaggagggtggatcatgaggtcaagagatcgagaccatccatggctaacacggtgaaaccccgtctctactaaaaatacaaaaaattagccgagcatggttgtggtggcacacacctgtagtcccagctactcgggaggctgaggcaggagaatcgcttgaacctgggaggtggaggttgcggtgagccgcgatcaagatcatgccactgcgctctagcccgggcgacacagggagactccatctgaaaaaaaaaaaaaaaagaaagggagagagggagggagggaggatttcaatgggacagaaattcaccaggtacattagaaagccttaacacttgagaatgtgaagtcttaaaaaaaatttttttaatagtttgggttacttaaaatgaaatactgtactgaagcagatagaaggactcttaggacctttctgtgtttctt

SEQ ID NO: 42083 - DNA, 1030 bp, Homo sapiens
tgtgtctagtcattagataattcagatttctaccttggatgccttgaagtgatgacaccttacccttgctcatctctctcccaagggaataaacctgtattttgctttcagcttctgcttagaggagctggctccatccagaacaattcccctcccactggacatcaaaagattgcatttccattggcaacaagtctcaacatagctcagaaactactgttgactacttgtctcccctataacaatattggatccattggagagtgaatcagtgtctccctcaagttcagcccactcatttagatttttcattttagactccgtgggaaggatgtcccagtgcagagttggcctctgtacccctgattatgtttcagctttctctaatttctctgctaacctgctgttgatgcccctaaaggcactcaatattgagtgtgctttataaatacatgaactacatgtattttatgaaaacataaactacaaatacgttaaaatatactgtagattcattactaaaaggcattatctattcagtatccttaatgtacaaataataaaagagatatgaaaccctgtgtctagagctaaaaatataccttgacagtacaaatacacatggctaaaaggcattatctttttagtatcttcaatgtacaaataatcaaaaggtctgaatacttctgattttcataatggagaaggggaattgtagaaactgtagaccaattagcttgatgtcagctcagaaaagattctagaaaatattattaatgaatgctttctgagagtttaataaaagaagtagtcatcactgggaacctgtggaggttcacttaaaatgttatgccatctatattccttcttctgcagcagagattgccaaactttttctatacatagccagatagtaaatattttaggttttttgggccatacagtctctggtacagctactcaactctgccactgtagcaggaaagcagccacataggcagtatgtaaacagatggatgtggatgtgttc

SEQ ID NO: 42084 - DNA, 1045 bp, Homo sapiens
tactttagttctggttttaatgatggaattcccaaaggactaaaattgttccaaatgtctgaaccgtgtctgaagttcaagaacagtatatggttggtctgaagactttaatcctagttggaaactttgaatgagaaacctggccttttagtcttgtatttcttgaactttctgttaacagaatatctcctcgccttttatgtagcccttaactagctgcagactgacttggtcttctctagtaaagcattttctatgtaaggtcaccagtaaatttctttttgtcaacagagtaccttcttgcctcctattcagccgttaactgttttgtactgacttggtcttctctactaaagcattttgtatataaggtcaccagtaaatttctaagtcataaaattaagtgatttttcttatttcccatctatccagtcaacagtcattttattcagtacctactgtgtgacttggtgctagggattcattagtaaacaaagcaggaatattcttttacaatgtggagctttcaattttctgaccctgttgaccttccttcttcaaatttcataaactcgcttacttctggttagtgaaatcaatgatgattattttaataatgattcctcccctcatgattgtgctcagggccctctctttccctgatgattgtttttcttgatactttgtggatgattttatatggctaagacttccaggttgtcatctgcccatacacagaggaagtcctgagggaacccacgagtttcctctcactgcttccgtgctgtgtaggcaccttctcctgttagaaaaccatcaataggagcttccatgatcatggtggaggcggcaaatagtgtgtattttgcagggataaggcagcgaggacaagttgcctctatctactttagccagaagattagtactaatttctaaaactttcaaatttgtctttaaaaaattgcacccatatagcatatacatttagttgtatgcacacacacactaaaataaacttctttgtatacagtgatttggtataatc

SEQ ID NO: 42085 - DNA, 1091 bp, Homo sapiens
attgtaagtatgctgttaaaacagaaatgttaacttcatgagtttaatgagtagcttcgatgatagcttagtgaagagatggaaggaaaggcaagtggggggaaatgagaaaaggagaacaagtgtttaatgaatatctacttgcagacttgaatgtcagcagcaacattctccctcctggaaaatgtctttcaactgtgcatcccattatgttcctgcagcccgtggtagcatgaagattgagacaaagagagtgtttctaagaaagctctcctttacaatataatgagatggaggtgggtagtttgcagagattgctggagcagtggtcaaatatgaaaaaaaaaaatccagcagaatgaaaagaccatgttaaccaggagatggcttataatgagcccagaaattgcatatcagatagccagctggctagcatttcctcatatccctgtgttctcatgcaaactgctaaaatgttctcctactctattttctcagcctcttaatagttctcatttctacctactgcattgaaaatatgaatgaaatggcaactctaccacttgaagaaataagaatgaagcccttttcagcaaaagtatttgcctaaacatggatggatattatttcaaatgcttttgaaaccaaggaaacttctgtttctttccttaaaaaaacatcttaactttcaagtctcagtttgactcacagccttttcagtattctgtggcctcttttgctatatagtttggacagactttgcttgaagtctccaagcaaaaaaatggaagtcctcccttcttattggaaattgataggggaggcttggcacggcgcctcatgcctgtaatcccaacacttgggaagccgacacaagaggatcacttgaagccaggagtttgagaccagcctgggcaacatagtgagatgctatctctaggaaaaaaaaaatagctgggcacagtatcgcatgcctgtagtccagctactcaggaggctgaggcaggaggatcacttgagcccaggagcttgaggttgcagtgagtcatgatcttgatcattaaggaagagtcttgtgaaattgttcaata

SEQ ID NO: 42086 - DNA, 2189 bp, Homo sapiens
acttctaagtggaaatgatatgggcacaacttacattagttctttgccaacatattatttacactgtgctttgtgatttgtgctgtcataatagctttttacttaagcctgtaaagaaggctcagcttcaggtaagtgaaatggtaatttttcaagtctatccttactcctcttcagcatgtctttgaaatgtggatggagggaaatcacctgcagagtccatgagctattagcgcaattgaaccataacatgaattctggtgtaagaaagctgaaggcacttttaacaatctagaaccgttttcttgaacactgtcccaagccccaacttcacagacttcctttgtttctatttagagcttttgtcaacagaggtaagatgctgttcattgtgtttgttaataaaatagacacctgagtatatacatgtgcaggtgtgtgtgcatgcacacacacgcatacacacccttagccaaaaccagtatattttactttcagttcttttatctgtagtgatacattcaagggtttaaaggagaagcctttgtttttgatctggttgtatttgtttatatctccttggttttgtgttccaaagatgtctgcttaggtctgtcacttttccaatccgtttagaagcagaagatttgagaaatgagaacagcagctcaaatcagtatttacataagcatattgcaaagaattcttaaagtagacaaaatagagaaggattggaacaaactttctacatttttgggagcttttgaataatgtgggtgttatacacacagagagacacacatatatattcattacatactcatgcccagctcatattctaaatataaatgaaagtatagactagttggaatcgatttgctttttttttttcttttttggcaagaggactaaaacttgttagagtgtgtgtaggattttcttttttttttttgttttgaacgtcaatgcaatgaacacattttcttttcaatttaaacgttttaggctgtattttctccttaaacatgtatttgaggtttcaatttgcatagtgtataattaagaacttagaggcagaatgatcttttaagactacctgtatgaccttggtccggttattttatgtctctgagtctatttccttatcaatacctacctattagtgttgcaaatattaaatgagataagatattttaatgaacacagaatatcactctatactaccaaataataagtactgccttctgttattcacacaatcgtgtgtgatggagcaaagttggtctcatcaggtggctgtgcaatgttgtgcaaagtaggttttataatttgtacctgtaggatagtagtattttattcttattatattcttcttgtagctttctcaggagcacagcttttgtatttgatcagttatttacattttttctgtatgtgaacataaaacagggtattcatcctctgtgattctatatgaacatgacgatgttggaatgaactgttctattagctgtccacatattatggttgttctctgtaatttgtcagttaaagttacttgtgtattttcttcctcagaagcatttgaagtacttggagcttttaaagactgcttagcagcttttaggattgggctgagagggaaggtacacctgttcaatatattccacttttatgaacttgtatcacatttgctcctttctgacaagaaaaagaaaaattgatgccctagcatatatgaacacagtaactgaaatcagtagaatgaaaagaccagtgagaacatttcgtgttggccagtggtctggtatgtcatcacaggaaagatctggactcattctttatagcacttgactccatgtggagttgggagctacttttggggcaactaaccagccaggcagaacttgattcctgctgtaagggaagtacagccttacttttttccaagtgacatgttctgccttctctggataattttcagccctcttccaggtttgaatctaactgtcttagaaccacagcctcaaatagcttgtatcctgcttttgtaaactccataatttctcttaaggattctcaactaataattttcatcttcctcaattgggtcacatctagtaattgacatactttaaagttatcagggaaaacaactcacttctactcagtgattaaaactgccgcat

SEQ ID NO: 42087 - DNA, 1050 bp, Homo sapiens
atatattgacaaaaatctattataatggaaatatttttgaaaatctaaattttatctagaaatccatgaaggatatccagttattattagggcatttggactaattgataaggagttgagttggaaaactactctccagatggagatttcaattcattttaactcacaagtatgacttaaatatctactcttagttcttaagttgcataacgtgtaagcatggctctcaagtcaaagatatgtagctgaatttgaagcaaagcaaactgattggtctatgagaagtgtaagtagagcacttggaagtataaaggagggtcagttaaatgtagcaggcttaaattgtgcagagcttgatggatgtttagatagtcaacaggaaagaaagggtggaacaagtttgaggcagggggagcaacaaagacaagaatacagagaaattgcataatagtgtggattgaattgactgtatgatgtctctggagaaagacgggacttagattgtcagggaatgttggttgattacagggaatgtgggataaagccagggaggtagtcgggtgagtggggaagagatggtttgtagagaaggacgtcaagtaaaggatcaatgactacaatactcttacttggagttagtccccagaagaggagatttgaatgtaggaaaatggtgagtttggaagttagaatacgtagttagaaatttaagtgtgtatttaagtgtaacttaaaatctaggacattaccaatgcctttgaagctacctgtgtactgtgcagaaacatctgggcaaacgaaagttgttgctctcccttatggtgaaacattgtcacattttttaaatgtaaccttcaaaatactacccttaactgtgttttttcctcctagtaacaaaaccagaatctaaggtgcattctgacagactcctccacgtggcgcagataaactctctaatttcaagggccttagacagaaaatataattgtatttcccatgtctaattcttacccttttttggtcatgtttttgatctgttaacattttaat

SEQ ID NO: 42088 - DNA, 1115 bp, Homo sapiens
ttgttcatgagacaggtcttgctctgttgcccaggctggaatgcagtggtgtaatcttggctcattgcagcctcaaccacctgggcttaagcgatcctcctatctcagcctcccaaagtagttgggaccacaggcacatgccaccatgcctggctaattttttattgttttattatttatttatttgtttatttatttattttttctttaagagatgggggtctctccctatgttgcccagactggtgttgaactcctaggctcaagcaatcctcccaccttggcctcccaaagtgctaggaggcatgagccaccacacctggctcttttctgttgttcattctcttcacccttgtttagatcctaaagtgacccaggcacttcaggatctgaagatagctggatgatgatgagtcttcttaaaaggtagcattttatagcaaacatgatgtagagccactgaagggttttatagttgctgtcctcaggggctggatttttaaactggaatatccatggggactttgaaaattccacctgctggggctctacctcatttgagaaccactaccttaataagttcatggccttacaatgggagtgggaggagaggtgactttggagcagacaattacaatgtgagtgacagttatctctttcatgagtactgctgtacaaactgggaatgcctgatctggttcttggagagggagtggaggttaacctgatttatgtaaagttgtagtggtcatggcgggggaggaggttgcattccatgaagcaccatttggaaagacccaaagtgtggggcctggttatttggaggacctggagatgttgttggaatgcttagaaattacaggaatgaggataggaaggagccagatcccaagtggtcttgacaagtcttgttaaagagttttcatttcatagtgcaagtgatgtagagccactgaagggtttcatgttgtagaatttattagatgtgtgtgagagatagctcactcagttagttttgtggaagatggctgtgtaagcatgagattggaggcaagaacttcaggaaaaattatgatgatgactgggagagaaggtggacaattctagagatgttt

SEQ ID NO: 42089 - DNA, 1033 bp, Homo sapiens
ctgtcattattattagtgaaggcatgttacatatttgtttggaccacagcatactttcaggaaactcttgataaacagctttcttttttatttattgccctgctttcttttgattgcttttgccgtagcatcaacctgcatcttattttaatcatctcctctctgaacattgatgattccgcagctttgttagaatacatcttgggagattccattttttaaaggctctttcaagggcatatggcattagatgattatgatatggcgcatttagaatatgccatgatttctctcctgctgaatccctcacacgtgtttgaagtaattattatcctctctgctagctcatgagacttgttagatcactatttgtgggtgtcataaaatgttggcaagaccccagtgtgaaacgcagtgtgaaatacatgtggttaaacttctctgattttgtatgtcaatcaaaacaaaatggcttaaaacagtagatgaatttcaaaagaaacttcaggattctagagcaaaaatgacacatggaactctttaggtctgtgttttgatatttaattcagggagtcatacacaggaggacgtatgcaatatagtagaatttagatgtgttatgattatatctgataatgttacaaatactgagcagctttttgttacatcatatttggtcccaaaatgtcatgccatgcaatgctgggggtgtttaaataccaaatttatgcatattttcaaggaagaagcagataatcttctaactatacagactgtgttacttatcagaaataatagtttatgaattgtcaaacagtgaaaattttaaaccatgtatccctgataatacttttatgtcttcattaagcatcactaatactgaatatgagtatctatctgatgaggaccttagaatcttattatagttagatataacaagattttatttattgtttttatcatggtgaagggtatataatgtcagcatgatctctcctttagttttacctcttctggtgttttgcagtcttaa

SEQ ID NO: 42090 - DNA, 1045 bp, Homo sapiens
ttgctgaaaattggaaactattaaaaacattcatttgctgggaatcaggagaggggagggaatttcaaataatagaggtttttttttattaaaaaaaaaaactcacaaaatctttgatccactgtctctcaaaaggcaatttgatagctaaatgcaagtattttttttttttttttttgagacagggtcttacttcttcgcccaggctggagtgcagtggcatgatctcagctcactgcaatctctacctcctgggctcaagcgatcctcccacctcagcctcccaagtagctgggtctacaggcatataccaccgctaatttttgtatttttgtagtgttggggcttcaccgtgttgtcaaggctggtcttgaactcctgagctcaagcaatccgcctgccttggccttcctggtgggattacagggattacagccactgcgcctagcctaaatatattaataagttttaaagttttatattatttccatttctattttggtagtaaaggtaaatgaacaagcattatagatcacagacatttaggttaaaaggtccaagctctttgagatgggatatactagggacacgttatcttttttttttttttttttgagatgaagtcttgctcttgtcccccaggctggagtgcggtggtgcgatctcagctcactgcaacctcactgcaacctccacctcccgggttcaagcgattctcctacctcaccttgccgagtagctgagattacaggtgcctgccaccacgcgtggctaatttttgtatttttagtagagacagggtttcaccattttggccaggctggtcttgaactcctgacctcgtgatccaccttcctcggcctcctagagtgctgggattacaggtgtgagccaccgcccccggccggggcacattgcctttataactctatttaattcccttgcttgcacgttgaatagatctaaatgactgggggaaaagtaaaaacatagtctttagtccctttcattgtggtaaattcactgaatgatagacggaaatttc

SEQ ID NO: 42091 - DNA, 1047 bp, Homo sapiens
ctaaaaggattgattttgctgcaaagtatatgcgattacattttttgatacctagtaagtagtagtggttgaggattcactggcctggccagagtgagggtgtatactaaatgtctgtggggtttcaatttcttcctattgaattcttttaaaatgtagagtctcttaccactgggagtttggggaacttcgcacagtggctcatgcctgtaatcccagtactttgggaggccgaggtaggtggatcacgaggtcaggagatcgagaccatcctggctaacacagtgaaaccctgtctctactaaaaatgcaaaaaattagccaggtatggtggtgggtgcctgtagtctgaggcaggagaatggcgtgaacccgggaggcggagcttgcagtgagccgaggtcgtgccactgtactccagcctgggcaacagagcgggaccccgtctcaaaaaaaaaaaaaaagaaagagagaaagaaaatgttgacggaaggcattctatctcagtctctgcaatgagccattcgcattttgtggaatcctttctggcattaattgggggacagaaacagcatctggcatatttacatgacagtagcatgtacttctcttttatatgtcattcattcgtacttccaataagttcttttctaatatgagcatacattgctttattgtgcttggcagatactgtattttttacaaattaaagttttgtgtaaaccttacatcaagcaagtctgtcagcaccgtttttccaacagcatatgctcacttcatgtctctgtgtgacattttggtaattcttgcactatttcaaacttttttattataattataactgttgtggtgatctgtgatcagtgatctttgatgttactattttagttattttggagtgacataaacctcgctatataagaacagtgtgtgttctgtttcaccaacctgcctttcctctctctctctctccttccctggccttcctattccctgagacacaacaatattgaaattaggtcagttaataacactacactggactct

SEQ ID NO: 42092 - DNA, 1029 bp, Homo sapiens
agcactagtgataacctggtgaaaagaaagaccatcaatttatgtgttccaaaaatgatgtcagcattgcaagaggagagctgactgcgtaggctcatcctcatttctcaggagagtgtgcctgtaaatgaccaaccaattacaagcagatgataatgaagcaaaatgatgtaaatcaagatctgaggagtgacatttatggccaagacttgataaatatggaattggagaaagaagataggaaacaccagaggaggacagcaaggactgtagttttttttactgtggataagcccaactccctactgtggcattgaatcttggccaggcaatagtttgattgctgatttccttagaagggaaggattcttgtgtaggattaaagtaaaagtaattccatgacaacttgttactgaggaagacagccaaatacatatttcatgagtaagcaacagtcattttggtggaatatggtgtgttacgtaaagcttggtgctagattaatgcccaggtgaccacttggaggacaatcagtgtagccctgtgaaagatacaaagtattgcctgcctaagtctcagtttctttgtctgtaaaatgtgtgtttaagtggagctgtgagacaatgagaatatatgtaaggtgcctggcacttaacagttgttcagtttctctctcttgagcatcctcaaagctccttttattgatttctttgatgctgaaagaaagagaataaattttgactgcacgatgagcttcattttttgaaggtgctgattctcacccccatttccagctacattgactatcgttagccacttgttacccatctagtgaagccatcttctatagtgcagtgtgtgttagtaggaaaggcttatttggccttgaagggctcgtttggccttgatccggtactgattgtggtttgaggttgagcatgttaaggatgaatagtagctggaatggtccatgatgtgtgcttagtatccttcagaatgtttacatagtcatatttagattgcttctga

SEQ ID NO: 42093 - DNA, 2245 bp, Homo sapiens
ggaaagcttcagtaagacacaactattaacataagtgctaaggattaagaaaaagatctgtcacaaattatgtctgtctgtaggaaggtaaagttgtgcctttgatatgacacctacccctggaaatcatattcttttccaagatataaacccaaatcagaatagggagtgagctgttaatatgaatactgaatctggacaggcacggtggctcacgcctgtaatcccagcactttgggaggctgaggtgggcatatcccttgaggtcaggagttcaagaccagcctggccaacatggtgaaaccctgtctctactaaaaatacaaaagaaaattagtcgggcactgtgctgtgtatcagtagtcccggctacttgggaagctgaggcacaaaaatcgcttgaacttgggaggcagaggttgcagtgacccgagattgtgccgctgcactccagcctgcacgacacagtgaaattctgtctcaaagaacaaaacaaaaccaaaagaattctaaatctgctctgaatagtagaagacaatgggagacatttatctttggtagcaacatattccaaagacttaagagtttaaagaaatcatcattttcctatcgcttccttcctttctctctcaatcctaaaatactctctgggcaatcaatttcggaattctttcaaggaaaggaaaccttgattcgtctgcctgttaactactacaaaatgtgtagattcctgctcttccatgttactactcagagtaataacgaaacacctattattgtcattatctggagaaaagaagctcctatactggattaaatgatgttgctgtgcccataagaaaggcaggtattgggcagtaatgaaggtatggcagcaggaatttatactttgtctctttcatcagagtagctcccccctcccctttttatcctgtaggaggaaattgtggagtgagagaagaggtctgatctgtttggggaaaaagtatcacagcctattagttagaagcaatgaaattgagacagctttgggactccattaagtgtgtggtgtttaggcagactgtgtccctgggtaaagtgtgctgttgaagaggatagtacacaatgaaataattgggcttgggaaatcaactgggcttcagcagcctcatatctccttgtggggaatgggtgagggagctacagctttccctcccttcttttagcataaaagctataccgaataaaatagaagggaatttcttgctgagtagatggactgtgaatatattttgaataacacaaacaatggagataattaaattttgtctggcacaggaaggattcagagcatgtcacttggaaccccctcatgccatgttcttctctaggcgtctggatatatggttgcagcaactgaataaaaataactcagatttgatcagtaatggcagcatctatagggacatgttttaatgcactgatgtgtatgaaattaggttcttaaataaaacattattcctggatattttcatttcaaaggataagctgaaattcacgaacagtgtgaactagactgacttttcccactgagatttactgataggcaaacttttgtgcacattgtggacactggttgagggtaggctcactagttttggtactattaatggtcagttgcctgtagaacttgtgaagtaagaaaaggtatatctatagcaagttcaaggttcagataattgttgttctctcttaagaaaaaggttttgagcggttgtcttctttacacttagtgtatgtaatgatagtttggctaaatatgaagaagaaagagaaatagcattactactgtttattaataacttttctttgtgccacacatttagctattcaggcactttgtgtttgtgtgtatacatatacattctcttatatacatttgcgacatgtggtaaaaggccctactttttggagtcagaaattgtgctcatttctgtatctgccaccttgtagctgttggctcttgaacaacaactaagcctctactttgaacatcaattttctcagtaaaatgagggaactagactaaatagttgccaaaattcttagtccacacacacacacacacacacacacccattttgtacttctaaagacactggaaagaagtttacggatggaggaggagccaagatggccgaataggaacagctccggtctacagctcccagcgtgagcgacgcagaagacgggtgatttctgc

SEQ ID NO: 42094 - DNA, 1041 bp, Homo sapiens
ccattacacacatgtggtaacattttaagactcttctggttgggctccttgagaaccaagctcgtgttcttataagctcatccttatattttcccattgtatgcatcgttgcatggcaaacacaggatttattcccaagctaaacctgtctcttggggtttcttatcttttacctccttggtgagcctcgggaagctagagcattgctctatggagaaaggagggtggcattgggaggaagggtaggaaaaacattattgggaagcagagaaagtcaatgtcaaatgaactgccaaggatgaatattatggctgctgggagcctcggagagtatcgtgtgtcttatgtgtctatttcacagtcggtgcttcatgtgagatggcagtctcgcctggaccgtgcttagtatcgatttactctcaggcatgccagaccattttagcattgctgaaggaaggaaatcctatgtatttccccttataaacagacatatcaaaagtgtatcttttaaacctttttctttctgtcttcttactgttctttctgtcttactgtaactcctcctccctccctgatttaaaagaatttttttttttttttttaaaagaaaaaagactttctggccgggcgcggtggttcacgcctataatcccagcactttgggaggcagaagcgggcggatcacgaggtcaggagattaagaccatcctgattaacatggtgaaaccccgtctctactaaaaatacaaaaaattagccggatgtggtggtgggcgcctgtagtcccagctactcggaaggctgaggcaggagaatggcgtcaacctgggaggcggaggttgcagtgagccgagatcgcgccactgcactccagcctgggtgacagagcgagactctgtctcaaagaaaaaaaaagaaaaaaagaaaaaagactttcttattaagagagcattatacaggccaggcgcggtggctcatgcctgtaatctcagcactttgggaggccgaggcaggtggatcacgaggtcaggagatcgagac

SEQ ID NO: 42095 - DNA, 1392 bp, Homo sapiens
actttgcacacttctagcccttccatgaaaatagaaggaccttatttgaggctagttttgtggtggtgggatctgagcactgctgagtgttaacaaaagggaataaattgatgccaaatttagagaccaaaaatgccatcattttcacctgcctgaactcttctgttgttttccctagttgctgccttgcgctttttccgcagtacagggagagaaatcagttgtctggctgtctaaactcacggcatctgcttagcagtttcaccagctcatagttgggactcatccctctgtcagaatcctttgctccattagaagggagactgggaccacgttcctgaattgatttgcatacttctacgttacctagctcagacaacatatggccatgtggagcacttggatttatttctgtttcctcaaattaaattcctaaaaaattggataactccacagtttgtttggtgttacaaaaaattttagttccttttttggtcggcaaagcaacacaattttggcattaaaaaaaaatctctggattactttaaaaagagtgttgatttgatttgcttcccctcttctcttacccctttcaggaaaaaaaaaaatgtatgttgaatcttaaaacactgcatcatgttgcaaaatgtccatttaggcacactgaatagaaagtatcatcgagtcatttttattcttgtaattcagtaatcttgtatcttttgcctttttctttttccttaatgttaattgtgtaactaaatgtctcaaacttgggacttttcactttacacatccatgtgtaaaaatacatagatacatacagtcagatagaagaaataagactcagtgttaatagatcagtggttggggtgggggaactatacttaacaatagtatgttgtacatttcacagtagccaaaagagaacaattcaaatgttcttaacataaagaaaagataaatatatcaggtgataggcattctaattactctgatttgatcttcccacattatataaatgtatcaaattatcacgtactccccattaataatactgtatatcaacgaatttttttaaaaaaagaaatagatatcatacaatgaataactggattaatgtgaaatgatagaaaaagttaccattttaggctggatgtggtgacccacgcctgtaataccagtactttgtgagtctgaggcagtaggattgcttgaggccaggagtttgagaccagcctggttaacgatacaagaccccctttctaaaaaaaaaaaaaaaaaagccaagtgcagcagcatatgcctgtagtcccaactactgagggcatagaggtaggaggatcatggatcactggatcacttgaggagtttgaagttgcaggaagctat

SEQ ID NO: 42096 - DNA, 1050 bp, Homo sapiens
ctttatttatggacacaaaaatttgattttatgtaatttttatttgtcacaaaagataattctttgatttttttcaatcatttaaaaatataaaagccattcttagctcatgggttatacaaaaggcaggggtgtggatttggcctacaggctgtagttgccaacctttcctctgtacctgctgcatgccagcgtcactcctcattctttagtatcagacgtgtgttaggcagggtgctaagcatcgagggatattcagagatagagcaaagtcccttccctgatgaagcttacagttaagctagaaaggaaccatagatgggacagagacacataatattagatgttaaatggtgtccctctgtgacaaaagccaccattgctttacaagtttaagagagagggaagtcacttcagctgatttaggtgatctgctaagtaagacatgacctggctagctacggatgcatggaaatgatgggatatcagctggatcctgaagaaaaaggctgtggacctttgaaaaggtaacagggcataatgcctccttttagaggaagggggaactgaggatggcgaaaatgtcaaccatgagtcacttattcctatcatttttcccccaattctttctttcatgtcttctcatgaaaatttcaaacatatagcagttttaaagaatgttacagttaatacccaaatactcaccatatagattctaccattactattttgctatactgttttattgtatatctatcctatcctcttttgttttagaattctggtctcgctctgtcacccaggctggagtgcagtggtcactacagcctgcaactgctgggctctgcctcctgagtggccaggaccctatgtgtgtttcaccaccatgtttggctaattgtaaataatgttttgtagagatgaagtctcactatgttgcccagagtggtctcaaactcctgggctcaagctgtccccctgtctcagcctcctgcattgttgggattacaggcatgagccaccacacctggctgctttattatatatctg

SEQ ID NO: 42097 - DNA, 1042 bp, Homo sapiens
aggtgacaagagcagaactgtgtctcaaaaaaataataataaataaagaatctatcatttgggtttggctttttatcatcatatattttgtctttacttgcttagtatctagcaagaatataaatgcaattattttgccagagaaaagtatatgtttgattaaggaaaacataaaatacaactttgtttaaatatctgtatgtatattcttaaattattgtaaaattaaattacctatggattaaatttttcacattaacattacttagtctattatgctccagcattttacatatttatgttatttaattaaaatctttgcagtagatatttcccattttgaagaagaggaaactaagacagcgaataaaataataaacaatattatttcttacctcttactgttgccacttcagtgtcagggaggaagagggatagcaaatgtaggaagggtgtttgcaaggtgagtgaaggtgaagctgctttgttacaagttttcttatcaagaaatggatagaacataggagtagagaagttcaataggaacatgcaaaatttgtctattgtaaaagaaggaagaaaactggagaatttaaggactattttttaacatctatgattaaaatattatgaaacaatatctttttaaaaagtgatatttttcctctagtataacacaagttgttagaaactaaggaatcaccctatcttctttagtaaaagcctacaactggtagagtttttttttttttaaggatctcaagatacttcatgaacctcaaaagactttaagttctctgcaatgttaggaaatgacttcatgaatatcacagttcaaggttctgctactgcttttagaagcccccaaagtgtgaagacatctagtacagtatacagtaagaggagaactggcttttattgctcacaataggaatgttcccatctatctgtttgcaaaccaactcataaaatatttgaatattcttcactctgctttatgataatatttcttggcttggaaatttgcttttttttttttttt

SEQ ID NO: 42098 - DNA, 1023 bp, Homo sapiens
cacttatcactattcgatataacattttatattcttcaccaccaacccagactagaatgtcaggtccctgaaagtgaggtatgtgccatactcaccactttctccccagtatccagagtggtgtgtggtacatagcgaaactcagtaagtattattgaatgaatgaatgaacacagatgactagaaaaatttctagaaaattttaaaacatgggcatattagccatgaatttaatttatagttttgttgttttcttttgggtattcaaaaatataatttcatttgtttatatctctaatgagatagtacagtatttgtgattcttctagtgtgatggcatgtacagtttcattggtgagtatatgtgacctactgtgccaggtggaaatggagtgaatgaacattttggggggaactaaaaagcaattttcaacctttttgataagctaggttaatactgtcttctcaataaaaagtactttttcttcctcttataatgttcatggtcttcatctgtatgtgtatattgccgatttaggaactaaagccgaaatggatctcagactatttcccacagactggtagctgtatcccctctgtcagcaagtatttgatatcttcagtgaaaattgtttctttttccacttttagcttctgtttagttttacaagtctaaacaatttttggcaagtgctaggggctcacctgatgcactttttaatgcattccactcctcgttgttattttctctgtccagtacacatggtgctccttccccctcattgccatcccactttggcagaaagcattatggatgctgtgtatgtagactcatcacccaagccagcatgcatgggagagggggcctctagaataataattgttacttggtgttctctgtactactctgtttaatctccctgcttaccacttactgccttcgtaaagtaagctcaatacaattatttattgcaatttgtgtagaatgtcagatgtggaacagactttgcacactcatcagat

SEQ ID NO: 42099 - DNA, 1060 bp, Homo sapiens
ataattttatgaactacaaaatttacaaaaatgttttacaaaccctctgcctccccagtatcttctccagcccccatgtcttggggcaggccacatcaggtctctctggctgcttcctttcccaggccctactacctactctggcccatcatatgtcttttgagaagatgatttttcagttcttttctttagtttagaaaatcagaattaattgattaatttttaaccccttctacctttctcctcccctaccatatgaattcatgcagagccagccctgcaacctaattttttttgttttgtttttgagacagagtttccctctttttgcccaggctggagtgcaatggtgcgatcttggctcactgcaacctctacctccggagttcaagggattctcctgcctaagcctcctgagtagctgaaattacaggcacccaccaccatgcctggctaattttgtatttttagtagagacagggtttccccatgttggccaggctggtcttgaactcctgacctcaggtgatctgcccacctgggactcccaaagtgttgggattacaggcgtgagccaccatacccggcccctgcaacctaatttttaaggagaggtggtaaggttcattccatgaatcataccacttggaattcttgaaaaattaattgcatttattgcacacctactctctgtaaggcaatgtacataagaatggaggagatactaagaaaattgagtcccactcctattgccgatcgggaaagtacggcataagcacatgaatatttagaggtcctgtggtttaagtaacggtaggtaaggaatcattgggccagatgggatcagtgactcactgaatattataatcagagatgtgagtgcagaataaggaggagatatgactggggactggtgtagttcttagaggttgcctgagctggctagcgtgacattcctactaagcaatgagcctagcaaccagaatctcccagccccggtagccaaggagcacaggtggtaggctatagaaggagatttaatgcaacacagctgggttca

SEQ ID NO: 42100 - DNA, 1051 bp, Homo sapiens
ttattcagttggtctgctcaaggcttgcatgccatttttggcattgaacatgtgatcctctagtttaatatagcatgtgcaatatggtaatttaagaaaataaatgtctgtatgcatagaaaacacagcatcctcctttaattcatgggtttatgggagattacagttttcttttagtttaagcctacaaagtgtttatagtaaaaaagtttcaatgaaatgatttccaatttatatttccttttcactcaccaccacaagtcagaaatcaaatcttatgcttagaagaaagcaactccaggactgtatccacttcgggttttgaataacaacagtaaggtggtctgactccaagattaggtccttgttgtttggacatatctaacaaggaactccatccccaagtgctggagaatccatgaagtcagtggtgtcttatgaagcttgagcaattgggaagccttcccagtcagctttttggcctcctctaggtcttaattacaaagcggattcatggtcctgcctgaaatctgattgagacatagactcctctatcccaaatgatatcattatcaacattggttccctgtggtacacatttgtcatattcattatgatttgtacctaagattccaggccacaataatagggtaagagtgtataatgggaaaaataacacaaatcgttttgattttctttaaggaaattcattgccttaacattacatacttgcctttgttttaaaactcactctatgccttatctaagaggagtcaatataaaagattttaattttagccccatatgctgtagctatatataaatgttctgtaaaatatatcccctagataaaagtacttactacttttttgaagttttttttaaaacctttcttttggtaaataaaagtctttttagctttgatgtgactattacacccttggtttgggttctttctccattccttcatccctagcccctgtgggacccctgtaagaaaaatgggaggggagagaagcatgaattccttaataagtcccaaaggtaatca

SEQ ID NO: 42101 - DNA, 1879 bp, Homo sapiens
agtggtgtccacatctaaaatggctcctgtaacctagtgatgtgctcatgtcattgatttgagcagttgtttatgttatggcataacaagatgtcattttgtatctactctgccttagtcctggaatggaaaaaagaaattttttgaattcaaaactgttgattctttatttaaaatctttaactctgttagtacatactaggtggtgttgattttttttgagactgttattcttcttgagacattacatatacttagcgtgtctgaaatttcaatgtctgaagcatttccaatgatttatgtatctgattgttgttatctgccagctttcactcatccttttgcctttccttacttgtttggtaatttttactgtgaattgcttatttccctgagaactttgtgtgagtattgcttgtttttcctggaatttttaggaattctttgacacctgggagaaggtggtttttaccagatatttgattatttcatgcctctagtgaaactacctgtgtgagaccatcttatattctcagggtgaggtttttcttttcagaccattttatgtaaattaaggctttaaaactctatgagagtcagcttgtcattatgcattatcagaagagattttttttttctgccggcaatactatttgagatgagaaattttcattgcaatttacttgagggagagggtagtttatttttagttcatctagcactgaatgtgtagtaggtcttttgtgtatagctctgttgggatcttctactagatgtcttacctggggtgggggccatgtgctatgctcttgatccctggatttgtgaagacttgaagccaaagctgaagttctaactagtttgggaaatattcataagaggaaacaaaaactaaattttttttcttctctttgctttatttttgacctgagtattgcttactttctgtctagctcatggatgtagattagaataatattttaaacttcattctgtttagtttttaaatcgttttcagtggaagtatcagtcttagtacctaatctcccatggcataaggctggaaatagccatgatcctgccaaacacggacactctgcaacctggaacaaaatattctactctaaaaatcaagtaattatgtcttttttcaataaaatataaagtataatcattaatgtaatttacttctttcattccagtcttcactcatgctttcaaacatagattatattattccaacccttcttaagtggaattagtatttcattattccataaggttctacaaatacctacaaagaccatcatgaattccaggtgctctgtaacctgatcaggttggagaactgctgatgcaaccaaatttaatcacttaatgttcttactaagcactcatttgtttttctgcttctatgacttgctctcactgcttgctatcccaaacactgtccgtttgtacatgttccaatgtcaccattcctttttcgggcaaatgcttcaaaagctactgtttctataaaactttcctttacccttctcttttgacttgttatgagctccttttgtagtttgtaatctccttaagagcaaatttcacaaatgttatatttgtaatatcttatgtagcagagtattctcacagtctagaacagatggttcttctgtatctgttgaaagaaatgggaagatagcaaagcaacataataggataattttatttttgcctactagactatctcaggatgtatgtgttttaaatcctaaaactggttagtggtatttcagttgaaaaggtcttgaccctttcccttctaacataacaatcctcatcataagtgagagagaagattgggtgagtagggctcagtgggggaagc

SEQ ID NO: 42102 - DNA, 1690 bp, Homo sapiens
gtgtggataagccccttcagtgatatttgcaaatcaaatcatatctgctttttgtgctacattgtcctcaaaatcttctgattggtttggttatagacatccctatatcagctttcctgttctctttcagtttaaatatctgtatgctgtagcaaattgcattatgaaatcctctcacatttatcgctgtttagtgcatggaaatggcatttcctcattaccagtcaaagataaactctaaatgtttctttttttttttttcctgaagtatcaaattatgtattcaaaaaacttttctctatagcattatttctctgagctgtttcttttttccctcctgaatgctgacaccagatgcagtctgcatggacattagtcccagggaaatcttgtcttctacccaggacaaggagattataggaagcaatgctgactcttgttgtagattcacaatgtgctgacacgataataggacatgaatgggcttttggaatgccttttcctttgagctgggctgagagggggacagaggcagacagctccatggcctgaatttcgttagctgtgtgacaatgggagagataagtagatgtgacagttatgaatgatcctctgtcatgcactttcacgttcagattcagataaactgacactgctgtcaaacacaagctatggagagctgagacctctgatgaaccttctaatatggtaaatgggagtcttaattcttcattaactgaaaaaaggagatttggccatgtaattttctccttgctgcctgttttaaagattccaataacccagcatttacagttgactaggcagggattgcttttccccccctacacttgcaacatgcagactgtgaaatctgaggaaacgctgcttaaacccagacttattgccttggttatctttaatgactttgaaatgtattggcctcattatggaacagtgcagttatcaattcctctaattaggtgatgtgctcccataagaaatttaacattaaagcacaaaaatgaactcgttagaggcatctattgctgggaacttcagtatcaatggtgaattgaagatactgtgtttcgttaccaactcttctgcaccatacatctgactcctccttgaagactagagcatgggcatttttttctttttccttaagggtttaatcctcatatagcacctctaacacctttgatgacattttagtgcttctggatagtaaactgtgtgcctttgactaaatcgactaggagtctagggaagggaggaggtgagcagtttacatttaaatgctccacatatcagcccatctttctttcttggaatttaacccatggctatttactctttcttatgtaagtccaataaacttcctttctataagtagcttagtacagtctttgtttttatcacgatagggaccattatttgtttattaaatagtgatgctgtttcactcataaatatttcagctgtatttctagagaagtaggatggggtttctgggtttaggcttcagtgaagggactttaagtctcttaacccttctttacctcaatcatccatctgaacaaaaaaaatcattatagcctcccctttggggaaactacatagtttaattagtgttttctaataacttacaaatccttagagaaaagttatagtagaagcataagaaatt

SEQ ID NO: 42103 - DNA, 1041 bp, Homo sapiens
acctcagcctccaaagtagcctggacctcaggcatgcaccaccatgcccagctaacttttgtatttttttagagacagggttttgccatattgcccaggctggtcttgaactgagctcaagcaatctgcctgcctcagcctcccaaagggctggggttacaggaataagacactgtgcccagccttcaatttttttgttattgttgtgagtgagtgagtgagaaagagagagagagcgcaggttgatatgctcaagcttaaggtctgtaatgggtttaaagctccaagttttataatcggaatggtagagacggaaaggatctctgatctaatccatcctccatttcataggtaatgccatggaggcctgaaaaggttaaggttctcaaagatcaaaaatgtatccttttggaaagtattatagtggttcctcaaaaaaatttaacagataattaccatatatgattcagcagtcacacttctgggtatataatcggaattaaaaacagggacttggacagatacttatattccaatgttcatagaagcattattcataatagctaaaaagtggaaacagtccacatgtatatcagtttgtaaatgaataaataaaatgtggtatatccatagaacagaatattgttgttacttttgtttttgagttgcattttattctgtcactggggctgaagtacagtggcacaatcacacctcgctgcagcctcaaactatggggctcaagaagtcctcctgcctggtactacagacatgagctaccatgctcagcctggaacattattacctagccttaaaaaggatgataattctgacagtctgcaatacgaatgaatcaatgtaatttgaaaacattatgctgattgaaataaactacacacaaaaggataaatattgtgggatttcactgctatgaggtacctagagtagtcaaactcacagagacaaaaagtcaccaggaactgggaagaacagtgggatagggagttacccattcatgggcacaaggtttcattttgggat

SEQ ID NO: 42104 - DNA, 1034 bp, Homo sapiens
caacctgttaatataggtctctcagttgcaggcttttcttattctatggattgactaagaagcccccaaaaatccttatgaggaaagatagagtcatgtgtcataagagaaggctagtaataggcttgagtttcaaagaaaagagtttatcagactgaggagtaaagaacgttggtaactggccttcaaaagatagttaagattgcatccggaaagatgtggggaaggggatgtaaaatggatagcaaggcaggatagcaacagggcattcttggaatagacaaccatccatttgttctcagtgtgaaatatacatggttttgtaatgggaattaaggccgaaatggcatgtcaaggccagtagttgagagctttgtaggtcacattgaagagtttgtatttggagtttgatggactcctaggatggatctgtccagtggacaactggatttcagacctaggagagcctctatagaggtattaattgaagcctttggatgatcgagattgtgaagatagaatataagacagagcctcttgagcatttctcccttagtgagaagaaggtggtgatacacagaaggaaccttcagcaaggtgagaatgatagataaaggatggactttccccaagaaacctggcaagggagtgatcaggagtgttaatactgtcacagagactttaaagaggatcacaaatgaggggaaaccttggattttaatcttgactcttagtactcaaggaaactgcatgttaagatgtggtaattaaagtattaaaatattctaagggtcccttgcactctccctttctgtgcccattgtgacagcatggtcacatcattgcttgaggcatgcaagagtgctttattgaagatagtattacggggggagattttattttgatagagagtaacaaatagactaataatctatcttaaagtaagtatcttaaagtcagtaggcaaaggagaaaaaaagatattgataaggaaagcatctgcaggacagattctagatttctgttttttgttg

SEQ ID NO: 42105 - DNA, 1030 bp, Homo sapiens
attgctgcctacataatattccacctctttggagcatttgcattggagtgaccagtggcttgaagctctgtatggtggagtgactgatggtagttgaagactgcaaaagtaggtatctgagggctggaaggcattcctggcacccctaaaactaccccactgggggccatccaagcctgtgattaacaaaccctagttatttgctaggtagtttccacatggcatagtaggatatatatatgtgaggcacaatacagtgtttatgtgagaataatatagattatttgaatctaggctgcagaacctacctgaaaatgggttttacagttttgtgtaattgccttttctttgtgtttgcatagaaggcattgcatagctggaagatgatggcaattataatttattatgctgtaattgttacctaaatgtttttgaataagcaaaaatcacatctgtttaggaataagttgcacagcaagagaattccctttgaaatgaataccgtgttctcatattctgtaactgtacacataaaacaacatatttatttccccactgagtccattacattcccaagtcaaactgcatcctctcttcctttcccatattaaaccctttgatttaatggaggttttaactactggttctttagggaattttcagtaggctttgcacagattaggttattggaaagtatagttatttgcttgtaaagtggcagttctgtgtcaaaattgcttttctctggagctgcaacagtaaaaacgataagcttctgctttgcatccaaaatgccctgatgttcctagcatgatcgtttttcctttgcttcttgctcagcaccattcggtcacaggctggtttggacaggcgaatatgagcacatgtagcccagaggactttgatatccagtggtgataatagacaaggcctgtcttccattctggttgccactggtctgtgacaaccagtgttccgggcatggtgagcatagtgctgcttcccttctccgttaaataggaaatgcata

SEQ ID NO: 42106 - DNA, 1052 bp, Homo sapiens
attaacaattttaaagtgaacagttcagtaggatttagtatatccacagtgttttacaaccactgcttctatcttgttcccaaatattttcatcactccagagtaaaaccccttacccattaagtagtctgtacctatcccttcctccccattgcccttagtccccagtaaacctctgatctgtgttctgcctcttcagatttatctattttggaatcatacactctgtgaccttttttgtctggcttctttcacttagcataatgttttggaggttcagccatgtatgtgtgtataattactccactcctttttatagctgaataatactccagtatttgtatataacatgatttgtttatctgtacatgcactgatggatgtttgggctgtttataccttttggctattgtgaacagtactgccatgaacatgtgtcacatatacttgtttatgtacctcgttttggttcttctgcatatatacctaggagtggcattgcaggacgatatgatacttctacattaaactttttgaagattgccgaactattttctagaatggctgaaccatttcaagttcctaccagcaatatatgagggttccagtgactccacatcacttccaacacttgatattttcctttttcttaaaatagccactcttatgggtatgaagtggtacctcattgtaaatttgatatgcattttcttgaccaatgatgttgagcatcttttcatgttttttggccatttttatatttttttttagagaaatgtctactcaggttttttgctcatttttcaatttggttatttgtctttttgtcattgaattgtaagcattctttatgtattctggatactagatacatatgatttgcaaatattttcactctctaggttgtcttttcactttcttgataataaatgccttttgatgcacaaggtttttaatttgatgaagtcttagcctgtttattctgttgtaacaaactacttgacactagagaatttataaacaaaggaaatttatttcttacagttatggag

SEQ ID NO: 42107 - DNA, 1064 bp, Homo sapiens
gcagcagaataaccccaaaaatggtccttaatccaaacaccgagaagtcaagttataagtaattaagaatacactggatggaacatacctacatggcagctagcatctgtgctttccagaggttgctggggacggttagttcagttctcatttttgatcctctttggaaactcaggagttaaggtcagcatcctcagtacaaaggtacttgaacatgtatgaatctttgccttcttgaaaactttttatcttgggaataaggaacctgatacaaagagaatctctagtatttcattccatcgagagaagttttgacatttacaattctgctaatttcacacatcatttcgcagcatgcaggattttggcgcctgccaaggggactgcaaattctttttggaaaaagtacttttttgggtgttggaagagttttgagttacagacacatttctttaatagtgttcttgaaatgtccatgtggtcttaatatgtaaatcatatgaaactcaaaacccactcctgaacttactcttccaagaaagctttaaaacagccctcattctaatagtaaggctgttttcctcttttccaatgtttatgtatactgtataatgtttactgtataatgagtttattgtataataagggactctgatttattagctcttcattattctcattctgtcagcttcccaataaatgctacaacccttggcagagacatgagtctcaatcaggtgatatcattgctttttaatgaactcttcttaccggagtaacagcattacatgtgaaataccttatcctgcattattaacggaccgcagcataaaaggcacaaaggcactgagaaggttgcactgaaaaatggggcagaattcattaccaattcgatatactgtcagctaacagtctttgattatcatatttacccttctgaaactgtgaaaaatcatgggcggagccgctgtgaacaatagcatgtgtaggcattttgtaaatgttgccttagttgtttaatgcccaggctgactgctggaatttaacacagtgacaactttctc

SEQ ID NO: 42108 - DNA, 1104 bp, Homo sapiens
tcctcacctcactcactccatacatccaagctccacccatactttttgccctcaccagcccagtaaacagctgcctgttgaccaccctcaagcctataggtgtgtgtaccaacagcatggcctgcccttgggaggatggcttccagggtaggaacctgcctatgcaggccctagaagcagcttaggccatctgggaagaggagtcctgtctccttggtgtgcaccacatggtcctaagggggaatgtgtcagctaggtgggcccatccccacgacttcatggattcttgccccatgtggagggacacagctggaggggccaagaaggatccccttatgcatggtctcaaggcaggggctggatctaacctgtattgcctctgccttttcatttcagtcttcataacctcacacttcatgtcctgcaaaaataaaatgaaataaaatggatccagctctccttcagaaaagctaaatggatgagctagttaactcatcagtgtctgcggacacaaggtgtgaaggcttagtctttagattcaatactggaaagtcagctggggtcttgtgcaaaagatgtgatgcattttgtgtaagaagtctgttttttccattagcatttaaagtatagcatactgctaaccagacacaaggaatgctctactatacagtgaaagaactatgcaagggaaaattgcagctgaaggaccaaattaggaatgttttcaatttcaagagtccagagaagaaacaaagcattatattgacatagtttgaacaaagtaaagcacttcgaaccttgctaacatttttaaatacacctttgttaaacctctttaaagaatgacgataattgcgttgttgttgttagtattcctaatgtccaaagggttgctgtaatttactctcccttcaaatttgaatatggttcataggcttctgtcttagtccatttcatgttgccataacagaatacctgacactgggtaatttataaataaaagaggttatttagtacaaggttctgcaggctaggaagttcaaggggcgtggcactggcatctgcttggcttctggtgagggccacatgctggtcaaaacatgg

SEQ ID NO: 42109 - DNA, 1032 bp, Homo sapiens
cagaaagggagaaagatgttgaattgagccaattcagggagtaagtaatacatgctctctggttgaactgatttttcatatggctaggtggctgggttctgcctgtgacttgttcaactctgcaagctactaaatagaataaaacttgctgaaatcagagaacttcaagaagataagttttatgtatatgtatatgtatataggcatatattcatatacatacccatgctctcacacactcatacacaaacttaaaggattctagtttagggtagacttaaccctttgacagttcaaagagagaagttagagtctacaaagtgattattatgtaaacccaacagggcctttcctggaaataccacaaaaatttcttagaattgaaaagatgacaaatgctgatttatgcagaactcgggacttcattgatagagcactgtcacttactacttccatcagcaggaatggttccttttaacatcagattgggtgtttacatggatgacaattagggctggtgaaatagttcaaataaaagaagaaccagaccggcatggggagtgaacctagttagttcccaagtattaaatacctgtcttccctcccttgtctctctcctcttcccttcctttctccactttgtttctcacttcactccctttccagactgttcttccctgtcagggaaggctgaacagagattgaaccacacaatacattgagattctgcagcagagaagacattcaaatcctgaaatactgtagtgggatctggttttcaaatgtttcttccccgggaaagtgaaacattccttgcagtcttataaaataagtatgttcgttgatatttcaagcaggagaaattcattttaagaagttggagtatttatatgtgacaggatagtagttcctctttctctcccccgtccctccctccctctctccttcctcccgtcctctcttccttcctccctccctttctctctcctctttgattttattttttaatcagaaagttctttttaaaggaag

SEQ ID NO: 42110 - DNA, 1043 bp, Homo sapiens
aaaaattatggaaaatctgaagctattgatatacctaatgctagatgacacattggtgggtgcagcgcaccagcatggcacatgtatacatatgtaactaacctgcacaatgtgcacatgtaccctaaaacttagagtataatataaaaaaaagaaaaaaaaaaaaaaaaaaatctgaagctattgatagtcttatttttaattgctctaaaataagtattaatttcttagaaagaattatttatttaaattaagatatttatgcagatgaaatacccaaatattctggtttgctgtttatttttatcccataactcaacgggtatttatataattaattatacttttcaagtttttcacccctatgttctacatatattgctacccatgtactccatactctattcttttatgcttctttgaattctgtaatttaaaaaatcaaagcaaactaaaaacaaaacaattcagctcaaataacattttttcctaaaaacctaagtctcccagcttctttgaactcctccttctatggactcttacagtcctcctctagcctatttatctcatttgttaattagctagctagcttttatgctatgttttattattagaatcctgtttcttttagtagattgcaaactactcagagccagagaccatgccttgtgttatttgtgtacacagctagcagagcaccttacacatcataggaatgggatctattttagtgattaatctgttctgtttttatttcagcagggtttgtggaagggcatggccaagttgatggtgatcatatgccttcaaatatcatgttgacaattatcacgttgatatggaaggaagggagactggcttactaaaaaagcattctagttgtctagattggaaaaaaatgcatttagtctttcaactgtctagcacctagtaggcagtcagtaaatagaagcttaaaaaaaaaaaattaggccgggcgcagtggctcacgcctgtaatcccagcactttgggaggccaagatgggcagatcacgaggtcagg

SEQ ID NO: 42111 - DNA, 1079 bp, Homo sapiens
aatacaggatgcaagtaggtttggcagcaggtttagccagaattttgtcagaatttgaagattttggaatcataatcagatagccagtattttctctctcccctcaaaccaaatgcattgtgcaagaacttgtgttaattatccctgttaattacagtgataccacctcagcttttccaggctcttttttgcagctgtctttgtggtgatttcttgtcttaccacttgctgaccaatggaactcaccattcttgctaggttctcttaaaaagcagcataacaagaaccggtcgggagtatgttcccttgaaaaataaaaatctcagcatcacacccaagtaaaagccatgtgccttattgaagttctaagtctatagtgtgtttgtgtacatgcccgtcacataaagtgattgtttattagtttcagtggatttttttcctagaaagatgcataaaattttaaagtaaaaagaatatagtgagccaggtggggtggcccacacctgtaatcccagcactttgggaggctaaggtaggaggattgcttgagcccaggagttcaagaccgacctgggcaacaaaatgagacctcgtctctacagaaaagtcaaaaaatgggccgggcgtgatggctcatgcctgtaatcctagcactttgggaggccaaggcgggcggatcatggggtcaggagatcgagaccatcctggctaacacggtgaaaccccgtctctactaaaaatacaaaaaattagccaggcgtggtggcaggcgcctgtagtcccagctactcgggaggctgagataggagaatggcgtgaacccgggcggcagagcttgcagtgggccgagatcgcgccactgcactccagcctgggcgacagagcgagactccatctcaaaaaaaaaaaaaaaaaagtcagaaaatgagatgggaggatcgcttgagcccagggtgttgaggctacagtgaattgtaatcgcaccactgcactcccacctgggtgacagagcgagaccctgtggaaaaaaaaaaaaaagaatacagtggctggaaaacaaaacatcacttgaaaatttt

SEQ ID NO: 42112 - DNA, 1050 bp, Homo sapiens
taaatgtcaaagggaaacatgatttttccccgtgtttaatgctcttgaaattttgactgcttaggagaaaaacttgaaagttgtggagatgttgcctgtgtgtgcagacatgtgccacccatgcttatgtctgtagataccgggcataagtatacatgcagtacacacatacacaatctcacagaaatgaatccttctccttttcctatcaatcttttaacatgactcctgattgcagttttttctctctgtgctgttagcagtaggaacaaccacctggagaaggtgtttgtgctcctgggctttgctttggtactgtgtcctgtacccaggacagcctactggcacaatggctaactgcaaatgcagtactaccgatttttcacacctgctttccctctttccacacactttttggtgcattcccttttttgtttagagacagggtctcgctctgttgcccaggctggagtacaatggcataatcttagctcactacagcctcgaactcctggactcaagcagtcctcccacctcagcctcccaagtagctgggactacaggtgtgtaccaccatactcagataacttaaattttattctgtagagatggagtctcactatgttgcccacactggtctcaaactcttggcctcaagtgatcctcctgccttggcctcccaaagcactgatattacaggcatgagcaaccatgcctggtgttcatttttaaattcatgctaaaagttgttgtgtttgatcattttatgttcacttgtgtgggaaggggcttctaagaaaaggagcaaagaaaaccagcaaagtcttatgttcctaactcaacacaaaccacatgcctaacttggctcgtgcaggagtcagaaactgctgagatgtcaaactgaagactgggcatgtggtttgtgcttacagtggaagagtcccatcccttggttggccatgtttcacactcggtaaggtttgtgcaccctcagcaacattccagaagctcagaaggccctcattgttgcttgtggaacccccagcctta

SEQ ID NO: 42113 - DNA, 1056 bp, Homo sapiens
gggaactgaatcacagaggtattaccgaacatgcccagtcttgctcctggttaatggcagaggcaggtttcaaacccaggtcagtgtggcagtgctcttagccgctaagctggactctcccacatgccacattccaataagcctgagagctgataggaaaagaccagtgaaaactgtaatacgttggaatacaaggaaatgttcaaagagtattttatcactttctgttgtaactctaacatccaacaaaatatcactcaaagaagatgttttgtgatgagctttaattaattaataagtcccatttgcagttagcacattacttgcatgcaaatgatgcttctaaggtgcttgaaaggtatttattttgataggttaagactaagcagtcactctggcaaatgctttattcttttatattcttattggaaaggctgtaataaacttatgttgaatcatgttctttaaaaggacaatttaaggttgtctcccagtaattagtgggatatggatgagggcccataggctgccatatagaataaaatgactgcagattccatattggtggattccgaatgctggacacttgaatgtactctcgtgcctacagtgtggacatgactttttgttctgacacggaaatacccctttttacctctctagccgcctcatcgctttctattccaagcttgaaatgttacccctcctggacagaatggacaagccattcttaccatcacctgtgtacatgatagggttgtaattcatgaatttattcaataagccagacataaagtgagttgtaccttcagggcagttttttaaatgctgcaacagaagagccatagataagcatggcttttctcactgagaaatttaaaattaagttagcacactaagaattgtcctccctgcccccgctcccctccttgggctcacaagcacacacattgatcttccctgctagattaccataggtccaggggattgaccttagtttctcctctagccttagatccaatcactcaagtagtaaagaataagaacaaaagtatt

SEQ ID NO: 42114 - DNA, 1050 bp, Homo sapiens
ccctgccccacccaagtataagacagccaccttgagagacacaaagatctcaaggaatgtcaattagtaaattacatatctagggtacaaaatgaaacttctttgtccaaagggattgtggtcaacctggagaatccaatttgcatgccatgcagtactacttaaacttcagcaggcagccttcctgaagtgatgttcctaagactagaaaatagtaactcactcatagcttctttcactcatgtttcattcaacaaatttaatcctcacttgtatgctaagccaagcactgtcatgggaactagggatgggaagaagacaaagacatagaaaaccttcagggaaatatggcctaattgaagggaaagctgaggtacctagatgaattacaagaccccgtagcgtatgctgtttctgaggaatggcatgatgtctgaatgcaaaaaactgagccatactctgtaagggaggaagcaattgagttagatcttgctgcagcacatggaatagatgttactaggtagcaagaatggggtagatcacaggcaaaggggatatcatttgcaaataacagagttaggaaaggcttagcatgtggagagaagcatgaaaacttctgtttgtttggtcagggtccatggcagtgttggggggaagatgagactgtaaacatatgttggtatacacagttccataaaaacaggccttgcacggcaagatgagagtttggacttgatccagatggaagccactgggtaccttatgtaggtgaatgacacatcagaattgacattttggaggaggattcaggcagtggcatgaaggatggagtgaaagggggtgaaagttgtcataatgggggatttgagaggtgatagagatctcaaccaaactaatgtggaaagaaggagtctgattttagaggcatttctgaagtgatgattttgtgaccactgggaaggggggtcaagggaggaatcgtggatgactcaggtttcaagtcaggctgactgggtcagtattgatgatgccatcaatcacacagcgaaa

SEQ ID NO: 42115 - DNA, 1050 bp, Homo sapiens
gtcgtaatgctttggtgataatatccccatgccttctagggtcagtattggggttataccacagtatccttagtgatgatattttaacatctaacttccagtggaccaaacagtaactcacttatagcctgagatcctattgctttccttaaggaaactggaatggaatcagccccacagcatgaactgggccacccagcagcagccaggtcgccgctctgagaggtctggttctgaggggctctgtgggagtaagacagcatgaggccatatagctttggatataggaaacgcctagaaaggtagagagatatgataccacacttccagctctagcaacatagtgctgtgtgactgcggccttgggcagtttactaatgcttctaagcttctgcttttgtgtttttttgtttttgttgttgttgttgtttttccttttaaaaatctagatataaaatacctagaattatatggcccataatagtaactactcaggtcaggcactgtgactcacacctgtaatcccagcactttgggaggccaaggtgtagaccaacctgagtaacatggtgaaaccccatctctacaaaaaaaataaaaattagtcagatgtggtggcaagtgcctgtagtcccagctaattgggaggctgagggaggaggattgcgtgagcccgggaggcggaggttgcagtgagctgagattgcaccactgcactccagtctgggcgacagagcaagatcctgtctcaataatactactattaataataataaggattcagtaaattttacatttcagtcccttccaccctgtttcctcctgctggtcccccaccattgaccgacttaccctgcaaaaaaccataacacacattagcaagattcatttattacagccaaatcagcaccccaggatcaggccttttaggaaatgggatccaaaacataagtgtcttaaagaggtagaagatcagagggctttgaaacatggccatgtcatcagtctgaaatttagaaagaagttccctgtggcaagagaatccgcagg

SEQ ID NO: 42116 - DNA, 1052 bp, Homo sapiens
ccttctggaggggtaggaacagaggaacagtgcctctcacctgaggagggaacttctctgaatccaccaggaaacccagtcacaaatcacacagaagcagtgttcattttttctgtccacaaccaatatgactaaagtacggtggaaagacaagtattttttgtcctggtgaggaaaggtgccttgatatgtactttttttctgccttgtggatggactgcattggacagaggtgggggtggtggagggagtggaatttaccatggtggtacaaatgagtcagtctgctcaatagggatgtgtcccatacagagccgcagatgcctggtttaaaagactcaggctgcagttaactatgctaaactcaaattttactgagtggaatttagtctttctctgatgattaaaaggcccttcagaatcttctgagccgttttgttgaacagtgcttttttgttacttcctgggtgtaggaaatggtggggaacagagggttttgctggaacacccactggacttgtgtgtcctcctctcggtttctaagggcccctcaggccacacgcctcccatttccaagagagtgagaggggcctagaaaaggctgaacacaaagccccacaaccgccaaattccctttcaagggtgttacttagtaaacatgagcccttgagcccacattcttccagactgtgtctgcctcaggccacccctccttctagaaggagcagtgggggccctggcaggaggctgccggctcagcctggagtggcccacagcaatgctccaattcacagtgaaatgatttcctctgcctcgtataatttaacctgcccacattgctaaacttctatattacacatttctgtcaggatgtcagaagaaatgataagcctccttgaaacagcaacctctattacatgctaagagcattgcgcctggctccccccagctctggtccttctggtatgtttctgagatttttagcatggtctctcaagtataaagaataccctacttcatgaccccagcctcttgttagctgatagatgaaa

SEQ ID NO: 42117 - DNA, 1009 bp, Homo sapiens
aaattttgattggcaagtttggttgggttcagatactttcactagaaagccgtaggcctgtgagtctccagatgaaaggtgggtttagatctacacatctcctgtttcagggcagtgagctgttttggacccatctctagtagaagtttcttggagctctccagccacaataaaggtacagtgttcctgttcactcactttggcagagccttgaaaaggagcacagagacggtcaaatagtaaaatctaaaaacccgtagaaaaccctagcagaaagtattcttaaagacccagctgtatttttctgttcataagacccagataagcatagtcttcccatttgacattctgactttaacatgagagggagtttcatgcccccttggtaggacattggagtacttgttgcagcgtgcaagaagtggactttgtccagcttatatttagaataaccttgccagcacattccagggagttgatcaaggagttttgccaaactgtgataaatcagcacattgagcagcctctgatggctgataagcttgggagtgccagttaattgacaagaaccgcacttgtcaatcttttgaggtcatggaaatggatctcttgtctttctgcccttccccaagtcttcacccgcttgctctttggtagattgagcatggccttgcactgcatggagcacacctcccacctttgttcttgtgtgtttgctgagtaattaatctcattgtgctagtatggaaatagtctattaaaacattccggaggacaccatggagagggaggaaggaggatgaagactggcggagggagtagtttgctctgtttaattggttctttcacctaatggtagtttgtcaattaaggggatacttagagaaagtgaaattaatccatgtgggtcaaatgcagctattaatttttaatcaaaacacaatgttcaacaaatctgtagctgtgcttagtacaaatgtaagcatgccaccagcctcttcccaaagga

SEQ ID NO: 42118 - DNA, 1042 bp, Homo sapiens
tacagagagaattttcaagaagtgttaatttaatatgctaaagtgttcccttcagcattttacctttcttgttgttttcacaaaacagccaagactaaataatgagcccagggctgtgccctttggtagcgtgatagctcattacccactagcggcctccatctgccctcatggctgcatagggagccattacgattatgatggaaatctcagaagccattaccaagatgcaacagagggcctactgcagacagcctaatggactaatttgtaattgggagagggaaatgagttagcgagctggggccggttttgatgagagtggaagtgcgcatgctaaatgtgataaatgaataggaatgtgtgtttgcacagtgggctctacaagctttccatctctcctggggactggaggcgtgctgacaagccgtgaggagcgaggaggaaaggctcaggggaggcaagcaagattcaaggagagtagctaaggataaatcggtgaggaaaactaatggcagtaaaaatccaaggaaatgactgcatctgccatgaaagtagtaattaggaagcattcggtgtgcatgtctttaaccgttaaaatagggggatgagtagatggaaggctggggcggtggtgggccaagagagaagcccctcgtagagggctccgaagggagagcatcctcagacctggtggtctgggcaaatgctgcctgctcagaacggagccgagtccagaaacaccacgggcaccgcccttcgaggggcttctggaacccagcaatgggaaggcctagcaagctcacaggcagccattgtgcaaggcaaggaggccaggctgcagtgccagacctgcagaacatctgtccttggagggctggagagtcgcttcataagccctcgtgcccggcgctctaagctgaggagtgctgggcaccagtgtggctatggacagatttctgaaagctggcctttccttctgtttgtcatttggctcccagcatttcatctgcccagcctggagagtgcgccaggtgccctc

SEQ ID NO: 42119 - DNA, 1049 bp, Homo sapiens
ttccaacatgggaatgacatgctgatttaaaacagttgaagcatactccagaatgactagaaatggtctcgtgtttgaagtttctgctcattggtggaagttaaaattccagtttctccagcaacatttggttaaatgtccctatccagcattggaactgctcactgatctctttttttgggggggttgaacccctgcccatcttctcagtatttcaagggcatagtcacttggctgtaataactgctcaaactatttactcaccagttttaagtatagatcagcctggtgtttatgtgataaaattctagaaacttcttcctttgcatctttctctacctgtgcccaccaagaaaaggagccgtacttcaccccatagccgtagatcaaatgaaaagaaataaatttctcacttgtctctaccctatgctaccttttcctttgttaaaaagggagataaaagagaaaagaaaacactggtctacataaatagcactaaatataaacagtggaaatgggcttctgggctttgaactctacagggaagttgttatggcaacctcaagttgaattcactgggggggaagtgtcagtattaatgagataagatcgaacttgtgactccaatggtaactgtattctccaaggtttttcttcttactgagacaagaagcaaagcctttattttatcagtgacatctagatttagaattgggagacaaattgtgtgggcattggggcctggagtttagtttccaggatgaggtttctatttctctgttgagaggaattagagccactcctaacacacctgctttagctattcttgttcaaagcctatagttgtaaatttagaggatgggtaacatagaccattaattccctaaagagacttgaagttcacttaaatttaaggattttttttttttttttttttttttttactggagtgttacacagatttttctatagggataaggtaataagatataattgatattgtaactgtccagtggaggttaagttcccaaaacagtgattgaccatgg

SEQ ID NO: 42120 - DNA, 1033 bp, Homo sapiens
acctgctttagatggtgctccagtgcactgagaatgttaacctcattcacccttctgtggatgagcagattattcctagaaaatggtccgttcatgtttgaccaggcatagccccactgtgaatgacaaagtcttttttgacctcccacgatctttctccctttctgtctcagccaagccttttcttctggaaggagctactctcttttggctagacgatcattcagaggagtcacctctgtccctccccctactgatacatctcagggtctcagagccgtttatgttcccatttttgcatcttgacatagggatgcaaagatgggaacatcaagcatcagttcttccgagccttcatagaaggagtggggggagtgggtagacatggagatgaaacaagactggccatggactgatcattgtgtaagtctggaaatggttgcacaggagttaatttaactactttgtttactttcatattggtttgaaatttcccataacaataagctaaaaacagatagtaagggatctcaagtgtcttgggcagtggttttcccattgccacaatatatgtggtgaatgggcattatctgcttggaaaattaacaaaattaaaatttacatatagatcagtgaaaacactgctacagagttaacttaaaattttagctgggtgtggtggctcatgcctgtaatcccagcactttgggaggctgaggaatgtggattacttgaggtcaggatttccagaccaagctggccaacatggtaaaaccccatctctactaaaagtacaaaaattagccagacacagtggctcacgcctgtaatcccagctacttgggaagttgaggcaggagaatcgcttgaacccgggaggtggaggttgcagtgagccgagattgcaccactgcactccagcctaggcaacagagtgagactctgtctcaaaacaaatcaaaaaatttaatataatatgtgttcattataaaaatcattcagggccaggcgtggtagctcatgcctgtaatcc

SEQ ID NO: 42121 - DNA, 1032 bp, Homo sapiens
aaaagggcagacctactccttaattgtgtctttctttttagcaggaaggaaaatcctttccgggggtcctgcagcagattgccccttacagataatagccagaactaggtcacgtgttgataaggtttagatacttgttcccttcaaatcttttgttgacattgcatctccagtgttcgaggtgggcgctgggaggtgtttgggtcacggggtggatccctcatgaacggcttggtgtcctccctgtggtaatgaatgagttctcactctactagttcacacaaaagctgcttgtttaaaaaagcctggcacttcttcccctctcaccacgtgccctgttgactacccttgccttctgcctcgagtaaaactccctgaagccctcaccagaagcagatgctggcaccataattcttgtacaagctgcagagccatgagccaaataaacctcttctctataaattatccaccctcaggtattcctttatagcagcacaaaatggacaaatacacatgggtgccacaaaccagtcactagcaaatatagattagaccacttggttatctcctggcctggacacatgtcactttcctacctgaacaaagttgatgttttctaataacagagaatgaaggatgacaagctgccagggtcgacaactaacaatgtctgctacagcagtacaacccgttactcctactgaaaaaactcactccaggtggaatagtagcttatgtcagggtctgtattgataggccagtagattataaagtatttggaagtgatcttagaatctctgctcatttatgtcaccactgtttcatttacatacctctaggatagcacttaccacgtggcatcatgattccatgtccacaggtctgactgttcctaccagattgtcaccaggaaccccttatttctttgtgtccagagtacccaggataatacttggaacttaatagaggtagaggctcagtcggtgtttgctgaacaaatgaatgaataaactaacaacaaataatgaataa

SEQ ID NO: 42122 - DNA, 1032 bp, Homo sapiens
gaagctgagtgctggtaggtagcagtttattatacagttctctctacttttatggaaattgttcatttaaaaaaaggaatagaaggttactatgcacagggagcagtggctcaggcctgtaatttcatactttgggaggccaaggtgagaggattgcttgagcctaggaattcaagaccagcctgggcaacatagggaaaccctgtctctacaaaaaaatacaaaaattagcccagtgtggcagtgcatgcctgtactcccagctgctcaggaagctaaggcagcaggattgcctgagcacaggaggttgaggctgcagtgagccagggttgtaccactgtactccatcctgggtgatagagcgagacactgtcaatccatcaaacaatcaataactatgaattcagctttgcttttaaaaagaaaatatattttaatgatcattgaagcatttccatatacttgaaaaatattaataattgtatgagaatagcatataatttcctgagactatagacagagctttgtgctcatggactctgaaccctttgttgtaactattagaatacaatagacaagcaagttcaaggtagcttgatacatactgtacacaaacactgagcacattccaagggatgtgaaccttaactacagaagcgtgtatggagctgctttaatttactgtgactgtgttgcatagaaaaggaagacgaccgtgctgccacttaagtactgataacatttaacactgtgtgcataagattgaggcagcttggaaggtccagaatatgaagcaaagaatccgatccattcagaaaccaagaaacctccaaataatagcactttcactctaattcagcctctgccaaatttgcctttggccaattgtcaccagtgccaaattaccaacagacttccttttctggtcttagtcatgttgacctcttccttctgtctcctagtcaagcagaatttaaaacatttacattgtatttcaatttctatgaagatgggagaggaaaggtgtatttc

SEQ ID NO: 42123 - DNA, 1065 bp, Homo sapiens
gccaccatgtctggctgatttttgtatttttagtacagacagagtttcaccttgttggccaggctggtctcgaacttctgacctcaagtgatcctcctgcctcagcctcccaaagtgctgggattacaggcatgagcgatcgcgcccagccgaaataaagttttaaaacactcgaaacaatgctacatggcatttgtatctatgtacaaatatagcaaaagtataaatgccataccgtgcatgataaatatcaaattggtgagtgtgtaccctgcgggaagatatctgaaatatatatttctccagctatatggtggctctacaggttttccttacatgtattcttatgttatcctatacttttcctgtagtccaaaaatatttcataatttaaaaagaagcaagcaggccttcagccaacagagaatggtttcattaaagtaggggagtgtatttgttggggtgcatgtaaggaagggaaggattctatttagggttaaacatctcaagaattgctccaggaaatgatgcgattgggagcatgactgaagcgttgcattgtactctgggatagcactggtagacaggcactccagaaagcacaggatgcctgcccattgcattgatgtttctcgagttctcagcactaaggcttgcatcctaaactctggtgtgggaaagctagctgcatatttacgttctgggtggatttgcctccggagaccctgctgttcaatcccattcagtttgcaggttaacatttactgttcctgtccttgaggtcagcacttgcccacagattttcctaatttctttattttactcttcctccaacaattgcaataacttggatactttctcttcactacttgcaggaaacaggaaggaggcacacagtgtgatacacagtcttgggttgatgtctgttttcaaacatgtttttggaatctccatttgagtagtttaggtctaattccagtcataccaactggcttataaaagccaccaggaatgggtaaaattgctccagaatgggaagggagcagcattccatatggcaaggga

SEQ ID NO: 42124 - DNA, 1991 bp, Homo sapiens
ataagaagctccagcaggtttggaaatcactaggttttgaatacactggtagataattagcacttcaagtaacaatatttatgccactctgtaccttgacttctttttcttgcttacacgaggtctagattttcaacaggatgatcagggactaccttctctagagagcttgcatattgcaagtgggttcagggagcaccattatagttgcatttcactccagaagagacagtgagtggcatggaaggggcattgcatcttgaatactgcatgcgttttaaagtttgcagagcttattcataaatccgcttggttaatgagaaaaaagcaggtatcgaaagacgtttgctgtatgtgtgcctcccagtctcagcccttccaggtgctttgcaggtccctaagtacagagtgtcactgtccagaattttaagggcttacctaccctggtttttcccctctcccctagtcctgttttgtcattgctaccatgaaaatctagcaaaagtgtagaaagttgtgtccttccagaaccacggtttctcagtgcaggtttactgtattgagcgcccactccttttctgtttgtattctgcccaaggcacagcagacattcactccttttatttcccatgaaattgtacaacaggcagaagcttgaagatacaacacggatggaaatttgagccttgtaacgttcaaaaatgacacaattgccaagtttcctaacttttcctaagagttgattaaagatcacaacttcatatcgctcctttttccctatgcatttgccgtccatcacacacctgactgtgagctgttgtaatagctagatgaggtttaaaaaaagagggagtaggggctcaaggattgctgtcctctcagaaatgttgcccaaggctaccctaaggctcagcctacccccagattctctttctgacaagtgggtgtttggtaggatggtgtgaaagtttccttctatgataacatctttaagatttgtttccaaattcccttttttttctttttgtaacctgctgagaatatgagtctgtaacctatgtatttatctgaagtcagcctgaacagatagaaaaactgagttacaaggtatgggactcccagtaaattaggaacagatgtgggtcaaaaacagatttccaaactctttatcaaatgatcccacttggaaacaagacatgaacaggcctaactactcttaaaatgcaaggtttgtctgagggcaaacatgctggaaaagatggtggccaccaccctgcctctacttttcttttcctttcatctttcttcccaccgtctttggttccctgcataggctgtgtagtgggtatcagtcagcacttgtctgctggttgcacaatgcagattactcacttctgcccaagtaactccctgaagccgtactgtaacaatagagcatataaaaaagaaactcaggttgatcttggcccctgtccaaggggattagctagggagcacctgaaaggcctgtgttgaacacactcacctgtaacccagttccatggcctggatctcaaggacagggtaatctcagtaccttttaatgacctagtaaatgtggtatctttctgtctttacactcgacctgatggctcatagagtctcctcattatggagctggaggagtactttgaggtcatctaggccctcactactcaaagtgtggaccatgggtcagcagcattggtatcaccaaggagcctgttagaaatgctgaacctcaggtccatccctggatttatagaatcagaatctgcgacaggttccccagatttctcatatgcattatgacaggtggggttgtcccatgatccaactctgagatggagtttagccagtggcgtatttattaaggagtgccctttggatcaatacctatgggaaggaggaggaaggaacaggaataggtaggtagagcaagaagtcaagcagcaatacaggcccagtgacag

SEQ ID NO: 42125 - DNA, 1359 bp, Homo sapiens
tgcaggcactttgttagcagccggggatacagtggtgaaaaaagtagacatgaagcttcatgaagcttatattatagtgcagcgcccataagcttttcaaaatcttcaattactgtaatagtgtttcttggggccagacgtggtggctcacgcctgtaatctcagcactttgggaggctgaggcaggcagatcgcctgaggtcggaagttcgagaccagcctcatcaaaagtggtgaaaccccatctctactgaaaattccaaaattcgccaggcgtggtgatgcacacttgtaatcccagatactagggagactgaggcaggagaatcgcttgtacctgggaggtggaggttgcagtgagtcgagattgtgccactgtactccagcctgggcgacaagcgagactctgtctcaagaaaaaaaaaaaaaaaaaagtctttcatggaggacttctcatacacgtgcgcacacacacaacacattgaacactttattgtttctgtagtgatggggagacagctaggtgtggagacctgtaataagtcctagtgatagcgagccccagttcccacctgggcagagttagatttatcctgtgtaactgaccaattcggagtgatttggagtgtttctcttcttgatgaggcccaggggccccactgcacttggcctacttctgaaaggagggaaatgctgctctcagtaatcctctgctggggggcgaaggtgggagtgattggattacagttcctttagtagctgcgtggagcttgccatgtgtcagaaaaccttagagtgtagtcatggaatcctcagtgctgacaggaatgcactctttttaaaataagtatgcctctctgtgttgggatatatgatcaattgaagcctctgggcagaatccattgatggaaagcctatatttaaaaacgaacctagtggaggtgtatgatacagaggatatggtacagagaagaagaaagcagtgaggtctcaggtgttggaaaagtcaagtctagacaagaagcaagacaactcacgatgcagacgagatgactggaagagtctggggaactttgggagattaaaggatagagatggtggatgctgggtgatttctacctgtgagcacgattaccagatgtccttgatagtgtgcaatgcccatgccatttccttcaggcgacgctgcagttcagcgtgcaagatactgccacacagttgagatgcagatgaatttggcacatgttcatgttgatgttgcccatgtgattaagcttatatgaagtggtacacacaaaaaaagaaccatttccttccacagatatttatatttagggaaaaatgagaatatttaaagaa

SEQ ID NO: 42126 - DNA, 1047 bp, Homo sapiens
tggaggctccaggatctaagcccaagtgccagcctaaagaccccacgctcttctccctggctgagtgctgaggtaccattcggctttaacagctgacggggctgatgcagctgcccggtgacaccatgtgccctgctgtgtactgcagttgccattttgcatttatagtgggattatctgatgctccaagctccacaagggcaaggtcttagtttttacatactgttgagtccccagtgcctgacactgtgctctgcacaccatatgtggtcaatacatacttggcaaatgaaaaagggaatgaacgagtggtcagggttaaaaatcaacgtatctttaaagtaagccaatgtgcttcccaaacccaaagaaattcttctcaaaatagagtgtcgaatagttttttttttttttttttgattggagaaacttgagcatgtttttaggccaagcagtaggaattattagagagggaatgatggcactattgatggaacacggtcccagaggagatctgaagtgacaagattaagagcagagaagaattttcattagcagaaacagggcacttcctccttagagaccagaggtgaagagagaaaaaaaggatccggtagtcatgggctatgtatcacttaggagtgctttcagctgcaagtaatagcttgactagcagtgcctgaaacaattaaggatttatttttttcatgtgatggtaagacagctacagctgggtgaccactgtgttgcttcagtggctcagtggggtaagggccattgtcttcaagactttcttggcctttccctcatgagatgcaccttctagcatcacatttgcattcaagtaaaagtccgtgctatccttgcagacacttacttcgcatgctgcctgctctgctgattgaggaaatggtcaagactaaatgaccactagtccctccttcaggtatgacagtggagtccaacggttagtgggatctgacctccagcgagcttatttctcctatgatgaatataagaagtttgtggccgggctcagtggctcat

SEQ ID NO: 42127 - DNA, 1026 bp, Homo sapiens
ctcaagaggccattatgtcctgtccttttgaagggcatgtttctcaaaagccaaggttgtacctttagtttcttgagagccaaggttgcatctttagtatcttcagtcatctttgcaccccagaatgtttagcacagagcttgcccatgatggctactcaaatgctgaaaggatgaatgactaaataaatcttgagatcagttgtatttttttctttaaaataactggctacagtcactggctctcaaccctggtgttgggctcatggggacattgtaatcagttgtaagcgggttgaagtgatttgttatgaatgattgttaggttttggaagtttgcaaactatgtactgtttgtataaattagaatgtttcccttcagtaatattctttaatgataatatcatcatcctgcagtgttaatacttcagtgtgacactctcccttgcattgtgatttgtcttaaatggaagaaaaaaggatggacttagagtcaggacccaggaaattgtatgttaatccacagcctatcttttctgtgccaaagcccataataagccagaaatcactgctaatggttatggaactatggaaatatgatagtcctctactactgtacgagatgtgggggccttgtcaaaatgaacattatctgtcaatttagagaaaagaataaccattactctaaaccaggggtcagcaaacttttacagtaaaggtctagatagtaaatatttgagggcttttgagggccatacagtctctgtagcaactacccaacttcgctattgtaatgcaaaaaagctattgtaatacataaatggatggacatcactatgttccaataaaactttatttacaaaaataagacggaggtcacattgggcttaatgagctgctctaagccatagagtacatgggaatgtaaaccatactgcttattttttttaattgtattaatggcatttattctacttcctttgtaatagctaaggagttcctgcaaagaaagaaaaattaggggtta

SEQ ID NO: 42128 - DNA, 1017 bp, Homo sapiens
ggcgcagtcggggagcgaagtccggagcaaggggcccccgcgtagccgccgccccctcctgctaccgtccagccagggagcccgcggcggccgccgatggagttcacttgagctgtgaaccggcgggagaggcaggcgcccgcaagccgagcgcgggccggagcccagccagccccgggcgctcacccgccagcccgcaagctccggccagaggcgccgccgccccgcgccccgccgttgcagcgcctcctgggccgcgcgccggcgagatccgcacaaaatccagactcccggagcggctccctccagcaccgcggcgggcccaggaccaggcagcccgcggcgcggctggagaggcgggaccggctgtcggggagccccgggcggccgccggggagaagccgccgcgcgccctcctcctcctcctccctctccctcctccctccctccgcacatggtctcctttgtcctgtcgccgccgccgccgcctcgctcttagctccgcgcgccgcggcggcggctcaggccgctcttctccgcctcgccctcccgccggccggcccgggacgcgccttgttagcccccgccgcgccagcgcggccccgcgcgccgcaggagcggcggggagacagtggcgagcgcgggccgggcgatctcggcgggcgcgctcctcccgccgcccggggcctcggccgcgctggatgtgtgcgcgcggcgccggctctcggtcgccccgaagctgttgcccggttcggatctggttcggcgcctccgctctcggactttggcgaggaaggagcccagagactcttgtggacagagccgggtcgagagttgggcgttttctcttcgtgtgttttggtggtttcccccctggtctttgacgatcgcccttcgggagccctgctaaagaaccaaaccatgaacttggggctgaccggaccgtttaaccctttgcaaccaggtaatgaagcccccggggcgcggctcgcttgcctacctctcgcggtcggaagg

SEQ ID NO: 42129 - DNA, 1026 bp, Homo sapiens
ttgcaaaatcattatgtgaatgagctgaattgctttgtgtatcatctcatagaaatatgttttgcacagataatgtgtctaataaggacacatttttaaaatcagatttttttccccccagcaaatagctgcactgcaggtctctctcaagcagtcaactagcaccaccttatggatgatttggggacattgctgcttccctgctaggctttcgtaaaatgtagtcaactgatttaaaataatgggaatgttgatggtgatgacaatattaatgacaataataatgcttttttcccccttcttgtttttcaggcatcagatgccagctctgaaaaactcttcaacactgttattgtaaacaaaggtaagacccattcattctcctgagtaatggcttatttttatgttagtttcattgtcattgcctaggaagaaagaagagctagagtgatctttctcttataattctgaagctactgttgatgtttcatgtttttgcttgagatggaagtctgcatactttgtgatgcattaacattaacaaccagtttattttaaaagaatacattgagtccctatttaaactgatttgactaatcactactactatgtgactttaatatagaaagctgtactcgagaagaatagttctcaaaatgcctgaactttattgttacttatcaactacccagcaataggagaaatataaatagctgatgtgcattgcagactccagtaatcaatggatgtttagaattcacagtattatggtcataaaccaagccttactctgctgtgggctttctgtaaagttaataaacgagcgagagggcagaatttaaatatgcactatcccattaatttcttccaaaccacgatctagagtaagagaggctaatgatatagcagtacattaagggaaaactaaccttaaatcattgccagtaggtttctgcgcagctttcatttgttagcagtatcgttggaaataaggaaatttaggggagtctgtaatcactggctctg

SEQ ID NO: 42130 - DNA, 1031 bp, Homo sapiens
atgagggtggggggcaggggcgagataccagagaaagtgcccaagagcaccccaggggcaactgccaggcagcttctttttctatgagatgactcattttaccaccacgaattgaaatgaggcttgcatgggccattgtagataatcgaaagaatgtcaccaccctcccatctgtcttcagctgtcacagactcacacaccaagcatttcatcagagttctagttcttcaagttcatctaggtctttttgactggagcaatctgacttcctacttttcttttgctagaaggtgataataattgcagcttcattcactcagtgctgcatttgctgtttgttggtttgtaattcgatgcgcagtcttcttgtgtctttgcgggagagttggttttagaggtggcacacaccaaaatcatgaatggatttaaggagggagaggctgaactaatttgattgttaccaagtccataatgtgttccttgggaaaattccacttgtctggactgtgctcctcactttctgagattgagaactggagaaaggaggaacgtcacagacaagacagcaagaagcttaaaaaacaaattcctggatttggagcagtgtgctctggtggaatattagatgataaactacactttgtggttttgttttgtgcagttggctgtagaggccacatggccctgtataatgacctcttcccaagatgttagacatcaaatcagtttgatttctacccccatgggaagaggaactccggttgtaaagaggcagcttgagaataactggtaaagggtgacttgccatttccccgctggtcttgcctcccaggagtaactgttatttgaccacatgacccagttacaacctgttacccctgtgtggccagggcctcacccccccagagcacaccttcgggtcaggctcatgcctgatttgtgccttctttccttctcagggccctccaggttgagggaagacagctttacacctccaccttctgtattagctccaggataaacttgaaaac

SEQ ID NO: 42131 - DNA, 1012 bp, Homo sapiens
aactctgttttcacaagccttccaggtagttctaatgcagacgactgtggtccagaaaaaacgaggaagaacattttggcagtgaggttttgtaaatgctcagacgatccacagagtcactgggtgaaatcatactctattgcacagggaataggtctaggttcgtagttgggcagccttttttttggaggggacagagtctcaatctgtcggccaggctggagtgcagtgtcacgatctcagctcactgcagcctccatatcctgggctcaggcagttctcctgcttcagcctcctgggttggtttgtttgtttgtaaatatcaacttcacctgatctgttcaaagtgcccctgcacctaccatttccaatccttccactctctatagccttgtgaacaggcctactcatgtttagcgtggttctgacagatgctaggcctgtacctagggctctgctcatctgaatagagtttgaaaccatgaccttgggccaatgttatgctgtaaccagctgagctaacttgctcaaccgcttctgaaagacaaactgttccatcgagttccttcttggcaggtgctgcatcaccaatgccggcctgccatctgtgtgaagggctatcacagcacacaacacacacacatactgggcaaatgtgccgtgattaccactaactattttgtaaacaaagtactgtgttaattctgttttaaactgctttatccaggattgtagaacaatgggcagaagtgttttgaaatctttttttcttctgtattgaatattagagttttaaggccataaaattaacatgtaaattgagttttcccaaaaaatgtaaaactcttaagaagtttaagtaagttacctaaatagtaaagctttttcagttgtccttcaagaataggcatcttccaaaactagttgtgttaaagtagtggttctcaaactttagcctgcatcaaaattagctagaggacttgttaagatacagcttgccggccgggcgtgg

SEQ ID NO: 42132 - DNA, 1025 bp, Homo sapiens
gctctgttcaaatgccacattctccaggaagccctcctaccttcccaaggtttgaacctttcctgtggcacttcctgcatcctgcctgtctttttttcttttcttttcttttcttttcttttcttttctttttttttaagatggtgtctcactctgtcacccagcctgtagcagtggcatgatctcagctcactgcaaccttcgcctcctggactctagtgattctcctgccttggcctcccaagtagctgggattacaggcgcatgccaccacacccagctaatttttgtatttttagtagagatgaggtttcaccatgttagccaggctggtctccaacccctgacctcaagccatccacctgccctgtcctcccaaagtgctgggatttacaggcatgagccaccatgcccactgcctgcctgtcttttattgaagttgtagatgtcctcttccccttttctctgaattctacccctatcctacccatggtgacccacagggtgctttgaattaaaatgaattaaaatataatatcctaaaagtgatttcaaactttggaatttaggttatatcctgagaatcttaagtgacttgattcaagaaagtaggcaaaaacctgaatcgtgtttggtctgatcaacccatttggaattaatcgaaaatctgatgatcccaactgggtacttttcaggaaaggagtgggaggctgcccacgtatattgagtgcctacagtgtgccagggcacctgctgatttatttgattcatacagtagcctagccaggtccgtctattacctgtgagaacactggtgactggtaagtgacagtgagttcttgccatctcctgttctttgccctttctcttataccagcccagcataaagaggatcgggggcttcagtttggtgaatttaaaaatgtctcttgttaaaggccgggcacagtggctcatgcctgtaatcccagcactttgggaggctgaggcgggtggatcacgaggtcaggagattgagaccatcc

SEQ ID NO: 42133 - DNA, 1049 bp, Homo sapiens
agtgttatggagaggaaagtagttggtagggatctttttattgtacatatgttttaacacacacacacacccctttctttcagctctggttccctctaaaaaggtcctgttctcatcctggccaccagacttcttccaccaggggtcccttctctctttctttgtcaccaggccaagtttgttaaccatcttcagaattacaggactttagtagctgaggaattccttttaaagtggttccaaactcagcacctttaggcaacacagcacattgttctgctttgttaagagaagcttgttttgaagagctaggaaaatgagttcaagctcagatttctctgggtagaaagggtatcccatatcagatgatgatgtgaagaagcagattgtgaactgtaaagtgaaaaggtcttaaacacgagagataagcaaaggggtgtgtatttcaggtaacatacaaacacaagggaaacagacctctggcatctcatcgcatctataaatctggatgatttcaggcaaaaatgaaaacatttgcttttcttcaatcttgggaatttctaaaacattgagttttttaataataataataataatagcaccatttgctgagccccaaatatatgtcttctgctctactgggctcctgatatacgttctctctagtgggcccaggacctgcaaggctggtattgttactgctgtatagaggttcaaggagatgacatgccagaggccacacgactgacgtgtgtgacagccagaatttcattcgtgtgtgtgtgtgtgtgtgtgtgtgtgtgtgtgtttccgatggagtctcactcttgttgcccaggctggagtgcaatggcatgatctcagctcactgcaacctttgcctcctgggttcaagctgttctcctgcctcagcctcccgagtagctgggattacaggcacctgccacaatgcccggctgattttttgtacttttagtagagaccggttttcaccatgttggccaggctggtctcaaactcctgacctcaggtgatccacccaccttctt

SEQ ID NO: 42134 - DNA, 1641 bp, Homo sapiens
aagctccacctcctcggttcacaccattctcctgcctcagcctcccgagtagctgtgactacaggcgtctaccaccacgcccggctaatttttttattttttagtacagacagggttttaccgtgttagtcaggatggtctcgatctcctgacctcgtggtccgcttgcctcggcctcccaaagtgctgggattacaggcgtgagccaccgcgcccggcctcatcctgacattctttatgtgtaaggtgctaaggtggtagcatactgctaaaactagattagtagtacttaatctagagggatcttttcaataattccatacattaaacaatttactgtctccattacaaggtgtaccattgacttaatactggttttttggggagggagtgagtttgagaaacactaggacgttaaaaactgctatgttgattgtaggatatctggatttcagaaacgttagcacatgcttgtgcaggggtgggagagggagaacctgtgtcttagaaatgaagaactatggtacatttatgtaggatatgatatcacattttataatttgtctgcttaaacaatgatttacagatcttttgagaaagagagcaaggaggttgggccttttagtaagacagaaaaatgaccttccgtttaagacttagacaaattaaattggactttgaaagtggtttacccttttcctctcgggtaaatgtcggaagtgagtgccctggctgaacataagggaaggtccattgtcagcaccctgaaagcctgtttgaaatgtcatcaacttggagcattcattggcagcgactatcaacagcccattttaaaaggatgccttgggtagaatggaaattacagtggccagccgttaatcctttttaataagggcaactgttgaggagaattatgttgtaagaatgaatgaaatttgggagcaactctagtccccatgttctgtcgtgactgtcaacaccaaatgtactttcatttttgcaactgcctaaggattttccatttaacaaacttacatgacaaatgggaaagcagtggcattccctgagagtccaaaatctggtttggctctgccgttagcacatttgcctgcagggattgatgtatctgattgaagaatgttgagttcagccaagagttaaggttaaggtccttctatttgttttgggtcagttcctacaggtagagaatttgaaagccctgaagtggtttcattgcccctagtagagataaatggccaaatgtaataaaaatagacagtgctgtccttaattgtcctcccctttatataaaggacctgggaggtggatcacctgaggtcaggagtttgagaccagcgtgggtggtgggcgcctgtagtcccagctactcgggaggctgaggcaggggaattgcttgaacctgggacattgaggttgcagtgagcagagatcgtgccactgcactccagcctgggggacagagtgagactccatttcaaaaaaaaaaaaaaaggacctgggagaagggaaggctagagggctagagccagtttgtattttattaggggtcaggatttactatgttaagttttaggatgtgaatctggaattttcttttttttcatgttttaagaagagaat

SEQ ID NO: 42135 - DNA, 1050 bp, Homo sapiens
catgctttaaggtacgtctattcctacttttaaaagtggcagatttgtgttttttaatgcataaattagttgaatgttcatccatccaaagagggatttcttctgatagattggggtgattagctgaaagactcagttcctggagaagagaacactagtggaaaatgcccaactgttaggggaatgaggaacaacagtgctgttcactgcattcctaacgccggcttatcagagttttgttttctgtttcatacacttaggaaagtattgttgccacaaagtgcatctctgcctgttagaaggatccagacatagcgtagacggattgtgcaatggagtcagaaataggctgtcctgctcccagtgagtgacttccccaccccttcatcctccttgtaaatcaccggcattcctgatcactttccgtggttccagctaggttaacaacagaagggatcatttccctcataacagtctccccattagtcaaaagttttactctcaagtgactaaaacgttactcataactgcttacaaggagaaaagatttattttccttttacttctttaatgcacatctggtggagaccctgataagcagtaagaaatggaaaaagcagggacctagaaagtgaaagtagacagatttgggtagtgcatgcaggctaattaatgatcccaggtgggctggagtgttctggttacattttccatgggtccagccctagagcagagaccatgggcatcagcctgccccttcccattatgtggctcaagcaccaccgtgtgccaaagggcgggaacattagatttccccaccgctgtaacatctgtaaattccacagtccatagaatcaaaatggaagagaacctcacgtttctgattgccagtcagaaggaatttatttttgaaacccagtttgctctgttatttgtagtgcaagatagaaatatcttaaccgattttatccagttcttatttaatgtctgtgattttaggaggaagagactattgtgtcataggtatttgaaattcacaagcccctctcc

SEQ ID NO: 42136 - DNA, 1031 bp, Homo sapiens
taccttctgccttcttttttgaaagcatctctgaagataaagttcaggtgattgcaggaaagtagaagtcattctgacatgcatttccgaagcatcaacttggttgtctgagagcatttcccttccaggattataattgtgagtggtaagcagcactagtgtattggtgacttactccagctgtatccaaggacaggtaaaacttcccactgtctctttctagaggctactttgtagcatttcagatgtgaaaggtgactccagcagagagctcatctatttattatttatttttgagacggagtctcactctgtcgcccaggctagaatgcaatggcgcaatctcagctcactgcggcctccacctcccaggtacaagtgattttgctgcctcagcctcctcagtagctgggattacaggagcccaccaccacacctggctatgttttgttttgtttttgtttttgtttttgtttttgttttgtagtagagatggggtttcgctgtattggccagctggtcttgaactcttgacctcaggtgatccgcccgcctcagcctccccaagtgctgggattacaggcgtgagccactgcgcccagcccagcgagctcatttctttattttattttattttattttatttatttttgtttttgagacagagtctcgctctgtcgcccaggctggagtgcagtggcgcgatctcggctcactgcaagctccgccttctgggttcacgccattgtcctgcctcagcgtccccagtagctgggactataggcacctgccaccacgcccagccaatttttttttttttttttttttagtagagatggggtttcaccatgttagcaaggatggtctcaatctcctgacctcgtgatccgcccgtctcagcctcccaaagtgctaggattacaggcatgagccaccgcgcctggcccagagagctcatttctaacaagctattatcaccatcctcactgctttctaaaccttataggtatgtagcttcaaagtttatattt

SEQ ID NO: 42137 - DNA, 1022 bp, Homo sapiens
ggtgcaaatccatacatgtttgtttgaaaatccttttagaaccttgccttgttaggacctcctacacctgtgtcacagacacagaagtaccgtgtttaagtattgagcatacactagttttttgtgacagaatctcactctgttgccaaggctggagtgcagtgggacgatctcggctcactgcaacctccgcctcctggggtcaagtgattctcctgcctcagcctcctgagtagctgggattgcaggcgcgtgacaccacaccacctaatttttgttttttttttttagtagagacagagtttcaccatgttggccagggtggtcttgaactctggacctcaagtgatccactggccttggcctcccaaagttctgggattacaggtataagctgccacgcctggcctgcatacactggttttaagggtggctgtgcttgggctgtgtatgtgcgtagtacacagtgtcatgtgagcacttagttaacagccaggcaggggtggacaggccaggacagctaagaatcgcggaaggagtctgggggtagcaggaaggctgcactgggaatggaaagcaagcaggagatgatcttatccagaggaagcagctaataaatattgaggctggcaggaggatacaagcaaacaaacaaaaagtggggccgtgtctttaaaagctttctccgaaaccaatatttggagttttcctgtgttcttggaagtgactggagattgcatccttcataccttatttctcctgtcaggtctctacatatcacatcacaggattcagctgatattggcctaagacccttggggtcggtgcagtgggaacgtgttatagatataaatgccttaccgttgataactcagaataagatataggatatcatcattaagtctgattatctaagcttatctgtgagccttacagaaaacaaaaacgaaagatcaggaccacaggttctttgactaccatttccctatttttttcatttgtcctgaacagggcctaacaca

SEQ ID NO: 42138 - DNA, 1021 bp, Homo sapiens
ttacagtaaataatactattatttaataactatatataattatttgctgtgtttaataacaaagtgaacattgactttaatttttatattgtgcttaactttccaaattttctataatattcatttgttttgcacttttcctcctcctcctcctcaattttgaaagttaaaagcacaatatgagaattaaagtcaatgtttatttctggatgatgggactgcaattaatgtttatctttccagtctcttttctgtgcatacttgtatacatttacacacgtagttttcactattgagatcacactgataatagtgcactttatttaatggcaattttgtcatgagatattttctgtgacattaaatacttcttcacaatagttttgggaatattgattgattacttacttattatgtgttgtgcattgtggaaagcactttacatggcctaatttatttccacaaccaccctaggaggttgttactgcatttgtgcagtaagtcattggacttttagaagtgtaggagttcatcagagtataccgaatctcaaccctaccagacccagcataataataagaaatattttatagcgcattcattttttactttctggaatgaaatagatacttaatgtacccatctacatacataatttaaaagtatatataaagccctaataaaatataaaggagaaataagtggaaaccaagtcatttataataacatacctttaagtatgtaagtgcttgtttatattagaagacaatgtttgactttatatctagaatggtatctaaatacttctactacaaatgcagactcacacaaatacatggtcatggagattcagatacctggagcagccttaccattgtgtcatgattttcccaaatagccatcaacccttgcatatgacccagatataacaaagtacagtccctgcattcctggaaaaatcagcgtatattaaaacccatgcaaagaattactttgtgtttatatacaaaaacagaggtgg

SEQ ID NO: 42139 - DNA, 1987 bp, Homo sapiens
ttgctctgtctgcagtagcgatgggaaagtttgcaggagttgtgatttcagaaagtgtgctcgtacagggaggatctgtaaagaggaaggggcaagagagactgtggtgagggtttaggggaaggaggtaggattcttttaaagagaatacattgcttacctttttttatttttttcttttcttttttttcttgttccgatagcagcagcagaagcagcactccagcgaagactcagcccgccccacctcacatctcccaccacccctctgcctccccgttccccctctccctgcccaaccacagccccctgcacagcttcacacccaccctccagccccccgcacactcacatcaccccaatatgtttgcccctcccactgctctgcctcctccaccaccactgacatcaggaagtctgcaggtggccggacacccggccgggagcacttactcaggtaggacggaggggcctgtgctcgtgaccccgacccccaccgcccctcgctgtgacctcaccctacctatgttgtcccgattgcaaggttgcatttgcctacaattttttccttccttactgtgatcttcctcaaacgctctctggcctgaggtccagcaaaaatacctgtcagcacccatactaagctagctcagcccctgtgaatcagacactgcccgaagagagtgggtttgtttggagttaggaggcatttccagctaaattcagccactgagtggtcagacccaggtagtgtgtcccgtgtcgtctgggctcccctgagggcgatggaagcgtccccaagcccatgtctgtctcgctccaggatcttagattgtgtcctggtttaaggggtttcttttcattgggcagggcagggccttctcctgtctccttgggaggagatgacacactctttgtgacaatatatcccagaattttaagggcagatctcatgttagacacagggtccttgtctcctcacctgtgttaatcaggtcaagcgtcccagttttggtccagtgtagccatgttatgccgccaatacagagagccatatagcagtaattgacacttgaagaggacatgcgagccctgccgtgtgaacagctgacatttattagtgtgctatcactgttcccaagcacttaaacgtgcaaattgctttaaccctcaaaaatcaaacccatgagttaggcaatattattgtccccctcttggagatgggaaaactggccctcagatgggttatttgccatgcccagggtcactcagccagtggtgacagctggaaatcggactttggcatttggcctggagtttgttccccagattgatagactgcctgtccctgaaagctgggagaccagctagagaacagggagacagggtgcgaccgggccttggtctcgtctgcttcattgattgcccccgtttatctcagggcccagccacaccctgtcacccctgccactgtgtcaccagccccgtacccctccacaggaaggcagtccgatgtccttttctgaaggaaaaggcgtcatcgtctccctcttcttctcttccagagcaagacatcttgcgacaggaactgaacactcgttttttggcctctcagagtgctgaccgcggggcttccctgggccctccgccctacctgcggaccgagttccatcagcaccagcaccagcaccagcacacccaccagcacacgcaccagcacaccttcacgccgttcccccacgccatcccacccaccgccatcatgccgacgccagcacctcccatggtgcgtaccccaggcagaaatgtgaggataagtagagcacgactcttttctttatgcagcacgtgggaccgggctgggcagcggggccaccagagatcgaatggggactgacggctgttggctggagagaagggaatgtgtcctagtgccctgcctcaggcagctctgacttcaggggcctaaagtaggaacttctttcta

SEQ ID NO: 42140 - DNA, 1048 bp, Homo sapiens
gaaagttttctgctggcctgtgtgagctgtttcacaaataaatttaaccaaaggtagttatagcatcaatatgatgacattatttagagggaacaatagtatactctttttctgttccaatgaaaggctgtctggcctaccccagatcactttgtatttgggtataatacatttcagaagacagctgcatggcaagacagtttttctgccaaagtgaagatgaaaatagggggaattcactgggtaaatcagaccaaatgctcacctctctctgatttatctggataattggctgttctctcctgtttagaggtttggttcgtgccaatctgtagaaagaaaatagtaggaagaaaggcatcctagtacgtgcagaactaaaacgtaccacttggtttttaattttgttcttccatttctgttggcttcttgtcagggagactcaggagctcagaatggtttcatatgtaatgaggttatggggtctcatgacagcttaatgacagggaagctttgtagggccacctccactgtagcagtgaacaaaaatgcagattaagtaactagcttttgctttgatccctttacagtttgacaaataccctacaaaagttgacccattctaccggcacagtgtgagtttcattaccatgctacacattgaatgtaactgctttgccatttttgtgctcttgccacagatcagtcaatgactagcagccttccttaatcatctttgcaagagttcccattgctcctcgccactttggatgcttgcttttgtggtgttttgcttttggtaaagatgcagtatcatcttctgaatcaaaagatcataagcattccaaaggcttgaaagcagagttgctctttagtggcagtcaggcatctgtcctgcaaagtgagatgtctgcaatggagtcagtagagttccaggagagtctgaaatcacagcatttcagtcgtcagttgaaatgccactaacacagaagttctggaatgcaacctgaattatttcctcttaaatagaaagtcccttgtctttttg

SEQ ID NO: 42141 - DNA, 1066 bp, Homo sapiens
ggcatcaaactgagattacgtggcttgctcatgtcgatgtctttctatgggacgggaatttgaatatgtcacttgcctcctactaaaatcttttttccccctctccgtctttggccacagctcttccattcctatcctcctgcagtgtcgggcatcccccctatgatcccacccactggcccttttggttcactacaaggagcatttcagccgaaggtaagaaacctcacagtgaaaacacacaggcatgtgtctaagtggcgtcccgggccaggcgtgcaggaagttctgcgtcctcttgcctgtgcagtgactcattaatcaggtcctaagtgaccactgggattagagtgagcctatttttcttttttttccaagtccatctagttttaaatggccgtgaaaatttacttttcaaactgtactacccagataatctcagttaagctaagatttcttgtgctcttcaaaatatacacaatatttatttttttactaccaatatcgtggacataacttctggtcaggaattctatgaaatatcagacacatgtgcgccaggttgttccgcaggtgtatgtaattagtaaagacacaaagctgggtccttactgattttagtagaagtggggataaaggttccacaactaaaattgtatcctatgaattctcattctccctcatttccctcgccaaccccatcggctgcaaacagggcctgccggcaggtggggtggtcgcctcccattttggtcctcctttctttctccctctctctcagccatcccacccctgccatggttacactggccaaggccaagactttgtcatcagttactaacatcctagtgtgaaattaacctttcatcctttataaaaatcaaattctgttctacctagtcagtgataatgccgtccagcgttggctacagctgtctctaaaggtcaatattgaagagtcattctcgaaacactctctttttaaatatacttacaatttctattttaccttcacacaaaaataaaaagagccgtactttcatgtgggtaaccattctcagacttg

SEQ ID NO: 42142 - DNA, 1117 bp, Homo sapiens
aagtcaacgagtccgatctcttgttagcagttctggtaaaaggtttgactagttggaacttaaggggaaagactgaagctataggctgaagttagtctctcttgcacttagaaaatatgtagctgggtccatttattttggctggtggctccctctttctgtagtaagtgacattgacttgccatagccgtttgacctccttttaaggtgcaggaaggaggtactataagcatctggtttgttaacatcttgcttaaagcaaattgttctcgaggtctggagactggccagtgtgatgacctctaaatgaatcctggtggttgggggtaagacagacatgatgaattgttggacagaagatggatggacagcagatttcttgctatgcataactcatttctagggcacataatcagataatttgatttctccaggggaaaaaggagaattgtgtcatcacttaggtgaggcagtatattatttgtgatttcaaactacccataatttcattgcaagagaagagaactgacccagacttgcatttaagtatatattttcggaactaactccatactgtagaaaccagaagcttctgttcttcgccgatgtagaatgaggctgtgttttcttctcatctgtccagtagtcactgagcgcgcacgccgagcttatgggtagattacttagcagaaatgaagtgaaaaggtggtccctgcccgctgactggtagaagagaatacactcacagcactccactccttataaagcaagacatgaaataattggggagatgtggattcaaattcaaccccagagggtggaggatggacttgagatctgcagaggcctagatagagaacaggaaggaaggaatattcttctctttgtttctttctttaaacttaggaacagcgcccaccaacacgaatgggtagttgactcttagcatttacggtaactgggcttcaatcaaaatgtgaatttctttgtaccactttgggggttaaaataaaaaccaccacggtcttgggggaggttaggacaggttctgtaccctctcttattttgatttgactcacagacattcactaatgagctcttctgaacagctgatttg

SEQ ID NO: 42143 - DNA, 1025 bp, Homo sapiens
ttatagcatggcaacatttgttaagtagggcttcccactctaccaggtctgccagctggcagcagaaaagaaagagaagaggcacagagtgggattcaggcttttgccgtcttgtccttggtaaccggggaggcccttgtcaatgtggttttctgagtagcaaacccacgtggggagagagggggagctggctgtgactcccttatgactgggcgctggagagctactgatggaaggcacttggagagtacaaagcactcttgtttcacgaaaaaagcctctgcagccaaaatctgctgaaagctttggggaaattgaaggtggttttctctgaaatgtcttcctcctaaccacgttgctctttcttgttccagaaaccagggaagtggtgtgctatgcatgttcacatcgcctggcagatttaccaccaccaacagaaagtcaaggtcagtccgaccttcgtggtgtagggaagaatgggatgcacatgtgagtgtgtgacgtgctcgggagaacctgatgaaggaggcatttaaaacacattttacagacccatagttaggaaggatcaagcctctcttggaaaagctactcagaagtcttacttattttttcctagagtcagggtctcactctgttgcccaggctggagtacaaggggacaatcatagctcaccacagccttgaattcctgggctcatgtgatcctcccacctcagtctcccaagcagctgggactttaggcatataccaccatacttggctaatttcttgattgttgtttttgtagagatagataggggtctcactgtgttgcccaggctggtctcagactcctggccccaagcagttctcccacctgagcctcccaagtagctgggattacagtgcaagtcacagcagccagctcagaaatcttactgttaattagggaaaccactagtgaaattacaaaacaaaagcaaactgataatgccccagggttttgttccctttataattttgtcattttattgatccaaagg

SEQ ID NO: 42144 - DNA, 1050 bp, Homo sapiens
caggtactaagggcagtgaaaacccaggagactgatggggaagaggtcatagcaagggaaattcaactagaagcttcaagtcccaggaccccatgccttgggagcagtgcttatccaaggcagtgtgaagccagttcaaagagaaagctgtcaagaaacaaggaggtggggcagctttgaaaccatgctggtgcaagggcctccagcctagagaaggatgccaggggaaaagattgagaggaagattaagacccaatttctactgcctaagaggatggtaggcggaaagattagcctgaggatagataaataagacaaaacagagtgatttctgtccatgataaggacttcacacaagagtttgttttttttttttggagacagcctcggtcacagcaacctccgcctcctaggttcaagcaattctcgtgcctcagcctccccagtagctgggacgacaggcgtgcaccaccacgcctggctgatcttttgtattttagtagagacagggtttcaccatgttgcccaggctgcccttcaactcctgagctcaggcagtccgcccgccttggcctcccaaagcgctgggattatggtttacttgtctggatggacactgccctcccccaaccttcctcaggtaattacaggtagtaggaagagaaagggcctctgttagttaaattaatactcctactttgtttttctttgttattgttatataacagtgatcatttgaaagttagcttatagacatgcaaatatttcttcataacttttggttactaatgtactgtgagctattagagtatggcaaagagtcattaaacaaacaattaatttatacagcagattgttcatgcagaattcctaataaaatgagctttaagacactattattttaaaccttactaaaatgggcctttacagcaaaacactgaactactttgggagtggtggcagtctccataaataggatatggttttatttctcaagccattaaccttgaagaccaaacatagctgggtgcggtggctcacacctgtaat

SEQ ID NO: 42145 - DNA, 1038 bp, Homo sapiens
ctgtattccagctggtgatcaagtctgggaacagccgtaacaggtcaaccttgtggagccatcgcgagttagagggtgaaagatggcagaaaaaaaagtcttgtgtgtgagtgtgttttttgagtttgcatcaatcttaatgtctcttcataatacttttataatacattaagcctcttgtctacatatttggagagaatatgactttactagcagagaaatacaatatatcttgtctactggactgtaaaatatatgtatgaaataaaattagttccatttggtcttctagtatattaaagtgctatctgacgttgttatcctgtttttgcaaaaaaaaaaaaaaaaaaaagttaactacagaccattgtttctaataagcagagagatctattttagtagtaaactgaaggtttagttgtgagcttcagattttgtgaactccagatgttgtgcggtgtttttttttttttttaagacaacaactaaaaaaaatgcaaggaatatgtacactggaactgtagtggtagctttcagtattgtaaagagattgttctatacggacctttttgctgtttatcctgtatgtaataaagtcctttctagatcctatgtgaaaagaaaagtgaagcaactgaatcttcagcatgttctcatcggcggagccttcttgtgtaatgtaaactgtgccatgttattaaaaaatgtgaactaagcttccagctgcttgtttgtgtgaggtgaccatcattaccttagggaagaagccatacctgtacaagaccgggctcttgaaaagaaacacctcgaacccagcccgtgtaagaacagaaggctcacctgcagtggctgaccaccctacccaactcggttagtgtctcaccaatttgttactataaacatttgcaccccacacagtcgcttgtggtttgttttttgaggagggggggttctgttagtttttcgtatgtccaagatactgtaaaaggtacttctggattttgtagacgtgtgtacagtgtgggccacgttagccag

SEQ ID NO: 42146 - DNA, 1080 bp, Homo sapiens
ctcagctcctcggcactgatgggtaccagcaccaatttgatttcctgctaacctatagatgctctaattatctcccccatctttgactgacaatgatcttgttaccttctaatggtacatgacaggtaaaatagcgaatataatgatgcaataattaaccactttggatggatatttgccacggcatttgctgtttatccatttttctgcctcaatcaaggtagatgaggggaaataagacgcaattgttgacattctttacatacgtagcataaaagaagttgaagacagaattttgcagtgcaggtagctgtgcacttgtggggtgcccaaggccttgtgtgtattcatgctggaaaacaaactaggcctcagtggcatcaatcggttgaaggaaagaggataacaaatgtaacctgggctttttcatatgttattttttaaattctgccatcctttttttctgtgcatttctgattttttttgtttgtttgtttgtttgttttttgagactgagtcttgttctgttccctaggctggagtgcagtggcataatcacagctcactgcagcctccacctcccgggatcaagtgattctcctgcctcagtctcctgcatagctgggactacatacaggcgcccaccacgcccagctaattttggtatttttagtagagacggggtttcaccatgttggccaggctggtctcaaactcctgatctcaggtgatctgcccgccttggcctcccaaagtgctgggattacaggtatgcgccacgcctggcctgaaaaattcttaaacatgcaaagtcttcttgcaataaaatagggttattttccagataggaaatcatattatctaaggctgtcaattccacaatatgaaattgctagtctttgccactgtcacaagtactaagctaaggttttcgtgtctcacgcccaaaatgctacaagttcctaatgatgagcttggtgggaaggagtccttgggccacagtcatgggggctgaatccaccccgtgtgccttcacagtcggtgaccccgtgcacaaagagcctctttggaactcagttt

SEQ ID NO: 42147 - DNA, 1049 bp, Homo sapiens
ggcatttatcctgtcccagtatttgagtgaaacttctcagcatttcagagcagtgaccatgatacaccctttcctttccttctccttatgggaaacttggttctaacccagaggacttgggctccaggacccagtaacgcagccctggacttgaccctaaaagggagtaaagacaaaggtgaagttcagtctggggttcagggctgccaaagctcatagcctggagcttcttaacctttaggcggggtagagacatttaagacggcccctaaacttggggagcgcgtaggctcataggaaatagagtccgttacttgtcctgggaacggcggtgggtgtcccaggaggcggacttccggtgcactcctgcgcgtgtgcacctctccctgcgtgcgtgttcgcgcgtgcgtgctcgcacatgcgcgccacctccgcactgccctcgcttcctgcgcctcttcaggtcaccgcttgctctagttcccaggctttggcctctagtggatgagaatcaccgagtctgcggggctggacgctgaccgcccgggccagcacctaggcgggcgggagctgtgcggcccagggttcgcgcgggccgggtagaggctcgagccgggacccccgagcgtgaaccccggagccagcggcgctggggccagaggggccaggcgggaggtggtggcggaggcgaaggggcgacgggacctgggcctggcccgtgtgtgtcctcggcggcctggcgccggccgtcgctgtacggtgagccccagggaggcggatctgggccccgagaaggacacccgcctggatttgccccgtaggcccggcccgggcccctcgggagcagaacagccttggtgaggtggacgggaggggacttcgcgagcagacgcgcgcgccagcgacagcagcccgccccggcctctcgggagccgtggggcagaggctgcagagccccaggagggtaagtcttgggttttcgggcccggagcgagaagggcctgagtgaagtcaccgtgtgttggggaccttagagtgtggggcagagg

SEQ ID NO: 42148 - DNA, 1078 bp, Homo sapiens
gtaatccgagcactttgcggggctagggcaagagtatctcttgagaccaggagttagagaccagcctagacaacatggggagaccctgactacaaaaaatacaaaagtcgccaggcatgctgggatgcatctgtggtcccagctactcaggaggctgaagtgggaggatggatggagcccaggaggtcgaggctgcagagagccgtgaatgcaccactgcactccagcctgggtggcagattgagaccctgtctcaaccaacaaaccacaaaaaacatgagccgtataatgggaattttttttctttttgcaccttgtatttgatgatgatggcagactatttgtaaaaggagtcgtgctacccatgagagtctaactcatctaattactacctgattatcttagagttacaggcgcatgcttcccctatcactcttttttttttttttttttttttgagacagtgtctctcacccagtctggaatgcaacagcgtggtctcggctcactgcaacttccacctcccaggttcaaaggattcttgtgcctcagcctcctgagtagctgggactacaggcatgtgacactatgcctggctaatttttttgttatttttaagtagagacggggttttgccatgttggcccaggcaggcggatcacttgaggccagaatttgagaccagcctggccaacatggcgaaaccctgtatcactcttttagacccttctgagtgtttgcaggttgagtgttcacagggtgttagcctattgagctttcttttgcggttcttatgcaggtgatttctgcctttgcaggccggagccctcatgacttcagtgacctgcttctgcccctctaggtctatcagccacagtctctgcaagtttccaagagcagcagaaaatgaacacattgcaggtgagttttcctgcttgtgtatatgttcctcaattttattttatgatgcattttaagaggtttgtaaggattcatactttttttttcttttttttgagatggagtcttgctctgttgccgaggctgcagtgcagtggcatgatctcgcttcactgca

SEQ ID NO: 42149 - DNA, 1019 bp, Homo sapiens
gcttgagtggttctctcacctcagcctcccgagtagctgggactataggtatgtgcccccatgcctggctaatctttttttttttctttttgtagagatggggtctcactatcatgcccaggctggtctcaaactcctgagctcaagtgattccccccgcctcggccccctaatgtactgggattacaggcataagctaccacacttggccatgagtcatttttaaaaaaacagattccaacaacctttttgattgctgtgtttagaagatttatacttaattttagatgggtttttattatctcttttctaagttgttccctctgggtttttttatacctgtttgccttttcttgcctttttatggggtatttagacatttcttagtatgccatttaacttcatatgccgtgctaaatcaattcagtatgccatttagtatatatttttgtataggattttataggtggctgtagagattatattatacatacttatgattgttggctagtatcaaccttttaccagttcaagtggaatgtagaaactctacttctttctaggcccctttgcccttttttatggtattgttgtcttgaatatcacctctacatatgttgagaaccacgtgagataatgttatgattttgctttcgcccatcaaatataatttttaaactcaagaaattatattcacccagatatttaccgtcttattgcttttttaaatttcttttttaaaatttaatttgtatactttttcttctgaaaaaaaatctttttggatttttcttcattgctttttttttttgagacagagtctcactctgtcgcccaggctggagtgcactggtgtgatctcagctcactgcaacctccacctccctggttcaagtgattctcctgcttcagcctgttgagtagctgggattgcaggcatgcaccgccacgcctggctaatttttatatttttagtagagatggggtttcaccatgttggccaggctggtcttgagctc

SEQ ID NO: 42150 - DNA, 1049 bp, Homo sapiens
tgtgtgcaacccagaggccaatttgtttttttgttgttgtttggagacagtgtcttgctctgttgccctggctggagtgcaatggcccagtcatagctcactgcagctgtaacctcccagactcagtcactccttcttctcaacctcctgagtagctgggaccagcggtacacactaccatgcccagctaattttttatatttagtagagacaaggtctcactctgttgcccaggctgatcttgaactcctgggctcaagtgttcctcccatctcggcctcccacagtgttgggattacaggcatgagccactgcacccagccctggaggccagtttgaaacctcagagtattccacattgccgttgagctctcaaagcttttgctgtgttgatcctggttgttttcacacatgggcacttcgagggcatggccaggacttctacacatatttaacccatttcccatttaggaaaaaaaaagtgcagcttgctgctagcgttcatttaattttgcataaacacacttttgagactgaagtaaatctgactgattttcaatgcgaaaataaaatatgaaaactgggtttggccttcttccaagtgtactttccttcccttccttcctttctttactgctttaaagctttttaatatactttcactcctgttctaaaagaaaaaaatatatatcaactgttcttggagttattattaaacagaacttgtctttaatccgaatgtaacagaaatgtacacgacgttatattaggattagagaggaatattctgcggtgggtgggacggggaacgggaaatgggttggagaatccttgcttctagctcctcactgtctttgagagaggatggggtgccaccttgttactgtggttcagtcttgtgcaggttgtggatggtcagcagggcccttccacacagtctttccagtgcttggtggagaggggagagatgccacctctgcttgtgttggcccaaggtggggagggtcaacaggtctttgttccacagtgtctacagtatctggggcagg

SEQ ID NO: 42151 - DNA, 1041 bp, Homo sapiens
ctcttcgctgtcatttggctcgaaagatgaggctccttttgcgggggttaggggatgaagggggcactgggatttcctggttgtagactctgctctaacagataagacagggtatataggaggccaaagaacaaaccatcaaaccaccccaggaactcaccactgggtcagcccttctcttctctacctttccagaatttgttggtttgattgattggatcgttgcttcatgtatttatttatttgtttttaattgagatagtctggctatgtccgccaggttggagtacaatagcgcaatcttagctcactgcattctccacctcctgggttgaagcagttctgcctcagcctccctagtagctgggattactggcgctcgccaccacgcccagctcatgtttgtattattagtagagatggagtttcaccattttggccaggctggtctcaaactcctgacctcaggtgatctgcctgcctcggcctcccagagtgctgggattacaggcatgagccaccgtgcccagctgcttcatgtattttgaacaggggttttagttgtaattagaagagaaatgtaatgggtgtgcttattccatctcctatggaactggaaacaacatttggcattgaaaattgttgtcttgataaccttcagggtgttacttctcattttagcggcaatacattttgcttccgtgtgatgaaacatcctacccatttgcatgttgattgtgtctcatgtcccatctcgcaacaggcagtaaaaccccatctccagcccaaagcaccttgctaaagagcctgcaccgcagtcactgtgcctttgcgctctggctcgtgcgacctctccagatcttcttcctcatttcgtctgttcactggggccctcttctccctgtgactcgcctcagccttttcactccttgctggacatggagtaggactgttgggaggatgaaatagacgaatgcgtggcaagcatgtaggagagcctgtggcacagaagcagcactcggtacatggtgcttgttgtta

SEQ ID NO: 42152 - DNA, 1083 bp, Homo sapiens
tcttctaggatttttatggttttggattttacatttaagtctttaatccatcttgagttagttttttataaggtgtaaggacagggtccagtttcagctttctgtatatggctagccagtcttcccagcaccattaaatagagaatccttaccccattgcttgtttttgtcaggtttgtcgaagatcagatggttgtagatgtgtggtgttatttctgaggtctctattctgttccattggtctatgtatctgttttggtaccagtaccatgctgttttggttactgtagccttgtagtatagtttgaagtcaggtagcgtgatgcctacagctttgttctttttgcttagtattgtcttggctatacaggctcgtttttggttccatatgaaatttaaagtagtttttctagttctgtgaagaaagtcagtggtagcttgttggaaatagcattgactctgtaaattattttgggtagtatagccattttcacaatattgattcttcctatctatgagcatggaatgtgtttccatttgtttgtgtactctcttatttccttgagcagtggtttgtagttctccttgaagaggtacttcatgatttatgagagtttttaaaaagtttttgtctgctaagtccaacgtctgggcttcctaagggctgatttccatcaatttattttgttattttggatacgttcctttgtcttggcatgatttgtgactgtcattgaaacatggacatttgaatattgcaaggtagtaactctggcatttagatgatacttctcattgtttgctatgtgtctgtgagtgagtgtgtttttaatcattgaaggctgtagtagtacatacatttagtgacttccaaactatttttgcaaagatttatcattttcatgtgtggtcactgaagtctctgattcttttagcttgtgttcagctcacattttgatagagatttccttgaatactaggagctaaaaatggaagaaaacacctctcccagtctttgaagtttgcctttgcaccacagcttttcttcagcacttagctgggcctgcactgaccctcgtaatc

SEQ ID NO: 42153 - DNA, 1034 bp, Homo sapiens
ttttttttttttttttttagttggagtctggctctgtcacccaggctggagtggagtggcgcaatctcggctcactgcaagctccacctcctgggttcacgccattctcctgcctcagcctcccgagtagctgggactacaggcaccagtcaccatcaccacgcccagctgattttttgtatttttagtagagacggggtttcaccatgttagccaggatggtcttgatctcctgacctcatgatccgcccgccttggcctcccaaagtgctgggattacaggcgtgagccaccgtgcccagccaattttttattcctatatacattttcttgagctttgttttgggatgtatttaagatcattggaaagttggatcctttcaggtcttgtttttatgattcattaggtgggtccagagcagtgctcaatctaagactgattctttcccattcctgcggtgcttgagtactccacacagagccctataaattgtgagtttttccagtctgacttgtggtggcccccatctctacaaaaattaaagaggctgggcacagtggctcatgcctgtaatcctagcaggtctttgagaggccgaggtgggcagatcacctgaggtcagcagtttgagaccagcctggccaacatggtgaaacccagtctctactaaaaatacaaaaaagtagccgagtgtggtggcgggtgcctgtaataccagctactctgctgaggctcaggcaggagaatcgcttgaacctgggaggcggaggttgcagtgagccgagatcgcgccactgcactccaacctgggcaacgagcaacaggccatctcaaaaaataaaaatcagtaaataaataaagaaaagactacctcatccagaaatgcctttatagacacacccataaataaatgttcaaccaagtatctgtgcaccccatggtcccttcaagttgacacttgaaattacccatcactccagccttcagccgtgggtttgtttcatatatagatttctagaactccctctttgca

SEQ ID NO: 42154 - DNA, 1034 bp, Homo sapiens
aagtttgtgcagtggataaaacagtatgaaacctaaatgttaaatttctacatgtcagtttaaaaacaaattggaggaagaattgggtggaaaggaaagtggctcaaaagtatgtgtggaaagacttaggataccttaggtacctcatctgagtcagcagtgtgatgtggccgccaggaaagctaaagtgctcctggtctgtgctgttagaagaaagactagaatgaggcaggtggatggtattcctgccttccgtagttctgctcactgtccgtggagcactgtggtcagatcagtgtactgcactgcgagggaggatgtacacaaacggaaattcattcccagtgaagcaatgaagatgttaaggagatttgcaacagcccaaaggggtggtggtggatgttggggttttggaggtatggaagtattagcccagaggagaaaagtctcagggggaataaagaaataagtgagggaaggacaatggtctccaaaaaaccaaaggactgtcccttgaaagaagcaaaataacttgctctgtttgacttcaaataggatccgtgggtgaaagaggaaatacactgtaatccactgtaagaataaactggttcatggttgacgtgggtcactctaggagagagttgtctatattgtaacaggttggatgactgtcctacagaaaagatgcgtaggagatttctgtttccattggaggtttagtaaaatgatgggttcctcttaactctgatttttttttaatagctttgttgagatataattgacataaaatagaccgtacttgtttaaagcatgtgacattttgacacacatacacctgtggaaccatcccaccactaagataatgaacatccttcacctccaaaagttcccacatgcctgtaatccctctctttacttccacccctgttcccaggcatccactgatctgtcttctgtcactgtagataggtatgcattttccagaatattctataaatggaaatcatacatttaagttttaaatatttggcttt

SEQ ID NO: 42155 - DNA, 1034 bp, Homo sapiens
ggcgcctgtagtcccagctactccagaggctgaggcaagagaatggcgtgaacctgggaggcggagcttgcagtgagccaagatcgtgccactgcactccagcctgggcgacagaacgagacccgtctcaaaaaaaaaaaaaaaaaaaagccccacctcttaatacgatcacagtggcaacacctgaattttggggaggacacattcaaaccatagcagagtcataatgttgcaacctattttcaagtaattcagccaaaaagctgggggggggggggaatatctgtaggccgagcacaatggctcatgcctgtaatcccagcactttgggaggcagaggtgggaggattgcttgaacccaggagtttgagaccagcttgggcaaaatagtgagatctcatctctacaaagaaaaatttttttggcctgacgtggtggcgtacgcctgtaatcccagcactttgggaagccgaggcaggtgaatcacctaaggtcaggagttcgagaccaggctgaacaacatggcaaatccccatcttcactaaaaataccaaattagctaggcatggtggcgcatgcctgtaatcccagctacgggaggctgaggcaggagaatcacttgaacccgggagttggaggttgcagtgagccaagatttcaccatcatactccagcctggacaagagcgaaactccatctcaaaggaaaaaagaaaaaaaagatctcatatccaaatttctcaaggcccaactcaaacaccacctattttataaacttttttttttaagatgtctcactctgtcgtccaggctggagtgcagtggcatgatctcagctcactgcaacctccacatctcaggttcaagtgattctcctgcctcagcctctggagtagctgggactacaggtgcccaccatgcccggctaatttttgtgtttctagtagagatggggtttcgccatgtttgccaggctggtctcaaattcctcacctcaggtgatctgcctgccttgacctcccaaagtgttgggat

SEQ ID NO: 42156 - DNA, 1062 bp, Homo sapiens
tttattactagctaagtgatttgcttttacacatctgcttggcagctggtgcaatgataagttgttaccacaaaataacatggtcctgaattacatggaatttttggggtcactttcgaatggttgaatttgttgatcccaacttagaaggggtcagaaaagagtacctcgggatgattgatccgttttttgtttgtttttaacttggcttttttttgttttttgttttttggtctgggggaagtattcacccagaactcctttaccatgtccacttgtgtttctgccttaccagctcacggatgattgatatccagaccaggatggctgggcgagcattggagcttctttatctgccagagaataagccctgttacctgctggatattgggtgagattctggggcctggttcagattgtctaaggtggtgaagtgtctttgtaaactgaccctgagtgtctggtcatgtcttccagctgtggcactgggctgagtggaagttatctgtcagatgaagggcactattgggtgggcctggatatcagccctgccatgctgggtaagtatgtcctgtctggcaccagggtggattaccctgatgggtgtggagaagccacaggtatttctctttctctgactgccttttctctaatgtagatgaggctgtggaccgagagatagagggagacctgctgctgggggatatgggccagggcatcccattcaagccaggcacatttgatggttgcatcaggtgagggtctttaattcctgcttttatttatttagagacagggtctcactctatcacttaggctctagtgcagtgtctgtgattatggctcacactgcagcctccacctcctgggttcaggtgatctgcccacctcagtctcctgagtagctgggactacaggcccacaccaccgtacctagctaattttttgtttttttgagatggagtcttgctctgtcaccaggctggagtgcagtggtgtgatcttggctcactgcagccttcgcctcccaggctcaagcgattctcctgcctcagcctccca

SEQ ID NO: 42157 - DNA, 1311 bp, Homo sapiens
ccagaggtgagggacactgggtttgcaggcaggcctgtgtcttttgacttccaggcagtggggctcagcctgcagagcctgctgggagaacactggtggggaagcagggcccagccccagagtgcagaccctggagtgctcacatcctctggaatctggaggcagagacctctgctctgcaggtcccagaaaggcgtgtcagttccttctcgtgggactggacctcgtccctgtcggaagggtcaggcctgggtgcctgggcttctggagtggggcagatggtttgagaactctccagggtgacctgagtgcactttggttcctgcaggggctgagtgaaaatcaggatgaagttgaacccagggagtctgtgttcaccaatgagaggtaaagcaactgctgaagcctgccccggctgcagcgggggctgccacatttgttagacatggactttctctctgccctcacccaagcctctcaggtcacatgcagcagggacaccaaggtgacggtagaaacatcaggtcccatttggactgtgcctgtttggggctaggggtttggggtcctggatgtctgggtgcagccatgcagcctggactccctttgtgagcccacacatgccccttccccttgccacgcctggcaggctgtctccttcttttctgatgctgccctccacctgcatctgggaccctctcccttgggtgctgtggctctcccttccttcctgcatcctcatcttgactctcctgggtcactgctgtcggcacacagacatgctgcacaatttctccttttctagaaaagttccttccttaaccccataacaacaactaaccaccccgttgttgcttcccttcatagcagaactcagacctgcctcttcttcccctcccaccattctctcaatccacttctcaggctgacaattctgtctcatcacaaattgttcttgtcaactccaccaccaatttccatcaagccacatctggtcacttgtgactttttttcatgtccttaatgtgcctgctcggtagggtcaaagacagcagtgcgctccctccttgacgcttccttcacttggccttccacccaccatcgtggtttcctcagccttcctggctgctcctcactccactgctgcttcctcttcgagtgctgggcccagcctggattggatcccttctctacctgtggtgctgtaaatgccagccggaaggtcctaattcccaaatgtgtatcttcagtctcttgccacctggggtttcccaatgccccctcagtgtctatacctggagtttccatggg

SEQ ID NO: 42158 - DNA, 1026 bp, Homo sapiens
tcagtatttttctgaatgaataattgattataaggtagtgaagagggaggttatatctgaggtccagttgacatgagggaaaggtcttaagacctttaagacatttaagaggaaaaatgagcccaaaatgcatgtgtttggaaggcccacagctgggcacagccatgcatgttcctcacgtccaccataggtttatgctgcctgaccccttgggtctttgctcatttcccttagtttccctagtccattccccatggggagctgggacccttctggatgacctcttctctgaggcgcccatctcgtgctcccagggagcactcccatctcctccctcccaggggaagtacacattgccttatctccatgtgtcttaggatccttcttgtccttacactggtgtcttcaaacgacatgtcctaaaagtaaatgtgggtaagttgaatgacctgagcatccattcctcagctattcaaaaagtaggggtagtgccacctatcttggcagtgtgttgagggtgcccagcacgtaccttgccatccctcgttctgtaggctctcacttccagttcctcagatgaggtacagggcagggaggagcttctcccgttactgtcatctcagtctaaccacattcaggacacttgtttattttaaataaacaggtgaattaagaaaaagttttttaagtctttacctaatcagtctccaggctctctttttggcctgttcctcccttcctcctggccgcctccctcccatgcctctcatgtgcctcctgcagggctgggcccccacttctcttgggacctgtgctttggggcactccccgtcttcacctccttcctttagctccattgatgactttcccccttgctgcttctcccatggctcacctcttgccccctggttcgccactctgccctcactttgtactctttgtagaatcttgagatgactcctcctgtgtccccagccctgctctgcagctgctcctgctttgtgctggctcatcaggctcaggcat

SEQ ID NO: 42159 - DNA, 1027 bp, Homo sapiens
ccggtgcccttgactgacctcggctcggcgccccctcggccgccgctgctgctgctgggtgcgacaggcaccctcgcgaagctagggccgtgggggccgagtccctcacgcgggagcctccaggctcgggtccagcggagcatgcttgcaagctgttggccggctcgcatctcacaaggtacgtcctccccgcgctccttctcccgccctagctcgcagccccgcccatttccgtcttcagccgccccgcccagttccgacttgagccccgccctctccccgcccccatcgcgggattctccgcccttggtcccgtttccttacgtatccccgagaacagtccggccccgcctccatccccgccccttacgccattacgtaatccccgcaggctttgcgcgggtcgccctgagcgccgcacctggcctcgccctaggctgggcaacccgcggtgcttgcccctcccctcgcgaagcgccgcggtgcgtagaatctgggaattcggtctgcgccgctctgtgcgtgctcggttctggttgcagcttagggctcggttcccgccccgcacctgccatcgctcactgacctgggtggctgccatcgtttctgtgccgccggcgggggcgagcggcgccagggtggctctgggcggcggagtgccagtgtggtggcgccgtgctccactgccgggggcccgggcaggttgggcggagcacggacacccacccatcctggagtcgtcgatctagaaggagctcgggggcactctagagctcttccccaagccccttcgtcccttttacgtttggggaaggctcccccagtctgatcccacctgcttttctgcccatactccccattctcatactcccctatcaggcaccctgcctttcaaggtcttctccacaccccacctcctgctggggtgctgtctgtcttccagatagccagttgcccgagtcctatacttttttttggtgggggtcttaccctcgcccaggccggagtgcagtgacgcgaccgtagc

SEQ ID NO: 42160 - DNA, 1110 bp, Homo sapiens
gagtttgagaccagcctggccaatatggtgaaaccccacttctactaaaaatacaaaatttagccagatgcagtggcacgtgcctataatcccagctactcaggaggctgaggctggagaattgcttgaacccaggagtgagctgagattgtgccactgcactccagcctaggtgacagagcaagactctgtctcaaaaaaaagaagagagggccgggcatggtggcttacacctgtaatcccagcactttgggaggctgagacgggcggatcatctgaggtcaggagttcgagaccagcctggccaacatgctgaaacccctgtctctactaaaaaaatacaaaaattagccgggcgtggtggcatgtgcctgtaatcccagctactcaggacgctgaggctggaaaatcacttgaacccaagaggcagaggttgcagtgggctgagaacgtgccactgtactccagcctgggcaacagagcaaaactcttttctctagagacgaagaagagagaacttgtgctgaagcctatggtccagagagtgcagggagagtgcagggtttttgaggagagaaaggatgtcgagtggggttgagcttggtggctgggatgtggaagggcagtttggggagcacaggtggaaacagagaggcgagcatggcctgtgctcacaggggctcctaaggcatggcatgaagtctgagtgggatctggagggccatctgggggtagagggcctgaaggattttaagtaggggaatgacatggtcagactcaggattgcactgcgactaatggcttggaaaggggcatagctaggttgggagtgtagggagggagcctggggaccagaaaccctctccaggctgttacagaaagagggtggtgtcctggctgaagttgcggcggtgcgagtggagaatagaggtcgatgcatccagacataaagagaaggttgacagtttagggactggttattttattttatttttttttgagactgagtcttgctccgtcgcccaggctggagtgcagtggcgttatcttggctcactgcaatctctgcctcctggtttcaagcgattctcctgcctcagcctcccaagt

SEQ ID NO: 42161 - DNA, 1062 bp, Homo sapiens
gtatgtctctcacctagtaaaagaaagatattaaaataattacacttatttcatatgttaaattatataggaagcattgtgaaatgagaaataatgtttaaccttgtttgagttaaatttgtatggacatgttattaatatatgctccagaaactataggaaattcctagaaatgtagtatgttatcagtcataattttgattattatgttaaaaggttgtatgccacagaaatcaaattttcttaattgtatcactattataatgaactctcatcagatctttaaccatgccattttacatctttatcatccatagacagttattttacttaaattattctgtaaaagcatttgcaagacttagctccagttcaaagttgcttctttgtcaaggaaattaataaaaagactgtgtcaattaccctggaatacaggtttctgataactttaagataataccattggacttggttagacattccagaactctagtgaaaatgatgggctcatgaaactgtgatctcacgatcaagcagaacaaatattaactacgtggattgtagtatcatatggcttcatgtattaactacatgaatataaactgatgaacataattttcacgttaaaaaaagttatttttgccgggtgccagtggctcggctcacatctgtaatcccagcattttgggaggctgaggcggacggatcaccagaggtcagaagttcgagaccagcctggccaacatggtgaaaccccgtccctactaaaaatacaaaaaaaaaattagccaggcgtggtggtgggcacctgtaatcccagctacttgggaagctgaggcagtagaatcacttgaacccgggaggcagaggttgcagtgagccaagatcgccccattgcactccagcctggacgacaaaagcaagactccgtctcaaaaaaagaaaattatttttattttctttatttttctttctaacacttctccctcaccacccatgagtttttatttgaaacattgctggtttttttgaatgttttattttccagattttctttttttg

SEQ ID NO: 42162 - DNA, 1051 bp, Homo sapiens
gggtaagcattcgcccagccaacatctggaacatcccagttctgcaaagagccacacccttcccagaaagagcccaacttgccaaagatttacttatttgttttaaactggttttagttgaccgcttttcattttgtgtatagcagcgttttaaggaaggtctaatttatccaggccacctgctgctttagcaaaccaagggagaggatgtgagattctaaggaatttacatatgtatgtcatatatatatatatatatatatagacacacaatttttttttgagacagggtcttgctctgtcatacaggctggagtgcagtggcacaatcatagctcactatagcctcagatgcctgtgctcaagcaatccactcacctcggcctcctgagtagtgagactacaggcacacaccaccacacccagctaattttttaattttttgtagagactgagtcttgctgtgtcgcccaggctagtcttgaactcctgggctcaagcaatcctcccacattggcttcccaaagtgctaggattacaagcgtgagccactatgcctggcttatttttaaggttatatgcatgcaaagcctgtatcaatgaaaatattttctttggtttttttcaacttttcatcttcgcattttgcagatttatagaaaatttgctaaaataataagtccattgaatacatacacacccttcaccaaggttcaccaattcgtaactgccatatttgggagttatatgtgtgtctctctatatatacatatatggatacagatacatatacatgtttagtgacttgtttatatttgtacatacatgtacatgttgttatttattgatcgtttgggagtaagttgcagggatcattgactcccccacaattatgctagatattctcaaaagaaggaccttctcttttttttttttttttttggagacagggtatcactgtcattgaggctggagtgcagtgatgcgatcacagctcactgcagcctcaacctcccaggctcaagtgatcctcccacctctgcctcccaag

SEQ ID NO: 42163 - DNA, 1029 bp, Homo sapiens
gttcagcaagcaaatcaaaacaaaattccaaatgatcaagagttgattgtaccagatcttgaatggactttgttttgcagtttgctaaattatctttttgaggttccagtttctcatctaccattggcagtaaagtgcagagtaatactgattttatatttctaattgcaacaaagctatgagtgcttagtggaaaaccaccgatcctgagaattagggtggaaattggaggtggcaagaattgaggtggctgaaatggtgccatctaaaaactggcaaaactccaaatttattctttatcaggattcagttagggagtttagaattcttttttaaatagagatgggtttcactatgttgcccaggctggtcttgaactcttggactcaagtgatcctcccgcctcagcctcccaaagtgttgggattacaggcatgagctaccacgcccagcctaggagtttagaattctaacctttgaatctttaaacttagcatgtctgtctaaatttctgagcatatttttatccaaaatttttatggtggtaaaatatacataacataaaatgtgccactttacccatttttcagtatacatttcagggatattgagtgtattcgtaatgtataaccatcaccactatccagctccttaactcttacagcttgtaaaactaaaaccctgtcccctttgaatagtaattccctattgccctccttcccccaggtccctggcaaccaccattctacttcctgtctctgagcatattttaagatttgtatgtaataggaaggaaagcagtgtataaaaactacagctagttttcactgatgctagggcctgtaaagctattgaaaagcttattttaaaatgctgtttacatgtcaaatgtcaagtcgtttaggtttgttatccttcttcactccaagtgttccattgcttagttccaaaccattatcctctatgaaaagtgttaccagaaatatttggatttgctaagaggtctctgcatgacggttcatgtaaaag

SEQ ID NO: 42164 - DNA, 1027 bp, Homo sapiens
gcacaatcacagtcccaaagtgctgggactacaggccggagccacatgcccatgcccagccttgagcactcaactttctgttgcatctacttactggatacatccctaccctcataacatctactctgtacattggcttctttttatagttaccctctctcagtctcctttgacacctacagatcttttctggctcaccctaagggttcagtattggccccatctgccatctggaagtggagtcccacttctgttgctctctgctgtgctgcatatcctggctcccaactgctccaccctggtgaaactgttctcattgctatcttccagattttctgcagtcctttgcttgtgacgtgatttctcctttccaaattatcagctccttgagggcagaaaccgagtcttaggtttgtgccttctctacattctctccacccttcatagacatgcagatacgtggttgatttgagtaaggaaaagtgatttgcctgtcaaggattttagtcacacttggagccgaaagtagggtttcctaaattactgaggctgtaattgactactttaatctttcataatcaatagactgtccctaatgggcagtagaaaggacactgctcagtagtggcagggagtttgcagcacagaccttgacttcaggtgtcctgaattggcacgctctgctgatctgttcctgttctacacgcactcctgccagcccagtgtagcctcaggcctgttgggtctacccaggagcatggcagaattatatagcacttggtacttaggaaatgtttttatggtcagttttaaacttataaaatcaagattgaaatataacagacaagaaaacataggtacagaggtaatttggcagaggtcctacatcaagctagctaaggtgtcaagtgaacctgttctcccatgtgttgttattgatctgtgtaggaatgtactgaatttcacgaaacacagcttatttatttaggtagtagtcccccaaacttgaatctagtgaaaggtggca

SEQ ID NO: 42165 - DNA, 1023 bp, Homo sapiens
ctggggcattcttatggcaaatatcgtttaatataataatctatttatactatattctgatgtcttttttttttttttgagatggactctcgctctgtcgcccaggctggagtgcaatgggctcactacaacctccacctcctgggttcaagcgattctcctgcctcagcctgcccagcagctgggattacaggcatgcaccaccacaccaagctaattttgtatttttagtagagacagggttttaccacattggtcaggctgatcttgaactcctgacctcaagtgatccacccacctcggcctcccaaaatgctgtattaggattaactcagttttacaaataaaataaagcttagagaagttgaataacttctcaaggtcatatgctagtaagtgacagaggctagatttaaaccaatacctatgcagagtaaacgacgcttgatacagctgaggagatgacatcgaggttgaaatggattggtaatgcacgccatacgcatgtatttgaggaccctgtgaagtattgcacgagagtgttaggtacgtcagtacttgctgtgtgacatctaaaatttttattaggacattcttatgcccataatcaggcaacaaggagaaattttttttttttttttttttttttttttttttttttttttttttttttttttgagacggagtctctgtcgcgtgagctgaagtgcagtggtgcgatcttggctcactgcagcctccgcttcccaggttcaagcggtaggagaaataattctattatgtatgaatgtgttaaacgtaaacaacttcagtaatccttcttctgaatacaacattacttctagactgtccatttctgtatttcttagaaccacggtgtgtgaaggagggtacttgcttaggttttaggatgtaaatactgcagatacagattctgagtgaataggagagaagcagttgtcttaggaaggtgtgttacgtttgggctgggcatggtggctcacacctgtaatcccagcactt

SEQ ID NO: 42166 - DNA, 1050 bp, Homo sapiens
acattgcagaaggcagaaaacaagataaaggtggctttggattcagaaaaggtggaccagatgacagaggtgattggttcttctaaagctgaacatcataaagatttgcagtatgcctaccaattccaactcgtgaacgttcctagtagaactcgattatctcataggtgtgataggttctcgtgagctcttaaaagtttgcgtaaaatcctagaaagaatggctgatgcttctgcaagcctggcgttttttgttttctgttggaagcaaaagctcttaaaatgatttcattgaaccttccatcacttgagttgtatgtcttccaaatgaatttttccatgtttgcgcagcaaggtaatgacacgacctcaactttatcttttttgtgtatcctcaggaatgggtagctctcgagaatctagaggtggatgggattcccgggatgacttcaattctggtatcagtatttaaagtatcaccacttaatttttcctaggagccttgctgctgttctctgtttcttacgagtagcccgcctggccggactacttatttagttcctttaacaaatacaactctcctgcagggtgcccaggcatgcaagtaagcctctgttagagcctgtgggggcaggacttgagccccatgcaccttgtgtggtcacctttgttagcctgcagctccttggatgtgtacgggcctgggtccttgagctcgctcagcagtctttctcagactctagcccagggaaactcctctgtggttttgtgtatggcaccaagagaagtactgttccttctggaaaacataggatagaggtttgggttcttacatggtgaaaggtagtcctgatggcccttttttttcttggaggattgtggggaggtccagtcccttgatggtggacctgatgcacttcgccgttctctttcttagccaacccaggcagagcagctggtggtatagcacaaagcatcagtccacacgccaggcctctgccctgcagggtgattttaagcatttttatcatctttactttctgtttttaaa

SEQ ID NO: 42167 - DNA, 1027 bp, Homo sapiens
gcttattcataaaagtgcagtatggtgaagtcaatctgtaattttatgtataagctagtctctgattgaaacatgcagcagctgtcttcttagagccaaccagcagctcagggaacggcctttcccctgccagtttggtattcgcaggtgttatagaagttgcccacatactaacgtctttctacccttggcttagcttggccactggcgctcaagcagagacacagtgaacacggccatggcctggccgccaccagttctggtgggaactgcagtgttttggtgacatctcaaaccctatgtgggctcactcgatggagtaatggctaatttgatactttatacgttatttgcgagagtagatcttttttactttttaataggatggtgctattttttttaatgatacctgctcatgtaaaaaacaaaatagagcaacagaaaagtaccaagaaagcaaaaacatttcatcatcagaaatagccagtgttaaactaagctttgtaaagaaaactctgaagattctcatgaatagtttgcttcctagaaacccaccaacagattttttgttgttgttttttttgagacggagtcttgctctgttgcccaggctggagtgcagtggtgcgatctcggctcactgcaagctctgcctcctgggttcatgccattctcctgcctcagcctcccaagtagctgggactacaggcacccaccaccacgcccggctaattttttgtatttttagcagagacggggtttcatcatgttagccaggatggtctcgatctcctgacctcgtgatccacctgcctcggcctcccaaagtgctgggattacaggcatgagccaccgcgcccggcccccaccaacagatttgatgagagatccttgttcatctgcttcaccagcgtggtgtgagctatttgtttcacgctagacattggtggtcgaaatcatttaatctcatagtaaagggtgtaaatttactttgtactcacgtggaaaggtacacttcacagtttag

SEQ ID NO: 42168 - DNA, 1965 bp, Homo sapiens
tcttggctcactgcaccctctaccttccaggttcgagcgattatcctgcctcagcctcatgagtagctggaaccccaggcgtgcgccaccatgcccagctaatttttgtgttttttgtagagagtgagtctcactgtgttgcccagtctggtcctgaactcctatactcacctcccacctcagcctcccaaagtgctgggattacaggcgtgaaccagtctttttaccaaattttaacatcagtaggttatacagttaaagtttagctttcactgaagtacaagcctgaaggccccttaagaccattgagaaaatactctttcctcctacacaccagtgggaattcagcatttctaaatgagatgcagtttacttctgccaagagcccacttagcaggcacacaaatgaatggggaaagaacgctttgcccccacaggaggcgccggtgggggtgaggcgctgtgctctctgctcatgcccctctgtgtagggcatggccaatttcggataactgctttgtttaccacacaggtgctttgcttgtagaatggcccacacctaaaacgcagccaaaacaggaaaattgggactttgtgtttttattttgtcttcatatagcgttttcttgtgatttttgtgttctgagttgtaaatacttctaaatttcaggtttatcttttaaaatagctgtatagatttctattagaaaatagagttcaacctgctttgaggctttcttgttttgcttaagccgtattaaaatacagtttcgtggtattaatatttttctacttttcatgcaagctgagcatgtaaacagctcgtttgtttgctctcctaagatcttgattcctttttctttgggaagtctgttagcgctgtcattactccacacattggcatttggacccacttttaacacactttattttggagagacttcagatagtggacaaactaaagaatttaaaatgaaactcaaacaattcccagaacattattctataagcagcttggagacgatagtttgaaaagtaattcagtgtcctgtttcttcctcaggcttcagggatgacttcttagggggcaggggaggtagtcgcccaggcgaccggcgaacaggcccccccatgggcagccgcttcagagatggccctcccctccgtggatccaacatggatttcagagaacccacagaaggtacgggctcatgtgtcagtggagggcatcttgtcctgatgggatgatcatggccggttcacaccccgtggggacttggcgttctacggcacacagagttgtcggcatagatccccacgttctctggaatagcaagttcaccttggtcattagagcatctgctgttggggtagcaggccaggtgaattttagaaagtgggctggtttgctgacagcaacatcagcatggtcgttttgctggatatggaatgggatccacactctgacaaactctgctttttctcccccagaggaaagagcacagagaccacgactccagcttaaacctcgaacagtcgcgacgcccctcaatcaagtagccaatcccaactctgctatcttcgggggtgccaggcctagagaggaagtcgttcaaaaggagcaagaatgagcctgcggttgggagggaatggggcgtggggggttagagcaggaccacagcctggtgagtccccgggcagccgtcctgcagccgccactcctgcgcctgccattggcctcctcacagcggaaacacagcttgtgagtgcatgtcagctgttaacaagtggtttttagtacattctgggctttgctgtatctatctagtgcctgtttgtgcgtttttttctttcttccgctgcttccccattttccttctgtcctttttctcctgctccttgttttcccagcagcacatggggttcctcggaggagcagaggtggccgccgtgggggggcgtttg

SEQ ID NO: 42169 - DNA, 1033 bp, Homo sapiens
agagggagtcctggctccatgaccccctcccgagtggactgtccaagcagataggctcacacgagaaacagtgaggctgaaagggggggctatggaagagcggtagggagtccacggagaagatgcagtgaatgcttgcatgcattcacacgtgtgtgtgtcccagctagttcactcctttcgccgtgcgtggtggaggctggcctctctggctgggtgcagtgaatggccagcgggtttcttttctgctgggccaaggcgctttgggggtggagggggtggtgctggtgctgcactgggctgactgcggcgctgacgcagcgtttccccccatccctgttgcctgtgtgttgtgtggatctgttcctagtataggcaacataatgagatactgtgcttcccacctccccttcagttcagagccaaaatgggtctagaatctggcactttactcatttcctttgataaattgtactatgcagagctgtcaggaaccttcagatagcagtagaggactgcagctgtctaggtctgcggccacatcttggggacacactggactgttcccatgtgcagggttcagcagttatgtgggagtgctaggggttaggcttttgagcttgaacgcctgcgtgtgaacagatgaaaaatccttcagtacccaagtcccagtctgtcctatggggagcagtttgggggcggccggcagcaggagcctgggaaagaggccctcgccaggtgatggcagggccagggtggcctggggcacccagcggaatgtgcttagtatttggtcaccagccgtcatcctgggcttttcctactgtgtcttgttacaaggcctcagcaatccacagaactctctctccttccttccacctgtcagcttctctgcttctgagataagaaccatttgtgtaacaccaacacttaacttcagaaagacatgcattatgtggtgtaatcaaacccgatgctttcagatgacctacttacatcttcaatgtggataagataaagaacaaaacacatg

SEQ ID NO: 42170 - DNA, 1038 bp, Homo sapiens
aacggtgataaaatatatacaatataacaggcctgggtgtggtggctcacccctgtaatcccagtactttgggaggccgaggcaggcagatcacctgaggtcaggagtttgagaccagcctggccaacatggcgaaactctgtctcaactaaaaatacaaaaattagccaggtgtggtggctcctgcctgtcatcccagctactcgggaggctgaagcaggagaatcgcttgaacccaggaggtggaggatgcagtgagccaagattgcaccactgtactccagcctgggcaacaagagtgagactctgtctcaaaaaataataataaaaataaaaaaattttaaatttaaacattaaaatttaaaaatttttgtggggccaggcacggtggctcatgcctgtcacagcactttgccaaggtgagtggatcacttgaggtcaggagtttgagaccagccttcccaacgtggtgaaacctcatctctactaaaaatacaaaaattagctgggcgtggtggcaggcgcctgtagcgcctgtaatcccagctactcaggaggctgaggcaggggaatcgcttgaacctgggaagtggaggttgtggtgaaatgagatcgtgccatagcactccagagctgacactgtctaaaaaaaaaattgtgtgtgtgtgtgtgtgtgcatagtagatgtatatatttatgggctacatgtaatgttttgatacaggcatgtaatatgaaataagctcattatggagaacgggcatccatccccccaggcatttatcctttgagttacaaacaatccgattacattaagttatttttaaaatatacaattaagatatgattgactatagtcaccctgttgtgctatgaaatagtaggtcttattcacttattcattcttttttttttttttttttttttttttttttttttttttgagacagagtttcgatcttgttgcccaggctggagtgcagtggcgccatctcaggtcactgcagtctccacctcccgagttcaaatgattctcc

SEQ ID NO: 42171 - DNA, 1015 bp, Homo sapiens
cagctctgggaaatgaaaaatatcacagaaataagaaactgcacagaagtgttagaagataaagataagaaaatatttcaggaactagaacagaaaggaaacagcccaggggcgggggctcacacctgtaatcccagcactttgggaggccaagacgggcggatcacttgaggtcaggagttccagaccagcctggccaacatggtgaaaccccatctctactaaaaatacaaaaactagctgggcgtggtggcaggtgcctgtagtctcagctactcgggagaatgaggccgtagaattgggaggcagaggttacagtgagccgagatcatgccactgcactccagcctggggaacagagtgactccatttcaaaaaaaaacaaaaacaggagccaaaagagaagaacattagagaacctatttacagaaaagaggaatggagaaaaaggaggggagaaaatcaaataattaattcaagaaaattccccagattgataagggtgtttcttgattgaaagggcccctaggagcccaggacagtggatggaaaaaggctcacatcaaagcacctcattgtggctgggtgacgtggctcatacctgtaaccccagtgcgttgggaggctgagatgggaggatcccttgagcctaggaatttgggatcagcctgggcaacatactgagaccctgtctcttaaaaaaagaatgagagggccgggtgcggtggctcacgcctgtaatcccagcactttgggaggccgaggcaggtgaatcacaaggtcaggagatcgagaccatcctggctaacacggtgaaaccccgtctctactaaaaatacaaaaaaattagccaggcatggtggcgggcgcctgtagtcccagctacttgggaggctgaggcaggagaatggcatgaacccaggaggcggaggttgcagtgagccgagattgcaccactgcactccagcctgggcaacagagcgagactctgtctcaaaaaaaaaaaaaaaaaaga

SEQ ID NO: 42172 - DNA, 1035 bp, Homo sapiens
agagtcttcctctgttgcccaggctggagtgcagtggcaggatctcggctcactgcaacctctacctcctgggttcaagtgagtctcctgcctcagcctcccgagtagctgggatcacgggcgcccgccaccatgcctggctaattttttgtatttttagtagagacagggtttcaccatgttgcccaggctggtcttgaactcctggcctcaagtgatccacccgccttggcctcccaatgtgttgggattataggcatgagccactgcacccggacagcatgcctcggtttctgcttctgcaaactgggaaaacctcaaaggtagaactggttggtccccttggcctgccgaccccttagcccctcaaggtcacagtcagccatcccgcttgttagaggccaggccctgttctggggcgggggctacctgtggctgcttaggggacgggagacaatgccactcccaggtgtgtttgatggcagcctgcagaagtggctttctgcatggccctggaggacggtgatttggacagaagcgtagggccagagacaggacgtgacggtggggctgctgcattggctccaggtaaagatctgtatctgatggcctcactcccaggcagctcaggggttcccgtggctcctggaaaagctacagactaggcatggccaggccctgcctgtgtctctctgtgccagccacgatgagcctcatcgtttctaaaacgtactgtgctccgtctcgcttcctggaacgctgctgcctctcccctagagcgtgcgtaatgctccccggctgtgtccctgggctgatttctcgttgcaggtctcagctgggttgtcactcctctctgcaaagcttccctgacctcatctccctctccaggtcacgttaggtgcctcttgtctgtgtccccagccacagcccgcatcacaaacaagactataattgccctcgtgcttgtctgtcaccttcacagacagagtgtgacttccagtgggtcacggccccatcatcatgttgtcctccgca

SEQ ID NO: 42173 - DNA, 1049 bp, Homo sapiens
tgatgtggccaccctggcccagccacgcctcctcactcctcagagctgcaaagggctgtctgcacctgcccctgagtctctccccgccccaggcaggtgtgagccaggcggaggttgggggaggggaaccagggaggagccggctctgcctgccttgggagggttctgcccaggccagtgttctggcctgtcccacgctctggactttccaaaatgccaagccttttccaaatgtcagttcctgagtcacatccaaagagtgttgggtgtggagtggtcaagatcttgttccccataaagccggagctccctctggggagctgcgtgggggagaaggcagctgcccagtactggggaccccacgggtggtggggacggggtctggcagcccaaggcattccactggtcgtgggtgagcaaaccctgctcccagctctaccagccaccaaatctgggtgaattgggccagtgacagtgtgggtggtacaaaggaggaagaaacagaaaaattagaattgggggaaacattaggcttcaggaagtctcgaggacatgtcctctgggatgatgctgggaccaggtgaggggccgaggagggtgcatggtggcactgcatgaaggcagccccttcccaaggggcaacagcagggttcgggggttggccctctgtccactgaatctccccagtgctgaaaagacaagccccaataaaccagatgaaccagacggagacaaattcacaggcactcaaaggaccaattgctcaagggctggggctgggggtggctgctgatgtgggaggtgggggggaagtggggagagatgctttgccagctgttgagatttcgaaggtttcatttgacaacgagctaagtgtgacatctcagtgggatctggatgccaaagccgccaacgcagacctgggccgctgcatcaacaggaaaacagtgtcagaggcacccaagggagggcccaagcagggctggagggaggtccagctctgggctggcacttacaggaacacagacaaagcatagtgtggccagaga

SEQ ID NO: 42174 - DNA, 1034 bp, Homo sapiens
agcccgtgagggcatctgaccgctccctgacatctgcctccacccccaatgcccccccagggaatggtgtaagtccctgatgctgtctcgaacccacatctccccgaccctgttctccctgataaataaataaaactgtaaataataaaactgcaggctgggcacagtggcttacacttgtaatcctagcacttggaaaggctgagacaggaggatcacttgaggccaggagtttgagaccaacctgggcaatatagtgagaccctatttctacaaaaaataaaataaatagccaggcctggtggtatgcacctgtagtcctagctactgaggaggctgacggaggaggatcacttgagcccaggaattggaggctgcagtgagctatgatcacgccactgcactccagcctgggcgacagagccagaccctatctctgaaaacaataataaaacgacaaccaatgctgactgtgtctccatcactgggtggggctgaggaagcaggcctcagaaaggaagccagttttcccccaaaattattccctgaggctgcctctgggcctgtggatccagatgtgtgggggccttcaggagtggcaggggagtggggcctccagcgtgaaaacagaagtcaccgtcagccttgcacccccggctctgcctcccaggactggtgtttttgcctctgttttaatttcctgctgggtcctcccttggacattgtcaggtatgcaggctgggacatcccttctttcctcctacattccccctagagcccaaggctctgtccgtggtccagccactccatggcagggaagctgtacctccataatcagctgcctgagggcccctgacccaccaccaggcaccaccctggtggggctgaggttagaagggaaagaatgccagaactccagtcctggaggcaggagagtgtgtgagcccagccccgccctctcagactctcagacctttatttcatcctcattttcctggctagaggttccatgcatcattttttttttttttttt

SEQ ID NO: 42175 - DNA, 1014 bp, Homo sapiens
aggaacagggcccgctgtgtgtgtggtgggccgggagggcaaccaccagccctacccggcagccttggggaggagctcaactcagcccatgagcctggagtgctaacgagcctcctctgcccacctgcctccactaggcctcgcagagctgaggtgcaaggcatgctgggagcttactggggtcagggacatggagagctgggtgctggcatcaccactgcctcctgtcgatgcccagacccaggctgcaggttcttggaccagcagcctcccctctggggggcctcagtcaccgggtctgtaaatcggagcccctaagcctggcctgagggctcccctgacctccaattccagtttgggcggagccagggggctgacatgacttgtcctaggtagggcctcactaacaagttacagacaccagaatgttctggaaagagtcactctgcccagtcgggatcatgccagacttgacaggattcttcctttcctccttgcaggaacctccggggagctgggcgggctgaggccgatcaaaattgagccagaggatctggacatcattcaggtcaccgtcccaggtaagggacgggcatctgaccaccccctgcagaaatcagggccggaccgttagcctcctgagggtctgccctggtgaagaagtggcctccaggccgctgtttctctctgtggattctgagagccatcggggtactgtgaatgctttttctggccacatctgtcccctgcgttgtgaatcagtgttctcagctctgaccttccagaaggtcccctcaaaacttcacctccctggcttggcttccctgggatttgtgaggctggacagaagaaaaagccatgggtgtgagaggctctgagtttgaccctaccccctgccaagcctcattttccacatcttcagaggagaggatagatttgggcgctggagcctcagtacggggtgactgttagaagccaagagggtgctgggcacagtggctcatgcttgtaatc

SEQ ID NO: 42176 - DNA, 1158 bp, Homo sapiens
ctgtggttcaaggcagggctatgcttcccctcccagccctggccccgtgaccccagctctgtgcctggcactgtacagaagcctaagagatgcccaccgccagagcgggcaccaaatcctcatctactggggaccccaggggtgccctccctgagagtttggcctttgggctcactcccaggcagagactcctcggagttgctgcttgattacccctgtgacagagagctcattacctctccaggcccattacctctccagagagctcattacctctctgctccatggcctaccctgccatcccccgacagcccccttctggccagcatgattttcccagtgtcctctacccaccacaaaccccagccccacaacaggcttgctctaacaggacaagttgtgctgaagatggggccttcagaagcagtgctgtatgacaaagaaggttgactcatgtctggacagggctttctggagtctgtggagctaaagacattagcataatacagagctgggcttggtcactggtgcttccgactgcagtaacacagcagctctcagacgtgagccgtagatctcagacctttccagaagcttggagttcttgcttcgtagtgggccccgactgtttctactcttttctttcattttgagacggagtcttactctgtcacccaggctggagtgcagtggtgctatctcagttcactgcaacctctgcctcctgggttcaagccattcccctccctcagcctcccaagtagctgggattataggcacctgccaccacacctggctaatttttgtatttttagtagagacgggtttcaccatgttggccaggctggtctcagactcctgacctcaagtgatctgccctcctcggcctcccaaaatgctgggattacaggcgtgagctactgcacctgaccttgtttctacactttaaaccagctccacgggaggccacctgaggccacctgctccaatcccaggcagtgacaatcgtgcaatgtccctggagcaggagtgagatatcagatggacctgttcaggactggggggggtctcactcccagctggatccttcaagcccagcgcagccccccagattccacatgtggggcggcagggactccaggcctgaactatgcatag

SEQ ID NO: 42177 - DNA, 1083 bp, Homo sapiens
ctggccctggcattctccccacacccccacattgggtttcccctaacgatgccatcttgggtcccaggaactgcctcctcacttggcttctctccccctgccctgcccccagagagggattccggggaccctctggtggacgagagcctgaagagacagggctttcaaggtaaggttgagctcacggggaggtctgttgtcccagcaccaggacattgacctggtttgggtttggagggccaggctggaagtggggaggagctggcccccaacttcagggcctaagggaccaggcaagccaggttggcagcccaggcccggctgtaccctgccagctctgtgttagagactccaggggagagggggtgcctacaggtggacggtcgggggagcccaggagcctgcctgccccctccctgccccaccccccagaggtagctgacacgcccactcctttttcagcaatcagctgtggtcttagtgctttgaaatcagaataggagccagacgcggcacctcacgcctgtaatctcagcacttgggaaggtcaaggtgggaggatcgcttgaggctgggagctcgagacaagcctggacaacatagaacccgtctctatgtctatttttaagaaaagaaatcagaggccgagtgcagtggctcacgcctgtaatcccagcactttgggcggccgaggcaggtggatcacttgaggccaggagttcaagaccagcctggccaacatggtgaaaccccgtgtctaccaaaaaaatacaagaattagttgggcgaggtggcgtgcacctgtgatcccagctactagggaggctaaggcgggagaatcgcttgaacctgggaggcggagattgcagtgagccgagatcatgccactgcactccagcctgggtgacagagcaagaccctgtctcaaaaaaaaaagaaagagagagagagagagagatggtggtctgggatccctccagcacatgctggcacttgtctttgtttgtttgtttggatggagttttactcttgttgcccaggctggagtgcaatggcgtgatctcagcccactgcaacctccgc

SEQ ID NO: 42178 - DNA, 1030 bp, Homo sapiens
gcctgactagccatgggaatctgagccttcacttccttaccgccaagatggacaagcacacctgcctcaccatgtgatctgaatatgggaaaagatgggcagtgctaggttagctgggaggactattttccgccaattgccctctttttttttttttttttttttttttttttgagatggaatttagctcttgttgcccaggctagagtgcaatggtgtgatcctggttcactgtaacctccgcctcccaggttcaaatgattctcctgcctcagcctcctgagtagctgagattataggcgtgtgccacagcatccagctaaatttttgtatttgtaggcaccctaacacaatgaaagtccaggctggttgaccaggctggtctcgaactcctggccagcctcaagtgatccgcccatcttgacctcccaaagtgctgggattacaggcgtgagccaccgcattcagccgcctttctttttgtcctcgtttgcaaatacagaatggaccttagtctgcaaactcagaagtgcgagacatgtatttttatttttctaaaattgaactggactcctaccaaaagcccccaatgcagagtggcagaaactttatctgagtccattttggatcatcatttcccttgagcttgcactagggcctggaaccttctgtgaggcccactcagtagacacttccacaccgcagagagactgagcatgagaaggtccgtgcttgaaaaaggcctaacggtgggatctcggtgcaaagatgggagagtggaaaccgagtggtgaagagatgactgtggcacccagcagggaattcccaggagggtgaggcttcgggaactttccagggggacaaaccctgttaagaatggctctagggcctggtgctgtggctcacgcctgtaattccagcactttgggaggccgaagtaggcagatcacgaggtcaggagttcgagaccagcctggccaacatggtgaaaccccgtctctactaaaaataaaaaattagctgggcatgg

SEQ ID NO: 42179 - DNA, 1019 bp, Homo sapiens
gagttggctgaagccaacagaatgtgctgatataagctgtgagaaaatgaggagctgactttgacttcagaggttcaggctgaacttggggaaggacggaggtgctgtgggtggagacagggaagatgcaggagaagctggtggggcaggaggtggcggatcaggcgtgttcaatctggggtctcatccagtcgaagttggaagcaagttggggctcaggggagcagtccaggcttgagatatgatttggggaatcatgaatttataactggtatttcaagccttaaaacaggccgggtccagtggctcacgccagcactctggaaggctgagacagaagggtcacttgagcccaggagttcgagacaagcctgggcaacatagcaagaccccatctctaaaaaaaaaaaaatagctgcacgtagtgcacacctgtggtcccagctactagggaggctgaggtgggaggatgacttgagctcaggaggtcaggctgcagtgagccacgattgtgccactgaactccagcgtgggaaacagagtgagaccctgtctcaaaaaaataaataaattacctaaacgtagtggcttcaaacaacacaaatttattgccttacagttttggagatcagaagtctgaaatgagtcttccaaggctaatgtcaaggtgtcaggggccaggtgcagtggctcacgactgtaatcctagcacttcgggaggctgaggcgggcgaatcacttgagatcaggagttcgagaccagcctggccaacgtggtaaaaccccatctctactaaaaatacaaaaattagccaggtgtggtggtgcgcacttgtaatcccagctactcgggaggctgaggcaagagaatcccttgaacccaggaggcggagtttgcagtgagctgagatcgtgccattgcactccagcctgggctacaagaaaaaaaaaaaaaaaagatgtcagcagggctgatccttctggaggctctaggggaaaatctatttccttgtcttttt

SEQ ID NO: 42180 - DNA, 1050 bp, Homo sapiens
tcccaggctgattctgcaggtctggggagttgccccacaatttgcatttcgattagctccccaggtggtgttgatggtggctgcttcccggacagccctttgagaaccattcacaatggtgcaaaatgaagggagagaaatttattggagatatttgctttttcttactttaaaattagatcttggccgggtgcggtggctcacacctgtaatcccagcactttgggaggccgagggaggtggaacacctgaagtcaggagttggagaccagcctgccgacatggcgaaaccccgtctgtactaaaaatacaaaaattagccgggtgtggtggcgtgcgtacgtagtttcagctacttggggaggctgaggcagggggatctcttgaacccaggaggtggaggttgcagtgagatgagatctcaccactgcactccagcctgggcgacagagcgagactgtgtctcaaaaaaaataaaaataaaaataaaatagatgttaaagaatgaaaaataattcggacgactgacggtagattgctcagaaaactggctgagagttgagaattcctgttagccatgattagaaaagttaaaagtttcataagtctccagtttaaaaaggggccatggatttaagtgtggaataaaatgggaaatctttggaagtttggcttttttcccactctgatttatttattaatttagtcgcagcacgggcatttgttacattatcctcttcagatgcccaaagtctgccacaccaccacacagaaggtttgagtgataggaccacagcttgtagttttggcccttggaggtaggggggttggggagcattgtgtgctgagtctcctctgccacatgcccctccagcgattcagcttactcaaatatgactacagagactgacattaaaatgtaggctttgggggttctttttgcgggacagggttgggggcaattcttgctgagaaagatttttaggttttttctttctttttttttttttttttttgatggagtttcactctgtcgcccaggctggagtg

SEQ ID NO: 42181 - DNA, 1035 bp, Homo sapiens
tactgggtgggccaaggaaccaagtctcgaacttggattagagtgattctaggcaggtgttgtctcttgacacctggaggaagctgccttcaccctaggcttaagattataagtaattttttcacgtaaaataactaactcactaagataattaggcatagaagggaataagaaccatgcataagggtaagaaccactgggaacaacagaaatagtcctgcaaaaacttgagatttggaattatcagagactataaaataactgccccattaccaaagaaatatgacaatcttgaaattccttagagagtaggaaactataaaatatgacttagcagtaactagaaatcatagaaatgaaaattacaaacaaaattaaaaaccggataggtgttttaacaacagaataaaaagatgaagaaggagttagtgaaatggaaggtaagccagaagaaataattgtttagtatggagaagaaaacgtaaaaaaaggtaagaagctaaaaggataagtgatgactaacatacattaatgtgagtcccagtaggataggagatagagaatggggcagaatctaaagagacaatagcttagagttttccacatcgaaggataccatttcatagttaagcctatgaatgacagacatatgtttaataaaaataaaatctacacctagaatacacagtgaaactgtagaaaacatcttagacaaagaaaacctcttaaaaacagcaggagtaggaatgggaatcacctaaaaagagaccgtagattacttctcaatagcgacagtggaagccaaaatataatgacaccaacagataatgaaataaccttagtgtgctgaaagaatataattgtcaacctaggtttctattccagcgaaaatacctttcaagaaaaattttttagcaaacaaaaacagtttgtcaccagaggacagcaggaacacaaaagaatgagcaaattatgtcataaatacgtggttacatctaaaggaaaattaaattaagcaaaaatagtgttgcatct

SEQ ID NO: 42182 - DNA, 1023 bp, Homo sapiens
tttttttttttgagatagagtcttgctttgttgtttgggttggagtgctgtggcgtgattttggctcactgcaacctccacctactggattcaattgattctcgtgcctcagcctcctgagtgactggaattacagatggtacaccaccatgcctggctaatttttgtatttttagtagagacagtgtttcgccacattgcccaggatggtctcgaactcctggcctcatgagagtcacctgccacggcctcccaaagtgctgggattacaggtttgagccactgggcccagccaagtgtcaattattttttattatggtttgtatttatttattttattttttttgaggcggagtctcactctgtcgcccaggctggagtgcagcagcgcaatcttggctcactgcaacctccgcctcctgggctcaagcgattctcctgcctcagcctcccaagtagctgggattacaggtgcgtgccaccatgcccggctatttggaatttttaatagagacagggtttcaccatgttggccatgctgatctcgaactcctgacctcaagagatccacccgcctcggccttccaaagggctgggattacaggcgtgagccaccacgcccagtggattatggtttttattataaagcgcaacttcctaagtatgtatgcttcgttatttgttgatgggtaatctgggctagcagttaattcacatggtaacagataaagctagatcacagtctttaataatagggaaatagagcatcctctttaataatagggaaaagatttactgacatttttaggcataacagttttctgctgacagctcctcagctgcttgtccacgttctccagaaccctggggctttagttaaggaatactcgggtgttgtcagtaaattaatttgtttttacagttactattcttgtttccagtgtttaatttttaaatttttcagttatctttccatattaagtttatttaattattcaatagctccctaaaagtagaattaat

SEQ ID NO: 42183 - DNA, 1033 bp, Homo sapiens
cagtgagccgagatcgcgccaccacactccagcctgggcgacagagtggaactctgtcttaaaaaaaaaaagaaaaagatgcccataaatattttgttcccaggttgttatggtggtattatttttaggggggaaaattggaatcaccaaccttttaaataatgttatcagtaaatcattcaaggtatattcattaaatggaatactatatactctgtaacattttaaaagaatatttaatctcgtagaaatatgcttagtaaaagtcagtaaatactctgcccacctaaaagtgattctggctgtgtgtacacaggggaatacttctggaggtggggattatgtaatgaatgctgtagtgtgggtttcagacccccaccctccttttgtactgagggcactaattgcccaggtgccatggctgttcgagcaccttgtacaagattccaccctttcccaggggagggccatgccagctcccagctctgggtgcagctacatcagtgttcagtgcttcgtctgtccggccctgcctgccttccgcctcccaagtgctgtaattgacagtgccccccagcaagcctgtgtaaactctcagtctactacttggagaatctgacctataagagattacaagggaattgtgttttttttttccttataaattctgtgttgtcttttgtttaaaatcaggccaaaaactatctcgaaagagaagtacctttaaaaaatgttgttagtttttttaattcatcgagcagaaatgatgctcttaaacgtccgcctgtaacatgatgtttgctgtttgtattgtagtgtaaagaactggccaagtccaaagccgaagtggcctgcattgcagtgtatgaaacagacgtgtttgtcgtcggaactgaaagaggacgtgcttttgtcaataccagaaaggattttcaaaaagattttgtaaaatattgtaagcattgtatttttatcttttgcatttcattaattttaagcctaaatatttgtaggtaagacaagttatattatt

SEQ ID NO: 42184 - DNA, 1073 bp, Homo sapiens
agtaatgaatctcgaaatgggtacatgacacactttcctattgaaggtaaagtacacatttataccttatctcagaacagtcagaagccaggttactgttttattggttagtgatgcaaatattgataaggtcaggttgatacttagtatttagaagaattctgaaatagcacttgttaatctgtaagtttcgaattgattgcctttttggcaattttttacagtgttcccaaacttgatactcataggctattagtaatggcatttacttctatctattctggctttgagtgcataagatgtattttctttaggcttagcatataatgtaaatgtaattgtttatttcagattttaaaagacatacagaattattgcttacacgaacaatcatcttaactgttattctttgctgaaattttactttttacctactggcctcatcatttcactctcattcctttgacctcacatctcttttttctttgacttttacagtcaaataacttaatgctccataaattcaaatattaagattaaaaaaagagaaaggaagtgtgtagagaaagcatattttaaaaatgaattaaagagtgactcataggtataggtttgtagatttacctagagtttgagttcaggtgagttttcacaatataaagtaagtggaaaagaatccccagataattgtgacatgctaaagctagatactgagaaccaaaaagatgtgacctcagtatgggacttttaattcaaggatattagctaccaaatgacagtttttcagaccgtaagcattgctttttaaaaatcaagataaaatacatttataacatatcttacttttagtatagcttctgaatttagttctcaatagataagacaaaagagatgaacatctgcttcctttcccctcaagcgatgtattcttactaataggtaatatgtttttttttggtacttaaaggcagtgtttttcaatcttttccatgttagtagctcagatctttaaggacagaggatacaaattagggggcagcttgcgttcttaatcctaagtggctctctgatgt

SEQ ID NO: 42185 - DNA, 1045 bp, Homo sapiens
ctctcataaattggtcatgttatcccttatttttctagaatgaaaagaggagtctgttatgtaactgcttatattccattgtatttacatttttattttaattaaaaaaaaacatttgtttgatcttttaccttctttgagggaaaggcaatcttaaaagttccccagtataggctggtttctccaaattcaattatagaattagggtttctccctggaatacatttctctcaaaaatactgatatgctcattgtaaaccgttggttacatttccctgtcagccctttttatagaagattgtgtgggtgaatgttgtatgctttactgtgtggaggtgggtatcttctgtgtgacagagttttcagctttgaataggcgggatttagaacaacaagacctaggtaatagatcatgtgcagtacgagggctcattgggcagtaccgatggctcaccgccttgcagccccgccggcaggtactgcaccttgaagactgcgtttttaggacatttttactgtcatattccagtgttaacaaagttgaatcgaatctgggttctggcctttattcctttactaacaagtaaacataatctttggcaaatcaattaatctctcaacctttgcacaatgaaagagaactaatgaaaatactctataagcttctagcactaacactctgatgtacatttgtcttgtgtaggaacaaatatgaatgaactttgtaatttttgaaatatgttgcatacaaagccagaggatatagtcttgtgtgcacttgtgacactcagtctcttgataggaaagtctccattgtaaagcctgggttgtggttttattgaacagtagaaaccactcctcacatttctgaaaggagagaagaaattctaaccaaagtagaaagcatttgtttctatccgagcatcttctagctgtggcaggaaattcattgtgactttgtcatatcctcattcctccaagactatgggatttttttgagtcaatttctgcaggtaacatgttatcatctaaatttttccagagt

SEQ ID NO: 42186 - DNA, 1055 bp, Homo sapiens
gcaggggagataagaagttgttgattctggggagattttgaagacaaagccaccaggctttgctgtttattgtttaattcttgtattttcttaaatgtctctgcagcacttttaaaatggacataattgcttaggttagcacttgaacactttgttttaaattttttttattgctgccaaatagtcatttaataaatacccaattgtttatgtaaagagttttagaggagctataagtggtatccatgggtgaaagaatgaatccatttatttgaaatgtatagggtaattaatggctctagttttgaaatagatatattacctggtgttgattgtttttttaactttgaatagatgtcagattgtatgataacacattcccagtctgattatgttgaagctaagagtatcagaacatattgtaacatagtctatttattgattcaccggccagaatgcagtgataaacagctttagctctgaagcctgtattatctttaggtgtattcgttaatatgttgcaaaaaggaagttggtgttttctaaacacaaattttgagttagggacggtgttgccaacttgaaggtattggcggagtgcttttgttagtgtgggtagcataactattgtaaattgatgaatagcaccttttgcatattaaaatatcttaaaatgggccaggtgtggtggtgtaatcccagcactttggaagaccgaggtgggtggatcacctgaggtcaggagtttgagaccagcctgaccaacatggtgaaattccatctctactaaaaatataaaaattagctgggcgtggtggtgggcgcctgtaatcccagctactctggaggctgaggcaggagaattgcttgaacccaggaagtggagattgcagtgagccaagatcgtgccactgcccactgcactcccagcctgggtgacagagcaagactccatctcaaaaaataaaataaaatatcttaaaatgtattttaaaagctttacattttgattatggaaacagagtttgggcttgaatttgaagcatgctgaaacg

SEQ ID NO: 42187 - DNA, 1007 bp, Homo sapiens
agcattcaacacatcagcattttatagcgtcattagttgttactatgattatgtttttctgaaatagtatcctttacaaaagcacttctgtctttctaagcacatacataggtcctaaaatgaatttgtctgatgttggtgacctcggaaccattttctccagttgattagcacggccagccagtcaataatttcaggtcactgttggccttagaggaagagcccaaaggcagcaagcaagggtgctggtgtccagtcgccttctagaagcattttcaccttcccttaagatttcccttgattaacacagaagtgtctatagaagtgacccagtgctgccccgggcaacatcgtatattaggccaaatttgcatttcttacctttatgagaagcaccctcgtagtctagtggagttacacacacacagtctgatctcagctgtgctctccagagatacaacatagtccaatcaaataacatcctctgagcctgtttctttagctgtaaaataagaataacaattatacccatctaaaaagatagtgtcttgtacttgagtgatcttttttctatgatactgtctttaacacaataattattttcttcaccataccacatttgtttttaaataagaatttcttaaaatgatgttttcagtattttatagatgatgtttgagcagcaatattaatagcatgttacctgacactttgagggactagaagatgacagtggcagctgatatgacccagatgtctctaatcctaacatgaggtgtactgaagggtcacagcagagtgagttcctggtgtatccacaaggaaatgagcacggaactctcacaacagcgtgtgtgctgtgcgctgtgcttgaatagctgactgctcctttatacacagcctctgtgctgactgaatcaacagtatctgtttcatcataatgcagccctatttctttaagcccatacattttgcacttgttaaaagtatttgaacaggccaggcgc

SEQ ID NO: 42188 - DNA, 1027 bp, Homo sapiens
ctgatctctctttcttttccctacaggattgcaggcatgcagcaccatgcctggctaattttgtatttttagtagagacgggatttctccatgttggccaggctggtctcaaactcctgacctcaggtgatctgcccaccttggcctcccaaaatgctgggattacaggcatgaaccaccgcgcccggccatgctaagtcctttcttggctccattgtgctgtccctcctgcttcctctccaggtccatctgccacagtgctacgtgcaccagcgtgccagcaacagtggctggtctctgccccgtgcctcctccactgggctcacacctgtcttattttgtcctttggtggctctgagaagcagcctctgcccctctccctttcccttactctttgtaagatcctcttccttctgccctaccatgttgcttggacaccagggtggaatagcagagaacggctgcttgtgtttgaattccagctctgccacttcgatagatttctgaactgagacatgtgactctctaggcctatttctgcatgggtcggagagtgggcgggactgctttactgagttatagtgaatgtagttttaacctaagcgcctcacatgactaactcctcatccatcaagaatgagctcagctctcacttccccactcctcacccccctgtaaagtaacctttctccaaggttatgcttcaacaggaatagctaacatttattaaattgtggcacgtaagtatcttggatatattggctcattgaatcctcacacctactattttacagagatgccagtggggcttgagattgaatcacttgcccaggctcccactgctggtaaacagtagagggggctcctgacccatcagtctggcttgacaacccattccctcaactgcggatcccggattcccttatcaccctgttgatttctccatagctgtggtaacatttgttgcatgaatggaccgttgaaatagggcctggcagggagaaattcaggaaatgaatgaatggtt

SEQ ID NO: 42189 - DNA, 1027 bp, Homo sapiens
cacaattaagacactagaactggtgggccgggcgccgtggctcaagcctgtaatcccagcactttgggaggccaaggtgggcggatcacgaggtcaggagtttgagaccatcctggccaatatggtgagaccctgtctctactaaaaatacaaaaaaattagctgggcatggtggcgggcgcctgtagtcccagctactcggggggctgaggcaggagaatggcatgaacctgggaggctgagcttgcagtgagctgagatcgggccactgcactccagcctgggggacagagacagactccaactcaaaaaaaaaaaaaaaagacactagaactggtggttacccaaataactgaacaccacaaaattccgaccggaagacttagagccttctttcttgaaaataaacttttaacacgtttctacagaagcatgaggctaacatggctaatagctgtcagcttatctctgctactcacagaaaaggtaaattatgacatcgatctaacctgtgccttgaaatgaacagcattaaaacccttgttattaggttctctcatgaaagccaaagaaggaggcctatgaaggctcacaaactggacgtggcctctgtatctttacgggaatgtctacatctcatcccataggggtccaagcgggaaactggcttagtactctcctgagcctgttaccttcttttattttcctggccatcaaggaatatttggtcttcttcctccactgtccttttcttcttcttctctttgagggcactcagtacagtctcctttgcacatgggtctggggcattacttgatggtgacgacagtgttgagctgattatctgctctggtctataatgaaagacaagattctagccgtaagatattttaattcccatgccatatcagaaacggaaatcagaagctaaccaacaggccaaagtataatttatacactcacaacagttccccttagcaagtaaagctactttttcgttaacggcaaaaagtgaaaaacaaacggt

SEQ ID NO: 42190 - DNA, 1043 bp, Homo sapiens
gctgcagtgagctgtgatcacaccactgcactgcagccttggtgactccagcctgttccgtgaatgaatgaatgcttatctcttattcgccatctatgcatccccacataaaaacacatcccattgcaccacacttgagttaccccagaccccgagtttctcgtgttctaggctctggtacacgcttcctctatcggtagcttcgctcatccccctaatctgactggtggaccctgatcattcttcacaatccagcccagatgttggcctctgggagccccttccttgactgtttcagactgtcatgcctgctttttccttccagctctatttcccctgcacctggcctccccatgcagccgtgactgttgggataggtctgccctttctcatagcaggaggacaccttggggcaaggttggcatgtctgctcctgcctgaacccacacagttcctggagtgcagcaggtgctcctcagctgtttgctgcacgcatggacgtaagagtgacagaagcatgtccttcgacatgacgtttttgtacctgaacattgtctagaggctttccagactgtaagctctgtgggattaggagcctgcctgcctcgcactccctggcatccttagtgctttgggcctcacaggccagcggagccctcgtgcgggttccaggcctgctttggtgggagtgctcagtacttttagccacacagagccgtggcctgcaaggctttcggagtacatctctagcacatctgagaatccggaagcaactcagagtttctggaatggatttcacaaagtctgtgaataagaaggccccacaggccctactcaacagcttttttttttttttttttttttaaatacagaagatgctagtcttcaaagaacctctttactcttttactctttttctttttttttcgagacagagtctcattctatcgcccaggctggagtgcagtggcatgatcttggctcactgcaaccttcacctcctaggtgcaagtgattctcctgcctcagcagcctccagagta

SEQ ID NO: 42191 - DNA, 1093 bp, Homo sapiens
ttgcttttgaaaagccacaaaagatctcattttcctgagtgaccttccttttggggcctgttcttgacagaaagcccgggaggccaggggtcagggctgccagcatcacgtgtctgttttttatctcctgagtgccaacagatgggaagtggatctgggggtcttgccacatccagttcagggtcactttctctgtagtgaggtccttggctccatcgagcatgaaaagagaaatacaaatgagactgacaaagaggaaagcattaggggaagcctgtggccacgagagtagacggtgcagggggcccactgcctcccgctgctgtgggaacggcgaggacatgggccagggtgtttctgccacttctgcaagcacagctctgggttttctgctgccatctgacctccaaagggacctcgcctcctctccttcctttcctggtccctgatgagatgggggaggtttctgtcactctgacaagtgcttgaaactccagacatgggctgtcgggaactgtcgggtactgccgtgcagagcgcatgttgtctgacctcctgacttcactgggccctgtcgggtgcaggagagggagctgtggatggcacagtgggacatgtgctctactggcctgggggtggtgggaatgcagaggaggggtatcccccattgggggtgtgtcagggatgagatgcccccacaggagcctaggaggccaagtgtggaggctgggaggtgaggacacgcggggctgttccaagggagccacatgctggtagagcccaggcacaggtcaccaagggagtcaggggtcgtggggggtcagaggtcataaaaggagttggggtcaccaaggaagtcaggtcatggagggagctgacacaggagagcatcttagagggccttgggaccttccaaggggtatggatttttttccccagctttattgaggtataaatgacaaaaattatatatatttatcagagcatctaagtttttttctttttctttctttcttttttttttttgagatggagtcttactctgtggcccaggctggagttcagtggcacaatcttggctcactgcaacctc

SEQ ID NO: 42192 - DNA, 1050 bp, Homo sapiens
agagcggcccctgtgtccacgcaggtgtttggtcttgggaacaagacctacgagcacttcaatgccatgggcaagtacgtggacaagcggctggagcagctcggcgcccagcgcatctttgagctggggttgggcgacgacgatgggaagtgagtgcccaccctgccaccatgatcagcgcggcgggcttaggcaggggccgtggaacgtgaggggcgcgcacaccattgtgtcagctgagactcagcgacacgcacctccaacacagagggaaggggctctcctgcctctgccctgcccctgccagttttgcttttcggcttgcccaactccctggagccttcctgatgctctgggtttatgtcgctgggtgccccagggtgcacagtcctgagctttggggatggggtggggtcggggcgtgcctggcaccaggtaccgttgccacatgggcctcccctgagccgctccccctctcctctcctcggcccagcttggaggaggacttcatcacctggcgagagcagttctggccggccgtgtgtgaacactttggggtggaagccactggcgaggagtccaggtgagcaagtgcccgcaggtgcggtgggtggcctgggcgggtcctgtgccgagggcagccaccctggaacaagggctggcagtgggtcgcagcaaggttagaagacactccgtcatagggtcgaggagggaccttggtcccagccaaggactcactctgccacgttgctctgcactgccctggggcagcggggtgcatcccacctctcgacaaggacacatcgcgtcgggctctgtggctaggttcaactttggcaaaagggctcatttccttaaaatctgcctccacagacttggccaaaaacataacgttcctctctgtgcccttgatggcccctgggtgctgcccgggcttccttaccttctcccagatggaagcctgcccagccctgccccggcttctgggcgtctggcccccggcagctccacgccgcctccctccttgctccctcgcctgccctccttgtg

SEQ ID NO: 42193 - DNA, 1050 bp, Homo sapiens
tgttctccctgctcctaatgcatctcattacctgtctcctacagagccagcagggatcttcctgcaacctcagttaccgggagggcctgttgctaggcactcagtgtgtgtttatagtttataaagctgcaggttgaagggaaggctgctgttaccagtccagctgcctgatggagtccagcttgttcttcatctttcaggagggttttgaagtaccctgagtatcacagactctacagacataaattctccccatttgaaagtggacctttggaatgaaggtcctgaattcttccagaatgagactgttacaaatacaatgattgtatcttgctttggcaactgcagtaaaaagaggcccagtgcaacattataggataccatgtgaatccttttcatgctcatttcctcctaagagtcctttctctgtgcctctttttagaacaatgctaaagtagctgtgctaggggcctctggaggcatcgggcagccactttcacttctcctgaagaacagccccttggtgagccgcctgaccctctatgatatcgcgcacacacccggagtggccgcagatctgagccacatcgagaccaaagccgctgtgaaaggtactgggcgcgctgaccctggagacttgcttcctgtccccagtaggccaggattcgagttttgagtaagattcttagatgaaactaaatgtttagagacgggggtttctctgttttaaatttaaattttacaagtgattacacccttttagacttggcgtctataaaaattgaaacagcggtgtcttttagaaatgtgaggtagcctaatcatcccattttctactttttctaatttgaaaagtagtatgaggatggggaagagggaagtgtcagcaacctctggtgaggatttggggacagtaaggtggtggtctcagctgcgggccaccttccctccaccccagggttatcttgccagcttctcaaaaagcacggcctctttgggaaacctccccgtctgtggaaggcagtgtcggatattcagtaaatgttgtct

SEQ ID NO: 42194 - DNA, 1034 bp, Homo sapiens
tgtccagggtacctgcctagacaatcacagtgctgggacccctgcctggcaccctctggctctgagcctcgcactcctgaccgcagctcagtcccacccacctgctcagcaaggcgtccccagcaaggcacccagaacccgcatgtgtagagagactcctcggcagggctgatggagcgacaggtcggggtttctctaacaagcactttcctggaaacttcattttaacatgttcccatctccctcagaaaaagggcatcgagaagaacctgggcatcggcaaagtctcctcttttgaggagaagatgatctcggatgccatccccgagctgaaggcctccatcaagaagggggaagatttcgtgaagaccctgaagtgagccgctgtgacgggtggccagtttccttaatttatgaaggcatcatgtcactgcaaagccgttgcagataaactttgtattttaatttgctttggtgatgattactgtattgacatcatcatgccttccaaattgtgggtggctctgtgggcgcatcaataaaagccgtccttgattttatttttcaaggtcccttctgtaaatgctgtgctttcttccctgtgagagccaactttagagtgtctgctacctcttcattaccaatcagaattagatgatgtttaactgttagactgaagcgtgacgctttcatcagtagcttcaagaaagtctaaattgttaatttatggaattggacacagtattcagtttacccgtacatgctcctcccgcccctcctgttggcacccttgcatcgcccaggcctgattcctcctgggggtagttcacccccacgggttcatagttcagcggcgaatgccaggcagctgttttctggctgagcaaacagcacctttctcattgagcttcctctactgacctctgtcccccttgggatttcatcttctgaccgaaccctgatgttcagtggcagagacagcccatagccagaactgtgggtagaccagggttggggtgtgcggtttgggacag

SEQ ID NO: 42195 - DNA, 1110 bp, Homo sapiens
agcccaggctctggcaggctgccaggcggggctcgccgccttcgcagtgcacgttgtccagcaggatgtgtccggtgccatagccgaagaaggcgttggtggtggcggccatggccgccccgcagcccagctgacgacagaccacagcggcatccggcagcccccagtcgtcgtcacacacggtgccccacaggccactgtgcaggatctccactcggccctgacacaggttcgcgccccctaccaggcgtacgctgccctcacctggggatgggggcgggggtcagggcgcatctcccactggcctctgcccccgtccgcaccgcaagggcagcccggtgtcccaggatctacaacccttgggcatctgctcaccccgctgcccagggtaccgcctccttggtccagactgggggtagcttgtgggatcatagtatcatttctgcctaaaaccaacccccctaccctgctccctgtctcctggcagcctgggacgtgctgccttctcatctactgcaaatgacatcctcaagatacagccccacacctcttcctccaggaagccttccctgatctcctgaggaacgggaccctcttccacctctggacttctttgcctctttcactgtccctcttttagagcacttttcattttcttcttctagtcatgatcatcattcttgggctcatctgaccttcctgtgagattaagctccagtctcaccgcccattcattttctattttttttttttttttttgagacagggtctcactgtgtcccccaggctagagtacagtggcatgatcttactgcaacctctgcctcccgggttcaagtgatccccctgcctcagcctcccaagtagctgggactacaggaatatgccaccacgcctggctaatttttgtattttttgtagagacagggtttcaccatgttggccagtctggtctggagctcccaacctcaagtgatccgctggcctcggcctcccaaagtgctgggattacaggtgtgagccaccatgcccagccattttctctaactttacatcttcaatttgtaatccctgtcttcccactgcctagggtagggtgtgagagactcc

SEQ ID NO: 42196 - DNA, 1020 bp, Homo sapiens
gaattatcagtagcaagaaagaagctgggctggtgactagcacccggaatttatgctctctttcttcatgggcctgtgcggcggtacgtaggctgcgggattgactttgaattcttcctggctgccacagcaaagagacaggatcaggttcttgattcatgatgcccttaaggtgttaggggaagaaaagcaagcgtgagaccaggcgcggtggctcacacctgtgatcccagcacttgggaaggctgaggcgagtctatcccttgaggctgggactttgagaccagcctgggcaacacagacatcatctctacaaaaagtaaaaaaatgagctgggtgtggtggtgaatgcctattgtcccagctgctctggaggctgagttgtgaggattgcttgagaccaggagtttgaggctgctgtgagccaagatcacactgctgcactgtagcctgggtgagagagtgagaccctgtaaccaaaaaaaaaaaaaaatcagctgtggaaaagcatcacgtgtttcccctgcgctgaggctgattctgcagggctactgatgtgcattggtaactgctcatgtctgtcctgttcacagatctgccggaggcgctgggcaatgaccccgggactccaggccagaggggtctgaagctgtttgggaaagcagcgggactccttgggaagatggccatggccccaagcccttccctggtgcaggtgtacaccagccccgcggctgtggccgtgtgggaatggcaggacgggctgggcacctggcacccctacagtgccaccgtctgcagcttcatcgagcagcagtttgtccagcagaagggccaacgttttgggcttgggagcctggcccacagcatccccttgggccaggcagacccctcgctggccccttacattattgacctccccagctggacccagttccgccaggacaccggtaagacgctgtctgcctctcgcacatatctgggtgccgcacctgctttcccacaggctctgcgccaggt

SEQ ID NO: 42197 - DNA, 1030 bp, Homo sapiens
ctcctgcgcgtgtgcacctctccctgcgtgcgtgttcgcgcgtgcgtgctcgcacatgcgcgccacctccgcactgccctcgcttcctgcgcctgttcaggtcatcgcttgctctggttcccaggctttggcctctagtggacgagaatcaccgagtctgcggggctagacgctgaccgcccgggccagcacctaggcgggcgggagctgtgcggcccagggttcgcgcgggccgggtagaggctcgagccaggacccccgagcgtgaaccccggagccggcggcgctggggccagaggggccgggcgggaggtgatggcggaggcgaaggggcgacgggacctgggcctggcccgtgtgtgtcctcagaggcctggcgccggccgtcgctgtacggtgagccccagggaggcggatctgggccccgagaaggacacccacctggatttgccccataggcccggcccgggcccctcgggagcagaacagccttggtgaggtggacaggaggggacctcgtgagcagacgcgtgcgccagcgacagcagcccgccccggcctctcaggagccgtggggcagaggctgcggagccccaggagggtaagtcttgggtttttgggcccggagcgagaagggcctgggtgaagtcaccgtgttttggggaccttagagtgtggggcagagggagggtcccgattgcttgctggagagacatgtgttgggttcgagggcagggtccggctgcaccgaacaggcgctgcatgggaagatctgggaggacgaggcttagggaggcgtggagggtgtcaccaccctcagctgcggacgtcgtctccactccccgctaacccctaacagtccttcctcctcctctccgtgctccagatttcgaccgcctctaaatgtccgtcagcacttctattctctcacttaagtgtctgctgatcccccccttagatctgccctgggagaatcgtagtaatgcaggaacagtctgcagggattctctcctgctgcctcagttgctag

SEQ ID NO: 42198 - DNA, 2058 bp, Homo sapiens
agagatctgttaatgctagtcaggcaattacactgtttcccattcctttaattccttcactatcctgtttcaatttcacacctttttctgctttcttatatgtaaaacacctcctccctgtccttactttcaagtgatcactgtacatcttatttcatgaagaatattcaaatgattaaaagaaaacatcacagattcccatcaccacgtctgcccccacaccgtttacaaacccacactccctgctgcccatcttgttgccccgggtgaactatctgaactactatctaaagtcagtttcttcccacgtgcactacattccagcagcttttacttagcaaagaacattttccagcaatttccttatctctccttaacaccattttctccccttttcctactggatcattctcatcagcatgtaaacaagttattacttgtttcccaacctgaccacatttttcatcttccgtctccgtaaatctgatctgtgccccactatttatttcctgaatttctatgatggccttttacctgatcttcctgcatgtgtcctctcaccctacacaatctattcccagcatggcagtcagaaacaaccttttaaaacagaagccaggtcttgcgcctcctattctgaaatcctcactggtttccccccaccccacccctcatgtcactcagagtaaaccctaacttcgcatgtgcctgacagggtcttacataacctacccgcccccacagcccagacctctctgatcttctggaccattgttgtcctcattgatcactctgctccagctacaactgtctacggctctccctccaccttcccaactgaaggcttttgtgcttgttgtttctatcctgaaaatgaacttctataatgtggttaactttcccttatctcattcaagtatttgctcaagtctttttcagtaagacaggccctaatcatcttatttaaaactggaacctacactcccactccctacacttctgcacccatttactttgctctgctttttcttttttcatagaatgtgtcacattataatactatatagttcactttttactatttatcattttattacctatcccagtcattacattttgagattcaggagtacaaaaatctttgactcttttgttcactgatgaaatcacacacacacaaaaaaaccataaactataacctataaaaaacctataaactataaaataacctatagaaaaacatatgatcacaaaaaaacctataacctatcagcaagaaaattggcatcaattaatacttgctaagtgaattaatgtatttgtgcaaaatatatatacagaagcatgtctggtgtatccttgttttattttttatttttttatttttttcaattttaactattattaacgaacatttatacatttatatgcttttctattttctacactattataaataactgtgatgaatatctttgtaagtctttgatgatacatgtgatgatttccttaggacagattcttagaagtggaattcctggatgcaagaacatgatttttctttttctttctttctttctttttttttaattttatttttattatttttttattttattattattatactttaagttttagggtacatgtgcacaatgtgcaggtttgttacatatgtatagatgtgctatgttggtgtgctgcacccattaactcgtcatttagcattaggtatatctcctaatgctatccctccccccttcccctaccccacaacagtccccgacgtgtgatgttccccttcctgtgtccatgtgttctcattgttcaattcccatctatgagtgagaacatgtggtgtttggttttttgtccttgcagtagtttgctgagaatgatggtttccagtttcatccatgtccctacaaaggacatgaactcatcattttttatggctgcatagtattccatggtgtgtatgtgccacattttcttaatccagtctattgttgttggacatttgggttggttccaagtctttgctatagtgaatagtgc

SEQ ID NO: 42199 - DNA, 1050 bp, Homo sapiens
ttttaatagaagaaaactgtataatatcaatattggaatggttaaatactgttttactcattatattgatattatacattcattagaagatgacttaattagccaggtgtggtggtgcatgactgtagtctcagctactcgggtggctgaggtgggaagatggcttgaggcaaggagttcaagaccagcctggacaacatagcaagaccccatccataaaaaaaattcccagactgacaaagaaacttaaaaaataaaacatagactaggatctcattaacaaattaacattatatatatataacagatgtgaaataaactaccagaaagattctcttctacatcatatgtcaccagggaaatgtgagttaaaacaatgagataccactacctaccaattagagtggtcaaaatccagaacatgctgtggaaaatgtggagcaccaagaaattttatccattgctcatggggatgcaaaatggtacagccacttaccaaactaagcatactttgaccatactctccagcaatcacactctttggtgtttaccctaataaactgaaaatttatgtccacataaaaactggcacataaacatttatagcaggtttattcatacttgccaaaacatagaacaaccaagatgtccttcagtaggtgaatggataaacttggtacatcaggacagtgaaatattattcagtgcttaaaaaagaaagaaagaagccatcaagccatggaaacatctagaggaaacttaaatgcacattactaagtaaaagaagccaatctgaaaggatatatactatgtgactacaactattagacatgctggaaaagacaaaagatggagacagtaaaataattgattggtagttgccagggttagggggagagagggatcaataggcagagcacaaaggatatttgtggaggtgaaactactctgtgatattacagtggtggtacatgtcattatacatgtgtccaaacctacagaatgtacatcaccaagagtgaaccccagcgtaaagtaggaaatgtgggt

SEQ ID NO: 42200 - DNA, 1048 bp, Homo sapiens
aagtatcatcattatttatcatttttgtctttctcatttccaaggttagaaaactgagatttagcgaagttatatgacttatccaaggctatatctcaatactattggaatcaaaagtagatgtggctgagtcttctgaattctagggcaaagtgttttctcaagtaatactgtctcaactgtcaagagtacagttctaccttataactgaaactatcgtaggtatcagaagagggactatatcaggagggcaggcggaggagctccatcatgatggtcctaaaccttgaaagatgggtaatgcttaactaatacaagaaaaaaatgaaagaaattctgagcaaggcaacaccttggataacgattagaaaattaacatttgttgactgatttaataagtattaagcactcataagcaccagctagtgttctaggtactgcgatttggcattgagcaagagacaccatcttagtcttacagaatctatgctataagtggaatatggacccttagaaatgaataacaaaatttaaaaattattttaccttctgttaagaaaatagagtaaatgggttgaaagtggtagagggaaggagtatttcaggccaagtcgtcagagaaggccgctcttaaagatgaccttggaggagacacctgaatgataaggaatgttatcatgcaaatgtccacggaagcattttctggtggatgagaccagtgatgcaacctgggaacaaatttctttctaagtgtgataagaagactttaagaggttctatgtactttttgaaaagatcattattcctgctttctttcataagtccaaaagaggtcatgaatggaaacaggaagagcaggattttttggtagttcatgatatgtaggagaggtttactcagagggagaaagggtgaagtgagagatcaaagcaaaatcctaaatttttggcttgagtacttgaacagatgagataaagaagggtatgaacataagtaggttgtgatgctggccctagttactaaaagggtgtgtatgtttatgaagtag

SEQ ID NO: 42201 - DNA, 1044 bp, Homo sapiens
acttgaaatgcatgaaacaatttttatggtagtatactttattatgaatcgtttataatttttgaagcaaaaacaatgtgaaatcatagtaaatagtataagatttggaactagacagatataaattcaaatcctacctctactaattgtgttcctatgggcttcttgcttaatcttttggagtttccatttctccatctgtaaagtgaggataacaaaatacttcatgtagttgtgaaaactgaaattagatgtttaaaacacttaatacaacatctgacataataaagcatgttccatagatgtttgctattattaatattacacattggccaattaatcacaacatttacgaatgaggtagatattatttctttttcccaaagatatggtgagattttctgggcagataagaggttcctttcatgatttctcataatatatgaagttagaaggagtttcaagatatgcgaaaacatgctgagacagcatggactagtcaaaaaaatctatgacatctggaactgccattttggaaacatgagctgttgtttagagtaaagataatatttggaaatatacctatcatattgtaagcacttgctaaatgaaagtttttactagcattttgtggcaaaatgagaagatatataactgagaccagtaagttaagccataatcctaaaaaaaaatctgtcatttagtaaatggttcacatttggagaaggttagtagggagttaaaatgtttgaataatttgccattatagttacatttttaccatattattagacttcagtgttttgttttctgaaatctttcctcaaagttgtaggctttatataatcttaaacatgtttcttctttatttttaagcccagtgtatctcaaggagaacttaatttgtatgtttctgattcttttatagttaactaattcaaaagttattttgtaagaattctttgatgtccagaaagccttatcattttcttataatatattcaaggtttttttcctttggaaaatggaaatcatgtcttgctt

SEQ ID NO: 42202 - DNA, 1059 bp, Homo sapiens
ggataacttaagtaaaattacttgggaaagttttgtttcatagatacttctaacaagataaactgaagtcatttacatgaatgttatttctgaatattctacgaaaatagatttcatttcataatcacttaagaagctatcataaatcaaaagtcttaaaattaaattttataaatgtttaaatgatgcatttttcccaaagagtaattattagctaaataaaaagagaaagtgcatgccaaaacgtgaatagagtaaaattgtaataaagcagcttttattcacttgagttttagaaatattcttcattggctatttttgttttactttgagaagtgtgattttaaaattgagatacttgtaaatagaggtaagaaaatcattttcagaaggttcagcatatcctagaggatttctttcttctagggataagttatcgacatttcgatgacattcatagaccgccctagaagttaaacatcaataaactcaagacaattctataattagactttaagaagttggaagcgggatttaaaccaagcaaacaagagacttgacaaagcacaaaactgatgttaggaaaacctatagttggtattgccaaaacacaagaacactgtcattcataaaggacctactaacttcccagagacccagatctagtaaaagggcagagtagatataaaagcttatgtttgactacaaacaaataccttttctctagtttaatatacagcctcccaaacaccgaggagaatacttaaataagagaacgggaaatcctctgttgagaaatctcatatattctgtccagaaaataaatggagacattatatcgtgtataaatattcaatatcagaatgttggccaacagatttgttcatagaatagtacagtgtatatttgttttattcccatacgaggcttaaaagttccacacattacttacagataaataaattacatatatattttagctttctagttattctattttacattcacagtaaccttgcaaaggaagtagtgaaacttttagcattcccatttcaaggc

SEQ ID NO: 42203 - DNA, 1048 bp, Homo sapiens
gatcatattaaccttttctaaataagagcaccttcatctgagtttatccttgtcagacttgccccttataacattaggcagaccatgactcctcttcaatcctaataggtgaagaagacatcaggacagcatggaagtgtgtccacaattactctgggttgtcacaaagatcttgactgttatctaggatgaccctttttagcatttgagcggtctctttaaaaatcaaacgaaatatatggtcctcgttctcataaaataaaacaaaaacaaagcaaaactgaaaagaccaagaaacaaaaaggtaaaacagatacacatgggattgttcattacctgtaggttaagaaaccctggtctgggaatatgagattgaatcagtgtaccagctttggaacatagtaagaactgaaagactaatagatgacagaatgttacagacgaattcacaatgagccatgaaggaataggagaccaatggcaaggatatagaagaacctgggcctgaaatatgctagtccttcagtagcatgacttagataaggatctgtatccctggactccccaatttttggggagactatacctggactattttatttgcctgaacatcttaaataaaaattcaagggaaaagcagtaaaagtacataacacaatagagaaataaatgaagaaaaattaaaagtactttagattttcccaacatgaataaagaaaactgtctgtagagatatctaaattataaagagaagaaagacatatttttttatcatggttaatggagttataactagaaacagagaaagctatatatgtgtatttatttttataggaatgaacatatgtactctctcacaaacaaacacgtgtgtgtgcatatgtgtgtatgtaagagatataccatttatctatcttcctagctctctatataattcctttgacaatatcattactagtagattcaggtactatctctcaagggatgtagtataaaacatagctttctctgtagaatgaaaaaaatagactagatatgtgtgagcaga

SEQ ID NO: 42204 - DNA, 1050 bp, Homo sapiens
ttaataaactacaggttcattgaaatgaatggcaggaaaggtagcatttcttgattcaggatgtaagggcaactttaaaactctatagctacttcatgaaaccatacattgctaagaagatgttctcataaagaaaacatggcagattaggtcattctcctccttcctgacttcctggttaggtaaaatcacactcataaaacactcccagcacatattcataggatgtcctagcatgttctaccaggagaggggagagaaagtgtttggtggtgattcaagcaacagtaagctatgtagagggttttgagtgtttccttagagagagagagagagagagagagagagagagagagagagagagagagagagagagagagagagagagggagacttcgtttttactacatagctatcataaagcccttatgagtttgagagagaagaattaagaacggatctcaggttaaattccagagttaatgatgtgttaatgaagatgtaggaagcaaaaatgattagtttaaaaggtgagaatctcaagcaaaacaaaagaggtggtaggtctggagtatcaccgataagttacataaataagatgtttattaacatacattacctatttatgcaattatttttgtagcttttgactccattctaagactatattgctaatagggtttagtaaacatagttttgcaaacctacattataaagatgtttcaacctcatacattggcctttaccatcacgttgaatacagaaatactgttctctctggaatttattgtgagtcctgggttcatttacattttatcagtgacccaacatgaaacataacatttactttttgtttagtactttcctgaagcagacaggagaaagtcattgaaattgcttcaaattacctgagaaattgccataatttgcaacttcacaatgcaagcctggatttcccaagttagctctgatctcaatgatgagtttaaatgccaggatgatattttaactatgcagagtcataggcatacatgaaactccattagttta

SEQ ID NO: 42205 - DNA, 1894 bp, Homo sapiens
agctaaaataggttcaatgttgctaaactgatacaagttgtactctaaaaatgcaacaatcattgagaatatctaggacaaccttctttccccttttttttattttagggtagatcctctgttatggtctcactgctaggaacttcttcacattatttcatagaaatcttgtgtagagcatagaaagagttgtgacagggttgttttgaaatatgtgcttactggagccaaactgctaaatttaccagccatctgacatgagaaaaatcatttgatttttgtgtgccttagtttcctcatctttcaatgcagataataatacccattgcaaagattgcagtgagtattaatatacataaagaactacggtgtctgtccacaaaatatcacatggattgtgacatggcattataacaagcataatgttgtgttggcaaaatactgtatcagttttataatttagtgctttgaggtccaccaaatgtagtttttaatttattgaacaagcatatttgagctctgaaatagttaagatcaactccctaaaattattggtgctacttaggaggccagaggtataaattgttactgttgtcaatgttccacacaaatcacttaggatatgtgaatgtctgctggacagaattcgacttcttttgtggggaactatcttttgtagggaaatgggctcatctttgaagacactgtacaaccaaaatcaaatcatagcaagagacccactttattaatttgtccaatttgattactaagaatttaaccagtattagcttctttaaacatgcaatatgaaataatattttaattgcctggtataagcaatacaccaattaggagatttgctgaatgtcctagcatttgtgcatctttataaacacttcatggatagttccaataagaatccattccatgctgactgctgtgctagggctactcacccagagacgtgataggggctactcccctaagaccaattcctcctggcaggccactcacaatctcacagcaggaggcagctaaacacaaaatcaatattaatataaaatcaactgctatatttttaaagagtagtgtttggattacataagcaatcataaaactcccgttggctttagcaagaggtttagtcctgtaaactccaaaggttttctgtgtgtgctgagcagacaagcatcctaacagaataagccagaactttcctagccatcctagcatgtttgtgccttgtaagatattcccagttacatcctttaatttgccaaagggcagaaaaagaatttggtaagttaactttcccacatgcacaaatttaactgctgttttggtattccacacaggggccagattggatggaagggcaagagggctgctgagggagatcactgcaagtgaaggcaaaatctagtctgatggctcagactaaaaaacttggcctgccaataagagggagcagtgcttccagtgaaaatgtgaggcagtgcctggctttccctgctatactccaccctcctccactccctggactgcctgccaagaaagagaagggtgagcaatagagaaggaagtgaatcactagcacttcacaagtgctgctgcagaggcctgccatagagagctggctgagacctaggtgctctcctgctgatctgagagggcagaaaaataaataaatagaaatgtcaaaaagaggacagcagcagtgtagggaagggaggcagagaggaacaaccccgggcaggaggagtgtgggtcaaatgtgagaaccaataccctccttccctagctaaagttgttcccccatcagcctcagtttccaccatctctgaggcattcacaggaggaataactggtgtgttaaaatccaccaaccacttat

SEQ ID NO: 42206 - DNA, 1050 bp, Homo sapiens
attaggaaatgtaatttagatttaaaaggcctctgttgtttacaaatgaattctaatcaggtaggtactagcagctcctcagggaggtaaaagctatcatttagaatgtggctgccctttctgggtagctttttgttttttctgatcataatggcatgcaaaaagataatacaagaaagtaccaatgctaaggcttacattggtaaagagagagagaatattactcttcagcaattgttcattgttatcagtactggatttgattacggatataggatttatagctctaaatttggagctctaaagaaacctttagttttgaaataactgtaagaatttgtaactcttgagtttccaatattaaatcattttcccaacttttaaaagttagattctccttttatccataaaatggtcctgaatacttgaagtttattataatcacatatctcatgttaaaacaaaaaaaaagctacaatccctgaactaacaattttctttttggggattctgggcaagagggctgactagaagcagctaatatgcaccaatttcaaggagagaagacagtgtgatcagtaaacactagctcttcaactagatcatccaagagtaaacttcggaattcatgaagaaaacaacacaacccacagagaatggagaagcgtgagatatgacaattgcccacccggagtggtacagagccaggggaggcccccacttcgggaaaatggtcagtgagtgagggtccctggggaccacacttctgccatggacccctttgcaatcctgggcacaggaaataccctaggacccctccacccatgggagagaccaccttgactgtggactaatgaagacccccagcatagcagagctgccttacagaaaagtggccacactgttttccatgagggtccccacccctgctactcctcacagggcaaggcctcctgacctaggatctcagaaacacccaacctgggctttcggcctgttgcagctctgcgttttcttggaacagagctcccaggggtaacaggcaggcct

SEQ ID NO: 42207 - DNA, 1660 bp, Homo sapiens
ataaaccatggctgccctaaagagaagaggccagtctgtctccccaggtcccctggtccccgctgcttgtcattgggcagggactcctggcttgaatccacaacacagctgccccacccagggctgattgtaccaactggtagtggctctgcatatctctgcagtggagccccaagaaacaagtgaaagtcctgctgccacaaccattgccaaggtcccatctcttgcttcctccaagctggggagggaacataaagcctgagcttaccccagggctgcagtgtggatcctgggcatgccaagctaagatctacagccagcattctggaggagctgacactttcagatcactaagagggagcacagatacaattgggaggaagtacagaggttccacatggctgagcaagagcctacctactggccattatgcttcagcaccatctactgagtcatagcccaaacttcatcaccaaaaacattttgctaatatacccacctgtgaaaccaaggacaaaaattagaattcagctacaaataaagaccctgcacaaaggtcttggccttctgaaaacatccagaaaagaagtcaactgacgatattcaaattataccacagttaaaggaatatcagcctacacaaatgagaaaggacctgacccgtagaagaactctggcaattcaaaaagccagagtttctcctttcctccaattgattgtgctggttccatagcaaaggttcttaaccagactgaaagtactgaaatgacagacatagaattcagatatggatagaaatgaaaagcatcaagattcaggagaaagtcaaaattttattctaatccaaggaatctaaggattgcagcaaaacaatacaggagctgaaagatgaaatggccattataaggaagaaccaaatggatctgatagaactgaaaaaacacactacaaaaacttcataataaaatcacaattattgtattagtttgttcttacactgctacagagaactgcctatgactgggtatattataatgcaaagaggtttaattgcctcagagttccacagggctggcaaggtctcaggaaagttataattatggttgaaggagaagtaaacatgtccttcttcacacggtagcaggaagtagaatgagaactgagtgaagggggaagctccttataaaaccatcagatgttatgagaacttaccactgtcacgggaacagcatggggaaaacttcccccatgattcagttgcctcccaccaggtccctcccaccagacatgggattatgggaactataattcaagatgaggtttgggtgggaacccagccaatccatatcattccaccacacccaaatctcatgtcctcacatttcatgcctttccaacagtctccaaaagtcttagctcattccagcattaacctgaaagttgaagtccaaagtctcatctgagacaagggcaagtcttttccacctaaaagcctgcaaaatcaaaagcaagttagttacttcctagatacagtggaggttcagccattgggtaaatacacctgttccaaatgggaaaaagtggccaaaacaaaggggctacaggtctcatgcaagtctgaaatccaacaaggcagttattaaatcttaaagacccaaaa

SEQ ID NO: 42208 - DNA, 1057 bp, Homo sapiens
cattgcccttgagaaacagaacaagacaagggtgaccactctcagcactcctattcaacatagtactggacatcctagccagaacagtcaggcaagagaaagaaataaaaggtacccaaacaggaaaagaggaagtcacactatctctatctgcaatctgtttctatacctagaaaaccccatagtttctgcctagcagctcctagatccaataaaaaacttcatcaaagtttgaagatacaaaatcagtgtacaaaaattagtagcatttctatacaccaataacgttcaagctaagatccaaatcaagaacacaatcctattcacaatagccaaaaaaggaataaaatacctaggaatacagttaatgacagaggtgaaacataaacatctctacaagaactacaaaacgttgctcaaaagaaatcagagatgacacaaacaaatgtaaaaacattccatgctcatgaataggaagaatcaaaattgttaaaatggccatagtacccacagcaatttagattgaatgctattcctcttaaaacaccaattacattcttcacagaattataaaaaactgtttcaaaattcatatggaaacataaaagagctcaaatatccaaggtgatcctaagcaaaaatagaaaagctggaggcatcacattacctgacttcaaaccataccacaaggccacagtaatcaaaacagcatggtactggtacaaaaacagacacatacaccaactgaacagaatagagagcccagaaataatgccagacagctacaaccacccaatttttgacaaagttaacaaaaaacaagcgatgggagcaggactccctattccataaatggtgctgggataacctgctagatatatgcagaagactgaaactaaacccctccctgacaccatatacaaaaatcaattcaagatggattaaagacctaaatgtaaaacctaaaactaaagaccttagaaggtaacctacaaattaccattctggacataggtcctgggaaaattttcttcccaaagatgccaacagcaatggc

SEQ ID NO: 42209 - DNA, 1071 bp, Homo sapiens
tccagcctgggggacagagacagactccaactcaaaaaaaaaaaaaaaaaaaagacactagaactggtggttacccaaataactgaacaccacaaaattccgaccagaagacttagagccttctttcttgaaaataaacttttaacacgtttctacagaagcatgaggctaacatggctaatagctgtcagcttatctctgctactcacagaaaaggtaaattatgacatcgatctaacctgtgccttgaaatgatcagcattaaaacccctgttattaggttctttcatgaaagccaaagaaggaggcctatgaaggctcacaaactggaggtggcctctgtatctttacgggaatgtctacatctcatcccataggagtccaagcgggaaactggcttagtactctcctgagcctgttaccttcttttattttcctggccatcaaggaatatttggtcttcttcctccactgtccttttcttcttcttctctttgagggcactcagtacagtctcctttgcacatgggtctggggcattacttgatggtgaggacagtgttgagctgattatctgctctggtctataatgaaagacaggattctagcagtaagatattttaattcccatgccatatcagaaatggaaatcagaagctaaccaacaagccaaagtataatttatacactcacaacagttccccttagcaagtaaagctactttttcgttaacggcaaaaagtgaaaaacaaacggttttactagaatttggtatttctcattcaaacaagcagattcgtcctttcttttttgcgttgtagtcatgttgtcataggaacaactggagaagaataaagtggacacgaaaagggagagtattcttccaacgataatactcacatcgcagaacgcgaaaatcttctgtcaggaggggcgatcctcagagtcactgggctacacaccatcctggagttgcgaggggacagcacagccttcttgtgataaccattccagcacactgtgggaagtacccccggacaggaatactgggcctgatggatcggatagcgt

SEQ ID NO: 42210 - DNA, 1039 bp, Homo sapiens
ctactaaaaatacaaaaaattagccaggcatggtggcgggcgcctgtagtcccagctactcgggaggctgaggcaggagaatggcgtgaacccaggaggcggagcttgcattgagccaagatcacgccaccgcactccagcctgggtgacagagcgagactccatcccccccccaaaaaaaaaaaagacaaaaaacagaattgtgtcacacaggccagatgcagtggctcatgcttataatcccagcaatttgaaaggcaaggtaagaggatcgcttgagcttgagcttgagcctgaggccgcagtgagctatgaccacaccactgcaccccagtctgggtgacagcgcaagaccccaattccaaaaagaaaaaagaaaaatcacaaagaatttcatggcagagtgcctgtctttcacagctttaactgctgcaggaactttctttttttttttttttttttttttgagagggcgtgaggagacacaatctctgctagtgattctcctgcctcagcctcccaaatagctgggattataggcatgcaccaccacgtctgcctaatttttgtatttttagtagagacagggtttcaccatgttggccaggctggtctcaaactcctgctgggatcatgggcgtgagccaccacgcccggccacctttagagttttcttaccacctggttttcctctctcaatatctttctctcatttcctgccttaaaactctagcttggcatctgggcgcagtagctcatgcctgttaatcccagcactttgggaggccgaggtgggtggatcacttgaagtcaggagttcgagaccagcctggccaacatggtgaaaccttgtctctactatttttacaaaagttggtcggacgtacagacgggtgcctgtagtcccagctgcttgggagactgaggcaggagaatttgtttgaacccagaggtgaaagttgcagggagccgaggttgtgccactgcactccagcctgggagacagagcaagactgtctccaaaacaaacaaacaaaaa

SEQ ID NO: 42211 - DNA, 1034 bp, Homo sapiens
tgtctcgcagtttagattctttcttttgtctcaactttggataacctgatgtcaatgtgcctacgagaagatctttttccgatgaatttcccaggtgttctttgtgcttcttgtatttggatgtctaggtctctagcaaggccagggaagttttcctcagttattctcccaaatatgttttccaagcttttagatttctcttcttcctcaggaacaccaattattcttagatttggtcatttaacataatcccagatgtcttggaggctttgttcatattttcttcttttttctttgttggattgggttaattcaaagaccttgtcttcaagctcttaatttctctcttctacttattcaattctattgctgagactttccagagcattttgcatttctataagtgtgtctgtttcctgaagtttttattgtttttatttatgctatctatttcattgaatatttctcccttcacttcttgtaccattttttggatttcgttgtattgggcttcatctttctctggtccctccctggttagcttaataactaacctcctgaattctttttcaggtaaatcaggggtttcttcttggtttggatccattgctggtgagttagtgtgatttttgcggggttgttaaagagccttgttttgtcagaaaaccaacacaattttctggttccttctcatttgggtaggctctgtcagagggaagggctagggctgaaggctgttgagattttgtcccatggggtgttctcttgatgtaataccatccccctttttctatggatgtggcttcctgagagccgagctgtggtgattgttatctctcttctgatctagccacccagcaagtctaccaggctctgggctggtacgggggttggctgcacagattcctgtgatgtgaaccgtctatgggtctctcagccatggataccagcatagtatttcgggtgtctcttgggtcctgcaggagcaatctgcttccttcagagggtctgtgggtcctcttaggtttcctgat

SEQ ID NO: 42212 - DNA, 1035 bp, Homo sapiens
acatagaaaaggtacagtaaaaatataatagaaaagaaaaagacatacctatatagggcacttactgtgaatggagcttgcaggactggaagttgctcagagtgagtcagtgagtggtgagtgaatgtgaaggcctaggacattactgtactgtgctatagttttatgcaactgtcagtataataagtttgtttacaccaacatcgctacaaccacatgaccaatgtgttgtgctacaatgtcaggacaactacactgtcagtaagcaataggaatttttcagctccattataatcttatggaaccatcattgcatatgtggtccatcattgactgaaatgtcattttgcagcacatgactgtatgtaggtatgtgtgtatatttatatacctatatatgaattataacctttgtaatttataaggttataatttatatataaattttatatattaaatattatatgcaatagatacatatgtatgtatatataaattataaagcaaggtcccaatctcaaatgcccacaaggcccataaatatatcatgagtgagtcaaatagttgtcttggtatgtgtgcacacattgaacgaatggggcagactgtgcccctttttaaaagggtactcttatggtagctctgaaagtcatgctgcatttgcaacagtgaatccagtggaatatgaatccagtgtcatcaagcataataatttttgaagaaaagtggaaaactcagatttttatggtaaaatctaccaattctcttttttttttttttggcagggtctcactctgtcacccaggtggcacaatcacaactcactgcagcctccatctcccaggctcaagtgatcctcctatgtcagccttctaaataactgccatttttttttattttttgtagagatgggggtctcactatgttgcctaggctggtccctaactcctgggctcaagtgatcctgcctcctcagcctcccaatgagctgggattatagacatgagccaccatgcctggccccaatttttgagt

SEQ ID NO: 42213 - DNA, 1115 bp, Homo sapiens
cattatagtggacagtccaatgatatggtttacaacagttatataggtattagacctggccattacttactatgtaatgttgagtacatgatttgaaccactctcaatcttagcttctttatcgttaaaacagaaatagtttgtaatgtttgaattagtaagaataaaggacacagtgtcagatgtgtcagaaggaagcatgattagggcattaagtgagaagttaaataaataggaggggaaaaaggccaccccttgctctttttctcttttggacctttttggtgacagagacagaaagaatgtgtatagtatatttaattatctgaaaatacagagctgagcatccctaatctgaagtttaaaatgcccctacatccaaaattttttgagtgccattatggtctgagagcagacattgtgtatgattgctgttttaaatttgttgaggtgtgtttaatggcccagaatttggtctgtcttgttgaatgtttcatgtaaacttgagaagaatgtgtattctgtagttgttgtcttaggtagtctatagacgtgcattatatatccagttgattgatgatgctgttaagttcatctgtgtccttactcatttcctgcttgcttgatctgtccatttctgatagaggagtacggaagtcttcaactataatagtggattcaaatatttctccttgcagttctatcagttttggctcacatatttttatgcacaattgttagacacatatggattaaggattatgctgtcttcttggagaactgacccctttatcatgatgtaaagccaccctatccctgataactttacttgccatgaaatctgctttatctgaaattaataactagtctcattttatttttgtgttagctgatatatttttttccatccatttgcttttaatctgtgtgtgtttgtatatttaaagtggatctcttgtagacagcatatagttaggtcttggtttttaatccactctgacaatcttttaattggtacatttagaccattcacgttcagagtgattactgatagcattggattaatgtctaccatatttgccactattttctgttgtcattgttctttgttccta

SEQ ID NO: 42214 - DNA, 1050 bp, Homo sapiens
agataatgtcctggaatttgaattttaaaagagttccagagatgattcttattgcaactttaatacactgctttacgtcactggtggtggtgtttttttgttttgttttgttttgttttgtttttttgctgttgttgttttgttttaagacagaatcttcactctgtcgcccaggctagagtgcagtggcgcaatcttggctcactgcaacctctgcctcccagccagtttcaagtggttctcctgccacagcctcccgagtagctgggattacaggtgcctgccaggtggtggttgtctgaaaatttatttcatttcctttcagtttaatgttagaaattaccctgctggtacctagagtccattttcatccattgttttttaaaataaatgttcttaagctgtctatttaaccttacttacgcttcattagaaaatacctgtgtgtcaaccatacatattttatgaatttttttctcgtagttgatcacagccgagttaaattgacattaaagactccttcacaagattcagactatatcaatgcaaattttataaaggtatgtactaactttaaatggtgtttctctgccatattaatgtctttctacatactagttttgtaaaaactttttgaattgctcaaacatgataccaacagcaaaagaaataaaaataaagccactgccctggcacaatgtttttatatgctttccttctagccttcttattcatatagataaatagtttctacttagttttgtgatagcagagataacattttcttttttatttcttctttcccatggaagtcttacctattactaaattattttctcagttatccctttggacacaaatgaacatcatcaatccccgttgttgacccatataggttgtttccaaatttttaaaatgataatattgcagtaaacatctttgttgttttgaataatttcttaggataaattactaggggtgggattactggataatactgatttaaaattctagaacatagctttaaatgtaaaacttttggcagttgtc

SEQ ID NO: 42215 - DNA, 1050 bp, Homo sapiens
gtcagtgacattgtttggtttatattctcatgttcattattaaaaacctgtatagtagatgcttgataaacttttgagttgaatagataatggaaggtagctatggaagaaactaagaaagagctcttcactagttttagtattgttttagaatcagagcatgctctgtatttctgccagttagctttgttgagtaggtattagggcttttgttattaatgcctagataagtaataatttttaattagcataaggcggttcttaaatacctattctgtgcaccatatccagtaaacacaaagtaatagcagtcatcaaaagcttaagtgaattgaatatattttgccatgctttaatatactatgaaagacacattatttggaaatggtttaagttaaaacaacaatattactaatacaatttgaaaccttatattttgggtaatgaaatatttttggtaatcaaaataaatgtgaaatttgcttttaaccatttttagggcgtctatgggccaaaagcatatgtagcaactcaaggacctttagcaaatacagtaatagatttttggaggatgatatgggagtataatgttgtggtaagtaatttacttttcacaataaattttgagaaatacttatgtaataacataggctattttactgaataaggaatgaggggatttttaaaaaatccataattatgtttacttattgctgatgtttactaaaaagatggacccatttttaggatgtctcattaaatttttacaaactaggctaaatattttaagaaggtgtgataataatttaaatcttgtcctaagtcagtaagtaatgatacagctatcaaacaacttataaaaagcagaaaaggattagtgctctaataggtcagtaaaatacttgatagtacagttatactcatttgagtccctcttctcaggaaaatatatataaacacataactataaatagactataaatatgcagtataagagaatttcatctatccctggagttcattcagtgccctcttgttcttttggatgaa

SEQ ID NO: 42216 - DNA, 1043 bp, Homo sapiens
ccagctaattttgggtattttttagtagagacggggtttcactatgttggccagactggtcttgaactcctgacctcatgatctgcccgcctccacctcccaaagtgctgggattacaggtgtgagccacggttcccagcctttgtttgcatttttttcttccttttttttttttttttttttttttgagacggagtcttgggctgtcgcctgggctggagtgcaatggtgcgatcttggcttgctgcaacctctgcctcctgggttcaagtgattctcctgcctcagcctcccgagtagctgggattataggcatgcaccaccacacccggttaattttatatttttagtagagttggggattctccatgtttgtcaggctggtcttgaactcctgacctcaggtgatcacctgcctcggcctcccaaagtgctgggattacaggcgtgaaccactgcgcccagcctcatcttttaatagttatacaagtgctttatatattgaggacattaacttttattcatgttgtaagtaccatggtttttcctgtcttctgcctgtttgcaatacataagtttcattttgtcatgtcagatttttgaatggtttttgtccattgagatatttgtacatagaaagtctttccctaacacaatagtgtatatattttgcatatatttttagtactttcatagatttactttttaacatttatcattggataaatatccaatatgtttatatcatatatatatatatatttttatccacctggattttttatggttaaggtatgtgatcagaatttaattttttgctcttcattgatagctaacttctcctttgccacttactgaacggtctgatctctggagaattcactgttatgtaagaaatgttacatgtactcagatctgttcctgaactttctattgtgtttcattgatctggttatctgtatctttatgttatacttttaactatcaaattttagatatatataatttatcccagtaactcaactaaaattctataaatgttt

SEQ ID NO: 42217 - DNA, 1061 bp, Homo sapiens
tcattaggggaaaacaagacactatagaagaaaagatacgaaatcatggtgtcatagatgggaatactatctgcagtcatacgactgaggtaatgaaaaattacaatataacagtattggaaagatagagaaggacacttccacagtaggaagtcagtagaaaatgtgtgaaacaaagatcaagaaataacttttgaaatagtctgaaatacagaggtgtaaattttagaagcagctataaaaaaatgttgaaagttgatgcctctggctaacaggagggctgcggggcagagactatgtttttcattcaaagtcttgtatttgactttttaaacagtatatgtgtattaccttgatgaacattaaattttcttagtctgaaaaactgcagtttttattcgcaaccagattgtaatggctcttaatatgctactcttagctacataattctcaggtatcaacttgtttaacagtcttaaaatgccctttttaaatgtttgtttttcagttgccttgttgaaggggatgctaaagaagaaatactgcagccaccggaacctcatccagtgccacccatcttgacaccttctcccccttcagcttttccaacagtcactactgtgtggcaggacaatgatagataccatccaaagccagtgttgcatatggtttcatcagaacaacattcagcagacctcaacagaaactatagtaaatcaacagaacttccagggaaaaatgaatcaacaattgaacagatagataaaaaattggaacgaaatttaagttttgagattaagaaggtccctctccaagagggaccaaaaagttttgatgggaacacacttttgaataggggacatgcaattaaaattaaatctgcttcaccttgtatagctgataaaatctctaagccacaggaattaagttcagatctaaatgtcggtgatacttcccagaattcttgtgtggactgcagtgtaacacaatcaaacaaagtttcagttactccaccagaagaatcccagaattcagacacacctccaaggccagaccgcttg

SEQ ID NO: 42218 - DNA, 1012 bp, Homo sapiens
gcaacttccgcctcctgggttcaagcgattctcctgcctcagcctcctgagtagctgggactacaggtacgcgtcaccacacctggctaattttttttcttttcttttagtagagatggggtttcaccatgttggccaggatggtctccatctcctggccttgtgattctcctgcttaggcctcccaaactgctgggattacaggcatgagtcactgtgcccggccttttttttattattatttttttgagacggagtctcactctgtcacccaggctggagtacagtggtgcgatctcagctcactgcagcctctgcctcccgggttcaagcgattctcctgcctcagcctcctgagtagctgggactacaggcacacgccaccatgcctggctaatttttttttttttttttttttttttcagtagagacgaggttttgctatgttggccaggctggtctcgaactccgatctcaggtgatccacccgccttggtctcccaaagtgttgggattacaggcatcagccactgcgcccagcgtttttgtttttgtttttgttttttgaggcagagtttcactgtcgcccaggctagagcgccgtggcgcaatcttggctcactgcaacctttggctcccaggttgaagcgattcttgtgcctcagcctcccgagtagctgggattacaggtatgcacaccacacccggctactttttgtaattttttagtagagacagggttttgccatgttggccaagcttgtcttgaactcctggcctcaagcgatctgcccacctcggcttcccaaagtgctgggattacaggtgtagcctgaatgtaagtattttcttaaatatggtcctgagtccaggtgtggtggctcatacctgtaaccccaacacttcgggaggatcacttgaggacaggagttaaaggttgcagtgagctatgatcacaccccagcactccagcctgggcaaaatgaaactccatccctttttttttttttaa

SEQ ID NO: 42219 - DNA, 1048 bp, Homo sapiens
agttaatgtttaggctaacttgctgaaataactgttttaaataagaaatgtttatttctcccctgtaacagttgtgaagatagacatgagttcatccagggacccagctggccatgtctctacttgcctctgcatttagattccatatctgagtaacaggcagttgtcttcaaccacatggggttgaagtagctcaccagtaccctgtccatattccagccctgagtaaggcaatgtgtggagagtaggcaagttcattcttgaggtcattaaagcagaagaatgctgatcacttccacttatatctcattaaccaaaacctagttcaaatggccacactgatttacaagggaagctgggaaatgtctccagctgggaagtcatgtgcccacccatcattttgagtgaagaggggatctattatttatttttatttttatttttattgttgagatggagtttcgctcttgtcgcccaggctggagtgcagtggcgcgatctcggctcactgcaaccttcgcctccttggttcaagcgattccctgcgcccagccagggatctattattaaaagggaaaaaggaggcctgctctaatgacctcattttactctaattacctctctaaagatcctgtgtccaaatacactcacattcttgggtatttaaggacttcaatatatgaatttttggggagacataattgggcacacagcatgggttaaagaaagtggaaattgtatcctttgacttttttttctccacctttctgtgtaagaaggaaaggatatcttttggaaaaaagatacggagaagaaaatgcccaggaatgtgtagaagcaaggatcctgcattgttcttctggtaagaagaaaatgaaggggataaaatgggtctctggggtacattgcctttagctccagaaatgtaaatgggctcttaggctccttctgttacaggcttacgttcctcatcctaaagacaagaatgccattagggttattagtaaaaggatgttttcattttacatttatgcctgaacttaataag

SEQ ID NO: 42220 - DNA, 1032 bp, Homo sapiens
accccaggaaaaatggaagggaaagtggtacaagttaaaacagtcttcgtggccgcagagacgatcgctacctcggccatggcagatctgggggtccggggcgggggttcttccctgatacccaccgggcacgcgagttcacgccagcgacagtggaaagccctcccctcgcagcgcgctccgccactagccgcaccccgccgagctctgacctccgaagagggtccctgtggcgatcccgccccttcgtctgatgtttgtgcctttgattggctcttaggtggatccctcagcgtggcttgcccaatggagcaatgccggctggtggcctggccgctccgccccttccctacccctcgcggagggcccgccccctgccccgcgccggctagcggaggagagtaaatacaacaggagcgcaaaatggcggaaccgccgagccccgtgcactgtgtcgctgccgcggcccccaccgccaccgtctcggagaaagaaccgtttggcaagctgcaactctcctcccgggaccctccgggttctctgtccgccaagaaggtccggactgaggagaagaaggcaccgcggagagtgaacggagaagggggcagcggcgggaacagcaggcagctgcagccgccggcagcaccttcgcctcagagctatggcagccccgcgtcttggagctttgcccctctgtctgctgctccctccccgtcctcttctcggagcagtttctctttctccgctggcacggccgttccctcctcagcctccgcttccttgtctcagccggtgccgcgcaaactgctggtccctcctacgctgctgcacgctcagcctcaccatctcctcctgcccgccgccgccgccgctgcctcggctaacgccaagtcgcgcagacctaaggagaagcgggagaaggagaggaggaggcacggtctcggtggggcccgagaggccggcggggcctcccgggaggagaacggggaggtgaagccgctgccccgaggtgggtgccgtgcggggaggggg

SEQ ID NO: 42221 - DNA, 1078 bp, Homo sapiens
gagcagttatacaaaaaatcagaattcaaattatagaagagggaggaggaggatatgatcatttgtgatcatgggcatcaaggagtgcttagtggaagaagctaaatttcaccgtaatcttacaggatgtgtaggatttgggcaggaggaattgggatgggcaatcgcattttagctaagggatatattagtaaaaatattggagtaagacatttgagtaatgatgaatcaagtaatccggaatcttgttatatatgtgggtgaatagttgaagaaaaggctaaaagaaggtgagtcttaactgaagattcttgaatgacatattatgggagttttctgtttttagataggcagaggtaagctgagttggtttattcattcgttttaagcagaagatagtgacatggtaaactatacatttaaggaatcttttttggtcactgtgcttacttggtggaaaggaaagaaactataggtacggaaaccctttcttttaaaagctagtgagaatacactaggtggtgactctggaaagggaaaaaaagatggaaatattttaacgaagtataaactgaactggtcaagtgatttagtgttaggggaaaattgaagaaagaagtattattagtgttactgaaaattttttgtatttggatgttggatgaggatgtgccattaacatagagaattggaaggagaacttgaacttttttatattagaaagatgatattttggtgttaaatattatggagatgaagatgtggagtttggcagaggggttgggttgggagattaatttggagattagtttgccacagggttatagtttacatcatgtgagtgcatttttagaggcaatatagagaagagagaggaatgcctaggagagatcctaggtaaatgtgcaggtttggatggtgggattatgagaatgagggaggagtcaggtaggatagtacagtttcagtgaaacttagggagaaattttgagaaggaattgatactgttatgttgcagtgaggtccacggaaaaaagggctgagaagccactggattttttagctttgattagctgtg

SEQ ID NO: 42222 - DNA, 1030 bp, Homo sapiens
catctgtaatcccagctactggggaggctgaggcatgagaattgcctgaacccgggagacaagaggttgcagtgagctgagatcaccccactgtactccagcctgggcaatagagtgagattcagtctcaaaaaaaaaaaaagaaaagaaaaagtcaagtctacttaactttacccttggtttagcccaatagccatttttttttctgatttaatcaaatagttttcttattcatttgaaaatatcatgctgtaaattctattacttgagaaggaatctgttttagaaatactttataaaagcctcatatgttcttgattgaatactggattcctaacataatgtgaattatgtgaatccagagattacacatgaaaataaaatttaaaacagcctaaaaattgagatttttaaaaaatgaaatatacgatattaactttgaagtagacaaaaatttaggtgatattttgaaccgagttaaactgaaactagtgatgattaaggtaaaagaatgagatagatgtggaaattaatttgtgacttctgggatgtccatggaaaaatttagggaaaatgtattcacagtggaggtaagtaataatttaattactgccttacagtgttaccaagattaaatgagggaaagtatgaggaaagtgccaagtatagaatctggctcacaggtacttactactgagtagtaaatagttatgaaatctttcttgtaagtatgtatgagagattaactttgtgattaaaaagcaacaaaattggccaggcacagtggctgaagcctgtaatcccagcattttgggaggccgaggcaggtggatcacctgaggtcaagagttcaagaccagcctggccaagttggtgaaaccccatctctactaaaaaatacaaaaaattacggtgggtgcctgtaatcccagcaactcgggaggctgaggcatgtgaatcgcttgaacccaggaggcggaggttgcggtgagccaagatggtgccactgcactccagcctgggcaacaga

SEQ ID NO: 42223 - DNA, 1366 bp, Homo sapiens
gtatgacatagtatacatattataaatgtataacttgatgaatcttcacagggaacacacccatgattttaaaaagccaaatattgttaatagccagaaaccatccccgaacccttctttatcagtactgtgccaaccccccagtcccaccacatgaacaaatacccaggtgatcactgtcctgactttgaacatcactgatatattttgcttctttttgaacttaggtggaatcagatagtacgtacattgttgtgtctggtctcttttctgtagtataacgtttgtgagattcatccatcttgtgtgtagtggtactgctgtatggtattccactgtgttagtataccagtgttaatataccacagtttgttgatcttgttaccatatggatggacatttgagttgtttccagtttgaggctggtagaacacggatgctatgaatatttttcacatgtcttgatgagcatatgtatgtgtttcttttgagtatatacctaagattaggatttcaggatcaaaacatatgcacctattcagttttgctaggtactgccagtgttccaaagttaaatgtgcctatttacattcccagtggcagtgtttcacatcctttgccacggttagtagtgtctttttcatttaagtcattctggtgactatgtagtggtagctccctgtggtttaatttgtatttccctgatgactaaggatgtcaagtacctttttatatgattattatccagttgaatatcctcttttgtaaagtacctgtccactctgtcaatttcttatttgctttttttctagttgatttgttggactattatatatgtagataagaatcttttgtcagctaactgtattgcaaatatttcctctcacttggtgtcttaccttttcactcatagatgtttttggtaactagaagttcctaagtttaatgtaatctaatttataatttataatccatttatgataactgtttcttacattctgttttagaaatctttgcctaccacaaagtcattaatatattctgtgaagttttcttctggaaacttttattgttttacctttcatggttaaatctatagttaataaaacagcagctaaaagtattggaaaaataatctgtagttcatctggaattgatctttgtatatggcatgaggtaaagatcagggtttatgtttttccatataaatatatccaaaagacccagcatcatttatggaaaagataccccttcctcattgtattgtagtgtcaccttaaaccagctaatcatatgtgtgtgggtctgtttctgggctccctttgattccattgttttgtttgtctaattgttacagctttataat

SEQ ID NO: 42224 - DNA, 1045 bp, Homo sapiens
tttctctaatgctgtggccctgaggttagtgatatattaggaaactgtatcatgaaagtccgtttgaggatagaaacatatgcatggacttttcccaaagtttgtaacctgtccatatctgttagcttttgctgtattaaatgtataaacaaaagcctcaaaacttagtgacttgaaaaaaggtttcatttatcacagttctttgggcttgctggacagttcttgtggtctctgctaacttagctggggctatatggcttcattcttatgtctgatgattggcagaccagttgggtcttgggacacctcacttatatggttggtggttgatgtatgttagctgggttgatggccacatttttctcatcatcccacaggttagcctgggctcatttgcatggtggtggttacagggttccattgagtagaaagagggtaagccccagtgtacaagcttctgcttgtgttgtgtttgctaatgtcccattgacaaagggaagtcacatggtgaaacccagattcgtgtggaaaaatagactccacttcttttaggttatttattcattttactttaattttttttcttgtgacagagtctcactgtactccagcctggacgacagagtgagactccatctcaaaaaaaaagaaagaaattcatgataatgctatcctctaggtaattaagtagcactgtttttaatcgataaaagagtatatatagtaatgttatatgtgttttgtattttcttatatgatggtagaagttgtgaattatatatattttaacaggtcattgtccaggatggagtgcagtggtgcgatctcggctcactgcaacttcccaggttcaagtgattcttgtgcctcagtcacccaaatagctgggattaggcatgtgccaccttggcctcccaaagtgctcggcctatttaaaaaatcctttaaatttttaatatttgtgggtacatagtagatgtatatatttatggggtacataagatgtcttgatacaagcatgcaatatgaaataagtgcatcatgg

SEQ ID NO: 42225 - DNA, 1550 bp, Homo sapiens
attccaaggaatgttgttcatcagttcaagacagtttcagctgtatgcagtttagcatggcatattcggctcaaattatatcactcagaggaggacacttctcagaatacagctactcatgaaacaggcacatcatcagattccacatcatctgttcttggacctcacactgacaacatgatttgtgctgtaagcaaagcctccttggattctgttttttcagataaacttcattctaaatatgaattacagcagattaaacatgaacctattgcatctgtaagaatcaaggaagaacctgtgaatgttaatattcctgaaaagactacagcactgaataatatggatggcaagaatgttaaagcaaaattggatcatgttcaatttgcagaatttaagattgacatggattctaaatttgaaaatagcaacaaagatttaaaggaagaattgtgccctggaaatctaagtctagttgatacaaggcaacacagttcagcacattcaaatcaagataaaaaagacgatgacattttgtgctaaatttgcatataccatctaaaatccttttttaaaaaaatttaatgtaataaagattcatgaattctgaaagcaagccaaggacttgctcctatgtctgttacaaaacatagtttatgtagctttgtaacattcctcagtgcctgtccataactgtgaagtattaagcacttagggccagatgcactgtaaacattgcaggtttaaacataaaggagtctttaaaaaaaaatcatttacgttggaattttaggttttagaatagagctgacattaacatatatatatatatataaatatatatatatattttgtaatatgagccagaattctttttcaacaatttaaagcttttccatagagcttatttatatccttttttttcattttaaatgtgtcagcactgtagtgtaaatagcttttaaatatctttttagtgtgatttatactgaaatgtgagccacttaataaaggttcatatgttcatattaataaatatgttttctgttgagtctgtaaagacaaactgacaattcatttaagtcatttgataatgattctctgctggtatatctatttagtgtggtattgtagtgcaaatgtacgtaattcaaatctagtaaatatttaagttcctcacactgtgcaggcttttttttttttttctttttttcttttttttgatacggagtttcattctgtcaccaggctggagttcagtggtgcgatctcggctcactgcaacctctgcctctcgggttcaagtgattattctcctgcctcagcctcctgagtagctgggactacaggcacgcaccacaacacccagctaatttttgtatttttagtagagatggggtttcatcatgttggccaggatggtcttgatctcttgaccttgtgatccgcccaccttggcctcccaaagtgctgggattgcaggggtgagccacagcgcccagcctatgcaggcatttttaacaaccaagactcagttaagaaagtgtgca

SEQ ID NO: 42226 - DNA, 1042 bp, Homo sapiens
ctgccttttgggttactgttggtatttccatttctggcttaatttatggtaaccatcaaaactgcttatatttctggttagggcgaagccatttaggaagaagcatttcaccagaacaagtaaaagttaattgcagcaatgatgtcagttttggcccctagtttaataaaaggataggcaaatatcataggaaatcttcatggtttgtaggaaatcagtgtttgcaacgtaggaagtttcatgggatagggaaggtataaatcaagatagtaagggttttgttttatatgtcattgtcttaccatgctccccacctatttaatcttctgttttaagctaaatttatggatttgcacctacctttttgagtggcagaagttcttaacaaaccagtattgagaaataagaagggatgtagttaaaatggttttctgtttctctttaaagttgaagaatgatatatttaacaagagttgtgttttatttccagttttccagtagcatatatgtagatgcattgaggtcatactgtgagaaaatgtctttagggtatccctccaaaataggagccttaaactttttaacttaaaggaaggcatatctaaaaaccatagtggttgcttttaggtatagtttcctatataacctatagtcagacttatctataatatgaaaatttaattgttttaaaaatgcatacatcggccgggtgcagtggctcacgcctgtaatcccagcacttagggaggccgaggcgggcggatcacgaggtcagaagtttgagaccagtctggccaacatggtgaaaccccgtctctactaaaaatacaaaaaaattagttgggcgtggtggcgtgcgcctgtaatcccagctacttgggaggctgaggcaggggaattgcttgaacccgggaggagaaggttgcagtgagccgagatcgccccactgccctccagcctgggcgacagtctcaaaaaaaaaaaaaaaaaaaagcatacatctctgaaggtaaagtataaatcagtgggctcaagatttgca

SEQ ID NO: 42227 - DNA, 1047 bp, Homo sapiens
gagttgctctgaatataccctctgattagcagcagttaaaagtgcatttttccagcctggacaacatagccagacctcgtgtctgctaaaattaaaaaaaattagccaggcatcatggtacatgcctatagtcacagctattttgggggctgaggcagaaggatcacttgagctgggaagtcgaagctgccgtgagccctgatcgtgccactgcactccagcccgggcaactgagtgagaccttgtctcaaaaaaaaaaaaaaaaaaaaaaattttaaacggaaggaagaagcagttcctgagttgtttactgagaatttatgttaaaataacataaactgttgattggctatacattgttctttgtatcacaaattccagaaacatgaagataaatgagtgaggcagctagtcaggaagaaaatgactttaaacagttgcccccaggcttgggtgtaggggcttgactcaagtcctatactcacgtgtctgtgcttgcctacctcacatggctcagactgctcggagctctttttcttttcacacaattgttatttaacctttattgagttgtggaatatctggctagatggcacttggggaaaactgaggtccagagaactcagtaacttattcaagagcacacagctcttagtatcagaacttggatctagaacccaattatcttgatgcttagtcattgctttttatctgctgtacttcctgtaccatatattacagtgtactgagtacttagagacaaagaatgttgccacattttttccttaagagtgtttacatatgaccaagtgacctgtgtggccacatactgctttacatttctatttaaattacagatttttgagcatatgttggtgctagaagagagacattaagcttcagcattttttagtccaaaggaaagctggccgggtgcggtggctcatgcctgtaattccagcacttttggaggccgaggcgggcggatcacctgaggtcaggagttcgagaccagcctggccaacagggtgaaaccctgtctctact

SEQ ID NO: 42228 - DNA, 1044 bp, Homo sapiens
acagttgcagatctgtatgtgctaggattggctcagcagggtgctttacccccaggatttccctgagatcatcctgtgtgtccttggatgattttggtttgtaatgagttctgcagccaataactgcttttgaacctgttttaggctcatccttaacactagaccagaggtaacctctatgccagtgtcatcttgtgactaaaatagtattctggagttgatgggaatcagtctcaaataacctctagggttaaggaatcattaagtttagtacctatcctgttttagacaaacacagaaaagatgcttatgaaatggtttttggtatttgtcttagtttgattatttttaaaagagatttgcagagttatagaacatatcagcagttttaatctgtttcttgtaagttacaattcagtagcttaatttttttcaataaaataaacttttagggactgtattttataaactgaaatattaaagagtttttttgatctttgaggattaattgtcataactacttaaatgacagttagcaaactgtgatatctgggaagtctttagtgttaattattcctgtgtattaactctaatattggcttagtatttaacataaatactttttggctcttgggttattttaattcagttttgtgtttactgagtgtcagggaaaattaaatatcattataaattctgtcatctctgttaagccatcctttagcaatggtaactgacactggtttttagaaacaaactacattactgattgaatgaattggtttcttgtatgtggatttttagatgaacaatttctggtataacctaggaaattctgaaatttctttaaaagattaaaaaaaattcaatctattttgtaagaaaacaagtgttatttattcatgcaaatagaactttctattattgtggcaactgatttttgtttacttaagagaacctgttgctaaaatagtaatgaggaagagtgtaatataagtctcgtcatacaccccttgctctgcaagtaaccagagtgctatgtct

SEQ ID NO: 42229 - DNA, 1052 bp, Homo sapiens
ttgaagcagggtctctctgtgttacctgtgttggagtacagtggcacaatcacagcttactgcagccgcaacctcccaggcctaagcgatcttcccgcctcagcctctggagtagctgaggctatgactataggcatgcactaacacacctggctaatttttttattttaatttacaatgagaccctgtctcactgtgttgctcaggctggccttgaactcttgggctgaagcaatcctcctgctttggcctcccaaagtgctggaattacaagtgtgagccaccatgcctggtacctagctcctcttatatgaagtgttaaggaatacgtttatgcaaaattaagcacaattttctgctttcagttcttattaaatagatatttgggttgtttaacctaacagttatgaggtttcctttcttacttattataaataataataacattctttcacttttaaaaaactgcatgtaagttaaaccagagtgtatatttctcaatgtcctaatcttggaggattgtcaaacctactttgtgataaattattgattgtctcttaaaatgctgattgtctctattgggaccaaaaaacattgaatataaaagtttacatttagatgtgtataaaatattaatctgttgtttttgttataaaattggagcagttgagtcgacatgtgcagtttaaaaaatttatactcttattgaaatcaaatgtatgagaatattattttttctataactgctacaggctaccgaaaagccattcctgtctttgaggctacaggattttgtatttggggctaattatacacaacaatttaaagtgattatgtactagaggacatatttggctgtcctaggttagctggttttatttttatttagcaactttgggtgagtttcttaactttcctaagccttggtttctttatctgtaatattgagataagaatccttttaaaattgctgtgatgattaaatgacacaacatatataaacaccaagtacagtgcttggtgtatagtaggtattcaataaatactgctat

SEQ ID NO: 42230 - DNA, 1047 bp, Homo sapiens
ttgttataggtttttttttcactagttttgatctacaccccccactccactctgtatactgatagcagaaacttaattttactcagtgttcaataatttcaagtttaaatgaattcagtttatgacaactgcctctccctcctccccttcctggttatggtgtctaagttttgaggtgatgaggtggcatttatggtctgatgaggggttgacatgtgaacataatggcaaccatcatccttgagtagtgcattgtcctccctgggtctcagctgattggcgtctgctgagaagtctgcatcctttctggtcctcagctgtgtgatttactgctttctgaaataatgcctccagcaccacaccttgaggttccttcagggctgctgctcccctagctagcctcaacgctctccaaatgccaatatggggccaatatagttccctctacacctaaagctgtacacctaaatttgcttggtagtaatagtatttgtagtagaattttactgttggtaataaaccggcctggcatgttacacacatctctaaatatatctttttgaacaataataaaatttattacaatactgtaattgtgttctgtttgtaacaaatgcataatgtgttacattttgttggtactattaacaattttattttaaattgaaagctttagaaattgattttctcctgttctagatttaagtatatatacaattccaatgcttcttttgatatattataggggctaaggaataaaccaaagaaaacagcacatgtgaaaccagacctcatagatgttgatcttgtaagaggtgagtctgataaataaatgcttaatacaagtagacattgttctggaagaaacagaattcaaaataggtttaaatattgtattaggctgttttgcattgctataaagaaatacttgagattgggtaatttataagaaaagaggcttaattggttcatggttctgcaggctgtacagaaatcacagcaccagcacctgcttctggggtaggaagctttacccatggcagaagg

SEQ ID NO: 42231 - DNA, 1026 bp, Homo sapiens
tctgttttgttaagtaaattatatacattgagacattttacccctgaatacatcaatatatgtctcttcaaaataagcacatataaccacattacagtgataacacttaacaaaatgaccaaaaatcttataatatttacattttattttaggtactccttggccctggattcaggcatggctggattgagaggctcggataatatcttcacttctttttgctgtagactttggtcttgctggtcacattcttaggttggctctttctaggtggtggctaaggtggcccctagcaatttcattttttcatagtctttagtgtttgtgatctaggagaaaggtcttgaagcacctatattagtccctgaaaaagactgattggccctgcttaggtcacttgcccatctttttataagcttttgtattcagacttactaagactgtgacaagcctaggttacatgtctatccctgaggtgggagaaataagaatgtatgattgatggataaaggagggagacgaaggtaaagagagtttatgtccagaaagtctaagggatgctgtgtaggcaaaacaagatttcccttcatgtagtaatagttagcattgatggatgtttagtggtttctctggaaactatgcctaagtaaatttgttattaattctaaggagatagacctctattaataagaagctctttgtatctgtatgatacacttatcataagatttctttatttgtaaaacaaagaaataatgtacttgaggttagggtagttctttgattgtctgtgatgttacttagaaatgtcctttgattcatatgcatctaatttacgttgcagcgttgaggtgtagtttagagactatgttgggtgttgtcttgttccgagagtttattactaaataccatggttaggctgcggcagacaataaaacagtctgagagagcttgtctctatagtaatattttaaactcatttaaatttagaaaaatattttggcaaaaaataatgtaaaaacaatt

SEQ ID NO: 42232 - DNA, 1034 bp, Homo sapiens
caagcacctctcacagcgttggcactgtcttcagagatctctggcatgctgctttctttttatcagggtttgtatttatttaaggttttatatggcatagagatggcactatcctttttctggcacttcagtctcaggtaatgaatattaattactttaaatgtgacagcctcattatggattttgttttgataaattataatagtatagataatggaaaaatagacactgtaaactttatttggctcatgtgtacatacatctatacgagaatgaatatatcaaagcatatttagctaggatttccttttttttttgggacagagtctggctctgttgcccaggctggagtgcagtggcacgatctcggctcactgcatcctctaccttctgggttcaagtgattctcctgcctcagccacccgagtagctgggcttacaggcacgtgccaccacacctggctaattttttgtatttttagtagagatggggttttaccatattggccagacctcggcctcctaaagtgctgtgattacaggtgtgagccaccgaacccggccaggatttcttgattttggtttcttttatatttctgaagtactattttacttgtgttaattggttaatttatttttatcaccgttttgggtcaaaattggctgtattaaaatgtcatgtgaattgtataatttttttcttctaagttcttgcctcaattatccaaaattatctgaaataaaacatataggcattgttacttaagtgaataaaatgtatattatagtatgtgattctacttttgtacaatgtaccatgagcatttgtgtactatacaaaaatggctttttgcatacaactatacaaaaatggctttttgcatacaactatacaaaaatggctttttgcatacaactatacaaaaatggctttttgcatacaactatacaaaaatggcttcttgtatagtttgtatagttgtaccatcaatgaagacttaccaaataggaaaatataattacagcaaacatta

SEQ ID NO: 42233 - DNA, 1049 bp, Homo sapiens
tttgggttcaacttgtatttcctctgtcccagcctagaatcaactattgtttcaagaagagtagtatatagaaaccaaaatctgagttcaagatacacttgttgcgattggggtgttgttaaccccagtccttttcagtgagcacagctagaaaatgtgtatttggtcctttacaattacatttatttctatagctatccaggtatattatacaccatcaatttgcattgatagctccaattcaaatacaatcctgcggggttcattctatctcttctttttatatttatatcttctttctgtgtcagtgagaaaaatctgattcccattatcctcaatatgtttacttattccattagtcacctttatatagatcaacttctaaccctgccaggctgcacctggtacttttctctaatattgtccctaaatgggcttccattattgactatcactgggctgcttttgctgtcccactccactgatattcttgcaagtgctttcattaccagctactggcaggctgcctttgtttgtaaactctgagagtaatacttacatttagcatttttcttttgccactgcagtttagtttgcaacttaccttcatagggttcatgagaagcatcaaatacctactacagcttagtaaattactgttcttgtctgctgagagtgtagcatgaactttgaggagatagtggggagagaaacaacccagagaagattggagggaagcagaggtaaggacaggaggaagtgagagatagctgaaaggtatcatatgggatgaatgctaccagtactctttcccctgctttcacgtagtatttaccctgccctgttaaggaaagaatacattctccttagaaaaatggttaaagcagcagttattacagactcaaagacccttttactggcctaccctcacccccctaccaccacccttttttttaaccctatagagtctggttcattctacacattcccaaattttcagccactatttctactttgactgctggcctccaggctcatgttttcagttg

SEQ ID NO: 42234 - DNA, 1030 bp, Homo sapiens
agaaagttctcaacttgtacagtttcataaccatgtaacttcttatgatatctgttcagtgtatatgctaactaattttaagatagaattttagtgtcttagagttgtgtgtataaatatattagctgtgcacagatctatatattccatttataaaacatgataaatatattcaccaatttttatttttagtgtcattaaaattgtgtgtgtatatagagatatatatacaactttatatacacacattttatttattaaatgtgatctatatatttactaattttttttttttttatagagtcatttgccctggctccatagttcccacccaggattagaaaaaataagtgctatagtatgggaaggtaatgattgtaagaaagcagacatgtctgtacttgaaatcagtggaatgataatgaacagagtgagtttttaaattttattcttgtagttcaagggtaagacttagtaattatatataagataattactggaatattatattagtaaccttctgacctcatttcttcaccctgaaaaaaaagttacatgtgtgtatttgtttctgtctgtaatttaaacagtgatttgtcaccaaaccactctcatcttctagtgttttcacttatctgaccaagaatagatgatacggtctataatttttctcttttatctttttctttcttttgaaattcaggagcttgttagatatatacaggtgttaataaagacttttctttggactagagattgttgttacaagaactttaaaaataaaaaaataattaaaaagacttatttttctgtatcattcttactggttcatttgtttaataggacttaagacatgaaaaaatcaaactagtaaatttgcattcatacttgcttacctacttaaatatatagaagtaatgcagatagtggtaaaagtcttgagtagttcaaagaagtctaattgaaatactgtggattaaaattttattttctattatttcttttttcagataattactgatttttaaaa

SEQ ID NO: 42235 - DNA, 1071 bp, Homo sapiens
tcattctctttaatattgcagtatttatgaatatttctaacttgaaataatgaaatacataaatttttttcaagatctggatgacagtccttttgccatctacttagtaaattagcgatctgataattgtttttaagatctgaagaattaatgacattttatatgtagtaggctctcaaacttgaatgggattcaaattactcagaatgagtatattttaacaaatgatttcatattgctataaataattctactgtagataaaatttatggtataattttatttttcttttctctctcttcccctggctccctcaaggtgaacagccatataccaggaataggataccagatttttggaaatgcagtctctctcatactgggtttaactccatttgttttccgactttctcaagctacagacttggaacaactcacagcacattctgcttcagaactttatgtgattgcatttggttctaatgaagatgtcatagttctttctatggttataataagttttgtggttcgcgtgtctcttgtgtggattttcttttttttgctctgtgtagcagaaagaacttataaacaggtgggtataatgtagacttccgaataagaatattttatcgttttcataatattaaaagtattcctgaagtactttattatttcattatatcatttttacctaattattttttattttgcttttatagtacctaaccaaataaaatcttaacaattcatattttgttaattttgtttttctgtggtaatctacttgaaaattaatcctcatcttaatcttttttagcgattactttttgcaaaactctttggacatttaacatctgcaaggagggctcgaaaatctgaggttcctcatttccggttgaagaaagtacagaatataaaaatgtggctatctctccgttcctatcttaaggtagaatgggagtgataaaagtagctttaacatgctggccctttctgatagttccagtttctttatcaatatatatttgtctctagatgtatagtaaccagcttttactcattcaaaaactgg

SEQ ID NO: 42236 - DNA, 1824 bp, Homo sapiens
tgtgccattcattgttgatgagatgaaagcccctaccctcatacgtaagcttatacttcagtgagggaatgtaagcccagacctaggaattatcctagtttaatctctagtctccaatttatcaccaattcctatcttttctgctcccaaaatatatcttgaatccatttgcttctctttgttccatttctgccaccctcattgaaaccatcaatcatcttctacctcatgctacttcagttacctcttacctggcattccagcattcacatttcttcttttcattcctttcttcagtctgccaccagtgatcatttaaaaatgtatatttggccctatattcttaaaactttttggaggttcttcatttctcttaagataaagcacaaaatcttaacaaggtttataatgccctttatgatctaagttctcccttattcacctgtcttttgtttcattttgaaacactctccttcctagtccactacattccaaccattttagactgcttccgttctttacatgagctgtgatctgtcctgctttatgttcttgcacatgcccttccttctacctagaacactgctgtgtgccatcatgcccctgcccctcccccttagtttggtgtaaatatcacttccttagggagatcttcacaggcccgcactcctaaccctcaaatctaaatgaagtctccctgccaagtatctcaaagcatcctatgtctttcccttttagcactcatcacaatttatcacatatatctgtgattattaacttgatgtctcactcccctcctagttcctgtgaaggtagagggaccatgtgttgttctctgttgtatttgtagcacccagcacagtatctagtgctaagcaggtgcttaagaaatatttgtcgaataaatgacttgtgtttgacaaaatgaagtatttgaaagttataccaataattttatgctatataaatatagatacccttttaactctgttgcaattcctcaggaaatcataacactatcattaaaatttgcctaacaaattaggtatattcaacattgtgggctgtgatcaactgatggtgatgagtcaacacctttattgaaaccatggaaattatctgctgattagtaaatatattttaaaatgtttccttttctcccttccacccacaccctgcagcgtcgaggtcctcagcgatcagttgatgtaatagtttcatctgctttcttattgactatctcagttgtatttatctgttgtgcccaggtgagttaactcgctccatgtagaaattaaccagatatataaatattaactttcagattaataaataatcaaataataatataagtaagcctagttagaaagtaagttttgaagttacctttttgcagtttttttggtagaataaataagtgcatcttatctctgtgccatgaacagtgagcatgtatgctcaaatgtctgttgaatgaacacagattaattaatttttgcctagaatccttctcattatctttacttcccaaaagaaacgtatgagttatgaaattgtcccatgaatatccaatttattcatgtttactattcttttctttctttctttctttcttttttttgagatggagtctcgctctgtcgcgcaggcggagtgcagtggcgcgatctcggctcactgcaacctccgcctcccgggttcacgccattctcctgcctcagcctcctgagtagctgggactacaggtgcccaccaccacacccggctaatttattttttgtattttttttagtagagacggggtttcaccgtgttagccaggat

SEQ ID NO: 42237 - DNA, 1029 bp, Homo sapiens
caagaaggaagcttatctgactctggatgacaaggacgggggaaaagtctcttctaagaatatataattataactcttcccttactacaggtttagggttcatattgacattatacatcttgtcctgtaaccctcatgtcaaaaagttaatataaaaagtggtcctaggcccctggatacctgacagaagcaaaaccaaggctgtttggaggcatgcgacttcagcctagacctcacgggaaccacagataaagctccttccggtatcaaaacataggaagaaacagtctaacatgaaggagtcaacagataaacccatagcaggattagatctccagctatttcagtttgatcaggtggaaactaagtttgtttacagtgatgaaagacatagataacactgtgaaaaaagaacagataagtttgaaaaagaacttcagacaaatgaaaaatacagttattgacttttgacttgttttttgcttttcactgctggaacaaagtcactgacttttaaaacacaatgaacagaataaatagcaaattaaagaaagctaaagacatagtgaactgggaggtgaaagaaatgactaaaatacaggacagagataaagagacagaaaatgcaaaatggatatttagacatcgtgggagatccaacataggtctaataagaattacaggaggaggctgggtgtggtggcccacgcctgtaatcccagcattttgggaggctgaggcagtcagagcacttgaggtcaggagttcgcaagcagcctggccaatatggtgaaacctctctctactgaaaatacaaaattaactgggcatggtggctcgcgcctgtaatcgcagctgctcgggaggatgaggcaggagaatcgcttgaacctgggaggcagaagttgcagtgagccaaggtcacgccactgtacttcagcctgggcaacagaaagagactgtctccaaaaggaaaaagaattccaggaagaaagaatgctgaaaaacaacatttggagaaataatggc

SEQ ID NO: 42238 - DNA, 1024 bp, Homo sapiens
gcatttcattttatttgcctatgttcaaatatgtttaataatgaccaaagtgcattctgagttttttcaaggaatgtaatactggagctttaagaacatacttagtttctcatgtgaaaacttaggctttgtctgatgtttttccttcctctattgtctaatgttgaggttgtttttaggaattatgttttataaactttttcaatataaggtacatgcctatacagaacttaacattttgcacagaatatatcaaatatattttgagaaaaaaagtacggcatgagttctgttaggaataaaagatgaaactattgtatctcacaaaaaatcttatttcagaatggaaatatttttgagaaaagtagctgagtatactggtttaagaaaatgcttgttttagattgaggttaacttagagttgggagttgatttattaagtacagtatacctctcaacagtttataaataatatgttgaattatgtcagtgtgggcagcagtagaatactaaaaggaaaatgtcatgttaagcaatttcagaacattaactgaactattttcaaagcagaaaaattgacattgctgcctttaagaataccatgaatgtaagaaattgaaagaaattgtaaaatatcacataatatagaaatggcagttcaaagagaattgtggcagatgttgtgtgtgaactgttgtttctttgccacatgtgttgtatttgaaagttttacagtaagtttaaaataaaacattctgtgactgacggtgtttttttttttaattttcaggtcatatacatttctatggtaattttgtgtttacttaacataaaatttagttagatttggggggagtgaaaataaattttttataactttccaacattttagattttgttatgattcttagaacatgaaagaataatacacaggtttttcatcaccaaaatgatattatatcattaatgtttgtttgcttctttgtttttgaatacagcaaactggctgtggcctgaaatatta

SEQ ID NO: 42239 - DNA, 1075 bp, Homo sapiens
agccagacagcctctctagattcctcctctctgggcagggcatctctgaaaaaaaggcagcagccccagtcaggagcttatagataaaactgccatctgcctgggacagaggacctgggggaaggggtggctgtgggcacagcttcagctgacttaaacattcctgcctgccagctctgaagagagcagaggatctctcagcacagcactcaagctctgctaagggacagactgcctcctcaagtgtgtccctgacccctgtgcttcctgacggggagacatctcccagcaggggtcaacagacacctcctataggagaactccagctggcatctggagagtgcctctctgggacaaagcttccagaggaaggagcaggcagcaatctttgctgttctgcagcctccgctggtgatacccaggcaaacacggtctggattggacctccaggaaactccagcagacctgcagaagagatgcctgactgttagaaggaaaactaacaaacagaaacaatagcatcaacattgacagaaaggacaaccactcaaaaaccccatctgaaggtcaccaacatcaaagaccaaaggcagacaaatccacaaagatgaggaaaaaacagtgcaaaaaggctaaaaattccaacgaccaggatgcctcttctcctccaaaggatcacacctcctcaccagcaagggaacaaaactggacagagaaggagtttgacaaattgacagaagtaggcttcagaacgtgggtaataacaaactcatctgagctaaaggagcatgttctaacctaatgcaagcaagctaagaaacttgctaaaaggttacaggaagtgctaaacagaataaccagtttagagaagaacataaataacctgatggagctgaaaaacacagcatgagaacctagtgaatcatgcataattatcagtagccgaatcaatcaagcataagaaaggatatcagattgaagaccaacttaatgaaataaggcttgaagacaagattagagacaaaagaatgaaaaggaacaaagcctacaaggaatataggactatgtgaaaata

SEQ ID NO: 42240 - DNA, 1032 bp, Homo sapiens
gttacagcaggcttcactgactgagacagttgtaaattctgattaagtttacagtcattggacttgaaataatcgtgctgcttccccatcacttcagctcttctgatctgtaggtggtgcatacaacatgatttcccattgcttttaaaagggaattctgatcttagaaaactacccttcatgtttagtgataagtaattgcaaaataagaactatttggtgattaaacagcatgtgttctatagcttctactttcatcataatatcatttgctggttgggcttagttgcagttacgacatctggttcttatgaaacgtgtaaattcattcaacaaatatttatagaatgccagttctatggcctgcattttctaaatatgtgggaatggaagtctttgggaagctgataaagtacataacacattattggaacatttcaccattaggtaaaaccatgtgttttttgttgctgttgttgttgtttagttatgtttaaatataaaaactgggctgtggattctttctctcatttgtcttgataggcctttgtagtaaatcatcttaaagatgttttagatgaatgcagtttataggtcaggttgagttttactgctttttgccaaaaactatttcagactttcagagctaagcactaagtaaatggactccacagtaatttatactgtgcacatggtgatgcttggaattttagaactaattctctggaaggttgtcaactgacaaatgtccattgtagaattagcagtcccatctgaaataacttaaactgtaatttaaaaagtagtatagaaagagcaattctgaaaaatatgaaactctcaaaaagatcttagtggccccttttggagaatcggtaggacttaggctttgtaattcatagacttgtgtagattttgcattgtatttgggtatatgtcgacgtttatgtccatcagtgaaaaaaatgttattttaaaattaaaaaaaaaacaaaaaacttagaaaattagagcatctgaatgattttgtta

SEQ ID NO: 42241 - DNA, 1004 bp, Homo sapiens
tattaccttatttgtttctcacaacccttttacgtattgttttactggtcaggtacatgagcatctgagaaattgttgctgcatattgaaggcacatacttatttacttggagattaatttgtgttaaggaaattagaatcttatatcagcaacagtatttttttgataagcattttaggagttaattgagtacagctctggtgattacagagaaatctgttagaagttgttgacacaaagaatgagttttaaaaatgtcaactattttaccactgggcatgctagtgaaattttccactcaattatgtttgtgtcataattgtttgtgtcaaacaaagaatttctttaaatgtcatatatttttagcagtgcattatgcattatggctgtgcaatataaactctcttagtttttattaaatttaaatgtgtgttagcctgtaatgttatcgttaatgctgtgcttgtttctaaagtgggagctccacaactcaaaatactctgaatcatagactaataggaagttgagtccaaagagattttttttagcatcccttggtttatactgctcttcaaaaagctgaaattacccctgaaactactggatcatggaattatacagtatgattgaaagtcactggaaagatgctcagttttttatttactggtagatacttatacagtgcttaccatttgctaccctatgtcctaaaggatctataaataccaggttatttaatagttatcgagtgtctgtgctgtggactgaatgtgtccctccgaaattgtatgttgaagccctaacccacagtgtgatggcatttggaggtggggcatttgggaggtaattgggttggaatgaggtcatggaatggagtcctcatgatgggcatgaagggaccttgagttctctttatcatgtctggattcagcaagtaagtgactggctgtaaaccaggaagagggccctcaccaagaacctgaccatgttggcaatttgatct

SEQ ID NO: 42242 - DNA, 1050 bp, Homo sapiens
ggagtgtaaacaatacaaagcagtggtctacagtaacaccatccagtcaattattgctatcattagggctatggggaggttgaagatagactttggtgactcagcccgggcggtaagttattaaatttgttggagctgacctgatgggtaaaaagaataacttgtatgctaataccatactgtgtaacataggcttgtcaactatcaggaccatttcataaaaggaaccaaaaggatagaagtgagtgaaatgaggagcgttagaagtgagtgaaatattagaatatgtaggattgtataatctctcctttatgctttccttatccattagatgatttggacaactgaataatcaccacagtgctttctgtgtagcatgctgtgttgggtacccctgtattcccataataatttttagtactgagtaaactgcttaccctggccctcttcaaaatctgtttctgcaatttggaatactgaagtgatctagtcatttgtattcatgcctagactgaaaagcaatctaatctcgaataatgaaaacagtataaaagtttgcttatctttggaataggaaaatatcggctattaaaaaccatgtatcaaaatttgagagctaaaagagatttttggagacaagctagtttcaattctttattttgccaagaaagaaactagcacccaggaaattacatggtacagagattgccatacagctcgtggtaaccaaggcactatgcctgtgcctcctcatttggcccaataacttgtttcagttggattggaagcagcccaatccaatccgtaaggcacctttgttttctttttttttctcttatcttctctttgattgcttaatgtatttatttctagcagatatattattgtattatttttactagtatttatttttatggttcctttataattctgtatattcagtatacatactgtcttcctactaatactatgaagattttgtgtatagagactataaatttttctttttgtcttagtgtcagctagattttattttttaaacatgtaggc

SEQ ID NO: 42243 - DNA, 1049 bp, Homo sapiens
ctgttaaattatatgcaacgatacttctgattgcttccataagtattttaaatttaatacatttgttactatcacttgtcactgatttacaggtggttcatgtaattgaatttacagaaaactaaagctttatttcaatttttcatggctacttctctccaaaaaacaaacattgacctgctttcttaaacaaagatataggtaataattaatttatgtggcaacattagctttgtgctttaatacatgctatggtgttgcatatgcttttttttattttcatttttttcttaaagccttcagtggacattttacgctgctgtcattatctgttactgaaatcgtttaacttcttttagtctgctcattactatttccataatattaaataaacaaactcagtactctgatttcaagtaatcagatatgtctgatctggagaatattgtcattttatcttaaaactaagaagtgattttaatgacaaggaagttcactatcagattgggacttagaattttttttttaacctagtataccttagattctgattttggttttgttcaccttgttttaaagattatgttctaaagcaaacttaaattatgttcaggtaatggcttacggtagtctccccttattcgaggggatacgttccaagaccccccatatatgcttgaaactactgatagtactgaaccctatatacaccatgtttcttcgtaggcatacatatctatgataaagtttataaattcagcacagtaagagactaacaagtaataataacatagaacaatcatagcaacgtactataaaaggtatgtgaatgtggtctcactttctcaaaatactgtaatatttttggaccttggttgaccacaggtaactgaaactgcagagagtgaaaccaggagtaagggggagctactgtatttctaaccaatattgtctgagaagaaaatgtgtggagttggagttaacaagtaaagattctagacttaggttcccctaataagtagttgggtaaacttggttaagtttcttaa

SEQ ID NO: 42244 - DNA, 1046 bp, Homo sapiens
tatggctctgctgctcaaacttttccacaaagtatatagaggaacaaatcccacggggcctggcaccatagtccaaaacattcttcttcaagtgtgtagtgttcctattcgtatcttgaataaagtttgtgcttatgaagatgttatgcttattctatgaccttacctcttgtctgacagccctctgtgtacccatgtttaggatgtatgaatttgttacctattatcttccactaagattttctactaagcagactttcattatttcaaaataaacatatcttaaaatttatcttccaaattccttagacgttactaagcaaattctcttttaagtagtttttaaagcattagttatacaatgatagagtaatagtccatttggagttttataataacatagctacaaaaatgttgagtaataggtacgaattagataaatttagatctatgtgctcattcaaaatgtaaagtagtaatgatactggaaaatgctcctgatacagtaagtacaaaaaagtgtgacagtatgatcttgtgaaaacagtaaaagataggcatgctgataacatgggtagaagacttgcaaatcacatagaaagaacatgaatgatttttcttatactgtattgggtcaggagaaaaaaacatctgaaaactgtccttactgccttattagttgatctatgccagagactgtttctcagcctgtgtttctcagtctttaactcacctaacaaaattgtggtgctatatgttctgtagcttgcaagatttcacagtataaagtgagtgtattaaaatagggaatgttttatatcatgtggtctcatcccatgttccattttagaatcacagctccaagcctctagggtcagcaaatgttggttcctgtgctgctcatgattgccactaatagcatctaaactctttcatacttgtatcagtactgtagttggaaatgagtatacagctgtttacagaattagcccccaaaactgggaagaaaggtgactttattccttgattctggtttttagaagata

SEQ ID NO: 42245 - DNA, 1028 bp, Homo sapiens
aggggtttgagaccagcctgggcaacaaggcaaaactctgtctttacaacgaatacaaaaattagctgggtgtggtggtgcacgcctgtaatctcagctgctagggaggctgaggtgggagaattgcttgagcctgggaggttgaggctgcagtaagctgtgagtgtgccacagcactctggcctggcaacagaacaagatcctgtcaaaaaaataaataaaaagttcctttagctcacttttggttcttactcaattttcctccttgcctttagagcagaataccttgaaaattgcctatatttgccttcatttcctttcctctttttccttaaacttactccagtcaagctttcaccccttaactaaactgtttttcccagctctccaaagaccttcttgttgccaaattcaatggtcacttttttagtgtttgcgttacttgatctgttggcaacttttgacaatatttattactccctcctccctgaaacgttttcacttggcctgtagaaaacattcctctggttttctatttttctgtccatttcttcttagtctccactgctgacttttccatgtcaccagaacctctaaatgtggagcaccccaggactaagtccttagactgcttctttgttttctttactcactttttaggtgatctcaactcaaggttttaaatactatctggtgttaactaccagatttattccagaccagacttctcattctctaaatatttagcagttgtctcaaactaatgtatttaaagcagaggttctgtaacttcctgaatccttacatttgcttcttttacaatcttctcctactaattagtagcaggtgtattcttccagtagttttgattttttttaaaaaaatttaacgttatccttggctcttcagtctcttccatctcttctttgtctacaaatcatagtggctctgccatccaaaatacattcacaatttgaactaccagccactctcacttgccttcaccctagtccaagccactgacctat

SEQ ID NO: 42246 - DNA, 1023 bp, Homo sapiens
gagacggggtttcaccatgttggccaggctggccacaaactgctgacctcaggtgatccacccatctcggcctcccaaagtgttggtattacaggcatgagccaccgcacccggctaaggtatgcatctttgaatgaatttttgatgtcatagtagtccttaccttttaaaaaaaatcaaaaatttagtttattttcttattcaggtttatttcttattagcttagtactcttcattaaatgtcttttgaacacagtatttttaaggctttggattgtgttaaggcatggattgctttaacagtgtttgcttttgaagtcagtgatccatttgggcagactggaaacaggtgaagagtgttagaaagcctggtatcatgtgaatgatacatgtgaattctgtacaagattacagaaagaagagtttttagagcagttatggaaaattttggtagagaaaggatttgagctgtcttaaaggatagaacttgggctagagtagaacttgagggaactgcatgaatacatgccgaagcagcaagaaatcaaagatcaaaaccaacacacattaaattaacccctttaccttgaactaagataaatagcctctggaaaactgggctccgaagtccatgccaaagaatttgaactttatcctataagagatgagaagcattaaagggtttaagaaaagctagtagtttagttgagtaagaaattggtggggtaaatctgtattctcaaggaaatctttctagagacttgctggccatctctgtaatggagttagattcaaatagtgttatgtctaaaatgtagatcattagcatcatttggggaaggatggtgtacggtgtttaaccattctcctatcgtttggtatattgactgcttactcttttccactctacactaatgtagaaacgcagtgctgcctagaaggcccacatttttaagtttaattttaactgcaactttcccaacctaagctctttgaaatacagaattttaaaactctaattct

SEQ ID NO: 42247 - DNA, 1022 bp, Homo sapiens
gatgatctcaaggacccttccaagttagtgattaatgggcaggagtgtgagtaggatttgagaccttttagaggactgtttcagtagaccaactgattgtggcaaaggacttaaactacagtggtagaaatagaattggtagggaaagggcagataaccaagtatctgcaaggatgcctgaactgaatgttgggcaagaaggaaaaggagttagagcaacttaagagtttttattttaggtgattgggagaatgatgatcagattggcagaaataggaaatgtccaaaagattattttggaaaaagatgatttgttcaattttggtttttgaccatagcttttattatgtggtgctcttctaagacttctgtagagctagttttaaacttcagagaattcgaattaattgggtgtcatatgtttcatatttgggttaaaggataaatgcaagtaacgtctataagcaagaaaaagggcaaggagtgtggaggcaggagaatctttcatctcactctgtggtcatcctgcaacacagtgtgcttgcatgtagtagctcagtaaatatttaggtttaatcattggcaaaattggaattgcataagaaagaattttagaaaccattctaaaatttagaaattttttgctgtgaagtttcatacattcaaaagtgtataaaatgcatacactgtgatttcacctgtttttgaaatttatataaatagattcattctctggatattctgtaactcagtattattttaatatccttacccatttatttaggtgtatttcattgtgcaaatgtgcaagttacccatttcacagttaatggtcatttgggttctttttagttttttattattcatttgtaccaatctagtgggtgttaattatggttttaatttatttctctgataacattttgatatgcttattggctatttgtgtttcttctttgaaattcctgtttgtgtctttcaccagtttttctgtggagttaacttttgtttaacttagactt

SEQ ID NO: 42248 - DNA, 1023 bp, Homo sapiens
tttaactcccagacctattttagagtgcaaatacttttttagaatattaagataaacctaaatcaaattttttatatagaagcttatggtcgtgaaaagtttattggtcaattttattatacttcctttaaaaattcaaaagaaaatgtgttatttaatagttaaccagctttttcagataaacatctttctccttcagcagaacattgctaattactatttctgtaccctgtccctttctataaaaaatttcccaaaattataccgtgaaaaagtgttcaagtaaacactgctgttgtgccttttttttttaaactgggggcctgccagtttttacgtgctacaaagaaagaaaaagaggggtgattgggtgttgtgggttactgcactggaaacagtggctcatacaactgtcttggtgccctgaaacaaatagctgagaccagaccatagaaatacacaggagcaaagagcagcctcttaaaccttcaggctaggtaatgacttgagacgattatgccctacattgtattacttgttcgcaccttcacaatgggtaagtacatttgtgtctagtaaactaaactcagtccgtttttgtatataaaagtagacttaatcattgttaaactatctttcctttttcctttagtctttccatctacagcccactggcactccaggcacctacctacttcaaacaagctcaagccaaggccttcccctaactctgactgctagtcccacagtaaccctgacagctgctgctcctgcttctcctgaacagattattgttcatgctttatccgtatgttacataaattacttgatttttgagtacctgttatagaccaggattagttgataaggaccaaaatagaaggtagttatctaaacagttcttcctactgctgctgttccaggcacagtgttatacaccatcactctgccttcactggagtgtatgtttcatcccttctctttatgtaagatggctatacattagaatagggacattagaag

SEQ ID NO: 42249 - DNA, 1024 bp, Homo sapiens
attgctatgatagtagatctcaagtgttctcaccatacatacacacacaaaaatccaaaacagaacaaaacaaaaaacccaacaaaacctcaaaagggataaacttaaagttaactgcttctaaacacatgataatcaaacttctaaacatagaagattacagcaaaaaatcttgaaacctgccagagaaatataatttattacatatagggaacaacagttcaagtgaatgcagggttttcaacaggaaccatggaggacagatgacagtgaaatagcatctttagagttctaaaagaaaagcactgctaacccagaattctgtattcagtgaaaatgtacttcagagatgaggacaaaataaagaaattcccagataaaggaaaactaagaattattactagcaaatctggtctaaaagaaatgctaacaaaagttcttcaggctaaagggagatggtatcagaagaaaacttggaacttcatgaatgaagaaagagcaacagaaactgtgaatatctaaataaatacagcagagtttttctcctctattaaggtctttcaatatgactactcaagcaatcctcccatttcagcctctcaaagttctgggattacaggtgtgagccaccatgcctggccctgactctactcttgaaagcaaaatttatggcattgctggggaaggtttccaggtttgcatgtatagtacaagtgacttttaaagcaaaggctacagagtaaagggaactatgtggttatatatatttagttgaaatgctaaaatgttaactgtagactattaaatattaggtgttctatttcataaagtagtgactataaagatactaagagtttttagccaaaaaagccaataaataaattaaaatggaacattaaaacattaaagttatccaaaaagaaggtggtgaaaaaagggataaacagaaaacaaacaataaaatggtagacctaaatcaaaccttattaatagatatgttaaatataaatggcctaagcactcc

SEQ ID NO: 42250 - DNA, 1052 bp, Homo sapiens
aacttcattgtttacttaaaagttattcaggtgtaagttgtttggtgccaatgtgattgtgtgattttgagagattttcttgctattcacttcaatttttcttccactgtggtccacatatatgcttggtatgatttcaggtttttagaaatttgtttggacttgctttatggccaagcatgtggtcaaacttagaatatgttcagtgtgccaatgaaaataaagtatattgtgtggttgatgggtattctttagatgtctattaggtccaattggacaagtcaaatttacatccagaatttgttaagttttctgcattaatgatccatctaatgccgttaatggggtattgaagtccactactattattgtgtggttaagtcttttgtaggtctagaagtacttgctttatgaatctgggtgctccaatgtcagtgtgtgtgtgtgtatgtgtgtgtgcatgtgtttgtgtatgtgtgtgtgtgtgtgtatatgacagttaagtctttttgttgtattgaactctttatcattatgtaatgaccgtaatgaccttctttgtccttttttagtgttgtttctttaaagtatgctttatccgatataagaataggaccccctgctcttttttgtttttagtttgcatggtaaatctttcttcatgtctttactttgagcctgtgggtttcattatgtgtgagatggttctcttgaagatagcaagtggttgggtcttgttctattagccaccttgcctctctgtgttttttaagtggggcatttagaccgtttacattcatggttaatatcgctatgtgatgttttgatcctatcctggtgctgttagctggttgctttgtagtcttgattttttagtctcgatagggtctgcaggctatgtatttaagtgtgtttttgtggtagtacatattgttatttcatttctgtgtctacaactccctcaaggatctcttgcaaggctggtctattggtaatgaattttcacagtgattgcttgtctggaaaatattatacatttccttttcttatga

SEQ ID NO: 42251 - DNA, 1083 bp, Homo sapiens
cattgactgcttactgtaatgttggaatgtcctccagataacagcaatttcttgattatgaatcttggggagctacataagtttgtctggactagtgtaacagttaagaatgttactacagaacagccatgcaaaccacagttaaaattgttcctgagtgatacagatgttgtttcaacagaatgaatgttattaaaggaaaagaaatttgcattaagaatctggaataccttctttcctaccttatacactgattagatgattgggaaattagaaaactcaggcaaaattctaggaccttaataggattaaggttgatattggctgaattttggcaaatgaggtaattaagatttttttctgtttaaaaggttcatgctggactttgactttctgaaggtctgcgtctttgaatgtctaaactgatcctttcattcccagactagtaacttttcaatttatttttatttttattttgagacggagtctcattctatatggcctaggttggagtgcagtggtgcgatctcagctcactgcaacctcctcctctcaggttcaagtgattcttgtgcctcagcctctgtctcctgagtagctacgattacaggcatgtgccaccactcctgggtaatttttgtatttttagtagagtcagggtttcaccgtgttgcccaggctggtctcaaacttctaacctcaggtgatttgcccacctcagccttctaaagcgctgggattgcaagcatgagccctccaggcccagccgattcccagactagaaacttatcagaagaacatgtgctaacaggtttcctggaactgttaatatattttatttacttatctctgaaaagttattctacttttttactattcattttgttaaactaaaacactgtcacatgcttgtaatagttgtatttatggtaatgatcatatgacagcattcttaaaggtcatgttttctaggcctgccaccctattgactatacacctattaagagtatcttaatgtgttaaggaccttagacattgagtaaaaaataccccttcatcttagaaacaaagtacttgaggtcc

SEQ ID NO: 42252 - DNA, 1045 bp, Homo sapiens
ttgggtctatccttagcatgtgcaacttggaggtaagccctgcacttgcatggatttatatagggaattagggatccctttctctaacttgctcttttcatggatcaatctccagcttgcagtggcctctttcccaggtcttctagtcagaaagtgagggtttctcaatgttagcttaagcttgtactacctttacaatctcagcctcctaattgggacccaccctcagggcagaactgtgggagaaaagaaaataatacagggattctcttggtatttttggccacttgaacctcattcctggttcttcctgccagaaagataggagttttagctgctggctctgccactgctgctaactccatgactgaaggttccagttttgacttccttccacaatctgcctgcttattttacttttcattcttcaggtagttgcttattcagtgttgtccagagtttctagttgtaatcagtggagttgattatccatctttaacatattgaatctttgcctaaattgactgactaataaatgttgactaatttctttattcaatttaatacaaagattttgctgaataagggcataaaaataatatgacttttaaaaaaacatttcattaactaccttttcattattggttttctttttatgaagtcaaaatcaattatagctagaatgcaaggtacttgctgagtgtattgtaaaacatttaaaaacaatagttttttttaacaaagaataatccttctttgatatagcacttttctgcatgatttttttatcttgaagatactgagcaattgcagttgctgttttaactgtactttcaaagccaatcttttcactatatatttttttttagggcaaaagagttggtagtggtgcacaaaaaacaagaagtaagtattttgtgatctttaagtgtatttggtttgcatttgaaaaatcataaaagatcttctaaaatcatataaaccaccctctaaatgatttattcaaggctttcttcgtctttatagaacatagatccttggtgaa

SEQ ID NO: 42253 - DNA, 1078 bp, Homo sapiens
aattcaactccagttgaaagagaagaagaaaaaaggatattgtgaatgttgcttgcagaaatatgaagatctagaaactgtaaatgtgattttatattttgggggcttgtttcgaaaactgtaatacttgtgttttaaattttagcttgttattctgatgcagatattttacattttaagaactcaagggaggaaatgagtattgaaaatgaatttttattcagcaaatactgagcgtctactacatactgatcactactctgggcaaacagcattgaacaaaacagacttaattttttaccgttgtgaagattatattctgtagggtaggggtgggataggggtggagataggtaaccacaggataaaagaagaataaaaatatagagagagaatattagatcagtgctatgaaaaaatagaacataggaatggggatgttgctatttagcctagacaaggaacacataactgataaggtgacatttgagtagagacctgagagaaatgaagtaatgagacctggatattgagataagtaagtgcaaaggtcccaatttaaaatgattgatgggaccaaggaatagatattgatagtccagactaagtggtagtagaagtgctgaaacatggtcagattgtggatttgttttaaaggtgggaccaagaggatttgccaatggattggatgttgcaagtgagggaaaatggtagtcaagggttactatagtattttgaaccttagcaattaaaaagtgggcttattatttataatgggaagagaagagttgaaagaagtaaagaccattgaggtagcagaaagaaatgggagagttgcaaagggtatataggatgaaaatgggggaactattatagtttgtaaactgatgagcaagagctatggattcaggctgccaggtttgaatcctggctccctggctgtgtgagcttggacagtgtttggcacatagtaagtgcttattgttagctgttatttgaataattttttacgtaatagataggtttgttttggtgtttggttcggttttggtagaagatggtgggaaagttaagggga

SEQ ID NO: 42254 - DNA, 1033 bp, Homo sapiens
taagaatgtaaaatgaaaggcaagagttaccccaatattttttgtaagaatatctataacttaagtttcctatgaatgacagtaaattatgacaataatactttgggtattgaagtatcttccttgagaacagcaggaaagagaaggttgcactttttgattaatgattcagaggactggctgcatgatatgtgatgttaaatagtacctggtgttcattagatgctttgatgtggtggtggatttctgtgaggtttctggtactgggattatcctgtgaatacaatataattttagaaatagttgtctatctagaattttaggtttggaaggtgcttttgatttgttgctggatttaatctcttgcatttggtctaagtgtagtgtttaataaatctggttagttactgttcacttttttaaaaaagggtttctatcctacttctgatcatgggcaagtgggcagagaccagggttctgccaggcctatgcttctgagctgggcagaattgggctatagttttctggaagcatttctacaacaggaagaaagtctgaggccagaaattcagacaaatagactaagagtgagaattagagcctgagttgtctgcaatggggaaccagctagatggaagttaatttaaaaaggcatgtaagaggcaagacttaggaccatgttatctggataggtagccattagccacttgtggctgtttaaatttacattaattcattcaaataaaattaaaaattctgttcttcagttgcattagccacattttaaatgctcaataaccctctctgccttcactccctcatctacttaatacctagtctccttctctgtttcattttaaaaataatacttatcaccatttaatatataggtgaattcttatgacattgccatttttataggtcaaaaaagtttgactaccattattgatgtatggccatctaatatttgatattttgattatttatttggtctatagtctttttcctacccctgcaatgtaagctctttgag

SEQ ID NO: 42255 - DNA, 1037 bp, Homo sapiens
gaactttcttatttttgctaatggctttttattgtttctcttaggtttgaatgtaacattctagtttgacaataacatgaatggcaaataattagagtttttcttttcaaaatgttacttattaccatttcctaccttaatcctttttctagaagtttctgaactgtataatttggtgataatagcatttttatctttttttttgtaataaaaataactaatgttcattgttaagtaagtagagtgttgattattgatttgtgagagctagtctttattgtgttaaagcaatatcttttgtcttatattttaagtaataggtattagattttattgaatgtttttctagtcagttaaagcttccaggactagtcagctttcccattggtgacaccaaccctccacaacaaggcctgtagataggtttggattttcttatttgacctgttattatgatttattatattaatgggatataaaattattctcgatgctgataataaacttgactttgtcatgttggataattcattgttttgtcccatatgttgctggcttctctggttgtgactataaagtagaattacaattcctattttttatcttaattattatgacacaagcccctgccgacattcttggtgtaaattaactctatccccaagtgtttcctttaactatttctgagattagtctctagcttttaatcttataattacattcctgccactggtagatccccctgcagtgacctgcagacagctgctctgccgggcagtttcccttcactagtgatgcccgctaacatctgccagagtggtttcttgaagaacccacaagcccaaacctatctataggccttgttgtggagggttggtgtcaccaatgggaaagctgactagtcctggaagctttttaagagagaaatctttgataaataatttttttgatgtctattgatgtattcaggttttctacttgtttttgaggccaactttgagaaattatagttttgcaaggaattgtccacaccatgg

SEQ ID NO: 42256 - DNA, 1050 bp, Homo sapiens
ctgcctctgcctcccaaagtgctgggattacaggcgtgagccaccacgcctggccccaggtgtcaaatcattgaactttcttaaattatctagcagtgatagtggtacagcccaaccacagggaactttgccaggtttgacacattgggttcccagacatatttaatgtaatttgtttatgatatggctgttaaactattggatgaacaaaatctttgcaagataaaagattccatttgaataattggaaacttgttctctaatagttatatttgttttacagtaaggactatgttttagagtgaggtataaggtgcgtgcttactcctggtgataccatctgcacagagctggcttaattactttgtctctgaaatatttatctcagtatgtctgtatatcaatctgttacttcacactctgaatatatgtatattttcctgtgtttcacctgttggcatatcttcttagctaatgagtgtgtggcagattgtactgtatacccttgtcctgtgagtgttaactataaccattctcagacagggactgtagctaccttattctcagttgactcctttattattttgtctataataaaattaaacagttttgacctataatggtgcagaagtgataataccagatatactgcaaagaaacaaagaaagattaacagtgactatttaaatgaaaattttagagaagctgaagtctcttcttggaaactggtagagtatagaaatttagcttgaactttctttgaggaaatggtccggaaagcactggataagaatctacaagcagcaaggcatagcatcatggtttgatgttatgaaggatgtcatacacattattgcagaatggcatcttggtcactgttatatgaatggtacctgggaggaactatagctaggtactaatataacactatgggattttgccagagaaaggcactgtgatgcacctctgtgaggactgtgctgtaacaaccacatgtgggtttcattcatttagcacacccctttgccagagcacatacttggccctcag

SEQ ID NO: 42257 - DNA, 1078 bp, Homo sapiens
gatttttccaagactatggatctgcaaaggatggtagtcataatcatcaagtttatgagaaggagttttacattagaaaacaatttcatgggccgggcatggtggctcacacctgtaatcccagcactttggaggccaagggaggcggatcacgaggtcaggagatcgagaccatcctggctaacacggtgaaaccccatctctactaaaaatacaaaaaattagccagacatggtggcacacgcctgtagtcccagctacttgggaggctgaggcaggagaatcacttgaaccgggaggcggcggttgcagtgagccgagattgcaccactgcactccagcctgggcaacagggcaacagagcgagattctgtctcaaaaaaaaaaaaaaaatatatatatatatatatatacatttcatgtacggtggctataatctgaacctgattttgtttctatatctttccaaatattaaggattccaaggacagggacagataatataattatggttgaaatgtttttcattcatgtttgcatgtgtgtgtgtgtgtgtctgtgtgtctgtgtgtctgtgtttagtatgaccagtggtgattactgtttggcatttattacgtatctaaaaagagaaagaatgagccacttttctttttctcactatcttgtttctatctgtgttattctactgaatatactctcgccactttaccagtaacatactagtcttcaaacttaatgaccgtttttgtccttggattctctgtaggtacttgaaaaggctgattctctcatcctcaaaactcttaatagtaattcttccttccttttctccagcttctttttagcacatcttccctctctaaatgtagacatatccaagcctgagtcagtgtccttttcactctcccactcatcacagttcaaccctatttctgtagatatttgctaagcctgacctctttcatgactgttctccccacaccaccagttcctattgcatctttctcaaagggtcaggatttcagttatcacttcaagatcaacacttccattttttttttaattttattttttg

SEQ ID NO: 42258 - DNA, 1035 bp, Homo sapiens
cctggcgtggtggcgggcacctgtagtcccagctaccagggaggcagaggcaggagaacccgggaggcgtaacttgcagtcagcggagatcacgccactgcactccatcctgggtgacagagcgaaactgcgtctgaaaaaaaaaaaagttcccagatgctgctatttgattagattatcatattttgcatacttttagaatctttagcaaacataacctaaaatcaaagtacacagtacacatatcacaaaatttgtgataatttttggctgtttttccaaacagattgaagctgcacgtgatagtttccttgtttatctctattgttccttccacacacccatgtgacatttattttctttgtggttgactgagaaaaaaagttaactttcccatgtccttccccggtcagctatcctgtttgccttaaattctattgctcttcacttgtgttggtactttcaggcctttttcactaaacactgtctctcttcaaataccttctcggctgccatcattcatgttgaatctttcttcagttaaaaaagttcagcatggacttttatgttttacttcattgttaaatgtatattatgggttaaatgtatttatttttttgaaaatattatatgggtataggtacagaattttaaaaagtttcctttacatctctgtcctccagttatccagttccccctttgagcaatatctattattgcatttattgtcagtctccttcttgagggagcccatgtattcatgtatgcatgtatatgtgaatatacacagacacacagacacacatacttacagacacacacataattgtattttttgtatgcagatgttggcatattaggtacatcctactgatatctcttagcaaaagccaagagttggagaccagcttgggcaacatagcaagacaccctctccgctaaaaaaaaaaaaatttagctgggcatcatagtatgcatgcctgtagtcccagctacttgggaggccgaggtgggagggtcacttgagcctgggag

SEQ ID NO: 42259 - DNA, 1006 bp, Homo sapiens
cctatatggtaaaatatacaactgacacagaaattcacataaaacatgtatgggttgatgaaatactaaaggcaaacaattttatattgaccattcagttcaagaaataaagctcggccagctgtttatttgctgcatcccaagcccttttcatcctcctcttgtaagatttgtaaacactatcctgacttttatcataaccccttccttgcttttgtttatagttttatcaccaaagcatgtacccctacagtttaattttggctgtgtaggttttaaaaataatttttgcctgggcacagtggctcacgcctgtaattccagcactttgggaggccgaagcagggggatcacgacgtcaggagatcgagaccatcatggctaacacggtgaaaccccgtctctactaaaaatacaaaaaattagctgggcgtggtggcatgcacctgtaatcccagctactcaggaggctgaggcaggagaatcgcttgaactcaggagttggaggttgcagtgagctgagattgcgccactgcactccagcctgggcgacagagcaagactctgtctcaaaaataaaataaaataataatgttttaaaaattatctttctcttttgtcccccccttgcaatttatttgttgaagaaaccagattgtttatcctatgtaatttcctacaatctggattttgatgttgattgcaattttgtatttagtgtaaaaacagacacattttggtgattgttccttaacataatgatttgtgttatctgcagggacatcatcagcctcattgaaatcagtttatcttgttcatgtagctgtgcataattctgatataaaagttatattaaaacttaaaaagaatttttttcaaaggttacaaaaataaagtctttatgcaagaaaagaaagatactttttattcctttaatgggacatattaatctttcacttacgtttattttcaatccatttaaaaattaaattcttaatttactcat

SEQ ID NO: 42260 - DNA, 1030 bp, Homo sapiens
taaggtgtggccactataaaatcagaaaaggtaataaagaccagagaatatatactattggtattgagtggtttgagtgtttacagcctttttgaaggaggataattgatcagtgctacatttgatgttttttgttttgttttgtttctttttttctttctttttgttgttgttgtttgtttgttttgagacagggtctcactctatctcccaggctggagtgcagtggcgcagtcttggctcgctgcagactcagagtcccaggctcaagtgattttgccacctgagtcctaaaagtagctgggactacaggtgcatgtcatcatgcccggctaatttttgtatttttagtggagatggggtttcaccacgttacccaggctggtctcaaattcaagtgatctacctgcctcagtctcccaaagtgttgagattacaggcatgagccactgcatctggccacatttgatattttatcataacactattttctttgcacctatgaggtagaaaaagagcagatggacttgattttccccatagccactcataaaaactcaggcatgtggagtttaagtggctggaaagctgacatgagagatttacagtggaatagaaaaaaagccataattctcagatactcaatgtgtgttctcaaccctcatttattcaatagacatgagttgagtgcttgccaggggccagtgacagggatatagctataaacaacagatgatgcatttcttgccctcatgaagcttgtcctttagtaggagagacaggcatgatgcaggcaactactgagaactctttgtaaatgatagaaatgataagtgttgaaaagaattacatgttgctctgagggcacttgctgggagacctgacctcatctggttggtcagggaagactttcttgaggaaatgatattatttccaaagttcaaaaaataacaggtgaatgaaatgggagcagaacaacttttcaggtagtcaaatcagcatgtgcaaaggccagaggccttgatgcagg

SEQ ID NO: 42261 - DNA, 1040 bp, Homo sapiens
ttccattactgtaggctttggcttctctgtgaaggcatttttcttctcattggatgttgctctggtgctgagagaatacaggagagaataggaggggttgggcaatggttcatcacctctctaaacccaggagaatgcataggcaagctgtggttcttttaagggtctccagctatgtttgcctaaggctggagataatcctgttgtacatgcttaatcactgttgcttgtgtcatttcaggaggatttccattttcattcagtttacaaatccagactgtttgaattttccttggatgatcttccatctggtatgatgttcatatagtgactttttatctaaaagacaacttcagtaatttatttaatgccttagaactaatctatatttggaatatcattagcccacatctgcttttgacatttttagagggagagccaagtcacgtcaagagggagaataaaatgcaaactgtcctcacagatgagtttggaaagatgtggaggaaaactttaaaaaattttaaaattaaaaataaggcactaaaggagaaacaagattagagcaagaattggtctgtgagacaaagtacatacaaattcactctttgtgaaatactggtcttgtaaacatagggatgaactcttaatcatttccctatttattgttttccttgtctcttttttgctctagcattttaagaaagaactattatgggttaacttttattatcattatgtgttatttgtgaaattagtcatttcttctcatctatacctaaatggatctaggttaattttaagagtgtttgtctcccaagattacttatgatttactataataagttagaagaaaacaagaaatagacaaatgtcaaaaatacaaatttagtgaaatattttcaaaagtaagctaatttattttaggttgaataaatggacctagcaacctatgttgctttgagagtcgcttccaagtcttcacatgacaggaagggcagtgcatgcatactttgccctccttagtggagcagtgatta

SEQ ID NO: 42262 - DNA, 1035 bp, Homo sapiens
tgaatatatattttcaatgcttaccgaggttttaaaaaacatttctaaataatatatgcaggtttgctatattgaatagtgatatacaatagtttagtcattctcaaatgtaattggtacatatgcaatctttttgggtcagccaacttatcaaattacatactagtaataatgccttacttaccttttgcttggtagcccaggtgaaatgataaacctgtttcaattcaggccccagttatagtaattacattcaaatcctaaactttatcaatttctccaaaaggaattagatcaaaagattcaatagctttctctgagattgaactggcttatgctactggtctttaataagtaataaatagaatagaggaagcaatattgcctgcttttaagtttttgagcatattttcaaaatgaaggtgaattaatagattcattttttgctctcaatttgtttttagtggtgggcatgttaagcttgaagaagatgtagatcttggctatgtggaagatgggacaccttgtggtccccaaatgatgtgcttagaacacaggtgtcttcctgtggcttctttcaactttagtacttgcttgagcagtaaagaaggcactatttgctcaggaaatggagtaagtatccagtaccttgtcagaatctatttcttttatatcacagaaatagacaggaccctaaactatttatttttcttaattatggaaaaaaatgatttttcatatttctagttggtatataaatactaattcaattatagttatttgaatatttctgttgtataatctgagaaagcctggggataaggaaatgaataatctttctaaccaaattctcccatccttcttttctgtgttactatgatctcatataatataatgccaactttttacaagtgaactaggagataaattttaacaaactataatgggattttaagaaagagaataaaaattggatgtgatggccacagtatttaaaaacgatgtggtctgggcactgacaaatctcaacagact

SEQ ID NO: 42263 - DNA, 1022 bp, Homo sapiens
ttaggagtgtgggcttgcaatcatatagcctgggtttgaatcccaactctgctttttattagctgggtaacattgggcaaatttcttcgcctttgtgactcaatttcttcctctgtaaaatggagataataatagtgcccactttaaagaattgtgcgaagaaggagttaacttgtaaaacacttaaaacaagactgggatatggcaagtgttcaataaatgtaagctatgctatttattatgattactgtatactgggcatcattgtctgttcttgtcactatatcgctgatacctgacatatgatatagcaactgatgcttgaagaagccaggcgacctgattaaggtcccttagtaagacaggagtgatatggtgaatcaaatccaggccttttgattttaagcctaaacctttttcgttctgcctatttgttaatctgtagctctgattgaggctgtgttatagttacatttagatgtggatgtatgttatgttcctgaaaattagatcagacaagacagaaacccctgtagtaaaaacctgtctcaggaggaactttgctcatcttcaacctaacttaactctctcctgcttctctactcaaggttgttttgaattagatttaggtgtatattctgtttcctgagtggactaatgaagagagattattttcctataatataaaaaaaaatggtgtcaattttatatgaatcttttttctatactcaattcgtgggagttcttagttcccctgaccctgacatagctagtatctacagcatgggttgaagtgctaaggttgtatagccttgtggaactttcttctcagcccactgcaaaacatcaggtctcccctcttcatcagacttttatttcattttgcttcctaaaaaatgaataacatttttgcatgaagacccttactatggaaggaaggaaacctttgtattagataattgacagatgattatatttctgcttagctttttaaatcttccttataaaatttaagttagtga

SEQ ID NO: 42264 - DNA, 1046 bp, Homo sapiens
tctaaacctggaggatggataggtgtcctcttcagtccacactatcacttctagaccatttgctttcaccattcctaacactcctaggctttagcttaggcataatatctgcctcccctcctctttcaatcatctacatccccactgccaggtactactcagctgttttctctccttcataaaaagttttctcaaatttattcatactcactctcaccattttctctcctctcattctgtcttgaacccacagcaatcaagctttcatccccactattctgctgaaagaggtgttattagaatcacgtgtgtgttccatgttgccaaattcagtggtcaactttcagcctttatcttactgggcatattggaagccctcattccttcctgcttgactgtcttcatatgacctgtaggtcaccactctttccaggttcccttacttcctcgctggtcacttcttctcatctcctttgctagatcttcctcatctttctactctttaaggttaggctgctctgtgtttcagtcattagatctgatttattctctatctatactcatgcctcagatgatttgttcaatcccatggcttcaaatacagatctgtgtattgaggactcccaaatttacatctccagcctgtttctcatgcatatatatctgcctatgtacttgacatttccacccatatgtctaatagacttcttccatttgacctgtccaatatgaaattttctcacctcaaaactgtttcctcaaaacctgggatcatgttttacaatttatactgctaaaacaccagtccaaagtactgcattttcattcctggatcattgtcttctaatttccccattcttactcctcttgcccctacacagtctattctatattcagcaaagtgagcaatccttttgaaacatgtcacttccagcctagccaacatggtgaaaccttgtctttactaaaaatacaaaaattagccaagcgtagtggcacatgcctgtaatcccagctactcaggaggctgaggcaggagaattgct

SEQ ID NO: 42265 - DNA, 1075 bp, Homo sapiens
accttacacagataaaattcccactttcttcagcactaatcttgcacaaccaggaatatcagaatgagtccagaggtgaaattccacgtggaaaagagaagagggttatgggtagtattactgactgctacatgcactatcataattcttagtcccaaaataactatggcattaaaatataaaatacaatgaaaggcatgcccttcagtgtttcccaagctgtgttctactgatatctactctctcaagatgctttattggttacaaatggaggcttatgattttggtaaattttacattatacatatatatgtaggtatcatgtgtatatttatttcaaagggttttagagacagtaagatattaaaaggctgaacacatgtgcagtaaagaaatatttttaattagtttattccagagagtaatcccacttgaaaatggaactttattttgttttacttttttaacttaacatctactaatagtccacagagtttcattccatggaagagactcaaaaacaaaaatgtattaaaacaatattctgaacatgggacttgttggatatggtgcatatgtaatttggaggtaaattctatagttctcacattactctctagtgagtagttgtggtacaatgcaaaacatatatttggtctttgtccctggttcctggtgcacagctggagtatcttttgtgggttgatgagatgattggtggctggggtctttagctggtttctttctggtgaccaggataggagctggtcaccagaaagaccatgtaattagaaggttggaacttccagcatgacctcctgacctctggtataacgagagcaaccacagattgagttcaatcaccaatggtgaatgatttaatcaatcatgcctatgtaatgaaacctccatgaaaactactaaacagtggagtccagagagcttctagattggtgaacacatggaggttctgggagggtggtggcattctaggagagggcatggaagctctgcaccatcctgccttccactcccaaatatcgtcctttgcaccttattcatttggttgttcctg

SEQ ID NO: 42266 - DNA, 1023 bp, Homo sapiens
taaccactgcttgttctgaagttagtaaaagtggttgagtagagtgcaaactgaagcaggaactagttaaagatttcaagctggaaataataaatcagttaataaaattataatttatttggttgattcttttggtattgacttctctcactctaaataacatacttttattgatattttattgttttaaaaaagttcaggcattatctattgactttctaataaagacttagctttgttttaccaaatccttctctgctgactactgagaaacacactttccgtagctccagtttcccaaatacatttctattgtcactttgactatattagtattcatattaactttcttaagcaatgcaaattatttataacggagccatgtagtaaactataattattctttcttgcttgctcgattggagttaataattatattgtttctgtttagttttaaaatatatgtatcactaatataacctcacttattctgtgatattaatgactgtgccgtattccttgatttttgaaaaatatatttatcagtaattttatctctcattttctgttagatatgtaaacttcttttcaagatgatgtatattcccttcaagcattttaccagcatcacctgcttaagaagtgtctttatcaaagccttctgacttgcttctgcctagattggctgcccctctataagagggcacagttgaattttagagatctatcaggcctgaaaaagacattagtttaccctcatatttgattaataatttggctggatgtagaattctaggctggacaacattttctttcatgctgttaaaagccttggttttttatatgtaagtatctagagttgttgagaagtcttatgacataatttttgagactttttaagcacttttttccccttctacaagcttgtagtattttccctttgttcctagtgctataaatatgctttggtctctttttgatccattttttctgctataatttttaaatggacaagtcttcata

SEQ ID NO: 42267 - DNA, 1029 bp, Homo sapiens
aatctacattttaacgagattccgaagtgatctgtgtgcacattaaaatttgagaagccccactttagcacctcacctttgtgacagttaattttcctattgagatgcttttttaaaagccaaaagatttatgaagagaaaccagaatagtgatccttttttagcttacaaattgtgtcttactgtgctgtatgttaaagtgtggtgaaatattttacctctagaaagacaggacattacaatgtctagaagtgttttaatgttcagtaataggtaactgatgaccattttattttctctcccctaggatattcttggtgatcttggaagtgtccgtatcatggaatcaatctctatgatgggaagccctaagagccttagtgaaacttttttacctaatggcataaatggtatcaaagatgcaaggaaggtcactgtaggtgtgattggaagtggagattttgccaaatccttgaccattcgacttattagatgcggctatcatgtggtcataggaagtagaaatcctaagtttgcttctgaattttttcctcatgtggtagatgtcactcatcatgaagatgctctcacaaaaacaaatataatatttgttgctatacacagagaacattatacctccctgtgggacctgagacatctgcttgtgggtaaaatcctgattgatgtgagcaataacatgaggataaaccagtacccagaatccaatgctgaatatttggcttcattattcccagattctttgattgtcaaaggatttaatgttgtctcagcttgggcacttcagttaggacctaaggatgccagccggcaggtatgtattttacatttttattcttatgtatctggtattttgtagttaaacaactaagcaaatatcaaacattttaataccaaactctgacactttccaatgattatcatttgaaaattaattatgagcacctgaagattaatgtcctgaccttgtaagggcacattcccattcccaacatgatgtggaaaactggg

SEQ ID NO: 42268 - DNA, 1058 bp, Homo sapiens
ctacgactctttactctctggagagggccagtggtggtagctataagcttggccacattttttttcctttattcctttgtcagagatgtgattcatccatatgctagaaaccaacagagtgacttttacaaaattcctatagagattgtgaataaaaccttacctatagttgccattactttgctctccctagtatacctcgcaggtcttctggcagctgcttatcaactttattacggcaccaagtataggagatttccaccttggttggaaacctggttacagtgtagaaaacagcttggattactaagttttttcttcgctatggtccatgttgcctacagcctctgcttaccgatgagaaggtcagagagatatttgtttctcaacatggcttatcagcaggtactgaatgtgcttgttatttatctgatgctagtaaaatactttttattagtataaattgtaaaacataaaattttacatgccctgtaatggaaatttgattttggtatactgcgggaggggaaagaattgttctttaaacaatgtttttgcaaaataattaggtggctaattcaaaattatttaagtaaaggctgctaccatccttttccatacagaataaaagcagaaaaatagagggttgggttctccccctttttcaatgttataattgcaatgagtgctttcagtattcaacaattcattattttaatgttttataattggctgtgctccacaaaatgatgaggcaattctcagtaaatatatacaataaaattagaaccagtaaaaatacaaaacagaacaggaagacaagatcaggagaaaaaagtcgaatacacctctgctaagagtgtctccacagcttctcttttggctttgagattttcaatacaatgagaagggagaccctattatttacaaagctcttgttatcaaaaaccagaaaagataatagttccacaggtgaagcttttctagcacttagctctaaaaaaaaaaatctcagggagcacttcatggaaggggtttgattatgaggtagactatgg

SEQ ID NO: 42269 - DNA, 1029 bp, Homo sapiens
atttatattgtgaaatgagacaccctaccttcaattgttcatcagtgggtaaaacaaattctgatgtacattcaggacaaatgattagccctaaatgaaactgtaataatttcagtggaaactcaatctgtttttacctttaaacagtgaattttacatgaatgaatgggttcttcactttttttttagtatgagaaaattatacagtgcttaattttcagagattctttccatatgttactaaaaaatgttttgttcagcctaacatactgagttttttttaactttctaaattattgaatttccatcatgcattcatccaaaattaaggcagactgtttggattcttccagtggccagatgagctaaattaaatcacaaaagcagatgcttttgtatgatctccaaattgccaactttaaggaaatattctcttgaaattgtctttaaagatcttttgcagctttgcagatacccagactgagctggaactggaatttgtcttcctattgactctacttctttaaaagcggctgcccattacattcctcagctgtccttgcagttaggtgtacatgtgactgagtgttggccagtgagatgaagtctcctcaaaggaaggcagcatgtgtcctttttcatcccttcatcttgctgctgggattgtggatataacaggagccctggcagctgtctccagaggatcaaagccacacccaaagagtaaggcagattagagaccagaaagaccttgactacttccctacttccactgctttttcctgcatttaagccattgtaaatctgggtgtgttacatgaagtgaaaattaattctttctgcccttcagttctttatcctgataccatttaacactgtctgaattaactagactgcaataattctttcttttgaaagcttttaaaggataatgtgcaattcacattaaaattgattttccattgtcaattagttatactcattttcctgccttgatctttcattagatattttgtatctgcttggaat

SEQ ID NO: 42270 - DNA, 1045 bp, Homo sapiens
gggattacaggcgtgagccagcaggatttttaaatagataaaataaaagatgcttttatctgaatatctagaaagtccatattttgctttcatattagtttcagataaaatcctaaccaatttaagccttaaacacaggaaaatgcatctcagtttaatattaataaaatagtggagtaaagtaatgtttaggttgcttattctgagacagcatatgtttgtgtgggcaggggtagggggtgaagatgaagggtataattgagcctaatcagtaagttaatgttttcaatgtgctattactcattgccagtgggaagttattgatcaactgaatctgtgttgtagcagttggtaatccaattctaaagttgtgagaggaaaaaaattttgagtaggcatttactgaggcaaaaatgaaatggtttttttaaaaatatggttctaaatttccttttttagacttcaaaataagaataattaaaacagtatctaccacatttggcaaaatagttggaattctatagactttcttcacagaaatactataaagaatatgttaataaagatattaatctgaattttatttcttaactaaaaatattaaagccattaagggatttagcacagatatttaaaattctgaatctgtgttcaggaaaaataaaaaaccagcctcgttttatagaatctgcatatgatatcataaaactgtgtgggtaagttatctttctttaactttattttgtagtaacatggagtattttattatgtttcttatatcacaaacatactatgcattatagtgtagcagattgctacagaactcagaaaacttcagttcatcacttgattccagcagttggcatttcaggtaatcagtttgctgtggtctgagattgctagccacaagagattaaattctaagtatattgaaatgctttcttgtaattagttactctgaagtaaatgctaaatattagatgtaaccaaggaattatagtattttcagaaaatctttgagtgaacttatggatatgcttataat

SEQ ID NO: 42271 - DNA, 2016 bp, Homo sapiens
agtgatttattagtgccaaaagaaaaaatgctctgactggcgaaaaggcagctgaaggcagcctcacaggagcaaaagtcaggaaggagtaaatgcctaaataaaaataagaatgctgttcttataaaaagggcaagtaggtcccaggaggcaaagcaacaaatatctactattaatacaagggaacctaactcagagttggagaattaataactgcttcctaatgaactcaagtctagtaactgaatgacaaacaggacttggtaacagaaaagttttgcatgcggagagcatcctagacagggaaaacaagtgaaaatataattagcaaaatcagaaaactaaaattcagtatgatgagagcagaaggaacaggctacaatggtgagagatgaggctaacaatgttatcagggaccataacatgaaaggtctaataagccttgttaaggaggtaggacttaatcctaagaacaaagaatagtctttaaatggttttacaaaggaaaatgacatgattgaatgtgttatagagctgtcactttgaccaccatgtgtaatagactggtttagtggattcttatctggtacatagaggattagaggcagatttggaagtgtaaaaaatattagaaatatgttcaaatgaatagtataatataaaaagggagattttgttgatagacattcaggaagtattttcataaaagtgtgtgttttagtttgagctgctataataaagtaccgtaaactgggtggtttataaacaacagaaagttatttttcagtttgggaggctagaattctgatatcagggtgccagtgtggttgggttctgatgagggtgctcttctgggttgcatactgctgatctcttgtattcttacatggaggaaagagagcaagacagctctctggagtcccttttataagggcactaattccattcatgagggctcattacctccctaaggcctcactcctaaaaccatcacattgggggttaggatttaaatatatgaattttggagggacgcaaacatttagtgtataacaatatagtttttaaaatatgattttactttctagggctttgaaggaagtatttaaaaatctgtttatgagaggtttcagtcattatgaccgtcagcttagaaatgacatattagtgatcactacaattatagctcaaaatcctgaagcaccaatgattgtaagtatgaatcaaattgcattaattttaattgtggaagtggtgggcttgggtgaaagaagtcctatattatgttggaatatttgtgtattttcttgtaatgctaagttatgctgtaatatcttgatggtcaccagtgtgcttatcactctgccaattcttctttgcaatcctttggaaatttggaatcttcctcatattgtgtgatttatacatgtatttaccacttatgatgcttttctttccttcctgatgatttgagtttccatctggcatcatttctctttcactggaagaactttgtttacaatttcttgtggtgcaaatctactggctgctggcaacaagttatcttagttttcttttatctgaaaatatatttaattcatcttaattcttaaagtctatgctcattgaatatagaactctaggctgaaaaatgtttttgtttagcatttcaaagataaagttctgctgtcttatggagtctgttgtttctgatgagaaatattcattgtgaggttccatggtgtaatggtgagcaccctggactctgatgagaagtatccattatttcaaatcgttattcccctatgtataatatatcatccttttctctcactgttttcaagattttaactctatctttggttcctagcagtttcgaaatgatgtgctaaggtgagatctcctttgtatttgttctgcttaggtttcatagagcttcttggatatataaatttaagtctttgagaagatttggagaactcttggccattatttcttcaaatattttttcagccc

SEQ ID NO: 42272 - DNA, 1058 bp, Homo sapiens
cctatacgtcatcaattagacacttaatgagtatctcataaaataagtacacataaactcagtgtaaaattcagaacccctaaacaaaagctgctttgccttttgttatttaaaaaataaatagttctctagatccttgactttgaaaagagctatttcagtcgttcgtattcagtgattgcttcactagtcaattatataatctgctagatgtcaattaattataaatgcctactcaaaaaatcttctacttgttaaattaaggtggttactcttccatcactagtggagtggagtggtgctctccaataataataataataatataggaaatagcaggaaatcaaagtatattgaaaaggagctaggtgaaaacatttacctttttgcccagtttgtttgggatgaacaaacctgaaagtacagtttatcattcctgtgcacattctgttgcacaaaactcagtctaactagaggaaatccaggaaacgtaatctttcatatgtctaggaagaattcttaatcctgcctgcactagggaatagggtagggaaaagggaaaacaaatagcaatggtttttttcttcttagaaccttttccctttaaccggaaagaagctgatctttatgttaagttcttagaggcagggaccttgtcttattgagtctaacatggctgtgtagtagtaacgtgctcaataagtagtaactagattttaaatgtaaatgtttatacacttcctgggtacagtgtacactgcttggtgacaggtgcaccaaaatctcagaaaccaccaataaagaacttatccatgtaaccaaaaaccacctattccccaaaaactattgaaataaaatataaatgtttatatacttcctgtgtagacactggggttacaaacatgtatagagcaggacaccaaggaccttttccttaatgagaaaatagaaactacatgtatcatagaaagatagcatgtgttagcctacacgtcatcaattagacacttaatgagtaggacagagtaaatgttacagaaactaagaggcttgggtag

SEQ ID NO: 42273 - DNA, 1137 bp, Homo sapiens
ggagtagataacatgcatcagcttatcagtgagctttgttctctcctgaatccctttctctagtctaccaccttcaagaagatattagaaggcataatttgtttctttccttcacagggaaccctaagcatgggtaggagcatacaacgagatgcccatacaaaaaataccagatacatcttaggtacacttgaattgatgtgaagtgtccatggctaacaatgaatctttgctccattttgtagactataagctctctaagaacaaggtagagaccatatctcattaattattgtacttagtatctccggaaataaattattagataatgtgatggtggcctcagctactggcagtctttcccttgagctctgcaaatgcagcaaagtactgagctcaaagggaagattcagccaacaaaatactacacaagtaatgctcaacacagacaacatgttagtttaaatgtatttacttcataacatgatagattttctccaaaatggtgaggcataaatactactacatgaatataaccaaggtgtggaaatagtattacttgcttgagtatcatttttgtatgtagtacaactaaatgtctcagattgattaggactgtaatctagacaatttctgatgtctgtgaacctttcttcttccatgtattttgcccatcagcaagaagaaaggtaaaacagggcagattattatgtagcagctatttaatagacaaataagtgtaagttgatggaaagcagtaatgttccttaatacagacacttgcacttggtagacagattcacccaagtttgcatattataattccagccaccacacagtgagtgagtgactctttctcacaatatcactaactctaagtctctgtctctcatcacatcctatattctcacaccacccctgagccctaggggacatgatgcctacccgatcctgccggctgagagaaggatggtatattttcttacattagtcaggtgagacaaaatttgaagctttcaaactgaaacttttactaaccaactgaatgaaaaggaagtcaaaagaataaaagtgtggaattcagtgagcacagataaaagtagcttcaacaatctcagtaatgagacttttaccaca

SEQ ID NO: 42274 - DNA, 1087 bp, Homo sapiens
ttaactttttgactcagtataatgaaagacattaatttgaaacatctacaattgcaattgcctctagtaaactttaataacaatgtatttatcaaagtgcgattcaatcaccttggggagaaagaaagcaggaaatgaagttgaaacaagtaagtacccttcagagaaaacaagcacttgttgacagctgactaattgaagagaaagaaggcattcttttttcaggaacacaggagacaaagatgaacaaaagactgtctcagagacaggaaaaaaatagttcaggagggaagtgaaaaagagatcactagtccttacctcttccaaaagggatgattagtagaaaatattttgttattgtttaagaacaagaaatacaaatttatcttaggacataaagacaaacacaaaggcatataaacattgtgtattttaggatcctcgttttccttttttgcataattttttagtggttgttctaagcattgcaatatatatccttaatatttcagactacttagagttaatattgaatcaattcatttaaaatgtagaaatcttgcaaggtatgagttcatttactcaccttttcatcctttttgctatagttgtcaaatgcattacgttataaatcctatgatgcaatgttatcattttcagtgctctttattttttgccgctgaagacctgattttccatctggttgtatttctcttcaacctgaagaacttctttggtatttcttatagtacgtgttcactggctacatatacttttagttttctttatctggaaatgtattttacttcaccatcattcttttagaattattttcactggatatagaatttaatgtagttttgagttttgttttattctttaaagatgttgttccactgtcttctggtctccattatttttctgatgagaagacatcaatcattcaaatcacaattcccttatatgtaatgtgtcatttttctctgacagctttcaaaatatctttagttttctgcaacttgctgacaatgtgccaggtgtgtgcaatgcaattctgacattacctagagtgaggtcaaatttcaca

SEQ ID NO: 42275 - DNA, 1558 bp, Homo sapiens
atcaaagatgtgtgcaaagagaagtcttagccagaacaatcaggcaagagaaaaaaagggcattcaaattggaaagaaggaagtcaaactatctgtttgcccaccatatgatcttataccttgaaaaccctagagactccttcaaaagactcctagatttgataaatgaattcagtatactctcaggttacaaaatcagtatacacaaatcaatagcactgctatacaccaacaacaaccaagctgagaattaaatcaagaactcaatcccttttacaatagctacaaaaaataaaataccaaagaatatacgtaaccaaggtcgagaaagatctctacaaggagaactacagaacactgctgaaagaaatcatagatgacacaaacaaatggaaatacatccaaagcaatcctaagcaaaatgaacaaatctagaggaatcatattacctgacttcaaattatattacaaggttatagtaaccaaaacagcatggtattgacagagaagtaggtacttagaccaatggaacagaatagagaacccagaaataaaaccaaatacttaagaccaactgatcgtcaacaaagcacacaaaaacataaactggggaaaggataccctattcaaaaaatgatgctgagaaaattggatatccaaatgtagaataatgaaactgcattcatatctctcattatatacgaaaattaagatagattaaagattttaatctaagacctgaaattataaaaattctacaacacttaggaaaaacccttctggacattggcctagacaaagaatctgtgactaagatctcaaaccaaatgcaacaaaaatacataagtgggacctaattaaagtaaaagtcttgtgcacagcaaaagaaagaatcaacagagtaaacagcctacagaatgggagaaagtatttgcaaactacgcatctaacagaggactaatatactgagtctgcaaggaactcagatcagcaaggaaaaaacaattccgttaaaaagtggacaaatgacatggacatttctcaaaagaagatatgcatacaaatggccaatacgcatataagaaaatgttcaacatcactaatactcagggaaatgcatattaaaaccacaatgatttaccaacttagctagaatggtcattatggaaaagtcaaaaaacaatacgtgctgacatagatgtggggaaaagagaactcatactttttttttttctttaacttaaaaaaattttttttattatgctttaagttctagggtatgcacaacatgcagctttcttacataggtatacatgcgccatgtcggtttgctgcacccatcaactcgtcatttacattaggcatatctcctaatgctatccctcccccagacccccaccccctgacaggccctggtgtgatgttccccaccatgtgtccatgtgttccttgttcagctcccacttaagagtgagaacatgcaatgtttggttttctttccttatggtagtttgctgagaatgatggtttccagcttcatccatgtccctgcaaagga

SEQ ID NO: 42276 - DNA, 1001 bp, Homo sapiens
agatgactgctctaggcttccttaaggatgtgtgatttttggactgggatatgaggaataattatgaggtaattagtaaaatagagtggagggtgaagggtctttaatcagaggaaatagtatgtacacaaagccttagtggtggcagggagtagatttgtgtgtctagagaacatgaaataagggaaagaatcgagatgagcctggagatgtaagagagcatgtcacatagaccatttaggctgtatttgatttttatatcttaagagcaattggaagcatttaagcaagggataaaatgcttaggtttgctcctcacagagatctcggcctgtaatgtagaaaatggattggtgtgggacatgaagggtctgagacaaccagttagtaggctcttgtggtagctagatgagatataaaagaagctttggttaaaagtagtgagtatgataagatctctgccatcattaaaaggacacagaatgccattaacttggaaaataaaatcaagccattctaaaattagactgtgacgaagtagagtgaagtttggactaagtgctataaatcacaaggccaatatttgttataatatatgtaggacttgagaaggaagagcaaaaagtcataggaaagaggctagcgtaggattgatgaggcttaaggataacaatgagaaggaactagaggataactgaatgagaaggaactagaaaaatttcagccacagatccagtgatagaaacttaatatctgaccctcctgaacatctatcactcaccttaaagtgcaatagaagaacgttgaggttcagtaattacattaggcctatacagattataaaaatctgtgtttgtctttttccaaatactatttattcatttattttagagacagggtctagctatgtcacccaggcaggagtacagtggcatgatcatacctcactgtaactttgaactcctgggctcaagcaatcctcccacctcagcctctggagt

SEQ ID NO: 42277 - DNA, 1064 bp, Homo sapiens
ttctactcatacttagtttggtttaaaatatatttatctaacaagtatgttatgtgccaagaaccttaccataatcaatggtaaaatccaaaggctctgagaacttattagaaaaggtgaaaaaaggcatgaaaaatgctggtgttggttccctgcttcacaaatcaaaccattaacatggttttaactaactttcgaaaacaatggaaatcagctttgtttgtgctctttcttttagattttctgcatttatttgaaaaaaacatgattccagagaggactgtagagttccaacatatcatccccatatctgcagttactggagaaggaatcgaagaattaaagaattgtataagaaagtcactggatgaacaggccaaccaggaaaatgatgcacttcataagaaacagttgcttaatttgtggatttctgatacaatgtcttctactgagccaccatcaaagcatgctgttactacttccaaaatggatataatttaaatatattaaaaatggtattgatggaacagtatttaatgcttaaaaacaaggaaatcctttcatctgtgacaacctggaggacatgttaagtaaaataagccaggcttagaaagacaaatgctgcataatctcactgtggaatcttaagttgaactcatagaaggagagaatagaatggtggttatcaagggctggtggggcagtggaggattgaggagatattggtcaaaatttacaaaatttcagttagacaaggcaactgagttcaagagatctgttgtacagcttggtgactgtaattaacaacaatgtattttgaaagtcactgagtaaattttaagtggtttttccaaaaaagcacataaggtaatgcacgttaattagctatattgagccattccacaatgtatagatatttcaaaacatgttacacatgataaatccagtttttctacgtcattttttaaaattatatttaatttttttattttgaaagttttttcacagatcttttttttagtattattaccttctgatatatgtgtcattattgaagaaccata

SEQ ID NO: 42278 - DNA, 1046 bp, Homo sapiens
acttttcggaggccgaggagggcagatcacttgaggtcaggagttcaagaccagcctggccaacatggcgaaaccccgtctctactaaaaatataaaaaattagccaggcatagtggcgcatgcctgttgtagccccagctactcaagaggctgaggcaggagaattgcttgaacgcgggaggtggaggatacaatgaacccgaggtcgcgccactgcacttcagcctgggtgacagagctagactccatctcaaaaaaaaaaaagagctaaaaaattacattttacaagtttatggccagcccacctgtaataacattctctgatattcctttacttaggatgtccctattgagatcattttttaaatttatgtggaaggattctctagattattattagaatgagcaattcagttttgtttgtttttgagcctgtcttgtacctggttgcactaaatatataatagttatcttttgtggagaccttaaaaccctaaatttgaatacatgttcaatgatagtaaagatatgacagaaactagaagatagctgtttatgatttgagcttttggaaaattttcgtttcttgaatgtaatagtattttttcctgaattggaggagactgatctatattgtttcatttttcttttgtcctagtctatttcactttcttttgtcataatctatttaatttcccactttcttattttagtaaagagagaataaatagcaagtgcaggccaggcatggtggtgcaggccagacatagcggtacatgcctgtaatcctagcactttgggatgccaaggcgggaggattgcttgagcccaggagttcatgcctgagcaacatagcaagaccctggctctctataaaacagaaaacgcaaactttaatattatcaacaatcaatatattataagagattgcaatttctaagtttctacctgagtgtttcacaaatacaaactggacattttccctttaaatgagttttattataaaatgtacatattgattgtaaaaacaaaaaattcaaatagt

SEQ ID NO: 42279 - DNA, 1090 bp, Homo sapiens
aactcctgtgatgtgccaagcagtgagctgggtcactgaatgctaagaagtagttaacacttggcatagcatttgttgtgttctagacatgttttaagcacttgacattatattatctcattgaacccatagaacaaccctgcaaggttggcactgttattttttccatttcacagatgaagaaaacgaggcacagggaagttctgaatctggcccaaggtcagtgagctagtaagtgaggagatggggattagaattcaagcaaccttgctaagagttgactctcaaccattcccctgtcctgtactgcttctttccctacacctttgctttttatgagccaccttcacccctgctgcatgagcatttgaggctgaatttgtggtgtttgtagctaactgatgattgatgagtgggcccttgctgtgtgagtgcctgacacatacagagtgcttgatgtatatgtgttgaaagaacgattattgacaaaaagaagattgaaggtgtgattgtaagagactttaacattatcttggttgtttttttaattgtgaagaaaaataccgatggctaaagattttagttgctctatgacccagtcagtaataaccaaatgtgtgtgcacctgtgctctgaggtcacacacacctgcatgtatatacatttgtactgtacagagaggaaacaagggagagactttccctctttgcattgacatttcatcattagatgtgttgccagttggcaccacccttcctgctctgttctgctattgtcccctcatgatttgtcctcttgtgtgtcaccccctagtctgactgacagtactccacaagcttgcctgccatgggctgtcgggatgtccacgcagccacagtcctttccttcctgtgtggaatcgcctcagtagcaggcctctttgcagggactctgcttcccaactggagaaaattacgattgatcacattcaacagaaacgagaagaacctgactgtttacacaggcctgtgggtgaaatgtgcccggtatgacgggagcagtgactgcctgatgtacgacactacttggtactcatcagttgaccagctgg

SEQ ID NO: 42280 - DNA, 1057 bp, Homo sapiens
ttctctttcagacataatttagtaggggacaagaagtctgttcttcagtgagtacactagagatttactctggtgactgccttttgagttatgggtgaagtaaggtatggctttaccataaccttgattcattcacccttgattcatttctcgcccccgtcactgattatttccttgagcatatatctctgcctaacactttagtaggtgctatagaggatacatgaaaagtatgagatctggttccatccagtaagacattttaatagagaagatcaaaatgttacctggcagttggggaataatctgacttcgttggcagttggccttaacttcttaatcattgatccaggaatatttcaaccagagacacaactttctggcagacagacaaattgtacaacaccaacaatatcctggaccttgaaattctgtttacttcagtccattgtatcctttaaggcacctgtgctagcctagattttgtaataacactgatttatgagaatggacaaaagtggtagggaaattgttccctctccacttctgaaagtatgatgatgtattaaggatggaggagttattaaaaatgtctcttctgatgaggtaacaattagatgaaaccatgttaaagctgagatgaacacttagaaattcagggatattgggtctttagccttatgaatttgagctgcttatttaattggtgtaatttactacatattagtactatattcgtaaggattttttattaaccattacagattttacaaacagctagttatatggtaaacagattattatgcctttttgcaattctgaatatgattctagtatttgtgtagatgtatttggtactttttcccctaattccaacactagtttatatatatagcgaataaatctagttgtataaatttttaaatgccgtcagtagaaagcacacaaggttatgatttttttaattactggcttctgatttctttcacttctgatccttttcctttttctcagatgtagctgagtcttgatcattttaagacaacgatgggtagaa

SEQ ID NO: 42281 - DNA, 1034 bp, Homo sapiens
gtataatccccaattcaactaccctctgtttgggcatttgacttattaatttcatatcctttgtaaaatagagataataatagtatctttcctttaagggttaagataattaaataaggtaatgcatatgaaggtttcagaataatggctcacaaaaagtgaatagctcataattggtgttatcatcttcattgccttcatcatcaccatcatcatcgtcattgatgctttcactttgacatccaccttctgtagttggaagggctacagagtagatagaaggattaaaaatgaagaattacagctatgaggagagttaatttcagatattcctctaacatttcacctaaagcttcatgtgatgacttgcatattaaaactgagaaaatattatctaaaacccaccattgtttagattccgtatgggggtgattggattcactttttaatccctgagtgtgttgctcgtagttaactttcagtacgtatctattgaatgtgagtaaatatctattgtagaggagtagagagagtgatgaattaggtgttaggcaatgtggattctcatctgccactttctagttatttgggcaggtcgtttaacttaccccggccatgacattctcatttgtaaaatcagttgaactatgatcttcaagttgcctcttagctctaaatgtaggattctaaataatgtaacaaccaacataagattacaattttttttcatgttttatgtcagacaggtaatgtactgaccttgtagtaaggtttgagggaggcacatcttacacatgaggtgaaaccccaatcatcacgcttatgaactatacaaaaggatcaaaatgacaattttatcacatcagaaaagagcactaaaactctgcttatgtacataggaactgagttcttctgtgatcattttcagattataatagtagaaatttttttgaacgcttgttttttaccttctctctcctggagctggggaactctacagtccattggaatcaattcagattttagtcttaaaa

SEQ ID NO: 42282 - DNA, 1050 bp, Homo sapiens
ttaacttgcttactttacatttagtataacaattctgttaggtggagactgtgcacaatgatattggcttctagtccatgtccctctttgttattttatataaagatataataccagagataataaaggtggcagttattattattatttttttgagacttggtgtcccttggtcatccagtttggagtacagtggtgccatcgcggctcactgcagcctccacctccaaggcccaacctatcctcccacctcagccttctaagtagctgggaccacaggcatccaccaccacctggctaatttttgtattttttgtagagatggagtctcaccatattgttcatgctggtctcgaactcctggtctcaggtgatcctcccatctcagcctcctaaagtgttgggattacaggtgtgagccatcacatacagccatgcagtgatttttatgagaaccagaatctagggatgatatggtttggatcgtgtccctgccaaatctcgtgttggaaggggggcctggtgggaggtgattggattgtgggggtggatccttcttgaatgatttagaaccatccccttggtgctgttctggtgatagtgagggaattcttgtgagagctggttgtttaaaagtgtgtagcacctcccccttcgctgtcttgctcttagcttctgccatgtaagaagctggctctccctttgcctactgccaggattggaagcttcctgaggcctccttggaagcagaagtcactaggattcctgtacatcctgcatatccgtgagccaattcagcctcctttctttataaattacctggtctcaggaatttctttatagcaatgtgaaaatggactaatacaagtggttagatacaaatatgatttgtggatatttctggtcattcttttccatttattgagcatggtggaagctggttcagtcttttctctaccctgactatcaccattaagggctgtctcagtgtccatatggatgatgtatacgctgtcatacaacattctagcatccctgactttctcgtct

SEQ ID NO: 42283 - DNA, 2020 bp, Homo sapiens
agtctcactctgtcacccaggctggagtgcagtggcgcaatctcggctcactgcaacctccacctccagggttcaagtgattctcctgcctcagcctcccaggtagctgggattacagacgcccaccaccacacccagctaatttttgtatttttagtagagacggggtttcaccaggttggctaggttggtcataaactccagacctcaggtgatccacccgtcttggcctcccaaagtgctgggattacaggggtgagccagcacacctggcttcaaacagttatcttttattttcgtgacttcattatcattgcagctgctgccatctcagttcagaaccttttcacttttacctattttagttcaataaactcttcattggtatcactgctccatcttattcctccactcagccttcccaaaacatctttcttgtcatagtactcccctgttcaaagattcatgcatcaaatgacgtttgttttatgtcaggctggatatggtctcagcctgactcttgatctagttcagcctcacaggcatttatgggttgaccatctctcagcatcttacagggctgggcctgggtggagattcaatctcactctctcttatagtaagattttataggccaggcacggtggctcacgcctgtaatcccaacactatgggaggtcgaggcaggtggatcacttgaggtcaggagttcgagaccagcctggccaacgtggtgaaaccctgtctctaccaaaaatataaaaattagctgggtgtggtggtgggtacctgtaatcccagctactcgggaggctgaggcaggaaaatcgcctgaacccgggaggcggaggttgcagtgagccgagattgtgccactgcactccagcccgggtgacagagagagactctgtctcaaaaaaaaaaaaaaaaaaaaaagattttatattactttctgtactgttttattttcactgtggtcatatctgccagtcctagatgctatgaaccttccatgcaagaggtctaaaagttagactgttctttaattatgccagtaatccagaaagtcattatatttcaaattcagcatttaagatagctgaaaaagaacatcactacctccttaattctctcattggaaatttagttttaattttctgatgcttaaaactttctgtgcttcagtttttcctttttataaatgtttgatcatatttaccatctccctaattatggtagacataattatcataattaggtctagtcccagacagtggctcaaatgtctgcgtagtgctgtaaagattcagagaggaagtacatgtcacaaagtgcaagatgtatgacatttgggagaattagtcactttcaatttgtaattctcaaaaggcagaatattacagaaatggaaaacatgagtagtgtcctctttccgttgtgagcaccctgcatcctggtggcaggctgtatagcctgtaggaagtctctgctgtaagggtggttagtgttccctcctgggcagtgctctgatttgcatgtttgaattcatttgttgaaagctgacctttgggccgggcctggtggcaatcccagcaccttgggagggatcacttgaggtcaggagtttgagaccagcctggccaacgtagtgaaaccctgtgtctactaaaaatacaaaaattagccaggcgtggtggcaggtgcccgtaatcccagctacttgggaggccgaggcaagagaattgcttgaacctgggagtcagagtttgcagtgagctgagatcgtgccactgcacaccagcctgggtgacagagcgagactctgtctcaaaaataaaaaaaaaataaaaaaagacgctgacctttgacgtaggaagtctttctgtacagcctaactactctattttcttcaacaagtgcaaaatgggctcagctgcagtacattatgcctattttccttctgactggaatttgagtcatcaatttagaaatttttatattgctgggttgtgattgggat

SEQ ID NO: 42284 - DNA, 1026 bp, Homo sapiens
agttccaaacactcttaactcttattattcttgtcataaaacttataaaaggcataattacaagatattggaaccagcagtttgctttcagttttgcaagcttaatttctttaggtctcatcagcgtcttaaaggagctttcatcattttaagggaataattgaagtaatgttcactttcccttctgaatctattttattttcaatgtgtaaagttctggttatttttccaacttactatttattttttaagttttccttctttcttagcaacttagttttcttaaatttctttttaaaattaatttttttaaaaaaataataaaaaagatggcatctcattgtattgcccagactggtcttgaactcctgggctcaagcagtccaccagtttcagcctctcaaaatgctggaattacagacatgagccactgtacctggctgtcttttagttttattttattaactcttttgaaatgaactgttgtttcttttaggcatatgagcctgggaattttcttaaaattaattaatttatttatttattttgccttggtaagtttattgtgacctgggtgttccacgagcatcctaaacttaggctggggatatggaaaattattttacagtggttttaggaaaaagccaggtattagcaaaaaattataagattctgaaatcatctgcaagtatggcatgtcttatagtgcaacattatatgattaattttttaataatgaaattaatagttttcctgtttttcaatagctactctaaattctatgataatgatgaatcttatgtgtatgagtaaggaatgtgttgaaaaaaaattttaaggtttttatgacccatgtagttataatacgatagaaaaaaagttttcaatatgcacttttatacctagatgaaaatgcatcaggcaagtacttattcgacctttcactgattaagaatatctttctccaatcttgcaagttacaatttaaaagacatttggaattgcttagagaacccagggagtcct

SEQ ID NO: 42285 - DNA, 1082 bp, Homo sapiens
cacaagtagactacaaactcctgcacaaatatgtttgggaaactcacatcctcttcttagtggatatgcgtttaatattcaagactctgtgaaatcctacacggaagaaacctgtttaactttactttatcagaatacttctaggggcacctctggtgataccatgggtaacaatgtttcttggacatcagtttgggaagtgcagcccagagtggtcattagattcctgcactcgccaccataggcctattcaatttgaaacatacttaaatgttgatgagcatgcatgcttattacaatttattgaactaaaaaatgtaatgagaatatacatatatgttacttcaagaaattcagtcgaatttagcttttctttttgcataaagattagacaaaaccttaaggtagatggttatgaattttagacatcttaccgctaagaaaagaaagtagatggctctataaaagtaagcttttttattattattttagtgagcaccaaatgtggtagacatttctgtagggcagaaaggatgagagttccagtctcatggaatttacattgtatagagatgtggagattaagggttacatgtgttcttctcaacatgtttatatatgtatatatattttacacattattgtagttggaaggttttttgcacattgtggccttggccactcataaatacatcctcagtttttttcaggtattaatattttgattatggaaacggactttgggcctatgcttggcttacaatgtttcagtccacaaatgaatcttatttttaattattgaatgaatgatttctctttaaataaccttaaaatgatttaaaatctctaaagagacttgttagttttatccttttttttcccccgtaactcaaaagcagttttaaaaaatctacacatttgccaggcttgaattgaaaacatttgagcatctgagtgaaggtgttggtgaagttggttgacggtttttttctttaatctcatgataacatcacttaaataatttataagaaaaatcctgggtattttcctcctttttttttagagatgagatctcactctgt

SEQ ID NO: 42286 - DNA, 1028 bp, Homo sapiens
gtctgtcattgttggacatttgggttggttccaagtctttgctgttgtgaatagttggtatgcagaaattcttgtaaggcatgccttcctttcttcttccctttcccactcctgtcctttcttagtatgttcaaccttgaggataagaaatagctaaagcatggtccctaccctgaggaatttataataaaggttaacatttaattaataataatggaaatgaaaactagtaatgtacttgagaagcagagtgacagagagagaatctagcaaatgaaattagctgattactcagtggaaaatgcagacaacaattcacaaatcagttgctaattctttctaccatgtatattaactttgtcccttggccagaattttgaagttattttctttatttagcttaatgaaacaacatcaaggagagtgtaaagtctttttcaatgtaaagtgactgaaactttgctttttagaactcatcatttcactaaaaaataagttcaccgtaagaactctccatcagatagaattcctgatggatgttccaggatttaagatgcatacaaagtttgggaaggcctgtcagttttttaaaaaaattaataggctttttttgggtgggagggggctcaactttcagtttacaggaaaattgaacagaaagtacagagttcccatgttacttctcattccctattccagtttcccctgttattaatattttgcgtgaatatggtacatttagtataattcatgaaccaagattgactcactattattaactaaagttcatagtttacattagggttcactctgtgttgtgccgttctctgggttttgacaaatgaatgacatgtatttaccattactgtatcacacagtatagtttcagtaccctaaaaaattccctgtgcttcacctgttattcatttctccttctctgccctgagctcctgccaaccactgatccttttactgtctccatagttttgccttttccagatgttatatggttgaagtcaaatagtctg

SEQ ID NO: 42287 - DNA, 1049 bp, Homo sapiens
ttcttttgatattctcctgatttcccctgttttgtcaagcttatacaaataatgatataaggtagaaatgaaggaaagtgtccaagaatggtacaaagggcggtgggaaagttccaagtaattcagaaagagctcagcagtctggggtttttggaggggatggaatcctggagccagggaatgcttctctctctctctctctctctctctctctctctctctctgtgtgtgtgtgtgtgtgtgtgtgtgcacgcacgtgctcatgggtgcagattttttggattgactccaacagtaaaagcacgaccttattaatttggactccactaattagaaaattactgtgaaatggataaggattgagcttaaagttaaatagcattttctgagaaattaatggcatagatataaagtaaatgtttgacctattttggagaagataatggtttacagtgcttctgtaatgaaggatccatgcataatcattttagtaacagttattgaacgtgtagaatgttgagaaagagtagtgtgatggctaagagcatagattggagcatcacaccccctggggtcaaatattggctctaccatttactaattctacaatttgctaaatcaaatactggctaactcaaatatctatttactaactcaagtatctatttactaactcaaatattggctctaccatttactaacctgggcaagttacttaatttctctcagccccagtttcttcctctgtaagatgggaataataatattgcctacctcttagctttgctgtagagattgaatgtattaatataaaaatgcttagctctatactcggtacctgataaatgtaacattaagtggtaactattattactgtgttcctggcaccctgctaagtgcagtgagaagataaaagagaatttctggtgtcaaaatgtgacgaactaacagataaaataatgtgtattgatatatacatacaatatcagtgtcatacagtacaaataggtacatattttctgtgtagtttactgtttataaactgtatt

SEQ ID NO: 42288 - DNA, 1033 bp, Homo sapiens
atgctgtcatagatcatgtagagctttttttcttgaaatataaatttggtaattgcaaagtatcatcaacagttaactttggctattttaaagttgataggacggaatgtgctctataacttttaaataaccagccaactctataagactttataaaactttaaaacaccactttcttgaatctcctttagaaatagaaacaatttaatacatctatgtattaataatttgttctcttttctgtatatatgcaaacagatatacaaatgggctgctttctaaatcagttaagtattggcctcctttccatgatcttagagtaatatgattcaaggatagcagaaacatgcaaaactgagagaaaacctttcatggcaactaaaatcttgcttctgcttattgatttgtttatattttgcttacttttacaagttatttcagattgcttataaaagtccattttaataagacctaaaacagtcaaggcaggaaagaagaaaactattatagaagaggaggggatggcaaagagccttcaaggtggagttagcaaactacagttcatcaagaaggcagtcgggagaccatcctaagaataatcattatgtagattcattcatttgttcagtaaatatttattgagcacatactatatgcctgtaatctcttaagcagtgaaaatgcagtaatgagcaaatcagacacaaatccctgctttcacaatcatagaggttgcattttagtggagacagtaagcaaaatgtttagtctaaatagtatgttacatagtaatagttgctaaggagaacacattaaagcaggaaaaggagataggaggtattgagggaggctttacattcttcatggagttgtcaggaagggcgtccctgagaaactcactttggaaaatggccggaaggctgtgagggagctgtaagggtgtcaagggaagagtgtacctggcagaaggaatagcaaatgcaaagaccctggtgcacttataggaggaagttgctggggagaggttgggtgg

SEQ ID NO: 42289 - DNA, 1054 bp, Homo sapiens
gatcatcaagattaaagagaggcattacatgatgataaagagcttagttctccaagaagacaaccaactttattgtatacacaccaaacaacagagtgtcaaaatacgtgaggcaaaaattgatagaactgaaaggtgaaatggacaaatccactatggtggttgtgacttcaacaccactttgtcggtaattgacagattaagcaggcagagatatcactaaggattcgatgatctgatcagtactgccaaagtaaacaaagtggaagctgccaatatttcaaggcctggacccagaactggcacagtgctcctttcacctactcttgatcaagtgttcaaagagaccagatccaagcgtaggggccatagaccacacctctcaatgaggagtgtcaatgaatttgggggccgtgttttaaaaccccgtatagagtttggtttttattctaggctgaattaaatctttggtctcatctttgtacacagttctctcagctatctgttctgaacatatatttgctgactcctttttgggttaatttcattagattttagatctctccttgagaacaataaagacacagggtggggaacatcacacactggggcctgtcgtggggtggggggatgggggagggatagcattaggagaaatacctaatgtgaacgatgagttaatgggtgcagcaaaccaacacagcacatgtatacatatgtaacaaacctgcatgttgtgcacatgtaccttagaacttaaagtatacatttaaaaaaaggttctgtttagtataaatggctttgtatagagggggcccttctgtcctagtgtacctggcacagttctggtttatgcttgtcattttcatgattattaatagtgctctttttactctgaatactgtcccatttggatgataaattatatgatcatattatataatttttatttttctggaacttggtaaaatattttgccaaaaaccgaaatttgattggaatatgttattgtgggatccaactgagtatttagagccattaatgtcagtgaatc

SEQ ID NO: 42290 - DNA, 1032 bp, Homo sapiens
aggctgcagtgagccatgatcatgccactgcacttcagcctggacaacagagtgagaccctgtctccaaaaaaaaaaaaaaaaaaaggtttaaaatatacatgaacaaaaggtagactattaaaaaatttcttaacgttattttttccacagctgtcttttctaaaagtagacccagtgacttaacatttttaccaggctttagaactgagagactcagtagttgttgagtgttgagacacgtagataaaaagtaattaagaaaggagaaagtcacaatgactcttaggttaaagagcaatttgataatcagtgtaattcttaatgagaaaccaatgaagcagtcgtagaaaagggagatgctgattagtggtctttgctcagattattaaagattagtaaggttagtgagtgttttgaaacatgtctgctggatgcaaaaaggttaattaacaaagcattctacaaattcttaaggaatataaaaacttaaaggaaataaaaacttttctatatgtagatgcagtaaacataaagagaccacaccttttatttataaaaagaaaataaacatttaaacctaacatgaaagatgttgaaaactttataaaatgttggtatttttgaaatttttggaaataatacttttagtaatttattctggacttattttgcaggtatgatgaggaaaatgttagtatactattataacagcattaatattcacccagtgaaatctactctgtgccaagaaggtcctagatactgagcacatatcagttgataaaacaggaaaagtccccttcatttctggaacttatggtgtagtatatattttaaggaaattttagtttgaagtgatgtaatacataaaatctcagtgtcatgaactgttgagatgatcataacttattaaaaacaaacacttggaggttcaattcatggagaattcagaatatgaattccatgaacctaggtcttgtttttttatgcagttaccatagaaaatattttcaaagacctttttcactat

SEQ ID NO: 42291 - DNA, 1026 bp, Homo sapiens
agaagcaagtaggatcacattgaagttgttgatgatcttcttattcactttggctgggtgtgaggcaagctcctgaggcacattaaaggttagcttctgggaaacacagagaagcggggaatgcaatgaatccttagcacactgagacctggctttgactggcaacataatttcattttaagccttgagatgagcttaggaactggccctcagttgcggttgtgttgtagaatgcagggctgtgtaggtgggatcttgttctgtgggttagagagcctctgaagactttagagttgggcatattagggacaaaaatctgatattcagataggatatcaattagaaaaagaagaaactggaagctgataagtcagtcattcagtgtgttgcagatttgaaattatgggtttattagatgttagtaacaaaaaataatattctatagaaagagatgtcagagctaggtgaagtattgattacagattgagaggaaaatgtcaatggttttgagtttgactgagtgaaaaaatagggccagagatagaaatagttggtgattgcatggagaattgcttttaagactttacagtttaaaaggctgttatccgatataatcttcatatgctagccctttgaaaaagttttaaatttttattttgtagaatttatattgtttatagaacctgtattataaatatggaattaaggctcagaggggttagatgacttgtctaaggagcaggatcttgtacctagaccttgttagatttcaacagggtcattactgacattttggagtaatcaatttgggttttagggattttgagctcatgagacatctgtatgaaaatgtcttgttgggaatgtgggagtgcagctcacaagagtttagcgtaagtagtatatatgtaccatggtcgttaagaagttgaaccatgtataacatttttgtggaagcgaatgttgagtgaaaacagagtcagttacaaggcaaggtagaaactcccatgggaagctggaggtgat

SEQ ID NO: 42292 - DNA, 1034 bp, Homo sapiens
ttttcatttcatacagagggttgtgttattgccattaagtcaaggttagcaaaaaagatagggattttgaggggggacatgggaaaaaatttatttataaaagtgataacacatttttcaataaagaaaggaaggcagcatccacataggacaagaaagggtctaaaagaggaaaggaacaaatagattcaacacaatataactcagagacagtagaaacatgtagaggaaaaggggacctctcatggtaaactctgtagtattgaactttttgtttgggtacattctttttaatacatgtctgagtattcccatgtgctttatccaccttctctctcttcctttctccacccttctttatgtatttttttcattattcattctattagaattctatggaaacattttagatttttaatacaaaatgtggtaccaggaaggcagaggtagatataaactgaaaaagagataaaggaaaaagaacaacttcttttatttcaaatatttggaattagttaacctgcttgtaaaatgaataattttatgatttaattgtaaaatttgtactgtataattaaaatattctaatagtacaataaatgttatatgaattattgatattacttttacaaattttttaaagttataaattggaaaataagactgattttaattgagtcattaaaattttggtgtttgactgatacttgattctctaccttacatttttcttttttaatgttatagcctatctgtttttgttgtttttcattaaccataccatttttccttgtaactgtatggtacaattgcttgtgaagtttgtatatgtaattgagttataattcaattgataattaaccagtctagatttcatttcttgcatttcatgtttggggtgttgtattgcttttctagggcttctgtgataaattaccacaaatttgctggcttattcttttgtagtgctggagagtagaagtccaaaatcaggatattggccagttcatgcttcttttagaggctatagggaa

SEQ ID NO: 42293 - DNA, 1024 bp, Homo sapiens
attccaactctaaatattagtattataacatgaacataatttttttaacattaaaatctcaaattctctcatttatacatccacatgttctcagggtttattggctttgaaatcaatagtacaatacatcttcattcttgtttcccactctatccctgagaatgtgttgatcacccagctagtgagaccactggccccggggagctcagaagtctaccagccacagtggaaatgagcagatcctctgagctaactttgacttcctgactttcacattcagtgatacaattgagattaaataactgattgaatctttcccacagtcatgacatcactgggcttttattatccctgtttagtttctcaccaatcatgtatgtgtcattagttatcagcaactgttggtggaaaattttgttgatgaaaaaaagaaaacctctttccacaaagcattgctgtgttctctgtcctcaggccactgacattgatgaattttgtcccatttttactatacgttctgcttcttccattacattttattttcccttatctcctaatggtcatggagaaatgggtctcaaggttactgtttctcagtaactgggctgtacctctagaaactgtctcaccagctcttattcaagctttgtgtgcttttctttcatcacatggtcattcatcatacttcaaatacttactgtttgctcctcattccgagtccaggttgcaccatggtgataaacaaggtttaacactgcaggacttggtgcctcctaggacgtggtgagaaacttaatgatgagtgaaatgtgtagtcagtgtagaaataatgtcacagaaattatatgtgacacttacagtgagcctgggtatttatatacagcaggaacttttcctacttggaagttgtttaacatggtcaccgatagatgacttactacatttttgtttctaaaaaaaatgtgatgtgatttacctcttcttattttttaaaataccttaaaagcagcaaaatgtattcatc

SEQ ID NO: 42294 - DNA, 1025 bp, Homo sapiens
tccacttcctttcaattttattttattcaatatgtataaattcccacacacaaatgttaacatgattataaaaatagtgtatttttataatggaaaattcctacagtgtcaaaatgaaaaaaagctgaaaaatcaccctttgtcctactacccagagaaaaccacatctagtatttggacatatatcttctatagagtttttctatatgtatttgaaaaaattgaatcatatcttgtatattcttttggaaccagctatttccactaaacaatttgtaattaacacctttcaatgaaaaataaattcagaaacctatcattcttaatgactgggaagtgtttcattatatggatgagacattatttacttaaccagccccatattgatagcttgttttcagtttttcattataataaaatgctgccagaaactttcattgcacaatcatcctgttagttaagaataattattagaataagaagtccttatttcaataaaatttaatttttatagatgtagactatttgttcatatccatcccttcatttaaactcatgaaacctactcccaagaaaatctcttattcactttattgagattgtactgagtctatggaaataatacaaaattgtactttcctatccacgattaaattattcaattttatggctgttagcataaatgtacagtttgtataaacatgtttggttttttgttctactcaagactttacttttattcaattattttaaataactttttcacaataagtttcttaaaaatataaactgttccatatattttgtattgacaaaaatggccaagagagaactttaatgggctgtagtttatataaatttttatgcaaagacatatctccaaatatttagcatttttatttacataaagctcatgtataatgataataatagtataaccaaattatattctgataattttctgaactttagactccacttttcagcctctgatagctgttgaacaacaataatgtaacttgtca

SEQ ID NO: 42295 - DNA, 1019 bp, Homo sapiens
ttttgacttaccatcccctgtaggcctgcagcccaagaatggagtttgacaaatgccaggaatctagcctataatttgtgtttagtgttcaaaaccctatacttaagtaaaaagaactacaaaccagtcttctgtaggctacttccaattcactgctcaatattttgccatctctttttatgtgatcctgtggctatggcttactttttgccaaaaaacagctgtggcttactttttgctgatgtacacacttattccagattgtttccaccaatagccaggcctgacatgccacaccatatgtttataacattgggataggattcaagaaagtaatagaaggatatagccgagattcgtgttagtataagtagtttattaaggtgttgctacaatgacagagagtactctttattccctccacataacccaggctgctctttgagaactttttttgcttcagggctacctgtgacaatatgtaggacaagttttagaaaacagaaagacaaagatgagaatttgttttaagaggctctttcccaaagtcttaagaaaggagattatctaagtgaggtcttcacatttaatgacattctcaaaacagcagtttgtgaagcgaatcatctagaatgtttatgctttgggaagttcaggaggtcaacagagtaactaagaggattacacatttaaaactcagtgcatttctaaatgcctttattcatatttgtatggtcttcgctggaataaaatttatgggagcaagctattcatgtcaggttagtttttggaaatacataactaaattcagaaatagcaactacagatcagcaggcaaaaatattagttttttgttattgttactgttttttttgtcttaaactctgaaaactcttaaaattaatctttacctttgtgctctgaagcagcttttggttagagatgctttcttttcttttgttctagtccatctgtttatgaaaaaatgttatcccaatgaaataggcttttaaatattg

SEQ ID NO: 42296 - DNA, 1003 bp, Homo sapiens
ctgggtcactttgattgattcagttgatttttcttctcattatgggttgtattttctttctactttgtatgcctggtaattttttattcaatgccatatatcgtgaattttttcttgccagattctagatatttttatattcctaaaaatattcttcagcttgttctgtgacatgttcaagttacttgaaactgtttcagccttttggtcttgcttttagactttgatgggcaagattatcaaagctgctgcatttagcctaggataaatttttctgcactactgaaacaagatcctttttagccctgtaaacaatgcctgtgaattttgagatttcctactctggccatgggaataggcaccattgtcatccctgtgtgagctctgtgcactattccctcaatattttgggtagtcctttccctaactttgagtagtttcctcaactttatgcactgacattacttaactgaatcatcaaggggactttctgcagatcttcatagttttctcttggtacagatttctcctctttgatcctctgctttgcatattatagtagccttagccttcctggacttccagctatgtgtcttcaactcagggagtttttcagacttcctctgggtttctcctgtctgcagattttcttcaggcagcaaattggagcaatcatagattcaacttgtttgttacctgtctctagaatcacttttctttattaccctatatttaagtgcttgagggccattattttatatgttttctatggtgttgagttgcttcaggcaggaaggtaagttcaatgtctcttacttatcttgactggaaggggaagttgtgactgattctttatgtcccctagcatttaacatgatgctagatatatagtaaatactcctcaaagggtaaagatagagagtcatttacatagattcatatacaaataaaggggtagtgtgtaagtgaaagaaaaatatgtaattttttgagagggcgtaac

SEQ ID NO: 42297 - DNA, 1050 bp, Homo sapiens
accttatttggaaaaatgggtctttgcaggtgggattaagttgagggtcgtgaaatggggtaattatcgttgagtatccaggtaagccataagttcagtcattgatgttcttataaaagagaggcagaaggagatttgacacagaagagaaagcagtgtgaagagggaggcagaaattggagtgatgcatccacaagccaagtaatgccagcacccaccagaagctggaggaggcaagaaactgcttctcccctaaaccccccagaggggacaaggccctactaacatcttagtttcagcccattgaaaacaagtttggcttcaggctccagaactgtgagagagcacatttctcgttttaagccaccaagtttgtgttgttacagcagtcacgggaaatcaatacattcatattaacatatttttgaagataatataattttctaaaacacaattgaggatgtcaagcttttgaagtgttctgaatcaattcaataactttgtcgtatttaattttgatgtaactgaaatgaatatttaaattaaaattttaaagcactacatttttcagggtaaaggttgacaatcagcacacattacagaacaacaagatggtgagcaatttgggcatgcctatgtatcattttgacatacgcgtgaggattttcattggcctcaagtttgcagctgaagtaaaagcatcgtggatgaattgagcatttttattattatgtcctgccagcttccagaaatgattcaaaacctcttggagctacctaatctataaggctgttaaaggtagaagagcaggtgcctagaggtgagctgtgacttgcagagtgccaagccagttttccatgcagtctttatcatcagtggtagctcctgacaccacagaacttgaaattgccctcaacccttcctttacaaatgctattttaaagaataatcttacataggcactccagatgaaggtggacctgtgaccataacttcctctcctctattcgtgctttttaggtcgaaaagtccaattagaatgcatctttt

SEQ ID NO: 42298 - DNA, 1029 bp, Homo sapiens
atacacgtatgtatgtgcatgtgtatgtgtgcgcgcgcatgtgtgtgttgaatgtgagggagagagagcatgaaaaaaacctcattctgatactcaaaacctccttctagggtgtggtcaggtggatatgaattgtttaacaacatctgagccacatttctcagccagcttctcctagaagcagatagtatagctcttcaaagcatggtctctctagtcacaccaacctgatacaggattccagctgccccactttctagctgtgcaaccttgaacaaccagtttgtcagtaaactggttataaacctgatattgcacacatgatatcaataaaggatagcttattttcttgatgcctggctaaaatcgacatatgctggaagagcaaaggttactgcccagacgctcttctctgaattcaggatgttgacaagttttgtttgacccatcttatttagtttttgttttaaatttgaattaagtaattttttgtagaaatttgaattaggtcataggattaaggtactttcacaggaaatccaggtattctccagttcccttagtgaaatgaaagctacagcaatactggggtcctgcactgtgcatggcagcctctggcagaagctgagcagtcgctgctctctgtggacagggccttgtcacattcagtcctgccttctttctccccagccctctccctcagtcacctgcctgactgcttctagaagaattttaatttgcattaccattctgctccaggaaggtagagtaaggtaggaggaaaagcagaaatcttgaaactgaagacgactctcttctactttttaaaaaggttagtttaacatgactttttatttaatgaagtcatgataatttgtcatttacaaggatccttcaggtctatatagttaattaaacaaatatgtaaggagtgcctactttatgtactttgataaaaggaatataaagtaaacaaaaattttaaaaaagacatgacctctttacttattaacacttagagtccaatga

SEQ ID NO: 42299 - DNA, 1073 bp, Homo sapiens
gggtgcatatctggtgccgggcacatggtgcactaagtatccagagatcaacatcatccactctgaggaccacaatgcgtagacagatgagtaatctagcaattaccgggtagtggttaggttctaaatagaagtttgcataaagcactcagacatcacaaaaaggtagcatgtaacttggaccagagagtccagaaggtctttcaggaaaaagtgacccttgtactgaagctacaaatagaggtaggagttcagctggcaaaattagggcagagcgttagggaagagaattcactatgagaagacacgggggctgagcatcgtgttaatttggagagctgaaagtgttctgatataagcctctccttataaccgtatactctactgtcactcccaccctttctttacttggcaaaccatgactcagtgttccctctcccactaaaccaccctctcccggtagcatttctccctgcacccagggagactcaagcctcccttctttaggctctgacctcactctcccataccatcagctttgttttgttgaaggccattcatcaccacccctgttcatctgcatcactagaccaggagcacttcaaggcagagtccaagtccttacatcttctgtgaggagtacaataagtgttagccaaataaagagctgaaccaataaaagaaacaggagatggacaagccacagacacaagtttagggtaaatctgcttaaatggatgtgtagaagacttttcagtatatcacagatggaaaggggcttcaagtgtcatgaacctgcttatttacagagctggggaccacattttaagtgttcgtggcacctcagttgcaattttctttttgtttcatttgcaaaagataatttttgacttttagaaaacattctttttcttctaacttaaatgtgtcttgttaatggaacttgttagtgaattaatagaaatgaaaatctggcatcagagaccatacatactctccttagtgcacaggtagccagtcattgctaatcatacattaaacccaaacaattttttccaaaatggcttttacag

SEQ ID NO: 42300 - DNA, 1046 bp, Homo sapiens
ggtagatgaattatctctcaaaacacaatgaataaaggctgggagcatggccatgccatatctgttgtggtgaggaaaatgggaaggggattctgaaagtaactggcctttttcttttagacactgagccacatccataccctaaggcacagatcccatgttaaacggttatttccatcatggcagtgacatttactttaacaacagatttcattatgtctttaacaacaacaaaaatgcactgaaaagcctgaaacacacacatacacaactcccaacacaattatttttctgtcttctctgaaagaatattttaaaatcatttcaacatctttgggatttcagaaaaatctagtattggtttacaatggaagtctcatagagtttatatatatgtgtgtgtgtgtgtgtgtgtgtggttattattactcagactataaatgagacaaatgaatagaaatattaaagggatcaatattctggccctcattatattgttatacagcatatctttgtgtatctctatgtgaattctctgctagtcctcagctgtatttaatccctcaagacttgatatacaaacataatgccaaatagagaacttcccttaaattattcaaatctccccataagtgatttcccactcttcctgcaatagaaaacatttgatcataaattcaattaaatcagccatcatctttgtgatgtttgtccagctaaatcctttagtgactaaaccaataaacataccagctgtgagtgtgcatgtgtgtgtgtgagtgtgtgtttatggcacaactattgcaaaagaatcgatttgaagtaaagatgaagggtagttctcatttcttaggccagattttaactacttcactgaagccagggcttaaaagattaaacttttagggataaaatcatgtgtacttctttaaatgctttggcttttatttgctaatttagaactgagttttaataagttttagatcaaaactgatgtactttggagatgttaggaaaaggcatcaaaccacgtcaaccattcttcc

SEQ ID NO: 42301 - DNA, 1027 bp, Homo sapiens
tcttcactttccagtatggtaaccactagccacgtgtggctattgagtaatttaaaatgtggctagtgcaattgaggaactgaatttttaatttcatttaatttttattagtttaaatttaaataaccacatgtggctagagactaccaaattgcgtggtgcaagatagaacataacttctgatcagcttgaagcaagtgttttaccataatgtgttgtgaggtgaattaggattttcagctaaaaacctcctgcccaagtttttatttttgcacttatttctttattatatagctataggcttaaatccaaatcctatgactctgccccaggatttgctttctctcagaacatccgagagattttccattttcaaattcttcgattttgttgaatattgaatgtctctctcttgggtatccagaatggagtttcaaagcatggcatttcggcagcactgattctgtaggcgctggccatttcacagtctaagctctgtcactcgtcacctgtttgtatctagtgttcctaaatatagaaacacaacttagtaaatgtgctaaaatgtgtcgggctacatagaagcttgacacccagctcattaactaagttggttttgtttgtgtgtgtgtgtgtgtgtgtgtgtatgagcagctgtttacattgactacaaataaagcgtaggtttgtatcatcctttttgaaatgacctcaatattattttgaaaatgttcttgtcgccaggtgtggtggcttaagcctgtaatcccagcactttgagaggccaaggtggacagatcacttgagtccaggagtttgggatgagactaggtgacatgacaagaccctatctgtaaaaaatttatctgtaaaaaaaatattttatttatttatttatataaatatatatgtatatatttttatatatacatatataatttatgtatacacatatgtgtatacatatatgtgtatataaattatatatacatatatacatatataatttatatacacatatgtatat

SEQ ID NO: 42302 - DNA, 1047 bp, Homo sapiens
ttttaggctcagctatgtgaaccatgcagaggacctggcctccaagctcctacaatgttccccaaagaacagactgtcggcacaggctgccttgagccacgagtattttagtgacctgccgccacggctatgggaactcaccgacagtgagtatgacaaatccacaacatccagtccaagcagacacatcattttattttggcatctgtatgtaacgtgtatgcagagattcacatatttgtgtgtccacaaacataagataatgtatgtttgtatgtgcattacaggtgtgtgtgtgtgtgtgtgtgtgtatgtgtggagagagagagagagagagagagaacaggggaaggggggccatgtgtatatatatttagtggaatcctgccattcatttgctagcttaccagacacaggaagaaaatggattccttttttgctatctctgctctgcagtctgcagctgtgcatctttgtatttgattatgtgtgtgtccaaaaaaatgatctgaacagtcataaaggaaaaggaaaatatgatttacatatttagtgctttatgcatacagtactttttaactggctgcagtacacagaggagccgatgattcatttctgtttgattctcagagaccatcttggttgtaacaataaccttaaaaagggctgctatgcagcgagctgaggagcagagttggcaattggctaatgcactgaattgacatgtacagactgaagacatgtaattcattttaactgcaaatgctcttggtatttgtacagacagctcttctctgaatcttttaaaacacattcctgggtgggttttgttttgtttttataaaagtctacatatttatacagccttttaaaattacattttaaatatttgggggaggatttatggctgggaggatctcagatttcttccagagtgtgaaacagaattcttgtgaaattttgtaaaaactattgccgtcagaatatttttgttcaatggtgatatgttctttccaaagaacaattagagatatttcttctatactc

SEQ ID NO: 42303 - DNA, 1044 bp, Homo sapiens
aaataagcaactctagcaatattgccttcacattcctaccagaagtgtttgcgtgtaactgaatcattgctgcctcctttggaggggatgtagactccccagtttagtttagctcccatctgggccacttcacctatttctgattcctgtctggctcctggtacggaccttatcatgatgaagcttttctctttcactatcaaattctttgtcctctactattgtgcagataggaagcataatctaaacttggcaacctctagccatgtcagcctggcccagtcatcacatcacgtgtgctacgtagtgaccagcctgggatggcaacttctgaaaaggccatctttcttgattgccagatggaaatgcctagtatttttggaaaatttttagtgtgtgtgtgtatatatatatacatacatacatatatatacatatacattcttaatgtaacacaagtctctgaaacaaatagagaacaaatgttactgtggagaaggctttttatgtgctgatttgtagagaaaagtgtgtctttgttctgatattcagtaattaagtgttcaggccagacatggtggcacatacctgtaatcccagcactttgggaggccgaggcaggcagattgcttgagctcaggagttcgagaacagcctggacaacatggtgaaagcgtatctctacaaaaaatacaaaaattacctgggcgtggtggtggcatgtgcctatagtcccagctacttgggaggctgaggtgggaggatggcttgagcctgggaggctgaggttgcagtgagctgagattgcaccactgcactccagcctgagtgacagagccagaccctgtctcaaaaagtaaataaataaaataaaaagtgttcaagtaactcaaaggatatatgcagcattgcagtagttcctcttccttcctccctctcttagtttgaaatatgttaacaggctaaattgatagcatggtaaagagagcaaattttaaactgtacacattgtcttgtgggtaatctgccagtatcttgagctac

SEQ ID NO: 42304 - DNA, 1029 bp, Homo sapiens
tgattattttcaacttagcatattatctttttcctcttcgtcattttacttcatcattaatgctttgaataaatatcattacaaaaaaatcaacaaaataatttaatttggatgtagtgtgaagcatggagcttattttacttcttctttcctttatgaataattttatcttaaacataagaatatcaaagcattaaataatgctcatcaactaagccaagtgcccagtaagtctagcttttcattacgagtaccaaatattactatctcacaagtccacaattaaggggtcagcagttcttcatcacatttagtgtgtgtgttcattatacaaataataaatgcattcatattgtaaagtatgcagataatatataagaatatctagtaaaagttaaagttctcaccctgcagaaaatcttgatctcttcactattgatagtttatgtgtatcttttcagatcatttttgatatgcatgacaattaccacttaaaatttcaaagaatgttattacttgaattttactcagattctaattatatgaaattcagttcacccaatctgaaagtgatattcatatgagaatcccaatttttttttcaccagatatttggaaactttcctattgctagaagaaataaacacaaaagtagaatgctgtaaagagtgtcgatgtatccagtactactattgatttttcaacatgaaagcatgaattttcttgtatggcttgtggtatttttctcactaccttatcaaaaatgttctactgtgtttcaaaaacaaacctgtccttctgcctacatagcgtaagagttaactgccatcacaataccatagaaagagtatgggttttggagtaataaaacctgagtgttagtttcaacttcaccctttaatagctgtgagtcgttaggtaaattatgtgtattctcatcactttcctcatttcctcatcactgaataaggaatagcaaaactagccatctccttaggattgttttcaagaacagatacattgcagttt

SEQ ID NO: 42305 - DNA, 1117 bp, Homo sapiens
gcctgcagtgtgtgcagtactgtgccatttcacaggcatcacatttgccttcagtgaatgtgccatagggaactctacatatgagaacatatttcaccaccaagtcttctgattctacaatttcccctttattcattcaacaactgtatattgagtgcctgagccgggcctgggctgtgctctggggacacagcagtctacaaaatcaagcttaatcaagaacatactgatgccacctgtcccctgacttgctccttcacaggaagtgtcttcacacctctggagggactaaatgaagtctctggttcaggaagtcattgtgggtaccaggtctccattctgttgattaaaatggtaaaagaggagagagccaggaaagactacatcatttggatatagttgtaggaacttcatgcctgggcaagcagatatcaggacagacctaaagctcccatttagctggagtgggcaggcttccaggaagagctggaatctcaactgctgtttaaagtacatggaagaaaaaggacagttttgtcatctgcttaataaaaatgtgaaggctgatagtggggttgaggattggctgaggatgcctgtggacaaatgtgcttgaagtactatgaggatgagtgctttctcttcttgatgtcatggtcctcaaaaagatgccagtgcctagatcagaatgcatagttacatggagcagcatgtagagcacgttcttcgtttccctgaaagaacaagggtaggctggggacaaaggagtttgttcccatgtaattatttttgctagggtggtgacttctttaagaagaggtttgataaaggtatatctgcacaatcaagcaaggatgaggagtggtcaagtgagccttatggagaactgcccacaagcagcaaggatttgagataataactgttgggatgtagaggtagcaaagggcctatgtgtggtatccatttacccccaggcctctcctggaaacttaaggcttttgtttttgaggacagagaactctcaagaatagaaggttacccctacctcataccatatacaaaacttcactcaaaatggaccaaagatctaaatgcaagggctaaaactataagactc

SEQ ID NO: 42306 - DNA, 1061 bp, Homo sapiens
aagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggt

SEQ ID NO: 42307 - DNA, 1048 bp, Homo sapiens
tagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattcaggaat

SEQ ID NO: 42308 - DNA, 1050 bp, Homo sapiens
aatgaagcaaaacatggtgtttagagagagaatgtggaggaaggaacgtgatgccctgtcagtgaaactgaaagttgaatgatagctcatggaaagaggaagtgaaaaaggtaggatacatccaagtgattgaaatatgacaagaatggaacaaaaattttttcaaacaaaaacatctcttattttataaataaaaaggttcatagtaaaagctaaactatgtctacaaaatatctattataggctactgaatattgaaatgtaaatgaatttcttctaatatagctagaaaaggttatggtaaattgctaaacaataagggacattatttatattcatttcttagtaagattccactaaaattaagattagtcactttatgtaattgcttaacatccatttaaaaactataatttggaaaagctacggaatttttcaaaacttatttataaaagtggtttggtgtctggggtgtgtgtgtgtgtgtgcgtgtgtgtgtgtgtgtgtgtgctggagagagggagaaagagaatttataatactgctatctggtctggtagaaatggcactaggactttggagacatttatgtgttcatttgttcaaccaacatttttgaatgcctacgactgcagctatgaacttttacttagcaagcatttttttttccccccgagatggagtctcactctgtcacccaggctggagtgcagtggcacgatctcggctcactgcaacctccacctcctgggttctagctattctcctgcctcagcctcccgagtagctgggactacaggcgcccaccaccacacccggctaggtttttatttttagtagagacagggtttcaccatattggccaggctggtctcaaactcctgaccttgtgatccgtccaccttggcctcccaaagtgctgggattacaggcgtgagcaaccgcgcccggccgcaaacatttatttaaatgatcacaaattctgtgccttattgtctgttggaataatcttatgatgtgtacctcaacaggtgttttgaaggataaatg

SEQ ID NO: 42309 - DNA, 1049 bp, Homo sapiens
attgtacttcagcgcttttttcttcattactttctgtgtatatagacagcatatttttttttgtagaacattaacccagattgctaatagcttcatgttatggcattcttccacacagtccagattgatttaaggaaaagcagaaatggaagtcaaagtgtgttataaattgagactgaaaaacgtgctctaaaaaaatagatttaatttcttacactgtgaatagccattgtattgttttgtttctgataaatcagttgttttgggcttctatttttgaactgttaaaaaattttgatgctttttgtggataaaagtagtgcctctctttatacaactgatggggttttgaaaagtatgtaagttgccttttttgttaaacttattttaaatgctttagtatttaaagggtatatgtttttaattaatctgcatatttaaaaactttttgtaacgcgaataactacttcctgatttacatctcaatatattctcctttcatttgcccaattaaaaaaatatgtagtctctattattgctgtttactaatagttttagatcccaatgtgtattagaattatagctacaaaaagttgcaagtaaaatttaacaatttcctattgaaacaggatctcattattatgtttttaaatgtgtagaattaacactttaaataaacaggtgtgaaaattgtaaaggaatatatatgacaactattttctgtacattaacgtccaaacattatacttgtttttcataataaaaaacattttgaaacaaaatttgctgagtttagcataaaagcatctttgaattatttctgagtttcctaaaatatgcaacattttaatcttggcatatctaatcctatgtgctgttctataagaggtacactggacttctaaccactatatgtatttagtagaataatggaatcacaaaggaacaagaattccagacttatagtttgaaatgtatcataaacaaccctttcatattttaggttagtagctttggatagctatttaacacagatgagtacagttagc

SEQ ID NO: 42310 - DNA, 1061 bp, Homo sapiens
tttgagtcagatattgttgttccattttattttgctgcttactgcttatgatcttgggcagataacccatattcatctttaaatcttggtttccacattctttcaacatttcctgacttctccccacacgaccccatttaaattaaattttttctgtgtgaggctctcctaatacctttttcttcaaagcactttttatcacttgagatgatatatttctgtgtttatctatatttaatttgtttttcccacctgtattacaattcatgagagtagggtttatacctcttttattcctcactacatgtcttactttagcacaaagttgcatgcatgatgggcagtcaataaatatctgttgaataaataaactacttactacctgacatatgccaagttattttcttcacaggtaaaactctacaaccacatctcttttggaaagacttatatgaagaaatcaggacaagggaggttcccataccacctccttaaatatatataggactgctgagtttatgaaattgtgtattaacttttatctcatttatttctcacaacttgatgaaatgagagactgttattaaataatagtagactaaagggtcctactgttaagatcatatattttgacacatgtctagcacagtgcctggcacataatgaacaatgaacactcaagaaactgaagagattccaaatagttgatttttttgaattgacattataaaaacttggctttttttttttgagacggagtctcactctgttgcccaggctggagtgcagtggtgccatctcagctcactgtgacctccgcctcccgggttcaagtgattttactgcctcagtaaaatcccgagtagctgtaatcccgagtagctgggattacaggcgcctaccagcacacccagctaatttttgtattttagtagagacggggtttcaccatgttggtcaggctggtctctatctcctgacctcaggggatccacccgcctcagcctcccgaactgcagggattacaggtgtgagtcaccacacctggccaaaacttggca

SEQ ID NO: 42311 - DNA, 1025 bp, Homo sapiens
ttcttttatttagacatgacattttcagttcttacccctcaatatttcagtaggtttattcagaaatgtttctttgcattccagtagttacattaaagactgtaataattgttctttattttttcatttttatttagtgatagtttgatctttaaaagagagactcccaaagctgcttttttcttggtggcaataaagaaaaattatctttgacaataacggttattttcttttttcttagcttgcccagtttcgacaaagaaaagctcagtcggatgggcagagtccttccaagaagcagaaaaaaaagagaaaaacgtcaagcagtaaacatgatgtgtcagcacaccatgatttgaatattgatcaatcacagtgtaatgaaatgtacataaatagttctcagagagtagaatcaactgtgattcctgaatctacaataatgagaactctacatagtggagaaataaccagtcatgagcagggcttctctgtggaagtaagtattctcccagatttttaatcattatggttctcgatggaaagtagtcataacaacagtcattagcaactgtgcgcaatttgatcatgatttttatgtcctcttgaaagttttagtagtatggtaactaaacagtcataactaaaatatttgatcatctcagagagggagttttgtgagtttaatttaatatatgttgaacaactgcagtacaccaaagactgagcaccagagttacaaagatggatatgactatctctgccctttaggaaaattattctagtggagaaggcagacttaaaggtatgcagtgtgctatgattagacctttgctagtatgagagatagatgtccaacttcattttttttgtttgtggctatccagttgtaccaataccatttgttgaaaagactattcttttcccaatgaactgtcaatgaatataaaggtgagggtttatatttatcccctcaattatattctgtagatctgtatgtttagcctttgctactatgcccccaa

SEQ ID NO: 42312 - DNA, 1066 bp, Homo sapiens
aaccaagtgcttatatggtttatgacatttattttaacctcgttaattacttgactgcaactccataagtcatttaggcacattgaactcttataattttcatgaacttttatgagccatcagatttttattttttatgaaaatattcaatattaatgtttttaatttatatatttccaaattaagtacaagaataaggtattaatcataaataaggatgagttgttcttttatatttcatcaacctaatgttcaccacaaggatgagtttttatgtgaaggccattttatagtcacatagtgaaagttacctttcctctgattctttctgaatagcaatgttgttatgatgtgatacctctataaaacattttaaaatttaaaatgtacctcacttgtactttcccagatctttaagttatctgtacagatagagtaaatttttctgtgaatgcagaaagaatacattaacatagtctgtaggttaaataacttcaacaaatgccacaataaaaaaggacattgagagaagttgagcttttttcagttgaaggagtctgttaatctaatcttcatgtttcaagtcatttatttactttcatatgaaggtttacttagtgttagaagactaatgttagaagaggagataaatactctaccctttagttatcaataaaataattatctaaatttaaaaacagaataatttattgttaactattaatgatcctgatattctgttaagtgttcctgttctaactttggaatatagtgtgttttagtttagttctggtgaataatcttttatagccaatttgtatgatgttaaacttttcagatttattaatattgataagttttacatttattataacataaatatgttttgaaacagtcatgtattaatggtattttaagaattcaatacatatgagttcaagtataacatttgcttatctgaattagagaaaaattaaacagcagtggctaaataaagtactagatgaaactataaacataattattataaaatggtaactgataactgattcatgtaatactgaca

SEQ ID NO: 42313 - DNA, 1057 bp, Homo sapiens
tatgttggcatttataaatatgtaaacatatttctctttgcatctttaagttcacggtagtgagtataattatttggtagaattatttactagaattatttttaattgagagaattaaaatttattttttgctgaaagtatgtagaacttttctaaaaatactgatactttggggagattttgaggtagaagtttaaaaataagtggtgtataattaatgtaaataaatgtcatattttgcttttaaatgtagttttctggtgaatttggagtgaaagaggaaacaaatatcgttaagttgcttgaaaaacaataccaagaacaattagaagaagaagtagctaaggtaggcttatagcttatctggaagattatcttggtttatattccctttgagccttcaaaaagaacatagattttatcgatggtatgtactttataagtttcatatatagttcatctttaagtgattggataatatcaattatagttgcctttaaacaaaatatcttgtgaatttttatttgagaagagcattgttcttgatgtagactagtaattagaagcttttcagaatgccaaaacaagtctatgtatttgttgccttgtgaagaagtttggtcttccttaaaagttgggaagaagataggaaaagaaagagaaagtggttggtcctctgtatatattatctgtatctatttccaatcagagaagttttgttaggtaatgactacagatactaagggaggattatcactgagtattaattagctcctggctaagtgaaggagtttatcaatgtgagttttgctcatctctgtatgcttatccactgtgtccagagtcattctttaatattagccatataccctagtgtaacattatggttccatttgttttgtctttgtattccttttcaaaacgtgtatacctgattggcttttaatattggaactggccgggtgcagtggctcacgcctgtaatcccaccgctttgggaggccgaggcgggcaggtcacctgaggtcaggagtttgagaccagcttgaccaacgtg

SEQ ID NO: 42314 - DNA, 1078 bp, Homo sapiens
gcctgacttatgaagtgacattagaggaaaatcctaaaggaagtgagggagtgaatcaggaagatatcaggttgaggaccttttaaagaaatatgaaagggaaagtcaagagagcaagagaaaaagaaaggtcaaaaattactctaacaggtgtctttaagacacggtcaggagacttgactagagtttgtggaggctgcttgcccagctgctacctctggtgagttggaggacaattcagtttaatcctgcaactcccatattcatggtgaaatattgtgaaatcctggcacagatttgtcttttctgcagatgtaactggatacaggaggaagaaatcagggaaagacagcaagggctcacacttccggtgaatttatataggtagagttgtattgtagtgtatatatctatatatatatatatatatttttttttttttttttttttgagatggagtttcactcttgtcgccaggctggagtgcagtggcacaatctcagctcactgcaacctctgcctctggattcaagtgattctcctgcctcagcctctcaagtagctgggattgcaggcacgcaccaccacacccagctaatttttgtgggtttttttttttagtagagatggggtttcatcatgttggctgtaactcctgacctcaagtgatccacccacctcggcctcccaaagtactgggattacaggtgttagccaccatgccctgcctgtagtattcttttatcatttaatgtctgtggcatctgtagtgttatccctatttctcacctttttgtcagattggctagaggtttattgattgtattgataatattaaggattcagctttttgtttcattgttgtttttattgtttttgtttttattttcaattgctacccatatctttttgatatcctttttctgcgtgctttggacttaatttgctcttcttctgcttttctaaaaggaatttcttttctaatgtatgcatttaatgctatactcgaaagcatagcgttacagctttaaacattatagcttgtaagtatagcaatgcttcctcgtaagcaatgttt

SEQ ID NO: 42315 - DNA, 1033 bp, Homo sapiens
gaggtactgccctaaaataaagtaaaattttcaaaatgtaaatacatatatattatgtatgttacctttttcattaattattaggttattgaagaaaaaaatgaactgataagggatcttgaaacccaaatagaatgtttgatgagtgatcaagaatgtgtgaagagaaatagagaagaagaaatagagcagctcaatgaagtgattgaaaaacttcaacaggaattggcaaatattggacagaagacatcaatgaatgctcattccctctcagaagaagcagacagtttaaaacatcaattggatgtggttatagctgaaaagctggccttggaacagcaagtagaaaccgctaatgaagaaatgaccttcatgaaaaatgtacttaaagaaaccaattttaaaatgaatcagctaacacaggaattattcagcttaaagagagaacgtgaaagtgtggaaaagattcaaagcataccagagaatagtgttaacgtggctatagatcatctgagcaaagacaaacctgaactagaagtagtccttacagaggatgctcttaaatccctagaaaatcagacatacttcaaatcttttgaagaaaatggcaaaggttccataattaatttggaaacaaggttgctacaacttgagagcactgttagtgcaaaggacttagaacttacccagtgttataaacaaataaaagacatgcaagaacaaggccagtttgaaacagaaatgcttcaaaagaagattgtaaacctacagaaaatagttgaagaaaaagtggctgctgctcttgtcagtcaaatccaacttgaggcagttcaggaatatgcaaaattctgtcaagataatcaaacaatttcatcagaacctgaaagaacaaatattcagaatttaaatcaactaagagaagatgagttggggtcagatatatcagcattaaccttgagaatatcagaattagaaagccaggttgttgaaatgcatactagtttgattttagaaaaagaacaagtagaaattg

SEQ ID NO: 42316 - DNA, 1017 bp, Homo sapiens
actccatctctactgaaaatacaaaaattagctgggcgtggttgcgggcacctgtagtcccagctacccgggaggctgaggcaggagaattgctttaacccgggaggtggaggttgcagtgagccgagatggcgctactgcactccagcctggcgacagagcgagactccgtctcgaaacaaaacaacaaaaaaaagaaagagttaatttgaaatgaaccccagtcaagaatctttaatagtttatattttcctcttagctagtttattatatgcctcaacttatcagtagaagctgtttttctctctctcattatatgcttcgtcaacatagctttatggaaattcatttgtctttctgacttaggttggaagttaaagataagacagatgaagtacatttgcttaatgacacattagcaagtgaacagaaaaaatcaagagagctccagtgggctttggagaaagagaaagccaagttgggacgcagtgaagaacgggataaagaagaacttgaggtactgttatctttgtctttaaatgtctggaaaatccagaatgatagaagagggtcttaaggctttcctccatctaaaatgtcaaccttagacttcttaataagatatggtaagttgttcactgtgcattgaatactacataaaccgtattatgaggaaatgctaatggagtggtgattggttttttttgtttgtttgtttgttttgctacatccaaagatgcatatagactgctctgctgcaacatgttttgggcatgtgaattggtacacacagataaatatggcaatcctgtcagtttaatacagaggtagttttggttcctgttttctcctagggaagaggaacagggatacttttctggagccctcactgcttaagaacatttaaagtgaacattggcccctttcagagagacacacccctgctttgcaaggctctcagctcaaggcaggctgctttgagtatctgcttttaatagaggtggagtatacatgaag

SEQ ID NO: 42317 - DNA, 1028 bp, Homo sapiens
ccttcttttatttatatttcatgattatgcactaactactgaacatttaagttaataaactaaataatcagttctattttctaataaagatactaccaacatagtattaataaaggcatggttgtatacttctgaagttttttttgtttttttttttttttttgagtcaaaagtctcactctgttgctcacgctggagggcagtggtgcaatctaggctcactgcaacctccacctcccgggttcaagcaattcgcctgcctcagcctcccaagtagctgggactacaggcacgtgccattgcacccagctaatttttttgtatttttagtagagacagggtttcaccatgttggccaggctgggcttgaactcttgacctcaggtgatctgcccgcctcggcctcccaaagtgctgggattacaggcgtgagccaccacgcccggccaagtatttttaataatattaacaagttcttaaatttgattttctcgtaccaggatctgaagttttcacttgagagtcagaaacaaaggaatcttcagctaaatctacttttggaacaacagaaacaactactgaacgaatcccagcaaaaaatagaatcacagagaatgctatatgatgcccagttgtcagaagaacaaggtcgaaacttagagcttcaggtacttcttgaatctgagaaagttcgaattcgggaaatgagtagtaccctagatagggagcgggaattgcacgcacagctgcagagcagtgatggtactggacagtctcggccacccttgccctcagaggacctactgaaagagctgcagaaacagctagaggaaaaacacagtcgcatagtagaattgttaaatgagactgaaaaatataaactggattctttgcaaacacgacagcaaatggaaaaagataggcaggttcacaggaaaacactgcagacagaacaggaggccaacactgagggacagaaaaaaatgcatgagctccagtccaaagtggaagatcttcagcgccagctg

SEQ ID NO: 42318 - DNA, 1031 bp, Homo sapiens
atttccaagggtatagcaaacaagctgaccaagtgttatttagtgtatgctatggttagatattgggaaaagtattgactaaaattgatactctgatcattatgaaaagcttaacagtcttcatgacaagatacatttatacatacccaatttattgagacctctgccacaagcattgtattggacattcttatgttgacttagtagcatctttgaattcattggagagttgtctctttctcatcccaagctccaaagctgaagcttggaggagatacattatgtgtgtacaagtgacccacctttttggggaagggagtggaggcaggttggtaacttatatgcatatttctggataacttgattcatgtacatatttttaatcctttaggtacccaggcactccagctgatttcaatcctggttctttagcatgttctcagcttcagaattacgatcctgacagagccctaacagattatatcactcggctagaggcactgcaaagacgacttggaactatacagtcaggtgctctgagtttaaccacatcttggcagcaccacagtgcgagacccacagctcccctttctttgaaattctttcacactcattaggataatcaaagcttccagtttagtgcatgagctaattattaagttagccaaagcttaaactcttgtaaccagcagagaaactgactttaaataatttaagtgaaaatatgatttatcaccccagatcccactcctcccaaaaatgatttcctactatgttcattcagcggactgatgacacaaaatgcacaatgagcaccagtgtgcaaggtactctgagtctacagagcctaactggagaacgtattcctaagtagcgcatggcagaaagtggtaaggccgtgccgcagcactccagcctgggcagcagagcgagaccctgtctcaaagaaaaaaaaaaaaaaaagaaagtggtaaggcatgcaaatcgggtggagttaaggaggaagcacttactttaagcacttaatgtaa

SEQ ID NO: 42319 - DNA, 1007 bp, Homo sapiens
ttcaaaatctcttaaaagtcagcttaagtatatgggctgggcgcggtggctcatgcctgtaatcccagcactttgggcggccgaggcaggcggatcactaggtcaggagttcaagaccaaccagttcgagactagcctggccaacatggtgaaaccccgtctccactaaaaatacaaaaatttgctggacatggtggcatgtgtggatagtcccagctactcaggaggctgaggcaggagaatcacttgaacccaggaggcgggggttgcagtgagccaagatcacaccactgaattccagcctgggcaacagagtaacactccaccttgggggtagtggggagagactcagtttaagtatgaagaggacattttaaggaaaaaaagggctttaaaaaaatggagaataataataatttcctttgtgtgaactctggtgggtctgatacaggtagcaatgtaatttgaaatcagttgaatttcctgtttttctctcataggttcaactactcaatttcatgctggcatgagaagataatcctttgaaacatcattaattgaagtgattttaaatagatttccttttgtaaatcaatggttcttttgtgcttttgtattgtgaatattcaatgggaccaatatgaacacagcttatgattgtatacaaatcccttgccagcacatgaaaacaaactggaatttgtatatataagcattgtgtatgtattcatgcacaataattattgaattacctgtatatttgtggaatgctaatttaaaacattaaattataaaccttgtgtatttatcaaatgggtgaaaagattaaacttttacgcattacaatactgctgaatgtgtagctcgaggtgtcctgcacttttcttataaggctactgaagttacatgttttgcctaatatattctactggtgatgaagacagataatatcacttgtagagacctatttttgtataatggtagaagttttgaattttatggggtat

SEQ ID NO: 42320 - DNA, 1049 bp, Homo sapiens
tgtttcagattatcttaaaaccagagttcactgatctcacattttaaaaagaaaaaagtttgttaactgttttaatcaatatgagtagtaacaaacatccctaattggattctagagaggaagcagggaaggccaggtgcggtggctcatgcctgtaatcccagcactttgggaggccaaggcgggtggatcacgaggtcaggagttcaagaccagcctagccaacatagtgaaacccccgtctctactaaaaatacaaaaaattagccaggcatggtggcaggtgcctgtaatcccaactacttgggaggctgaggcagagaattgcttgaacccgggaggcagaggatgcagtgagctgagatcgcaccactgcactccagcctgggcaacagagcgagactccatctcaaaaaaaaaaaaaaaaaaaggaagcagggaacaactgagccaaaacaaaattatcccctaaggacttgactttggacttccacataaatgtgaccttgtagaactagatacatatttatcaggtaaataaatatgtaattatttagtaattagatcaagatacatgagcagtctttagcattaataattacattatttttaggaactcttatcaaatatggtcctggatctcttaatttcccatatgcagtgattttagttaaaattccaaaggatttctttttcctataatatctccatttctgagtatcatcataccaaaacaattagtattctcttattcaaggctttagatgttcgattattccctacccttccatcctcacacacacaataattgcccagataaataataataaactgtggtttccaagtatctcactgggatttttattctttataccttgcaggactagtccaagatttgaataccctgaacttatttggcaagagcgatgagtactcttaaaattactatctggaaattatattatttagaatctgccaattacctagatcccccctcaacaattgtttcaccaaggaacttcctgaaagcacatgtataagtatcataa

SEQ ID NO: 42321 - DNA, 1030 bp, Homo sapiens
tgaccctttagctgaacgcacaggaaccagagatgaaaacagcagagaaactgctagccaacctacagagttgtgaaaaataacatactgttttgagatactaagtttgggatggtttgttctgtagcagtagatatctgaaaccttaactgtgttcattttggacatatggatggtctctagtattctattatgaataatattgtaattaatatctttgtgcatagtatataccaatttaattttaatacttaatgctaaattatttttcagaaatattgacacaattctaattgtcaccattaatgtctgagagtaattattttctctataaactgtcactgaatgcttttcttttacaataaaatgagttttaaaaaaaagtttcctatggtgcatttccctaactacttatgaggctagctacttatgaggctagccatctttcaatatatttgttgggcattttgattttcagttctgtgaattgcttattcatatctttactcattttttcttgttggattttttcccttactaatatgttggtgttctttgatatccttattatggatataaacctttaacttaatttacaaataagttttgtaagtttgcttttgttttagtttatggtatcacttattataaatttttcttttggcatttcatgtaatcattgctatggtttggctatgtccccacccaaatctcatcttaaattcccacatgttgtgggagggacccagtgggaggtaattgaatcatagcatgagggcaggtctttcccgtgctgttctcatgatagtgagtaagtcacacaagatctgatggttttaaaaaggggagttttccttcacaagctctcttctctttgcctgctgccatccatgtaagatgtgacttgctcctccttgccttctgccatgattgtgaggccccagccatgtggaaccataggtctattaaatctctttttcttccctgtcttgggtatgtctttatcagcaatgtgaaaatggactaatag

SEQ ID NO: 42322 - DNA, 1057 bp, Homo sapiens
acctgtaatcccaacactttgggaggctgaagcaggagaattcacttgagtccaggaattcaagactagcctgggcaacatgatgagacctcccctctacaaaaggtaaactaaattagctgggcgtggtggtacatggcggtagtcccagctgctcaggaggaggctaaagtaggagaatcacttgagcctgggaggctgagggtgcaatgagtcatgattgtgccactttactccagcatgagtcacaaagcgagaccctgtctcaaaaaaaaaaaaaaagtcattttggtaaggcttttgctggctacccttttagacattgcagcaccacaaaactctccttgctggctttatttgagaaagaaacaaaaagcagtgattttagtttattttgttcctgctgcattccccttcgcctacaataatgcctagcacatgataggtggttgataaatagttgttgcaggagtttattattttagctgtgaagaagagtattcctttcctctgagaagtacacttgaaaaaatcctgtaactctagcgtagactaccagttattgacttccaacatttactctgctttcctttttctaaaattgataaagtccaaacctctcttgtttggatttgaaattactatgttttttggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccaggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaagaaaagaaattactatgttttttgtttgttttgttttgttttgttttgttttgttttgtttggcaacatactacacctggcataaatcctttcattctctctaagg

SEQ ID NO: 42323 - DNA, 1049 bp, Homo sapiens
aaagacttaaaaactttaagtagcttgtaagctagtaagttgtagagccaggattcaaaccaagatttgtgttcataattttctcaatatactataaggtctttccaaaatgattaaacttccaaaatctgtgatttcttattgtaaaatgtaggcaggattgtatgggaatgaaatgacaggaggtacataaaccacaggattaggtttttacacatgtattcttcaagctttattattaaatatgttcatttaacaacattatctaagatttaattctgtaatattaaacctgtaagttgcatttcttcaaagaagagcaatgttaatccattggttaacattttgtcctgtttttgtgtttacacagtacagttttacagtcagtttttgaaaggttggatttcataaagataaatgatactgtgttaaaagaggtaaagcttatatttcccactttccttaaaacatgtcttaacaaacctgatattttgctgggatttgaagggacctctgttccttacttgagttctgaaccatgtgagtagccaaaacagtaagcatatccagttttttcttcccagatttggtaatatctctggggtagctaaggtcaggaatattattgcaaatggaaaagaagtattactgtcaatacctctctcaagtttcatacttttgtttagaagttagtgtaaaaaagttgctgaaacaccgaagtatgatagattgggttctggctgatagttaccattatagtcatcaaaatacatacatacatacatgtatagatatagtttacttactcttatgttcagtgttacactgttgcttatgggtataatgagcacacttcccagaatatccaggacaagtatgatttcaagtattacttaatatagttggtctctgttaattatgtgtcttaatttgggatttggaaaatatggacggtattatctgtgggaaatataaagaggtataaaaccattgcccacaagtttacaatttgactggacaaataaaatattccttaagacagtgaacgt

SEQ ID NO: 42324 - DNA, 1056 bp, Homo sapiens
tgagatgtagtttggtcagtagaactctgaagttccccaggttattatacagccaaggttgagaactaccctacacaaagcctatgtcgaacactgtgcatattattttcacctgtgtttgttgttgttattgttgttgtttgttttgagatgagatctggctctgttgcccaaactggtttcaaactcctgggttcaagtgatcctcctgcctcaccctcccgaataactggtattataggcatgtgccaccacacccttcacctgttttttaaagctatgttttagtgtccagcctcccactgaattaatagagtaacatgaaagactgttgtattctctgcctctaagttttcctccctctattctatcttctacattgtcacaataattttctaaagcatgaaataattatatcattgccctgcataaaagcctttaattatctgttcttttcaggttaaagtgtaagttccttatctggtcccaacctattttttcttttatctcttgttaatctaatgctagagactctgaactctattcatacttaactgttccttgtgtaggcctttttttcatacctgcctttgcatatgctgttttctttgtcactaattttcatcatagctcaagaatagatccagaaacaacgtttattggaatagaatgaaactagcatttattggactcattaactaaggactgcagtaggtactttaagtaactcttataatcctcacagccatacctaagaaatggtcattttccatgctgtacagatgggaatctgaggcttttaggggatgaataacttgcttaaaattacataactagttgtaggcaaatacggtattttgaacttcatgtccagtgtttgtttctatgaccttcccccacccacttcacattgcttcagtagtaaataaattagcaatcacattgcccatgtgatgattatcataacctctttccagacatagtatgcataaacatttgatgttttcagacttaaattctgtatagcagaaagaaataaatttaatggtcttaaat

SEQ ID NO: 42325 - DNA, 1050 bp, Homo sapiens
acaattaacagacattagaaagtaaggtgaaatggagaaattggttgaaaggaagagagaatatattgagttttcatttagaaggctagatattgacatcctagcttatccacatgaaatggtaggcaggctgttgataattacaactaaagtgttagggaataaagaatatagacactcatttagaatttagaattgagtgttatctacatagagttgacagctaaaagcaagataatgtatagatgagagatgcaaggaaaagactttaggttatagataaaataacagagttaaagtcacagcatcaatttgaagaatgcctgtgttcaaagagatgagaacaagaagtagtgcctatgagggaaacacaaaaaatagagaaataaaagaaccaagatgatacaatgtcaaagatgcaagagaagaatttcaaggagaggagctgtttaatcatgtaatgtgctgcagaaagctaaaggaattggggggactgagaaacgctgatagatttgagagttaggaggtattaatgactttctggaatattgtttcattaaaatagtccaggtagaagtcatattcctgggcataattgagtcatttgctgaggaaattgagagacagttggtatcaataactaatttgagaaatgtgaaggccaagaaagatagaaaatttttaggaaagtaactagaaggatagcaggattaagttataatcctgagtaagtcaatccagagtcaccacccatttagagggtgatcaaagggatggggtagggtttgtcttgaatagtaggggttacctctcttaaagccccctacccctcttcctctggaattgtgaagggaaagaaaggcagaatagaagaacagatgtgctgcgatcatgataatttggtttcttttaaggtagaacattttatgtgccaccaagataggcttaaaaccatatttaagtaaaatattcagtcctcctattaagccctccttagctaatttgagactgggaaagcagatacttagttgagatgctttggttgaagca

SEQ ID NO: 42326 - DNA, 1022 bp, Homo sapiens
cttccatgccaaagataacatgcaggtggattttcatagccaagtctaatgctacaaacatggatccttccatttcataattgattatgagtttctctacaggtgccaaatggcagcaatgagatacaggtctttatggttccctcaccccaactgcagtcaaactcattagggagcaccttgcaaagatagtttaccaatcattctcacccaggttctaataatggtcagcagttaccttcaacgatgacttctcacacatcccctcttcacacacatttttttaaccccccaatgaatgaagtccacattctggcatatccttttaataaggttccccttaccaagattctgttagggtacagcttcttaaattttgttgtctttgcttttgttaaggaagactagggcattaagttaaagatgatttgtcttgttttctaaaatttaatattttttgtgtggtaatatctgttgcaaagtaaaccaaatcctgattttgaaagttatcccagcatgcattttagaaataattttctgggactctgaataaagaactcaagaataaagtcagctctttagttctgcagcagtcaggagcagatagtctattttgtgtttaggtgttggtaacctgtgaaacagagagggtagaaatagtaatagatcctgctatggatatgataagtctctggatttactataagttccccgtattgaataaattaggtaatataaatttatcagtttccacagccacattggttgtactttaggctcattgcttctcaaacatttttgtgcaaaaagaatctcttggagatcagaatgacattttgattcagaggcctgggcttggaggggtttggggatgaggctgagattcttcatttctaacaaattcccaggagatactactggtccccagaccacacttgcagtaaaaaggttctaggtggtaaatagcagctgctaagaccttgccctcggaatctagaaggtggctgccagaatgacaactt

SEQ ID NO: 42327 - DNA, 1296 bp, Homo sapiens
gcaaacatatatgtatattgaatttttaatgcaaaagtaagatcatgtcatatattgtattctatattttttcaacttaacaatatatcatgaacatctctcctaagtcagaacatacaatctacatattttaaacatttacctattgctaaacttctaagtaatttatatatttttacctttaaaaacaaggctgcagtgaatatttgtctgatatatatcttctttatccaattgtgccattattgtagttaaaaatacagattctagagccagactgagttcatatctttgcctgatggctgacttactatgtgaccttgagcagattatttaaactctctgcctcagtctcttcttaaaatgaagttaacagtccctacctcataaggttatagtgatccttaatgagttaatatatgtataagctttgaccagtgcctggctcattttcaacattagctaattgtctgctgctataatcatgattattacttcgtagtcgtcattattgcattgtttacacattttaaaagtatagttcctatatgtctttagaaattgatttgatgggccataagattttaaactttgtcagatgctcttaagctgtccggaaagattatattgatttacttttatttcattagtatattagagaatctttttctccacattcttgctagcattgaatattatcagtgttattatttacccagtttggacaaataaatggtaccttgtttatttctctgattatcgtgtaaattgactgttcagttgtgcattttctatgaagtttgttttcttaatgctttctaagagaactttgtgtatttttccatatcctaagttttttacttatatggtattcagagttataactttttttcctttttgtcttctgaatttgtgacttgctaatactatgatcacatgtccctgtatttttctagttttgtagattttttcaacccatattggatttgttttgtctactattttcacaatgtaaagagtaatactttcatactcaagtaaatacctatattacctggatgtttataacagtactatttgtaatagccaaaaggtgaaaacaactcaaacgtttatcaactaatgaatgggtaaacaagatgtgagatatacacacaatagaatattactcagccataaaaaggaatgaactactaatacacactatatataatatggatcaacctcagaaacattatgctaagtgcgagaagccagacacaaaaggtcacatttgaatgattccatttatatgaa

SEQ ID NO: 42328 - DNA, 1135 bp, Homo sapiens
ctgaaccattaggaagatttatagattgtatccttgaaaacattcattcatttttatacaggaaaatagttttgagtattatactgtgttatcaaatataatcccaaggtaatgaagttgatgtagattaagcagacggcataaatatttagcagtatttattaaatggagttgaattttaagaaggactatgttaggaatacaaaggtcattttctgagtatttccccagtaataaaagtaacttatgtaattgaatattacctaatgaaaaaatgaatataatttacaaaatatgtgacaggctaatttgcttgtgcttagaataaaattatattgaagcattatttttaactcctttggaggttcatcatcttccaagcaattaaacattcctgttcccacatcttctcttctcattctgttctcttcctgggaaatgttaccttctcccaagacttttggaaataatacatttctcccccctggactagacctctcttctgagctccatatttcatactgtatgtaattgcctatgtgaaaatccttccagtctatctcaaagctaccttaaactcatcgtgtttaaaactaagatcatgttcttggaactgaacctggttctctggtgttccctaactccatagatggcagcaccagccaaccaactgggtattcgaggcagaaacctggaacaccaacttcgacatttcctctcccatcctgtcatcacttaattgtcagtttcacctccccaatcttaaacttctccctttttcttcatttccactagctgctatcacctctcaactacactacagaagaaagtcagaataatcttatcaaatctaatcatgacaacctattcttcctatctctagtcccgatttttcattgactgcctatcactcctaaactgaaaatggaagtgtttatttttttaaaatcctgcatgactgagcccctgcctgtttctctagccttatctcatacagtgcttcccctctagtcccatgctatagctacactgacctttttaatttcacaagggtgttaccctccctcctgccacaggcctttgaacatgctgtattctatctttctagaatgtctttcccttccccttttatctg

SEQ ID NO: 42329 - DNA, 1029 bp, Homo sapiens
ttggtttcaaatctctgtgtgagcttggacaagttatataacttccttcagtcttgatttcttcgcctaaataataattgaaaagtttgctgggaggaataaatgaaattatgtaaaacacctagcaaagtaattgaatgtattagtttgttgtttttaaagggttaggtttttatggctctagacattatagtatgttttacttggcaatttttaaaatgttcacagtaggaagataattttttttagttaagccaggttcaagatcacttaatatagaatttatacctaattcactaaaactttatttataactctaatttcttcggaagtttcttctgctttcaagctgtttattaaatgatttttaggacctgtaattggcattttgacatatctatagtgaactatgtaatcattttacaacttgatgccagtgaggacagttaaaaaattatatatacttttggaaagagtaaagaagctaaattaaacctatgccagcgaaaatgtagtgaattccaagagtgatttgtgagtgacctgttttgattgttagtagaaagtactggaaattttgaccatactgctagatcttgacatggttgtaagccatgatcaattatgaaagcttaaattttgtgtaaaaacgctaataacaagaacatacctagacattcatttgcagttactacttttatatacttttttctttagatgaccaaaatttgtaattctcatatttttgttattatatagcttttataacattaccatattttcttttttgagagctatccattccatttttctttaagactgggacagggagaaattacttgaagcttggatgtccaacccggagaactgctgccaacgatcaggtgttcaaatgccaactccaccaccaagtgggtataatgcctgggacacgctcccatctccaagaactccaaggactacacgctcttctgtcacctccccagatgaaatcagcttatctcctggggatttagacaccagtttggt

SEQ ID NO: 42330 - DNA, 1050 bp, Homo sapiens
tgaattccaactctgctatttattagttgttgatttaggtaattggtagcctgcctgttcctcagtttcctaatctataaagtggtgataatagtatgtgcttcctaggattatcatcagttttttaaatttcttaacgtatgtaaagtgcttaaaacaggatcttgcatatagtaatcgttcaataaatattacttattatcatattcctaagcattgtaataagcagagagagcctacctatgatatcatctgtgaattttacctgcaagataaaaatataggtaaggtttgccccagatttctctcttttagtgacacttatcaactccatgttctgctcataaatttttattaaattgtgtcttgatgagaaataataatatggccaacagaactgatcctgtcttcaatgaggtcttctcagttctgtaatttaattccccagagatgattaaatcttctctgatatatttaaaatatgtaaaattcaaaacatcatcatgtagtaactatgtctaagcaaactgtgaactttgacaagggactatacaacttcccagggaatctcttcatagctaaaaagaggagaatcttgttatgtgaaaaaggaactctacagttaacagttctctacttttagtctttaagacttttttttttttttttttgagttggagtctcgctccgtcacccaggcaggagtgcagtggcaccatctcagctcactgtgacctctgcctcccgggttcaagtgattctcctgcctcaacctcctgaggagctgggattacagacacccggcaccatgccaagctaatttttgtatttttagtagagatgaggtttcaccacgttggtcaggctggtcttgaacccctgaccttgtgatccgcctacctcggcctcccaaagcgctaggattataggcgtgagccaccgtgccaggccacaatataccttatataccttgtatatcgctgcttagcacaggagtgaaaatggcacttgtgaaaaaatggataaggatctaccagaggttgaagaatg

SEQ ID NO: 42331 - DNA, 1018 bp, Homo sapiens
agggaaattctgctagggataatctgaaaaagtaaagcctagaaccttttggttgacctaaagctagatttgcttaccaatggagtgagaccagaatccaagatgagtatgtgcattcctttatgactaccatcagtgttcctgggctgctggggcatatgcttcttttataaacacatacatgtcacacatgagtattttatgtaggtttttagtttggttcaaataagtattttcatacagttacttaaaacagtttttgtcctaatgatccttctttttccttttttgagaaaaaaaatcattgtttaattaatattataaatggcatatttgcaaaaacaaattcactgtgcctcaattactttttagctgaaggaggctgtccagataccactttcattgaagatgcagttcatgtgctcttaaaaactcggcgcattctcaagtgttcttatccatatggatttttcttggaacctaaaagcacaaagaaagaaatttttgaactaatgcaagtaagatttttttaattacatttaaatggcagcagttattatgaaatacagaatttttcatttttgaaaccacttgttttatttaatgtggacatgattactaaaacaattttcttttcattttttaaatggtttttaaataaaggaaaagttaccagtaacaaattgaaattttctttttgtttaaatttgtcactctgcaggtctgaatgagttatgagtggtgcaaacatttcctgtagcatttatgtctttgttttaaactggttgaagtttgaaatcaggcatatttctgattatataattaaggattttatcatgaaagatgaaaacaacccacattacctataagatgagaaagttgctgtttaccagtttatttttgaaatacaactgaaaaagttacagtatttaaaaaacaaaaacacctaagccaattggcatcactatagccaaataacttcattgtgcatttcttttcttttgaagccactaaactt

SEQ ID NO: 42332 - DNA, 2037 bp, Homo sapiens
tatatcctacatttctgtcaaggatcagtattcattttctccgtaaagccttccacacttgaccccaatcactgtcgtcttgccttaattcaaattccttcagcacttttatatagtctgcactatggcatcatgcatttgcttgtatggtgcattgaaatgtattagtttttttcacatagacaaattataaattccttgtaaacagctgctatactcactacttctttgtaatctataccaatttcatttctataaatgcctatcaaatgagcgcttttttaaaaattcacatgattttatatacagtcctttctctttcataatctagaaaacatgtacaaaatagaaaatatattacataggaagttatttcaaaattttaactagtttcttacttcaaaagagttagatttaactgagaaaccacatagaccctggatttgctattgattaacctatgaagcctgtgattttttttttttctctgcttactatagacagacctagaaatggtcactgaagaccttgcccagaaagtcaataggccttaccttcgcacaccccgccacaagatcatcaaagcagcatgccttgtacagcagaagaggcaagaattcctggcatctgtggctcggggagtagctcctgcagactcaccagaagctccaaggcgcaggtaaaaaggacgtacactgtggaaatcatcctagctccagccacaaataccagcagttttgttttttatccaactagggttcatattcctggaaattatttacacctaaaatatggatagctcataaaagtatgttgactttttttggtgattttttttttcctccatgctatttctgtttttcttgttattttttgtttatttatcattgtgtagctccttagactaaattaacctaggttaatttcacatttcaggtgaactcataaataagagtattctaatgtatcatttcaaatatgtaatatatatagtgatttgatagttataaacatcttacgatgtagaatttggaaactttgccagcttgttatggtcatatttgtatttttgtattaagaagttgtgaaggaaagagaaatttgatatttgtagttatttaagtgataaacccatccactaaagatcagttgagttgtagttgttttattttacatactcatactacttctgtaaattgaagcatactttcctatttataataactataagcattaaacattcctttggcactattttacataaattcctttgatcctatttttacataatatttatgagtaaatatttacttgtaaaatacaaatagaagcattataaaatactttgttataacatggtaatttttattttttgatcattttacacaaacataaaaacttagaatttggaagaaaggaaaattatcattttaattctgttttaatagttgatctactttagttaagcaagttccaacagaggaattcaaagtaatgttcaaagggcaaggatctgattgtatatactttgtagtattgatattaaatcaaatggtatgtctaatttctttgtagctttgctggtggaacatgggattgggaatatttaggatttgcatcaccagaggtaattgttttatggggtttttgtttttgtattttttcttagtgcagtcgtgcttgcatttgcatccttatctattctaaatccttctgagattatcagcagtgctgtctctttcttttgtaacaaaaatgccttgacagagcctacatttagctatttatgtggtattgctatatcgtcacattgttaaatgcattactcttttattgtttttaattactgaatagtcagaattaaggcaaatttacaatatacatttttggaaaatatcttctaatttgttaatagagagaatttattagaaatgcatttctagtcataatattgttttaatctgaaactattaaaaatataaaagaacaatccattttttaaggttaatgcaacaacctgagggaactgatttataa

SEQ ID NO: 42333 - DNA, 1110 bp, Homo sapiens
attcttaccaaatcagcatgattttcaagacagtacagagaaaagactgctgagctgatgtaggagctttggctgcagtctctatggctttcagcaagccgtttaaccttactactgcttcatgactgtggctaacaaagtagggatagtacggagcacagaggatttttagggcggtgaaactattaatactctctttgtatgatactataatggtgggtacatgtcattatacatttgcccaaccccacagaatacacagcaccaagagtgaaccctaatgtgaactctggtctttgatgatgctatgtcagtgtacgttcatccgtgtaacaagtgtaccactctagtggtgggaggggttattgataataggggaggatgtgcatgtgtgggggcaggaagtatatgggaaatctctctacttctgctcaattttgctgtaaacctaaaacctctgtaaaaaataaagtctattttttaaaaagtggggatggtattacggcaatataaaatcaaaatactttatgaacaaatcttttctccagatgtaaactgtcatatatgcaccctcgtatgtgtatgtataattttcattcaaacgtgaaacaactttagaattggcaccaaacatataaacactgatacattagactatctcgaacaccttttactgaccactttgaaaacttgcttacctattaaggttcattcatagctgtgatgttctatttttattttcaatgtgggattatcttctgtttcccccagggagtatattaccaaattggtgatgttgtttctgtgattgatgaacaagatggaaagccctactatgctcaaatcagaggttttatccaggaccagtattgcgagaagagtgcagcactgacgtggctcattcctaccctctctagccccagagaccaatttgatcccgcctcctatatcataggtaagtttgacaaatggcacaggtttttttttaacttagttaactctccaatattatgtaaaagagtgtgttagtcagcttgggctgtcaggacaaaatatcacagactgagtggcttaaacaacagaaagtcactttctcacagttgtggaggc

SEQ ID NO: 42334 - DNA, 1068 bp, Homo sapiens
ctaacaaacacaagccaaggagcatgatacatccagatagtggaatactctgaaattgtaaaaaaaaaaaaaaaaaaaaaacctttctatataatgatgaaaaacctctgtaagatctacagtgaaatggaaaatgcagaggtgcagagaaatgcgtattacaggttatcttaaagtggggagaaaatgggaggaaggaggtggcaaagtgagacatattgaacagataaataaaaaacaatagtgattacttatggggatgaaaccagacccatggagagcaaggaaagggtgacacttgatgctatatatctttttatccgttttaggttttaaaccatgtgaatatatacccttctcaagaaatgatttttttggagtagaatttgttaacatttttaagtgatttttttaaattatatgattctgaatgatgaaaacaataaaccacttctgtttccctttccctcaacttttaaattgtaatataaagaccattacgtgacaaagaagaaattggttacagagcataaagacacagaggattttagacaagacttccactcagagatgtctggattttgtaaagctgctttgaacacttctgcagggaactcaaatccttatcttccgtattcctgtgaattgcctttatgttatttctcctcaaaatgtatgtgttcatccgggggacctgtagacagagcaccagactcctctaaggatggtagaaaccatcataaaacaatggggcattataaccacaatgactctttgcggaaaacacagataaactctttgaaaaactcagtggcctgccctggtgcacaaaaggctattacgtcttcagaggcagttgacagatttatgcctaggacaacacaactgcaggagcgcaaaagaagaagagaagatgatcgtaaacttggaacttttcttcaaacaaacccaactggtaatgagattatgattggacctctgttaccagacatctctaaagtggatatgcacgatgactcattgaatacaacggcgaatttaattcggcataaacttaaagaggtaagg

SEQ ID NO: 42335 - DNA, 1026 bp, Homo sapiens
tcttcttaggcaacataaaggatctaaaggatacaagcaagttctttttcccagatattgtcgccataaattcagttgattaaaaatctgcttaacaatttcatctttttcaatcaaatcctattcccttaaaatggttacactttttggttaatgttacttaaatcagataatgatacacatattattaacaataataatgaccatttattgagtttctgttaaggaccaggacctgtgctatgtgctttattatattacctcttttactaatttcatagcccagggaaatgtgtatggccatagtatgccaatatctgctcccaaagttattggggagatctatggaatattcttttaaaaattcaaatataaaatatcatagaaagcatgaagtttgttcttttatttcctttgtttgattacatcttcttataggtatctaaaaaagtggcagatttaatccttgaaaaacagcctgcttatgtaaaggtaggataatatttgttattttttgtagtagaatttttaaatgtttgagtgatttacacttgaaactgttaaaatattgtattttttgtcaataattctgtagcagcatattgactgtttttgggtgtgtttgtgtatatgtatgtatgtatatttttctttttcttttggggtaatttaccaaactgaagaagcgaagggtttttatatatgattctaaagtgatctcttgggtttttcaaactttagaagagccagtgaaaattgctcccattaacatttaaacaaatagattcaccaatattgaccactcattggcaatataacaatctggctttaaaatatgataaaattggtactgtctaactgaatctgtgttttcatcggaaaatcagagccttcaaaatccattgaaatgtctaccaatgttcagatgacgactttcattgtcaaagcatcttagtaaacagaaatcatatttgtcatatcctttaattaccttgtgaagttctcttgggtaggaatttaaacaga

SEQ ID NO: 42336 - DNA, 1049 bp, Homo sapiens
aaaacttttaactatttattgttcacttttgcagacacttgaatattgcaaaggaaggttttactcaagctagtttaggccttcttgcaaatcaaaggaaacgtcagttgctgattggacttctgaaatctctgagaactataaaaacattggtatatatgggtcatttaaaaaaattaaaactgaattttgtggttgaaacagattttacctttgatttttgttttttcagcaaagaacagatgtacggttaagtgaaatgctggaggtaagttaacaagttttggaaatttagggtcctactgatatatagaaacagtaaagcagacaaaattcagaagtgcatttttctcaaatgggtttatgatataaagaatatttttagacatgtaagatttttagacgtcaaagattcttgctctggagcctttttctattgacatgatattacttcatttagaaaagcaaatgtatttgggaaaacatttatcttctgataacattggaatgttaacttgtttgtattgcgtccaaatagcaataaaaattaacatctttttcatctaacatatagtagtaatttaaggaatgtgtgatactttagttttgttcagtatcatgtattaattgcttttctgagtgagccatatgttttttctttgatgcattcttagcattttctgtctacttctgtcataaggttcaccaaagcataatgtaatatgtgtgtctcctcataatacttgagctccttggggtaggtactttgtcattatcagcatcaccagtggtttgaattgcatctgttgaatttagaattgagcatagggaaaagtttttgtggttttctgtataattgttttattacttctcaactattactgctaactagggtttcagaaacccatatgaaaaattcattgggcattaaattactgttaggtgataaaaatactctgagtttattaattagtgttttttttctaaatttatttctttagaactatttattgatttcttggtggtaaattgttgactatcaattacaa

SEQ ID NO: 42337 - DNA, 1091 bp, Homo sapiens
ttctttttcagttacctgtttattaagtctttgtatcttacaatttttctaaaatatttcagttaattgaaatgcgatgaaaaattctctaggtaggttagaggtatgtgtaagataagttagtaccagtttcacatttatacaatatttttgtacttagttgtttcataggtctttaccatcttctgtcaggcagagtgaatagtgactttctggcattttcagacacaagggatttacaagctaaatgttcagattataggaaatgttgtttttgtaacagataagacctttattgatgattttgtagaaggcaaacaatatgaagaaatgatattttaaatattcaggttttaggatgatgtggatttttttaaaatcagtatttcaacatcttgtatgcttttagcctttgtatctcacaaataagtctatgtatttgacaaataagttatagagatgtcttctcctattaaacttcattgttccaagcaggaattttagtggttttccataaaaatctctatattctatctatggagatggtatttacctattgcctagtttgattaaccttagctctgttgaaatagtctgtgttctttaagataattcttaaatttaattaatgaataggataaaatgtacagaatgctttttaggagtcacggtttctctagaaagagcaaaaaatattactgaattgagaagaacagaaaggtataccttttcatgatgctcagaaaaaaggatagattctaaaaagctattctgtggctaattattgccagggagctaagcttttcttcttcttccaagagaactgactgaacatagtgtcagaaataactctcgagaatttgtagaatcagaattgggagagtgctgagtggtcattggtgtaagttgccatgaagtcggttgtctttctgtaatgtctctcatacatggtagctgtctagcttctgtttcatgactcccagtcattggaaacacagtggtttgcaagactactcattctatcattagactgatctcattagtagaagtatcttccctaaggtaaaccaaaacctgtctctctgtgattc

SEQ ID NO: 42338 - DNA, 1091 bp, Homo sapiens
cttccatgtgtcacccttgacttcctctgacatgtcatggccaaagcaagtcaggcttggcaaagggaggggagaagtatgcttctgccgcaggaagcactgcaagtcaagggaagtgggcagggctgtatattgctcttacagggaattgggaaaaataatataatcaaacacatctaagcagttgtttatattttttaccttacctagttcaaaaggggctggaggtagtcatgttgctgtttacgctgaaggcatattttcattataatcaaataaaataaaatacaaggctaagacaaagttgaagagtgggcacatcatgctttatcatatcatatttaatgcagacatcaaatacaatgcttaacttcttggtaggcataagggaattgaagaaacaatatataccactatcctcgttatctgagaaaaagatacaggcctttataataatggtagaaatatgttcctggtgctgaattcagatgttagtaacaacaaatttttgtatgaggattactgatcaacatagtgggccttgcttttgaacagtgggtttgtaggaactgagaaaagccacattcaagaccctttaaagtaaagtaaagtatggcacagtcctgaataaagccttactctgtgaagagaatttgactattgcaatttcagctttctccactaccatatcttttactggacttgcaattaggaaacaatgccgagtatgacaatttaacttttatatcttctcatttaggactgggattaggtgctgccattatcaccccagttgggatccccagtagacttttatgcctatcattttctctctccctgggatgtttttatcttcagtttttagatatatacaaaacagaactttaaggaagccactgtctcagaggcctctgactagcaaatgcactattccatccgctgttgttattgcatagaagtgcctgaagattataaactggcagaggtcatgcttcttcctacaaagggagaagtacggttgtgtaaataagacagattaatttttggtgcttgagaagatgaaggaactaattattgagtatttgggaaac

SEQ ID NO: 42339 - DNA, 1027 bp, Homo sapiens
ctggctagacattcaagaccttcccaagatgtattctgacaatccctgtagctagtttctgcccagttttctctttatcctaacttatgttttggccaaactaggcttttcccccataagtagaaataactttaatttatgaggtacctaccatgtgctagatgctgtgtttagcattttcatgcagtgtcttatttggttttcaacctagcaaggatcatgttgttatccttactttatagacaattaaagcttagagtacttaagtaattttattacagtcacaaaataaataaggattccaactccagtatttagagtttactctttccaggatcatgtgctgtctctttagagctctcttgctcacctacttctgtgcctttgctcatggtgagcttccattctggaaagcactccttcctctatttgttctgtaaaatacttaacatcttttaagggtccaatcaaatagtactgactgcttgggtttgaattctagttgtgatattttggagaactttatctctgtgtgcttcaatttcttggctaaaagttagaaatgataataattgtatttgtatgatagagttgatatgaggaataaatatacacagattcttataatagatgctatacacatgtaaacacgtgtgcacacacacatatatacattcaatctttatctatagctgtacctgtgaagaagttagaacagttcatgtaccaagtattatgtcagtgtttgttataaaagcagaagttatcttagatatctgagaaaatcctcttaattggaaaaatgataaatctgaaactcagagaaggtttgtaaacctgtcctaggtcacatagttggtgggacagccaactctggaattcagaattttcacttcctgtaacagaatgtttctttacatttttacactagactattctgccttgtaaaacctttctatcttgcctctgaacattcttgttctttgtttctctcttacgaggaacattgcattataactatttgaat

SEQ ID NO: 42340 - DNA, 1028 bp, Homo sapiens
tctctgggaactaacagactagtggtagaatgaggattagaaatgtaagtaccatacagtagataaatgttttaatagaggtgtgctacaaatgctttaagagtaccaaggagagagagaattcattctgataggaaggacacagatggtaccacagatatacacatatagataacataaacaggcagagagggaagtagagaaggcatctcatacagaggaaagagcacaaggaaagtcatccaggcacaaagtgcataccttgtttgaagaaatgtgaatttcttcatcttgccagaatgcaagtttatgggaaataaatgaccagaggtgaaaatataaaggtggttagggacagattttcatcgaaggcttttaaggaagaagttaagtatggtcagatctgggtttttgaaaacagatcatcatcagttgaaggggaagtaaaagggaaggatgaaaagggtgaagacctttacaaggatatccaatggtcagggtgagagacgggagtcaggatggctgatttaaatcattagcaaagacaatgaaaaagatggtatacataaaaggaaacttgcagaagtaaatccatttggtgatgaccaggagaaagacagaaagagagacacatacacacacacacacacaaacacacacacacacacacacatacacagagagagagagagacagagagagagagagagagagagagagagagagagagagagagagagagagaaaatgggtattgacattaccaaggtagagagcatgtgaattaggaacaggtaaggggaagatacaggtatttatttttcatgtttgatgtctttgggttattcatgctgatttgacattcatgtgaggataatagcattcaggtctagaattcagggcagaagtgaggccaagagatggacatttgtgattcatttgtaaataagtgatgactgaggctgtggagttaggtaaattattcaataataaagcataaaacaagataaaatgagcatatatgtaaa

SEQ ID NO: 42341 - DNA, 1854 bp, Homo sapiens
ggcttttattggcctatagttacccaggtagttaaggaagccaaattatagcaaacttttgggaagaccttctagcatgacccttccacaatctgttatttcttttattactaattttatgtgtaacagagtatcataagaatcatgttacttttaaatagcacattttctttaacaatataacagtagaaaagtatatatatttcagtgaaatgggagattaaaatcaattcctgcatttctgttgcattttaacattttcctttttattataggacattaattatgtatggaaatggttcaacaactttgttgtcttagttgcctactttctgtgaaatactagaaatgtgggaaaaattcgacaatttttacctgttaccatctaactctgactaattcctcctaaatcagtgttcaaataattatcatatttgatacttatggacctaacttagctaaaacttcatgtataaatttttaattatttgaattatttatttgataaatagatacatttacatctattttaatttaagaatatctagcatttaacaacatcctaaggcaatgatcattcaatccaaatagtcctgtattggttaggatcagatttgactaaataaaatgggaaaacccaaagtaaaaagttaacacacaaggaaagtcttcactcactcctagaggtaggatcagatttgaccaaataaaatgggaaaacccaagtaatgtgttaacacacaaggaaagtcttcactcactcctagggaagtccagaggtaggcagtctttggtgttgatggctccagggttatcagagatgccatctccctttatcttgctgctctaccatctttagagttttcaaaggcaacctatcctttcttagaactcttacacaaatcttctgttcacatctcattgactgaagctgtgcctttacacaagaaaatctgcgaaatgtagtcttttagctagcatccctcacccaaataaaattgagttttgttatgatggtgaatgaagagaatggatttgggggaagacagtaagttatcctattacagtcagtacaatgtcacaatgttgttttaatataaaatattttaaacttactaggttaatatctaagcccagtgatggaaatttataacattctcttttccaactcatccttttagatttaaatttataaaataatatagattctggtttcccaatggcagaaactcagtgtagtataatctataaggccatttaattcagaaaatagggcatttattaaatgtcacgtggtgagaaatctctcttttgatgtcagacgttgagaaaattaattcctctttcaaatctcactattaacttatgaaaccatctgctaagcctgactgcctgtattgattttttctttttaaaatttttaatttttaaaatagatttagggggtaaaagtgcaattttattacatgatacattgtgtagtgatgaagtctgggctttattgtacccattgcctgaatagtggacattgtacccaataggtaattcttcacttttcaccctcctcccaacctaattaatttttcctgattacatactccaccttctttcacacagacccatccctgatccctgtgcttttaataactagtacttgacccacctctgctgacttacatgacaactgcggcctttatcctctggattttcattatctatttcctaatctcctgctattgtcaatttcttatctcttcagttccaaagttctcagtcttcactctacagaggtttgtattcacctgaatgtgttttagaatttgtgatctcatttccaacatctcaaactctgga

SEQ ID NO: 42342 - DNA, 1112 bp, Homo sapiens
aagcacaaagaaggcaaagtacatttcattttgggattgaatttttactctggaacccagtataaagctctaacaggtaggctgatcttcaaggaaaggctctttttctgtgtatatggtaggctacttcccttcaagacccctatgtgaatctagaatctaaaccatggatggcgggatggcgacacctgtgctaatgtttgagaaaaagtagtaaaagaaggagagagatagagagataaagatacagatctatttatctgtatctatctacatctatcagaaagagataaagatacagatatagatacagatctgtctaactatctatgagagagagagagagagagagataatttgcctctattgcccaaaatggaactgtattaagttgtatgctccaaaagtctagtcctagctcccaggaaggagaagagaagagagaaagaaacagccagtgtttttttgagaaaacaaattctgggcttttctagcagacttgtggatagaagaggaaaaaggtaggaaaaaagaagatcatatagacttactttatagtgggaacctcagagtctttaccatctaggcttcatgagagttgctaaatgtgaccagacttgttaacccatagctcctccccaagaaatttaatgtagtgtatgctcttccttggtgttagaatgtttttcaccagattcttgttcctccttgaggtatagtaagagggagaggagttgaaggaaggagttttagtttctttctccatagaccaaaattggactaattttgttctctcttctcttgattaagtcaggtctatgatcagctaagggtgaggctgttccttctgagggaagatgtctgcagacatcagtaagtcctccctgcaccactggagtggttttcttgggcactttcagcactctgttttgtacatctggtattaatgataccagcagttcagctcctctgttcttgctatctattacagggtaacacattactctaaaacttagcaacttaaaacaacaaatgtttattatctagaaatggctattctgggtggttctggttctgagtttctcatgaggtggtccataaggtgtcagctg

SEQ ID NO: 42343 - DNA, 1058 bp, Homo sapiens
cgggagcggtggcgggcgcctgtagtcccagctactccggaggctgaggcaggagaatggcatgaacccaggaggcgtagcttgcagtgagccgacatcgtgccactgcactccatcctgggtgacagagcaagactccgtctcaagaaaaaaaacaaaacaaaacaaaactatagaccaattaatgcaattaaacccctttaattatcaataaaatgtttatttccactgaaaaaggcaacttacttttcttaattggctcacaaatgggtcactcttttttccttatagtggaattaaaattcaaaagtttactctttaacatttcttcttattctgtttggccctgcctaaaaagtttcactcagtgacagagtgcctttgtgtgtgcgtgtgtgtgtttagcccatgctattttgtacagaactaatatagattttggtattactacagagggattattctcaccacaactgtgacatattatgttaatgattccagtgaaatatgaccctctgatgggccccagtgtgtgtttttcccctctatgtgtccatgtgttctcatcatttagctcctactcataagtgagaacatgtggtatttggttttctgttcctgtattagtttgctaaagataatgtcctccagctccatccgtgttcctgtaaaggacataatctttttatttttttatggctgcatagtattccatggtatatgtgtaccatattttctttatccagtctatcattgatggacatttaggttgattcctaatcaacctaatgtgtttggtattgtaaaaagtgctgcagtgaacatatgtgtgcatgtgactttatgatagaacaatttatattcctttgagtatatactcagtaataggattgctgggtcaaatggtatttctgtcttccacaatggttaaactaatttacgctcccaccaacagtgcataagcattcctttttctctgcaacctcaacagtagttgttactttatgactttttaaattaatagctattctgactggtgtgagatggtatctcattgt

SEQ ID NO: 42344 - DNA, 1025 bp, Homo sapiens
ccatggaagcagattacctgccccaatcgtaacttcaaatgactctatctcaaccaacactttggctgaaacctcaaagaggccctaattcagaatcaaataattaagctgcttctggatttctgactctcagaagttatgtgagataacaaatgtttgctgtttaaaatggctaatattttggaataatttgttttactgaagtagataaccaattcacattgtctggagattatctctgacacatcagtggtatgataactctcttgttagcatgaaggtgtactgaagccaggtgcaaaatagagtcatatggtcaagcctagctgacagtggattcagtgggtctatggattaatgagcttatttctttaatacctatgtgcttaaaaggatggatatatttagccagtaatggaactcacgtagattccttgacctttggaataatagccattatagtgggaaaggccatcagaaagcccctcaagcttcattgcaccatgcaagatagtacatcagaggcatcataggtagaatggtagagattgaatggctacattcaaaaactaaagaatgttgatattgcccctgcaaaaacaagatgtgccatggtgggtaatggtgcacttctgaaaattttaaaaattggtagctccagttacaacttctgtgccatatgtgatatctttactagaacagataatatagtttctggcacatggcatgaggctattgatatgacatgagtgtttctttcaattctcatcagaaaaggaggtaagaagcagttcaccttcatttgggatgacaaaaagcagacattcatggcgttgtgccaggaatatgttgtcaagttatataatgtatagagtctctagagaacctcaatagaaccacttcattgcagaatcttagcattgtggagtaaggtcatgctatactagcagggagctgtttttcattcaaaatcagttcctgatatagagcaatgaaaaagaccatcatctccaatcctaacaaca

SEQ ID NO: 42345 - DNA, 1033 bp, Homo sapiens
tctcaccatcaaaatagtaaatccagtggggaattggatccaactaaaaattcaataaagccaagacagagtatacaactctaggcaatactcactcagcagcccaatctagtggtctgaggaagaagcatgttatttcctagggtaattttatctacattaatttactctctgctgtccttttagacacagtatttgtcattttgcagggtaattgcagagcatataaagatgccggataagtcacccacattcagagaagaaagagttagtggaagcagacttacagataacatagatgttggaattagctgaaaagatctttaaaagaactatgataaatatattagataatttaaagttaaaagtggtatggttatttggaaacatagtcctccaattccttgacactctttgttgagaggtgatatttattttacctccccttaaatatagataggcttttatctgcaatctaatatgactttcatctgtgatcctgtatgtcttctgggcctttatttaaagatatcatgcagctttttttcttgtcttattgggatgtttcctctgagagaagccagatgtcagataagaagtttgactcctttcagattgccattctggagaggacatatgtagatacttggaccaatagccctagctgagtttccaggtgacagccagtgtcaatggtctactatgggttgagacaacttgatattcagatgagttaagccttcagatgactgtagccccagcttacatcttactgcaacgacatgaaagacaacaaagtgcgagtctttcctgaattaccacaaaatcatgagcaatagaatggctattttcaactgttaagaatgtgagtaatttattgtgcctcaatggtaaccagaacaagtagagaacagatggtggatttcagcagagaaattaaactataaaaaacaatcaggtggaaattctagaagtgaaaaattgaatatcagaaataagaactcagtgatcatttgactgaacaagagaaatg

SEQ ID NO: 42346 - DNA, 1034 bp, Homo sapiens
agttcatgagatttctctatcataactactttcatccccatgttggaaggacaagaagatgtataaatgtttatggctgtgttaaacttgtcatgtacagcttcacacgttgtgcattgcactattccaggggtgccattcacttagattacaatatgaataactctcttgacataatgtacagcacaactgctacaataatacacaatgactctgctcattgaggtccactgagatcttaggatcactaaagaatggacaattacagctatttaaattgtagttattggattaatcccaatttatagttgtactatttaattaaaacataacaaaatcaaatgcaaatgaaaacaaaaaacaaagatgtatctgtgtgggataaagagataaagagacctttgcctattaaatgtgttttacactttcataagaatcttagcagttacgattctcgattttgtcattctgccaaacatattaacttattttaataaaaagtaaaatggactgtcaatattagctaaagagaataaacaaacctagtggggaaaataaaatatttcccccagactcaagtgacataaaagtaagaataaattacaatgaaatgcaaggtatttatgtaaaactaacattttcttatgaaatggcagttgctattactgatgctccacaagcattatctaattttatactcacaattttctattagtagaaaaagttattatacttactctacaggccaaaaaatggaagggaagttatttagtaatttgctggaacaacgcatataggtagtaagtgacagagctagacttaaacctacatgacacaaatccagagttccttaacagttcatacaatacctcttaaaatgttgtttaattaaacatacaaaatgccaaaggtagttatgagagaacactttaatgatagcaggcttgagtatctggtaccaggccacaggatcactgtatgcttctgacactggaatgagagagtaggtggcagaacacttatagctaaagtaa

SEQ ID NO: 42347 - DNA, 1101 bp, Homo sapiens
taaaagagctggtaatacagcatttataaatttatgttcccctaagaagttattctcttgtgtcctcttatgttaaaagaatgactcctagtccatcctgggctacattacaaaagaccctcttcataatcttggtctctgtattgtaggttttcctttattaatctagccattgtaggtgccatgatatgtataaaaaaagaagagctgagtaagggtgacataggtgtttggatttgctggggtaaccactgatcatcttgtctattctgaagtagtcaaaaagaaagctgcaggggacagaggtttctgagaggtggccagagaggcaatgtcctctatctagccatgcttcaaaccccagagcctgactggatttccaaacttcccattggtgtgaattaatacataatccacttttctttccaaggtaacatgagttggtcttctactactggcaatctaatgagctaaatttgatgttgtaaacacaaatcaaatcatttacaatgttattctatctgagaccaggaaattgccttgctttagataaaagcttaatataggagacaggaagacaggaatttacatctgaactgataagataaaggcatcaacatagcaacaaggtgaataggaaaatattttttcaagagacccaaaccacaaccacaaaaagatatatttctatatatactattctggtgacttactcatttcacagataaatggaagaatgaatttcatttaccagggcagactggaaggggaaggatcttttagagctagctattcagacttcagtgggcagtgaggtagagaaatacaaggaaaaggaaatgtggacccagttggatactggtaagaaattccagtctattaaatataataataatggtggccatttttattggctattatggcttttaatgccttctatgtgctaggcatgcctcgtgccttattttcattccttgtaacaagtctacaagtactaataacttttttacaagaaggaaactttaagctcaaaaagttggtgaaaaccacagagttaaaggggaagggtagagtttgtactcaaatcatctgaattccaaa

SEQ ID NO: 42348 - DNA, 1057 bp, Homo sapiens
cagggagaccaaggcaagcagtgattggcaatacgttgacttcctggatttctggcagaagacaccaatatgggcaaggaaattattgaaatgtcaatcctactttggatatttccctggattaaaagaataggtatactaaaaggcaaattgtatagtttcatagtttatggaataagccatggagctagttttcctgggttcaaattacagcttctccacttgctagttttgacatcttgcctaagctatttaacctctttgttcaccattttaaaaatgggcctattaataatatagacctcttagagctgttacgagaatcacatgtgttaatgtttttaaagctcttagaagagcaatgaacatatagtaaggattacataaccctttatcaaataaataagtgccagaaggtataagtgttgtagcttaactttagtattgtgtatttttagctttgaattgtttcctttaggccagcatttctcaggtttgacacgattttcattttgggccatactgtacttcatgatgaaggctgtactgtacactgtaggatgtttagcagcacccctggtctctacccactagatgtcagtagcacctccccagttgtgacaactaaaaatgtctccagacaaagccaaatttccgctcgggttggggcaaaattgtaccccttctgcttataaagcttggatttatgtgcaattattatttgcttcaaacttataaagtggagctaattgcttcatgtcactactaccacagacatttcaaaatcaaaataagaaatgtgttagcaaagttcttggaagaatgagatgtcatcagcttgctctcaagtctactcgttttcattcactcatttctaaatactgtatttctctattccatgtactctggcttttctgtttctttgtgtatttcccctctgtgcccttctctgtgtagcaacgccgcatggctaccagcaggtggtatccatgaataatgtgatctacatcttttccctggcaagcgtcatcagatcacctctcccacgctgctgtgt

SEQ ID NO: 42349 - DNA, 1047 bp, Homo sapiens
cataatcatatgaaaataaatcaacatttcatatgccacatggtatttaaaggcatccattcattatttcacatttcaggaagatgtatattagataataatattataatttataaaatttcaacaaatttcaatatattacaatcttgtctcttctcatgcagcaatctgagtttaccagttttccttctctggattttacattctgacttttaatttggcatagggggagccctagccccactattgttttgtcaaaatattgaaaacagctctttggaaaatgggtacaggaaatcttcagaaataatgtagtcatttctgagcccctttccaggaagtaaagttgagaactgataaccaaagcaaagttgaagggtagaattctaaattagtttaattcatctgatacattggaagccttttgctgtttcactttccctgggccacttctatactggctatagaattaggtacagccaatcctttcctggagcgtcacaatccatatctggccttgtagaccaatcaatattgtagtgatctgtattgatctttaagagagttagcatgactggttccaccgtttgatcaattcttgggtatagatccagtctaaaagttctggtcctcatgaaaatttgatcaaacaaattaccccaaatagaactttgacagcttagtaatagattatcctaaatcagtaaaataaggtgaggctttattactcaatatgtaacagataattttagatacatttctattgaagaattattattagtagaagttgggaagatatatttgcataacatttcacctttttttacattatgaaaaatttgtgctgcattcatctattatctatctatctatctatctatctatctatctatctatctatctatctatctatctatcaccacatacattcttccctcaggtttgtcgatcataacattttgtcatattgctttgatccttgttatttttcagaagaaatcattgctggaaatccctacatgtatcatcctgatcacatttctattt

SEQ ID NO: 42350 - DNA, 1013 bp, Homo sapiens
tatttggtgattttttttttatttggcccatgacttatttaaatgtaagttgtttaattcccagatatatgggtcttttctagacatattatttttgctatttgtaattaaattcccttttaaattccataacatattatgtaaaatttcatttcaaatttttaagatttattttccatcctatgttctatcttcatgtaccttttatgatcacttgaaaaacatatgcttcttcacttgttgagtgtagtgctgatataattggcaattaggttaatgtaattaatgtcagtccaatcgtctatatctttacttacatatatttacacctttgccattttttactgttttatatttctttctgtagattgaaatttccctctagagtgtttttttttctttaacatttcttgtagtgcagatctttggacaatacaatttctcagtttttgtttatataaaaatttattcatttcacttttatctttggagttttcttcactggatgtagaattcttagttgacaacttttttcttttagccttataaatacatcatttcttgtcttctggtttgcagagtttctgataagaagtcatctgttatttaatcattgttattctgtatatcacatgccatttttctctagctgcttttcagattttctgtctatctttgactttcagcaattttagtatgatgtgtctagaagagttattttttatttttatcttgcttggagtttgttgatgttcttggatctggcactcagccaagaagagcatccaactcacagatctggttccatattactctatcttgcaagagtagatttcctcgtggtctctgttagcctttcctttttgttcactcggatctccctcatacatttatcatgtagttgtcagcagtgagttgagctgttcatactctgaattttggtcactcttttttttttttcttttgtttcttgcactgccacaacttctcccttatattcccagcttttttct

SEQ ID NO: 42351 - DNA, 2555 bp, Homo sapiens
gtctttaaatattttttcaattatacaattgttatcattgttaactgtgggaaattagtgtgcaacgaaaattatcctttataggtactggaagttaggtctcgacttttctaaacttgctttttgtacccccaaattattaaatatttttcttattattttatataatcgtttttgttcttacctccttagaatttacatctgtttttttctgagttgtatcttctagtagttctttcagtgaggatttattattattacaatctcttactttttttcttaaaatgttactattttgttgtcacattgaatggtaaagttaggtcaatataggattttaggttgactgttattttcttcaggtagtatagctctggttgcttttaagttctcttctttagcattctgtataatgtgctctttttttttactatattgtaatatttactatattatagatttactatattgtagattaattataatttattctgttcagaacctgttcatgatttctgaagctgattctgagtactcgtggtttttataaattctggaaattctaagttattcttttcaagtattttttcttcacatctttgtctctccggaatgcctattaacttacaatggtttttaaaatatattctatatttcttaattcttcttttctatttttgtgactaatttaatatttagcttccaatttaataactcttatttcagttgtatgtattggtggtttaactttacattatatttttaacttttgttactttttttctctttccctgtttcaatttctattttctacctttagtataccttaaatatttatttttgtaatctcaactaaactgttacaatgtctgatggactaggtagcgaggatcttatctcaatgtttttgtgacacatgacttgtgtattcagggccctcatttctaatgtccatttttgcatggtgcaaaagccttatccctcatgagttattgaaccacaagcctcttggtaacaaaatgcagcatcggtcctttttgtaaaagaatatgagtaatcttaaagagacgcaaagtaggactttccttgttttaaccacacatacaatcaaggataaatataatatacatatagtacatgttttacattatattactggtagtgacagatgctttgatcaaatctatactaaatagtcatacttaagtgattattacttttaatcagagtttaacagaagcaaatgacaatctcattgatagccagagcaaaagaaaggaaactaactcctcatctaagactttaggaaatgaagccaagtaattattgtgggaataaggatgaagtgcctgtcctgtattgtccaatagttcttcttctgtataattattctgacctagaatgatcaatgagctacaagcacaaatacttattgaagaaaacaagttttaatttgcttgttttttatttgggctcccagtcttggaaaggaaaatatttcaatttgtatttttaagtttcaaatcgaacttatctgtatataaattacaatcaatataggctttatattctttataatttgtcttttctgtacaatcaacatcaaaacttgcctttaacttattcaataaatcaccaattaaaattttcatatatgtattagaaaaaaaatgcactgtaaaaaatctttttaatgagatttcctttaatttaatggattggataaagcaatgtactaagatttaagatacctgggtcatactttcagttatattgcttggtaacccttattttaacttctctggttttgatttctcatgcaaagagaagaatcactaatataaatagaaaatcgctagcatctccactaattttaacattgtattggacacctactcagacctactgattgtaaaacacttaccatttttctcagctccagtctagctccccacacactttctaattctttctcaatgccccggagacccaaactgtgcttattctttttctgagctgtgggccacttcgcccagtgactctcaaattatgtacttcaaacctttgagaacccatggagttgttgcagttataaagacactgtaagttcttatatatatcaaatattttctggagactaaaagtgattcatatgtatggacttcactttttcaaatatatgttaatgctcctgtgatcagcaaaattaaaataattaatttttaatgtttttaagttcagaaaagattttgtcattctgagttttccaatcaatgtacaattaaagtctaactactcttaaatagaaatacctggaaatttcgacttttgataatattaggaataactaaccttaagctgtttacttccatttctttcatttcagtataagatccctttgaaaataaatccagatatcaagttttagcaaggcttcttggaaaattactataggaaaaaatagagtaacaatttgataccagctctgccctatggggcacctatgctatggcatattatatgtacttttgataacatatatttaactttcagta

SEQ ID NO: 42352 - DNA, 1430 bp, Homo sapiens
aatctaggtctcctgtgaaaataatttgcagatgagattaaggtggcaaatctgttaatgtaaacataggcagataatttatgtggatccgacttgacctaatcacatgagccacttaagagtagagaattttcttttctttttttttaaattatactttaagttctgggatacatgtgcagaacttgcaggtttgttacataggtatatatgtgccatggtggtttgctgcacccatcaacctgtcatctacgttaggtatttctcctaatgctatccctccccttgccctccacccactgacaagccccagtgtgtgatgttcccatccctgtgcccatatgttctcattgttgaactcccactttagcagatcacagaagaggaggtcagaaatctgaagcacaagaaggatttgttgcaccaatgatgacttgagtgaggggagatacatggaaaggaatgcgggcagcctttgggagctgagagcaattcctggctggcagacagcaaggaaatggggatctcagtcctacagctgcaagaaacttaatttgtccaacagcagggatgaccttacaaatgaatttttcttcagagcctactgataagaactcagtttatgtgaaaacttggttttagctttgtgatgccctgagtagagaatctagctatgccatgctccatgcaagacttttaactttcagaactgtgagataatacactggtgttgttttaagccactaagtttgtggcaatttgttacttggtagtagaaaactaatacagaggacactgcagttattggaatgagggacaatggcagcttggactatggctatggatatggaaatagaaaaaaaacagaactgagatattcagggataaaattgatatgactatgtgacagatggggggataaaggagatagattagttaaaacatgtgtctggtttttcaccatgcatagtttttcacatcagaagactactgtgctaagtgaattattgggtagtggtaagagttggagaatattaattgggtttagatacgtagagattgaagtgccttgagacacttaacaggagccatcaattggcagttggatatgagtcattggtattataaatcaaaaaatatctgggagaagtctcaattaatttagaagtttatttcaccaaggttagggacctgcctgtgacacagcctcaggaggtcctgagaatgtgtccccaaggtggctggactacagcttggttttatatgttttagggagacagaagacatcagtcaatacgtgtaagatggacactgattcagtccataaaggcaggacaacttgaagtggaaaacttccaggtagtaggtggattcaaagatttccttattggcaattggttgaaagagtttataggaagacctgaaatcaa

SEQ ID NO: 42353 - DNA, 1061 bp, Homo sapiens
caggggggttagtaaaatggtgtttactggttaccttagtaaaagtcgtttccatgaagggatgtggacagaaaccagactggaatgagataaagagtgaaggtgaggaaatgaaaacaaaatacttaagtacagacaactctaaagaagtttgcttataaagaggagaagaccaggaagtagctggagatgtatattagtctgttctcatactgctgtaaagaactgcctgaaactgggtaattcataaaggaaagaggtttaattgacacacagttcagcatggctggggaggcctcaggaaacttataatcatggtgaaaggcacctctttgcagggcagcaggagagagaattagtgccaagtgaagggggaaagcccttataaaaccatcacatcttgtgagtactcactcactatcatgagaacagtctggtggaaactgcctttatgattcaattatctcccaccaggttcctctcatgacacatggggattatgggaactacaattcaagatgagatttgggtgcggacacagagccaaaccatatcaaagtggtttttttattttattttctgtgggagacaacatatttaaaagccaactagaaggaatcagttcagaagttgttaaatatacaagagaggaggaggaagaaataacaaagttttctgagaaggtgaaggagataagatccaaagtacacatagagatttaagttcctttagtataacaggaacaaaaggacattgatgggtatacctatcttgtacaaataggtttacatattaggaaaaaatgaaattaatagaggtccagtctgatggcttctttttcttccaaaacttgtttgaaaagcactgtcacctgttaagagtatggggaggagagtgggcattataaatgtgaagaggggtggataaagtctgaaatagtccttgtggaaaatgggggactcaactgaattgacctagacaggctatgaggaagcctaaatgtcataacattaatgaagattttcttgtcatctttccagcagctgtcagcctttaccttc

SEQ ID NO: 42354 - DNA, 2604 bp, Homo sapiens
tttttactttcttatttgtaatttaattttgtccatcctaatttgtttatttaatagattaggaaactaaagcttaaagggatgaaatatctccatggtgacactactactaactggaaactttttttgaactgatgacactactactaactggaaactttttttgctctgtggcctcattctttcttcaatagaataaggaagaaaattttgaaatattgagtaaaaacttcttctgaaagatgaaagttgttttgaccactgtcttctctctgtaatactaattaaatatttatttagcaagattctcatcagaattcatctttcagaagaagtttttactcaatatttcaaaattttcttccttattctattgaagaaagaatgaggccacagagcaaaatcaattatttattttgcatagatggaatttatgtagatagcgctatcataaaggtactgcaaaaggaaattcatgtgcaaatatcctcatcaactgaattagaactcaacatcatcattgctacatcatgcaagaagactatacagcaacttagtttagacaggcatgagtatctgcttagtctattcattaataaaaaagtctattcattaataaataatcaactttggtttcaggacataaaatgatcccaaagttggccagataaaaatagggtcacctcagaaagcggttctcagattagtttgaaaagtgatttaacacattgctgaaatgtaagcgggtatccaatccaaaagaaataacaaaacagaagcctttttactatcccccagagtatggtttttttaggaaaacatgcagagaaagaaaggcaaggataatgtgcacaatttagaaataaatggaaatcctttatgtgttaatcatttctggaatacttatgcaatctgtgttttatggtccattttatatatttctttaagctgtccattgatagaaaagaatacacaaaagtctgaaaagttagagagctttagtaattacattttgtcacttactaacaaccaagaaagagaaaaaaactataatgatatttagtaacccatgaatgtgacttttctaatttctaatatgataaattagcactcctcaaatttagaatgaacttactgtaaatatctgtccatctctatgtcatttatttaccccaaatatcttacatattggaaattttttaaaaatgtattttaaatatttatattttaatctaatctgtgttatataatttcagatctaaatgtcataaaattcatgatatatttttatatgtatgtatatttgaatgaaacatttaataatatttacataaaagcaaatttcatatatatcatgtaacaactatgaattttagtttagcttaaatttcattttgggggaaaaacataatactgacatgtatgatttttggtagggaactaaatatatgttcaaatgtagattaaaagataactatagtagaaactatgaaaatatatgaaaactagttttataacctatgtcaggcctctgagcccaagctatgccatcatatcccctgtgacctgcacatacacatccagatggtcggttcctgccttaactgatgacattccaccacaaaagaagtgaaaatggccgttcctgccttaactgatgacattgtcttgtgaaattccttctcctggctcattctggctcaaaagctcccctactgagcaccttgtgacccccactctgcccgccagagaacaacccccctttaactgtaattttcctttacctacccaaatcctataaaatggccccacccctatgtcccttcgctgactctcttttcggactcagcccacctgcacccaggtgaaataaacagttttattgctgactcaaagcctgtttggtggtctcttcacacgaacgcgagtgaaatttggtgccgtgacttggatcgggggacctcccttgggagatcaatcccctgtcctcctgctctttgctccatgagaaagatccacctatgacctcaggtcctcagaccaaccagccaagaaacatctccccaatttcaaatccggtaagcagcctctttttactctcttctccaacctccctcactatccttcaacctctttctcctttcaatcttggagccacacttcaatctctcccttcttttaatttcaattcctttcattttctggtagagacaaaggagacacgttctatccgtggacccaaaactccggcgccggtcacagactgggaagacagacttcccttgatgtttaatcattgcagggacacctctctgattatttacccacgtttcagaggtgtcacaccattcagggatgcctgcctcggtccttcacccttagcagcaagtcctacttttctgtgggaggggcaagtaccccaaccccttctctccatgtttctaccccttctccacctttctagggggcaaggaacccccaaccccttctccttcacccttagcagcaagtcccgcttttctaggggaggggcaagtaccccaacctcttatatctctgtgccccaatcccttatttccatgccccgacctcgtatctctgtgc

SEQ ID NO: 42355 - DNA, 1102 bp, Homo sapiens
agctaggttccaattcttcctcagcctgtctccaccctataatctttttatcacctcccctcctcacacctggtccggcttacagtttcgttcggtgactagccctcccccacctggccaggaatttactcttaaaaaggtggctggagctaaaggcatagtcaaggttaatagtcctttttctttatcccaaatcagacagcatttaggctctttttcatcaaatataaaaatccagcccagttcatgactcgtttggcagcaaccctgagacactttacagccctagaccctaaaagttcaaaaggccatcttagtctcaaaatacattttattacccaatctgctcccgacattaaatgaaactccaaaaattaaattctgaccctccaaccccacaacaggatttaattaaccttgccttcaaggtgtacaataatagaaaaaagttgcaattccttacctccactgtgagacaaaccccagccacatctccagcacataagaacttccaaacgcctgaatcgcagtggccaggcattcctccagaacctcctcccccaggagcttgctgcaagtgccagaaatctggccactgggctaaggaatgcctgcagcccaggattcctcctaagccatgtcccatctgtgtgggaccccactgaaaattggactgttcaactcacctggcagccacttccagagcccctgggactctggtccaaggctgtctgactgactcctgcccagatcttctcggcttagcagctgaagactgacactgcccgatcgcctcagaagcctacaggaccatcacagatgctctaggtaactcttacagtggagggtaagtccgtccccttcttaatcaatacggaggctactcactccacattaccttcttttcaagggcctgtttcccttgcttccataactgttgtgggtattgacggccaggcttctaaacctcttaaaactccccaactctggtgccaacttagacaatactcttttaagcactcctttttagttatccccacctgcccagttcccttattaggccgagacactttaactaaattatctgcttccctgactattc

SEQ ID NO: 42356 - DNA, 1058 bp, Homo sapiens
tttgcccctgcccaggactggcaaattagctttactcaacatgccccaagtcacaaaaactaaaatacctcttagtctaagtagacactttcactagacaggtagaggcctttcctacagggtctgagaaggccaccgcagtcatttcttcccttctgtcagacataattcctcagtttagccttcccacctctatacagtctgataacagaccagcctttattagtgaaatcagccaagcagtttttcaggctcttagtattcagtgaaacctttatatcccttacagtcctccatcttcaggaaaggtagaacggactaaaggtcttttaaaaacacacctcaccaagctcagccaccaacttaaaaatggactggacaatattttaccactttcccttctcagaagtcagacctgtcctcagaatgctacagggtacagcccatttgagctcctgaatagatgctcctttttattaggccccagtttcatttgacaccagaccatcttagactgtgccccaaaaaacttgtcttccctactatctctgtctagtcatactcttattcaccgttctcaactactcatacatgccgtgctcttgtttacactgccagtttacactgtttctccaagccatcacagctgatatctcctggtgctatccccagactgccactcttaactcttgaagtaaataaataatctttgctgacaggactatgctgaatttccttaggcactcttatagatgtcctaggtcctcccaattcttagacctttaatacctgtttttctccttctcttactcggtttagtttttcaattcatacaaaaccgtatccaggccatcaccaataattctaaatgacaaatgtttcttctaacagtcccataatatcaccccttaccacaaaatcttccttcagcttaatctctcccactctaggttcccatgccgcccctaatcctgctagaagcagccctgagaaacattgcccattgtctctccataccacccccaaaaatttttaccgtcccaacactttaccactat

SEQ ID NO: 42357 - DNA, 1067 bp, Homo sapiens
gcgccatactttaacagtttgtctagatttctcacaaataatgtgatttatattgagcaccaacaggtaattttgaaattagatagaggaaatagtggtgtattgtgaaagtactaaatgctttaaaatgattttactgtgttgtacactttaaaatgattaatttcgtgttatatgagttttaccttaataaaaaacagtaacaattttaaaaatcagaaaagggggccgggcatgttggctcacgcctataatcccagcactttgggaggccgaggcgggtggattgcctgaggtcaggagttcaagaccagcctgaccaacatagtgaaaccccatctctactaaaaataaaagaattagctgggcatggtggtgggtgtctgtaatcccagctactcaggaggctgaaaggaggctgaagcaggagaatcgcttgaacccaggagacggaggttgcagtgagctgagattgtgccagtgcactccagcctgggcaacaaaagcgaaactccgtgtcaaaaaaaaaaaaaaaagaaaagaaaaggatttgaatagacgtttctccaaagaagatgtgtaaatggctaagcatattaaaagatattatcagcatcagtagtcattaggggaatgcaaatcaaaaacagaatgtgatactactttacacacactagggtatctacaataaaaaagacagatattaacagttggaggggatgtaaataatttgcaacccttatgcattgctggtggaatataaaacagggcagttgctgaggaggtcaatttgacacttcctcaaaaagttaaaaataaagttaaccagaaaccccagcaattctgctcctaggtatttgcctcagagaaataaaatttttgtgtccacttgagcccaatgcacaatgttcacagtagcattattcataatagccaaatagtgaaaacaacccaaatattcatcaactgatgaatggataaatatagtattgtatatgcattaaatagaatattattctgcaataaaaagaaatgaaatactgatacaagttacaagatggttggat

SEQ ID NO: 42358 - DNA, 1034 bp, Homo sapiens
actttagcagggttgtgaaaatcaaattaggcaatgtatgtaaatccttacataagtattcaatattatgacaactattattattattaatgcttttgttgctatttttattattttgatgatcatgtctaggattaataattcctgaccccaaaagactatctagtgctctaaactttcggaagcagattctaaaaggatgagtttttttcccttctttattcggagttggtagattggtcaggagataggggagtctgtggtgggaagaacatacatgattctatataatgctcatatggtctttgtgatcatatgcggtgaggacacacaatttactaatgaaaccttgaagctctattttattatcaaagtactgagctctccatttgtgtacaaaaaaaaaaaaaaaactggattacctgtcttaacctatgataagttataaaacctccaaactctgtgggcaaccagttctgaaaacacacaaaagacagattaaactttgagtttatattggaaaattggggagctatttgatttttttcattacactccttgtgattatatgcattgacaaccatattgagcaactcaattttccttcactactacaaagcaaattcttgtccaaacacagaaatatgtctctattatgtgatattctttcacccgttacatctcaaatactcaagaataaattgttcatagagtaaaaatgcacaaagatacctacttgacttgataaactgtttcctgtttttaaatgaaactgcatcacagaatggactttccttttgtttaatttccagttacctgagaatgaggtaaaatgaaaaatgaaagaaaaagaagttagaaatttttttagagattctctctgtcagatgcttaagtaattcctttcttctaggccaaaaagaaaatgcttcctagctcagggtatatacctatcaaattgtaaagggagcatttccacattgtttgtgctactctaagttttggtttaaaagatcattgttttatgtacatgt

SEQ ID NO: 42359 - DNA, 1043 bp, Homo sapiens
ttttatgttttcttgatgacttgtttgttttgacataacacacactcttttctttctagtagtactcttgtcttgaaatcttctttgtctgacattagtatagctatgcaagttttcttatgcttactgttttcacaagaatattttctacacttttaatttgaatccatctgtgtctttatatcaaggatgctttttgtaaacagcatatatttgggtcttgttttgttattcggtatagtaagctcttttaattggaatggttatcccatttacatagtatgtaattattgacatgtttgtttcggtgttccattttggtattaattatttgtcctctttatactttttttttttcctgttcttcctttcatgtcttctgtttggtaaatcacatttttttgcaggggatggggagtattttattttatctcttgtattgacattttagttatatctctttttaaattggttgctttagaaattacaataaaaattatgaagtcattacagtctacctttaaataaaaataacatatgacctcagagtctgcataagaaccttataaaagttataacactataattccatttatttttccctattctttgtttcttgggttatcataatttacttacagatatgctctattttttttactattttttaaataaaaaacaagtcccttaaaatttataaatgtaacaaaatataaaaaacataatcaaggtaattttaagtcttttatgtttacttagttatttactttttctgatagcttcgtgcatttgtaaagaatttggtttcctctggtccacctttctttcaacttaaataacttatttttctatttatttatttactctgtattaatttattgaagtgtagatttgttggagacaaactcttaacttttggctatctgataatatctctactgcttccatagtttaaagatattttcactggagatagcacgctagatttgacagtatttatttatttatgcttagcactttaaagttattctatatgcatctgg

SEQ ID NO: 42360 - DNA, 1041 bp, Homo sapiens
ccttcgtatgttggattcctaggtattttattctctttgaagcagttgtgaatgggagttcactcatgatttggctctctgtctgttgttggtgtataagaatgcttgtgatttttgcacattgattttgcatcctgagactttgctgaagttgcttatcagcttaaggagattttgggctgagatgatggggttttctaaatatacaatcatgtcatctgcaaacagggacaatttgacttcctcttttgctaattgaataccctttatttctttctcctgcctgattgccctggccagaacttccaacactatgttgaataagagtggtgagagagggcatccttgtcttgtgccagttttcaaagggaatgcttccaggttttgtccattcagtatgatattggctgtgggtttgtcataaatacctcttattattttgagatacgttacatcaataccttgtttattaagagtttttagcatgaagggctgttgaattttgtcaaagaccttttctgcatctattgagatgatcatgtggtttttgtctttggttctgtttacatggtggattatgtttattgatttgcctatgttgaaccagccttgcatcccggggatgaagccaacttgatcttggtggataagctttttgatgtgctgctgattttggtttgccagtattttattgaggatttttgcatcaatgttcatcagggatattggtctaaaattctcttttttttgttgtgtctctgccaggctttggtatcaggatgatgctggcctcataaaatgagttagggaggattccctctttttctattgattggaatagtttcagaaggaatggtaccagcttctctttgtatctgttatagaattcagctgtgaatccatctggtcctggactttttttggttggtaggctattaattattgcctcaatttcagagcctgttattggtctattcagcaattcaacttgttcctggtttagtcttggaagggtgtttgtgtccaggaatttatccattt

SEQ ID NO: 42361 - DNA, 1055 bp, Homo sapiens
ttggggcatttagcccatttacatttaaggttaatattgttatgtgtgaatttgatcctgtcattatgatgttagctggttattttgcccattagttgatgcagtttcttcctagcgtcgatggtctttacaatttggcatgtttttgcagtggctggtaccgattgttcctttccatgtttagtgcttcctttaggagctcttgtaaggcaggcctggtggtgacaaaatctctgtgtttccttgtctctaaaggattttatttctccttcacttatgaagcttaatttggctggatatgaaactctgggttgaaaattcctttccttaagaatgttgaatattggcccccaatctcttctggcttgcagggtttctgctgagagatctgctgttagtctgatgggctttcctttgtgggtaacccgacctttctctctggctgcccttagcattttttccttcatttcaaccttggtgaatctgacaattatgtgtcttggagttgctcttctcggggcatatctttgtgttgttttctgtatttcctgaatttgaatgttggcctgccttgctatgttggggaggttctcttggataatatcctgaagagtgttttccagcttggttccattctccccgtcactttcaggtacaccaatcatacctagatttggtcttttcacatagtcccatatttcttggaggctttgttcatttctttttactcttttttctctaaacttctcttcttgcttcatttcattaatttgatcttcaatcactgataccctttcttctagttgattgaatcagctacagaagcttgtgcattcatcacatagttctcgtgccatggttttcagcttcatcaggacatttaagttcttctctacactgtttattctagttagacttttgtctaatctttttttcaaggtttttagcttccttgcgatgagttcaaacatcctcctttagcttggagacgtttgttattaccgactttctgaagcctacttctgtcaactcgtcaaagtcgttctctgtcctgc

SEQ ID NO: 42362 - DNA, 1046 bp, Homo sapiens
acagattaagtgatttgcccatagaaatgttattaaatgttaaggtgaggattctaacaaagttgacattatgcttgatttagggatatttccccacttcacatcactgttctctcattaccagaaaagtgtataaatattttgtcagacagcgtgatgcctccagctttgttctttttgcttaggatagtcttggcaatgcgggctcgtttttggttccatgtgaactttaaagtagttttttccaattatgtgaagaaagtcattggtagcttgatggggatggcattgaatctataaattaccttgggcagtatggccattttcatgatattgattcttcctatccatgagcatggaatgttcttccatttgtttgtgtcctcttttatttcgttgagcagtggtttgtagttctccttgaagaggtccttcacatcccttgtaagttggattcctagatattttattctctttgaagcaattgtgaatgggagttcactcgtgatttggctctctgtctgttattggagtgtagaaatgcttgtgatttttgcacttgattttgtatcctgagactttgctgaagttgcttatcagcttaaggagattttgggctgagacgatggggttttctaaatacgcaatcatgtcatctgcaaacagggacaatttgacttcctcttttcctaattgaataccctttatttctttctcctgcctgattgccctggccagaacttccaacactatgttgaataggagtggtgagagagggcatccttgtcttgtgccagttttcaaagggaatgcttccagtttttacccattcagtatgatattggctgtgggtttgtcataaatagctcttattattttgagatacattccatcaatatctagtttattaagagtttttagcatgaagggctgtcgaattttgtcaaaggccttttctgcatctattgagatgatcatgtggtttttgtctttggttctgtttatgtgatgcattacatttattgatttgcctatgttgaaccagc

SEQ ID NO: 42363 - DNA, 1001 bp, Homo sapiens
agtagagacgtggtttcaccatgttggccaggcttgtcttgaactcctgatctcgtgatctgcccgccttggcctcccaaagtgctgggattacaggcgtgagccaccacgcctggccaacatttttttaatatgtaagagttttcttgtatttccaaataaaggccattgctttttatctattcttatatttttttctaaaatgacttgttttccctttataatatttagagctagacatttttaattttaatggagttaaatttattggttactctttatggtggatgctttttgcagccagttgacaagtggagtgaatttattcacatgtttggcaactgattggctgttagctaagatgagggaaagaggttttcttttcaaaatttaggctggcccaggccaaattgcttgaagactggccgggttatgagaacacaatagatgtgtgcagagtctctaaagactgggcttagaagtgccataacattacatctacggcattccattgggcagagaaagccacaagacaagcccagagttaaacagaggagtaatagatcacctctgtggtggaagtgctacaaaggcacattgaaattatatgggtactaaaacgagaagaattcttgcaatataccagagatctttgtacaagatctcagaggccagcagaagcaaaccacctggtgccaaaatctctgtaagcgccatcatcactgtagtgtttaaatgcaataaccacttgatctctcatcgctttgcacttcatcaggatttcatcccgtgcctccttggtgtttattggagtaattaggatgccactggaagccataggataacagtgctacattttcccacccctgtaaaaaggttagcatactcatccaacatgagagcaacccaattacagaattaccttttgaaggtctttttcaggcactagacctaatataaattactgtatcagacagaaaatcagcaagaaaaagatagca

SEQ ID NO: 42364 - DNA, 1072 bp, Homo sapiens
aacaaattaaaatccacaaatacaatagatgcttctctcttaccaattctacccccacttccactctcagatgctagatcagtgagaggagattgcagttctaatgatggtctgaatgcagatatgctacctgaacaacctaatgtagccattgtaaagaaagtaaatacaaagttcctgaggagccttaagggagaaagatcccttcctggtagtcagcccctaatctgaggtctcaacagtgatgtggttccaagttctctgaggaaagcagttttgttgtctgcgataaatgaaatgaattggataagagttggtataaaatgcctaagtcttcccggaatgagggttggcagttatcagattcctcgtggaagttggtgctttatgaaactagcagcagtagtttgggacttattttattatacatatcaaagactgcagaaaagagagctatcatgggcccagatttattttcttgaccagatctgagctcacctggaaatgattcatttcagactggaatttaagtgaaggtaaaaaaaaaaaaaaaaaaactatcctcacctaacatcagcttttacttggccacactagtgagaaagagttctcaataaaatccataggaaaggaaaatgcatggaacggccttctgccttcatgttacacaaagagtaggaactaagaacaattgatctttcatgatgcttttatgaattatataatctcttcagccacttactctgttcttctttatctattgtgtcttacactaattcaggagcacttgctctttggaaaacaaaacagcctttttcagttgaaggtaatcaggacctaggaagcatgagagattgatcatattctatgcattctgtgagttcagattttgtattcagtttttgtggcaggaataaattacccagtaatggtcaggtaggcaacttttcattcaccatattaagtcttatataatgattcaagtgttctaatttagccccccatgagttattttttagtgaagaactataattaagctaagtttgatggacttgcccaaggtcacttatta

SEQ ID NO: 42365 - DNA, 1024 bp, Homo sapiens
ttttaatttctatgggtacatagtaggtatatctatttatggggcacatgtgatattttgatataggcatacggtgtgtaataatcacatcagggtaaatgtggtatccatttatcctcattgttatagctttttttctttaccaccagttttgagaaatttgtttatgatatattggggttaattttctctatgtttcttgggctttgggtttgttgaactacttgaatctatgggtttattattttcatttggttgaatgcagataatttgaactacgatcatgaatgctagataatttttgtttcctataaatattcttaaaattgttttctggagtgaagttaactgatcatttgggtcttgcttttaaagatcatgtagaaaagtagatcttaatatatcagtttactttcatttttttttctatcctagatctatattccttcagttctagcaggttactcatagcttcacatggatagtttttgtattttgtctttcccttctagctgtttctgataattactgctctgccaaccacaagctacttcatttaagtagcttaaatggtgccaaaaatcaaataaataaaataaaatttataatttcttaatttaatgatgctatcaataaaatattttaaaatgaaaaatatgcttcctctaccttgtcctctaaaacctcctgaagaaaaaattgtgacatagcaggtctctgggccaacctataactcctgtatctttaatgtgtttctaaattccaggagaagccatggtttaatcagaagaggcttgagataggagaggattacagtttacaacatgagataatcagggacatggaaagtcagtcacttcataggtgatgataatggttgacaaatatactccataaggtactatgctacctgctggacataaagagttgtgagttataagatttctttaggtaccttatagtaaaacaatttttagacaaaaattagtgacccatcaagttgaattacaataacacttttagc

SEQ ID NO: 42366 - DNA, 2115 bp, Homo sapiens
agtgtgtcacaaaggcactagtcattcccagggtaacaggtgataagaagcataagttttgaatgcaatggaagaaagtaatacctccttaatagttaagttgtgaagtttctgtactgaaagagggctttggggaagtacctaagcaatgattaaaaacttaattcagatggtattggtatcagatataaaaagacaatattctaagataaactcagcagagaaaatgggggggtatcagtagtgtctacatgaacaagaattcttaatttttcagaaaagttactatacttttaaaatacaggggttttaccattccctggtaagaaagaatagaaagtttatatcaagacatcattttaaatacaaaacatagttgtgcaaaatgtagagaaaagtaattataattcttttttcagagtgtgggttcagtgatgcagactgtaagaattccagggaaagagcctctccatatattattatatacggagatttccgaatttggcagataaattctgcctctgtaggtcaaaattaggcataggtgctcatattaggcataaagtgtaagtgtcatcccttaataaatgttaatttgtctgggtgaatgacatgacaatagtatagttaacaattccattaatgtgaactcagtgtatattatccccttctattactacacagataacacacgcagtgaaatgatatatttaaaagctacttatatttttagatgggattgtagataattaattttcaaattctctaaaatagctatactttttatagtagggaggaaaagcaacacttagaaaaacactcttagactcttcatgaataacattagtgaaataatgcaaggaaagcactactttcctaaggagaacttactaccaagctacatttttttttcttaaaggtggcattggccatatttctcaacacagtttctaggtgtgaattcattggctttgtttccaataaatttcaagcctgaacattcagaaagaatagaaaaggctgcagatttttctctgggaatgtatatatgcagctatgtctgtatgtgtgttagcacacacttatgtgtgtgggtcttttataacaatgaaaatagataagataacacaagaaattagttcttcacctacagatacaaatcaaataggaattagtcaattcactgaagaaatagtgagaagatacagacaccttcaaaaagaagcacaagggtaaaacagaatattttttaaaatgattcatatgttattgtattctttaagaactctgagaggttaggtaagagagtattatgagatggaaaaggaacactctcagaatttctaaggtcaggcagccctggcctgcactattttatctgaagagagaaattgagggaacttttttgttgttgttgtttaccccagatatacaggagataaagaataaaggaaatataaaatgttttgaaaataaccagcatcctcaaaattagataattatttataaaataataaagttgtgaaacttattagtaatcataagcaatggaatgatgagtgaaagaaacaagtaagttagaacatatgtgactacccatagtcatgaagtcacacactggctgtcaacctgatttttttttctttctttctttcttttttctgattatccatgtgaggaaaataagtattcctcttattgtcaagtaccatagcttcctttgagtattcctcttattgccaagtaccatccaacatgtcaccattgtgtgctgattaatgaggctcagataatatcagtatccaatatcaattaaaagagtcatttggcaaaagcaaaaggaaaacctcagttttcgggaggcttttctacggagaaagcacaagcagatcacatgtggtttcatcttgcttgacagttttgatttgactgtcaatgctctgaggcacttcaagcagtataattttggtcttgctttcttgcttttctctgaccctcaggagtaaggtgccttccatcccttcctcttagtaagtgagtgtgctgaatatcttttcttgcctctccaatatgccattgtcttctagactcagattaagcattggattgggccat

SEQ ID NO: 42367 - DNA, 2042 bp, Homo sapiens
gtggtgttatgactcagtttccctacattactttttttgagatggagtctccctctgttgcctgggccaaagtgcagtagcatgatctgagctcattgcaatcgctgccaagtgattctcacatcgcagcctccccagtagctgggcttacaggcgtgcaccaacactcctggctaaatttttgtatttttagcagagacattttagtatttctagctacattggctaggttgatcccaaactcctgacctcaagtgatccaccagcctgattctgcccttttgtctcttagtacacatgctactcacccaactcctgagatctaattgggaagatgctgatcaccagtttcaggtgcttctatctgttgggggaccgccttcccctgaagccagctgtgactaattattattattttattgtgagcattattattttagagagatagtttaataactgcctgaccatcacctgatggttgcccgacatttcttgtggtagtgaggtccagggacctctcctgccctgctcatgtctgactagctacctactgtaacaagaaaatctttgaggccaagccatattgcttgaaggagcaaaactttttatgcccactgacaagggaaggcagagttacaccaacggttttcctgtttctgccaatttgaagaggattcagtttctttatgattttaaaagagcaccttgtggatgttttaaagtgaccagaacattttagaaccctctgactcctgctttcttctaatttcctaagagcacattagaaagagtctgctgattatttaaaaatatatagaggtcaggggaggagtgttggatattaatcatctctagagcagaaatttagacttatttcgcataagcctcaagctgttcatgtgaggacaatcccacatgtgtacgctatctgacttttgagtaactctctcaaaatgtgactcccacacgtacctccgcctgccctattctctgcttctcctctcccgtcatgtgagaggaggtacctgtgactaacgccatcacttgtgctctgacttccacatcaccttgtccttcccaggagcctttagctatccaatacctcttatttctgcttcttttccaatattccttttacacagggtctatttaatgaatatgaatatgctcaaatctttcccatctaaaacaacaaaccaagcttccctggtatcttcctcctcccagtgattctcctctcctttgtgcttccagttgccatcccctctcacatcagtcttcagttagttctcatctagtttcaaaccccaccattagctcccatgtaggatctcccagtgacctctatgttgaaatgtaaacctcaccttgacttgatcagcaacacttgatgctcttaactttgccctgttttcttaaatacgttctcttcttggtttccatgacactatattgtttttttctcgtttctttcctatttgtctttctattccttaagcacttctcctcttctgtagggttctttttatctacctgacctctaaatatcagagatctcaaacttgagttctagggccatttctcatcactattttaactatctatctctttgtatactattatccacacacataacttaagtgatcactatacatcaatgaataccaaatttatgtgtctgtgtcagagctcccctttgagctctagtagtcactctagctgacatcctggctaagtggtcatgggcatctgcatattgcctgtaacttattctccaattttcctatcacctctttccaaaattgccctagataatctattatggagaaagaggaaatgcttttgtgtttctggaggagtggggccttctaaataaatttagttgagtttcagagctatgtattgaaccgcatacttgtcactgtgtggagatttcaaatatgtagccacctaagattggctaacactgagcacatgttcttccactcaagcacgatccttatacagcatttcttaactcagtgagtagcatcacatgcccc

SEQ ID NO: 42368 - DNA, 1020 bp, Homo sapiens
atatttaatgtgctcacaatgcccttagctgatttggccacatgtcttactaccctcaatctaagttcctaccactgacctgctcatactgaactccctttatctctcagccttcagtcagactgacctctctggagtactcttacctctcactgactcctgcatctatttgagtcctattcatcttttacatttcagcaaaaacaccactactttaaggaagccttttctgattcactagatttaatcaggacccccattatatactttcttttcacagcatttaatttaactataatttaaaaagtttaagtgtgaccctatgttaatgtgtatataatctactagactgtaaactccgtaagaacagctccttgtggtgtagaaattttataaggaacatcttagtgtctgtgttagtagtggatcttagatatgatgggtgggtggcaatcactggtagataaaaatcactgataagctcaggcagataaaaaggtatgtgttgaatagaagaactaaaaggaatggaaggtactgaaagagaaaagattagagaatgagaattcaacaggcacgaacccctaaatcggggatgccaaccagatttcagctcatatattatctttgatctgctgctcttgccttccagaagtgatatattgagaaggattctgagcctgcattagaactgttggaaaagaagtgctgtcattgattaatgatgtttttcctggagtgggagagtgaagtggtggcatgtgtgctataggtttgccatgtctattaaaagatattgccaagtaattgtggtccaaatttcaatttgccaaggaaactgggtaaagctagactactttaagaaaatacattgaagaaaaaccaatttactaaaaacaagaaaacaaaagagacaaaacccgcaaatacaaacacaaaaaccaaaactcaaatcaattagaggaaagcttattagtataacaactgatttcaccaaaaagctgttacgtgtggtaaaac

SEQ ID NO: 42369 - DNA, 1050 bp, Homo sapiens
ttaattgatggtttgtttaattattctttgaagcatccaagtaaaactaatcagtatgatattttaagagtcatcacttttcattctttgacaaatgggtactaagtatgatttttccaatattaaaatggtcttaggcttttatatgaattcttgaaaatgataacatagccataataaattatgtaaattatcggtgtgccctttggtttagattaaatcaagatccctaaaaataatctacataatgaagctttcctggaccagcctgggcaaccacacctctttataaaaattaaaaaataaaaattagccaggcattgtggtgcacgcctgtagtcctagataatcaggaggctgagtctagaggcagattacttgctccccagagtttgaggctgcagtaaactttgattgtgccactacatttcagcctgggtgacagagtgagacctggtctctaaacaaaacaaaaaacaacaaaaaagccctcctgaagaaataactgtagttgatacaaatgtgtcattgccccaaaaggtaaaaaatctttgatttcgtatcttgcctattatgaataatactgcaataaacctgtgagtgcaaatatctcctcaacatactgatttcatttcctttggatatatctccagaagtgggattgctagatcatatggtagctctcattttaattttctgaggaacctccatattgttttctacaatgactatattaactttcccaaccaatggtgtccaagggttcccttttctccacaccctcaccaacacttgttatcttttatctttttgataatagccattctgacagatatgaggtaatatttcatagtggttttaacttcatctttgtaaaaggaaacacattgataataagagcttcatagcctcggataagctatttatttcttaaaataaaaacagagcagcctccgagactatcagcctcatatctttcataagcatgagatttaattttaaaataacaagggaaaagcctaggcttggtatgatgattatgtctgacac

SEQ ID NO: 42370 - DNA, 1033 bp, Homo sapiens
aacaagtgatcattggtcttatgtttggaatctgaaaaggctttgaaatattaaacaatgggtaaaattctcttccctctcctcccctctcctttctatttcttatctcaaccaatattttaaaatcccatacttaggatttaaaaatattatacaaattatactaattatttcatatgaattttcatttaattaatgtttactttttcattattctttttgaattgcatctcaaattcttctgctgataacatcttccgtcttcaggcaatattttttagactctttaagtgcgagtataatggcagtaattttttttttaggttttcgctgtctaaagcagtggttctcaaagtatagatagactatagaaccttgggggtcctgaggtactttcagaggattcataaaaactattttgatatatatactatccagagcaaaatcagggaagaggagcatggagatgtcccaccagacagttacacaacaggtctggaggtataagaagccatgtagatttcactgaattacaagaatatccaggacatagagtacaaggtgggattgataaaggatggggctggagaggtagacagggatcagaccacaaataacattttgggcatccactgtagttcaggtaaccttcagtcacaccaggaaaactcaaataacctcctagtttgttactttatctcaaatgttgcccctctttatttaccataccattggcagaatgatcaccgtttaatgtagttcatgtttatacactacttaaaccccgtcaatagctactcattgctctcagaagtatttctaaccacttaataggacctcaaatacccatcatgatctgaccctaactacatttccagcctcatcttttgtcagctccttctttatgctggctgttattttacgtagctcttttggaatgtcttccagaagtgttttataataccattgttaggtttactactaggtacttgagacaccttgtagcctttgctgctattgaacatgatatctt

SEQ ID NO: 42371 - DNA, 1073 bp, Homo sapiens
gtttgggaggccaaggctggcagatcacgaggtcaagagatggagaccatcctggccaacctcgtgaaaccccatctctactaaaaatataaaaattagctgggcatggtggcgcacacctgtagtcccagctactcgggaggctgaggcaggacaatcacttgaacccaggaggcggaggttgcagggagccgaggttgcgccactgcacttcagcctggcgacagagtgagactccttctcaaaaaaaaaaaaaaaaaaaagtcaatatgcaaatgttcctattgcacaagtaaggtactgtcctattctaactgacaggcagaagaaaattaaatcacctctgggcaaagatggcaacaaacagataatctactacatcacatacattgttttcagtattcaaataaaaatacaaaaatgatcaaaaacaaagcagaaagcagataatagaaacaggtccacagatgaactagattttggaagcattatatgtggacattaaaacaattgttattcatagggtcaagaaaatcaatgtcaaagtatagaatttcacaagagaactgtttctcagcttttaaatctcttatctcaccccacatacgatttagaaaatgtgtcaagagaaaaagcaattcagactattggacttattctctgtggatcttggtccctccagctcttgctctctctctctttctctttttttttttttttttttccagatggagtctcactctgtcacagattttgctctcttgatagcttttaactctgatatttctttccacagtgttgtgagaatgagaatcaagactgctgctttctgctacatctctaggttaataacaatgttattagcaaatgcttcaaggagaaaaggggcagagaatgacatggtcacctcactgaattttcattctctcaggaatctaggcttctcaagctctgcttgcatctgctgctctttgatgtattcaggtgtttgttgattcatttttgtacaaccagcaattattctcaatggaaggctagtattttacaaactaccgttatcacacacaaaggtg

SEQ ID NO: 42372 - DNA, 1068 bp, Homo sapiens
tttagtttcttttgaaatggccaagcatagagcacagccaaatttctatataaaagacacactgatggtgattaatttcctcttatctagagcctggcttatggaacaaagtagattgtctatcttccttattaatctagtaaatgatttagccttgttcctagtgtccagaaagttttagtaatgaagaaggcaaagcagatacaaatacatctatctgaaattgctgcccattggtatttgttccaaaagtttgattataaatcagttgttcagaagttggaagacattttcctttgggataaaatattatataggatcttgtgtctcttggtgattccatcaaatccaaatatacctgaggtatagtattgtattaatataactatactatagtgtttgtctgggagacatatatttatagttgtatttcaaagaaacagtttattctattagagaaatattagactcctttccattaacaaaccacgttctgagtagttaaagcagagactccttgagatctaagcctctgataatgatctgatacagggaaattgaacttgataggggatggggacaagattacgggacatgaggggaggagatggctactatggaataagcaggaggctggggaaattccagaagtagagacaaaggagttgtttactggagtttcctactagagtgacattgtagaaaacactggccactcaatctccccatttatttttttctaaaggtctcaaggattaacctgttttcccatttcatggtcattgtctcttatatttccctcctgtgttgtccacacacctttcattcctgatctctggatcctaaacactgacactcattgtaaacattggttttttaatatatctggggcacagctcagtaaattgagcagaggaagaaagtggtatgttgtttaagttttaataaatcctcgtatttattcatcaacagttaatttagagatcaacacttagacactcagaaaattattcaaattagaacatttgtcttttttctttagagaacttctgtttaaatggggagatg

SEQ ID NO: 42373 - DNA, 1022 bp, Homo sapiens
tctcgctgtggttttgatttgcatttctctgatgaccagtgatgatgagcattttttcatgtgtctgttggctgcataaatgtcttcttttgtaaagtgtctgttcatatcctttgcccactttttgatggggttgtttttttcttgtaaatttgtttaagttctttatagattctggatattagccctttgtcagatgggtagattgcaaaaattttccccccttctgtacgttgcctgttcactctgctggtagtttcttttgctgtgcagaagctctttagtttaattagatgccatgtttctattttggcatttgttgccgttgctttttgtgttttagtcatgaagtatttgccatccctatatcctgaatggtattgcctaggttttcttctagggtttttatggttttaggttttacatttaagtctttaatccatcttgagttaaatgatttataaatggttttataggattgaatcaagctgatcccacaacgctacatccatatttcccaccaaaacaaataaacaaaaacaaacacaaaaacctatatgttatttgtgaaagtttatttttcattactatgcagttcttgcaaacaataaagtggagatagagaaaatgagtcacacaatatgtgtcttttgctcagtttattcatagagcctatatttttcactattaataaagacagtagcctcctgtgttttcatgctcattaatcagtcagtggcttcatggattcttgctgtcagacaattctatttggaaaactaccaagatagcaactcccttacttatagaacaaccatagatgtaggagcaattatctgtcaaagagcatattttctcttcctttttacctcccatccctttgacagagcattttagcaacactactgagtatattgatgtccttataataggaaggcaacaattctattctttactttggtaagatgaaatgttaggataatgaagagagctaaagatagtgaatttttcattctctttta

SEQ ID NO: 42374 - DNA, 1044 bp, Homo sapiens
attatcttgtctggggtttgcctagcttcttgagtctgtaaatttatatattttataaaataatttctatggaagagtttaaaaaaaaactgtgcataaatttattcctcttatcaggtaaagtaagggctcacttactcacccctgaactggatatcattaagtgatctcagaccccttttcattaagcttcagtgaggcttcagaattgtttccactacagtcaatagccaatcaaatactgtgcaaaagtgtactaaagatgtctttgaagatgctgttcattacaactcagggacctcttcagtcctgctatcggagaaattgctctctcactttagatactttaaaaaatcttagggaaactgttgagctcctctctgtgatatgtttgccaatgcttacgtacagatttgtgggtccttccactaagtatgcagaatcagttggagtgcattttgtgtattgacctcacttataattacagtttatgttttattttctcctcttaccctattttcttcatctacatattgaagattttataatttgtgagttgataaaatctactaaagtcctattggaaaaattagagatgtaaataaataaattatggcatcttctttagtaaaaacactgaatagcctaaaggtattaattcttcccaagtaatttatagttttaatgaaattataatcaaagacctattttggatgtagacaacataattccaaatctattttgtagaataaagtgatgaaaagacctaagaaaatgttaaaaatgaagaatgattagtcaacttcctcgacaatagatttaaacatttgtagaattaaaagttttaaaagaatatgagctttacacaattctgggcagggaaattaataaacagacacatgttgacttatggcaacaacttaatgtggaatgaataaattagttaccaaatggtttgaaggaaatacttaatctcatgccttacaacaaaataaattccagatgcattaagggattaatttttaaagaatagcgtacaaatct

SEQ ID NO: 42375 - DNA, 1056 bp, Homo sapiens
atgtgaagtgcttagaatagtgctaggtacatagtaattgctagataagtgttattatttttattagacttgagatattagataaagacttaaagcaatgctaacattagaaaatacttagaatttaaagtgtaaagtgttaggtgaaaattttctggttaaaaagaacaaaaaaagtagcataattctaattgtgtattgaaagttatttatacatattttaaaagaaatctagaagaaaatatcctgaaatatttccagtggatagatctagagaaaaatgcaagcataccttttttcattgtcctttgctttattgtactttgcagatattgcatttttcacaaattgaaggtctgtggtaacactgtgtcaagcatgcctataggtgctgttttttcaacagcatgtgctcactttgtgtctgtgtcacatttgttaattctcacacatttcaaactttattattattattatatctgctatgatgatccaagattaatgatctttgatgttactcttgtaattgttttgggacagcacaaattgtgtccataatgatggcacacaatctataaatgttgtgtgtgttctgactgttccactgagcagccattcctccatctctctccttcttcccaggcctccttattccctgagaaacaatattgaaattaagccgattagtaactctacaatggcctctaagtgttcaagtgaaaggaagaatgacacatctctcactttaaataaaaaagctagaaatgatggagcttagtgaaaaaggcatatcaaaagctgagataggctgaaggacttcttgtatcaaacagttagccaagttgtgaatccaaaggaaaagttcttgaaggaaaataaaagtgctactccagtgaacacatgaataatgaaatgaaacaggcttattgcagatatggagaaagcttaagtggtctggataaattaaaccagcaacaacattttcttaagccaaagtctaatccagagcaaagtcctaagtctcctcaattccctgaaggctgagagtggggaagc

SEQ ID NO: 42376 - DNA, 1074 bp, Homo sapiens
ttttggggggtgagaacacctaaaatctactctgctactaattttcaagaatataatacattgtgattaactataatcatcaaattatacaataaatctcttgaacttatttcccctatctactcagaagtagaaagtagaattgtggttataagggactggactgtgggtggttggggagatgttatgaacaagggttaaaaacctattgaatactatgctcattacctgggtgataggatcaatcataccccaaacgtcagcatcacacaatatacccaggtaacaaacctgtacatgtaccccgtgaatctaaaagaaaagttgaaattatttaaaaaaagaaaagaaaaatgatctcagtcatactagcaacaaaaattactagcattaccagaaataaacctaataaaaactacaatttggttatataagaaattataaaactttttgttgaagaagataaaagaagacatgattaaaaagaaatatatattatatttgtggaagggaaacacaacatctaaaacgtggcaattctcagactgatacatatattcaatgcaatttcaatccagacatatttattcaaggtatttgtttgctttatattcagacaaccttcctattcattatgctaggtgtctttctataatttgaaatactaaacaagcaagcttttttttttttaagagaaatagagagagggtcttgctatgttgcctaggttggaatgccgtggctatttaaggttgtgattatagtgcactggagccttgaattcctgggctcaagtgatccctctgcctcagctgcaactacaggtgtgtgccaccatggtaggctaatttttaaagtcattaatttaagtatgtaatcaaaataaatttaaataacatcgtttctcaagtgtgaagttggggccttttttttttatctagtatctctagaaacaatagttttcccatctacatctttcttcctacttgtctcgtatagttattttacaaaaaaaaaaaaattcaattcaccttccttctgttctgctctcctaaaatgctagaataaaaatag

SEQ ID NO: 42377 - DNA, 1054 bp, Homo sapiens
tcagagtctgctctctcgtgtgtgagtgcagttcagtgaacagcagcacctctggaggggtcctcctatcacaaagagcagagagacagagaggaggccagcactctggagggctccctgccaataccaagttgccttccaaggctttagggaggtaattaaggttaaagaggtcataaggatgaagccctcgtccagtaggactggtgtcttctaagtagtggaatacatgtcagggcttgctgtctccccttcaagggtacagagggaaggctgcacgaagagagagagagaagacagccatctgtatgtcaggaaaacaagcctcaccagaaaacaaatttgtgttttttaagccacccagcctgtggtactttttgtgtgtggcagtcctagctgagtaatacagggatatatgggaatcatctgtgttgtctacctagattttttgtaaacttacaactcctctaaaaatagtctattataattttttacattgaaaaaaaaagtacaggaaaggaaaattctttaagtaggcaaaacatcaagcagaacacttgcttgttcacactgtacagaagaagaaattttcataggtgtgattctgtatcagtctcaggatatggtttggaagaaacaagatttgaaaacttaagtcagagatagatagatagatagatagatagatagatagatattatatctaatatgtgaatggacttctcagaataagtagagtgtgaagatatttgtattttatatgcatactcaccaaagtcattcaattcacagggagctccaaataattaggtagacataatgatgcattttctctgctcttccagagggcaggatgcagacttgttagtggtaatcttgctgatctttactcttcaacctttcaattctctgtaagtctacaattctttttattatgatgatttatacttgaaatacagagtagtttctgtttttctgagtaaactctgacaaacacaacatgtcataaagacagcaagcatgaaatcttacactcagaggcataactccattt

SEQ ID NO: 42378 - DNA, 1033 bp, Homo sapiens
tgactctgtacctggggtgattcggcactatcttgatacatatttggttgttgcaactgggatggtgctactgggatctaataggtagaggtcaggaaactgttcagcattttacaatgtacaggacacctccctaccgcaaagaactgtccagcacaaaatgtcaataattccagggttgagaaaccctggcttatttgtcacttcctcaatgttttcagtcaacataaaattaattcactttctctctctcaaaccatgctgttcttttccgcagtaattcatcgaaattttcaattgtgtattcagttctgcatctaattgtttaatgcctatttcccccactagactgttctgtgagaatagaaatgtgtctattttgtttcgccactgtttattcagtgtgtggcataatatctggcatacagcagaaaataaataataattgcttaatgaataatttaataagctttattattgagtaggacattattttagaaaccgagtagaaacagtcatttgtcacactgtcattcaaatccaggaaaaaatgtagtgcaaaactaagacatacaaataacaaattacagtacagggcagttgaaataatatcctaaacagggttaaaaataatattttgggtaaattcagaggaaggaatgaataattcttatgaatttggagttatggagcatcattattgtcattaccttcttcactaccatttttgaaaaataattaattgactcacaaaataggggttatctctgagatgtaagttgacacatgcttaacttactatgtcactcaccacattaccagatggtaaatttttagtgactctgcactattaatttgttttctacattacaaacaaattggtctgagtggaagcttgagttgcctgagctcaaaataataattctatcttgcaatgatctttctgaatatgctcaagaaaccaattttggtgttgtgagaagcccagaatggtttcatttattctggaccccaattctactgacagggtaca

SEQ ID NO: 42379 - DNA, 1052 bp, Homo sapiens
ttttaaggattctatggctatttgggatcgtttgagattccatatgaattttggaaagtttcatctatttctgaaagaaaagccactgggattttgttagcaattgcattgaatctctatattactttgaggagtatgcacatttttaacaatattaagccttccaatccatgaacaaagatgtcttcccatttatctgtgcctttttaaatttttttccacaatgttttataattttcagtgtacaagtcttccacttccttggttaagtttattcctaagtattttttgatgccattataatggatttttatttcttttttcttgtctaatttctctatctgggacattcagtgctacactgaatagaagtggtgaagatcaggaggaaggaaggaatgctcattctcaccacttctattcaaccattgagtattatgttaaccagcggtttgtaatatatggcctttattacgctgaagtacattcctttttttacctaatttgctgagactttatatcacaaaagagtgttgaattttgtgaaattctctttctacattgagaggttcacgtgatttttgtgtttcattttgttattatggtgtattacattgattgacttttgtatattgaaacattcttgcaacccaggaataaatccaacttggtcatagtatataacccttttaatgtgctgttgatttaataacctagaattttgttgaagatttttgcaccaatattcatcaggtatattagtctacagttttcttttcttgtagtatctttttctggctttggtatcagggtaatgctgacttcatgagtttgaagtgttcctcactcttctattttttgaaagagtttgagaaggatttgggtataatgtgtgaagcaacttttgctgacagtgttgcagcagttctccaaaattgaattgtacagtaaccaaaacagcatggtactagtaccaaaacagagatatagaccaatggaacagaactgagccctcagaaataatgccgcatatctacaaccgtctgatcttt

SEQ ID NO: 42380 - DNA, 1034 bp, Homo sapiens
gaaggcttatttttttaacagaaatctggatattaagctcaatttgttattaatatattatttgtacaacccatagagagattaagggaatgttacagtatatggctttcaaatgtgtaatggctttctatgtgtaatggggagcatgttaaatgatcatgcaaggaactatttcctgccattcatcagaaaacatacaataaagaagaaatatcttacaaatgaggccttttgataacaggtaatgcagccaggaaacttcatagtgctatcaattgtggtgaaaatatctccctattagttgatatttgtgaaactgcctaattgcagccaatcaaccaaatatttatggcaaatttcaagcattttgcatgtattgatgatgatgtatctcatgctaaggctgagaccaatgacactacctcaatggtggattaatgtaagagatttgacatcaagaaatcaaattcaccagtcagttttgaaaaaaaaatatgatgacaggctaagaacaaaatgtggaacaaatgtattcctctaactcacaatgacattcaagatttcaaggcaaggattaatcaacacaaagcaaattacatctcactcaggaaactggaatttttgttgtggacaataaaaatattgaagtttaggaccactttgcaaagaactcctaacaaacaaatttctcaatttgatgcttattgtttgctatagaggaaaatagagtagacaaaaatatttaatgccaagtttttaaaataaatttgaaatgaagaattcaaaaattgctgttgcataagagaataattatagcacaaacagtcacatcacattaaaaaaatgctgtctcattattaggagctgtgtaagcataagcagagtcccaacacatctgttttgaatttttatttgcttttaatctcattgcttttttttatgtctttcgacaatgtttgacagccttccatattcagagactaatactaaaagaaaagacaattcacaatttgttggatttgaacacgttcgga

SEQ ID NO: 42381 - DNA, 1009 bp, Homo sapiens
ttttatgtgtatcagaaaatatattaggatttatgagtatgagaggtcagaaaaatttttttgtgttgttttatgttgatgttcccagagtgattataactagactccttaaagtaaatagtctattttatgccctgccgagtgaggagagtggatgggaaagacgtggactagaaagagagtgtcaggcaggtttgttctgaggaagtaataatgcagtttctcataacagttgctatggtctgaatgtgttccctaaaattcatgtgttaggaacttgattctcactgcagcagcattgggaagtggagccttttgggggtgtttaggccatgagaatgccctcatggatagattagtgctctcataaaaaggggcttttgtgagtgggtttgctttcttctgttcttgtctgccatgtgagaactcaggcttctccccttgggaggaaccatcttggaagtagtgagcagccctcaccagacaccatatcttggtattggatttcctagacctcagaactgcgagaaaatacatttctgtcctttataaattacccggtcttatgtattctgttatagcagcacaaacagattaagacaagagtgttacaagctaaaacaaaaatgttaacaattgttataattactttttaggaaaactctcaatttacttgacataaatgagagggaaaaatattgacttcctttaaattagaattgtgtgtgattaacacagatgttcaatggaggtcatgattctctccatgtgtattgtgactcactgtgtgcaaatactgaatattcaccaagttcactaagtttgcaaactataggccatgggtccaatgtagtctactactgtttttctaagtaaagtcttattgaaacacagtgacactcatttatttatgtatctatgacttctcttggactccgatggcagagttggtaattgcaactgaatgcttatgcctcacaactagaatatttactagttagcccttcac

SEQ ID NO: 42382 - DNA, 1032 bp, Homo sapiens
gtctagccctagaactttatttttcctttccagtgagagccaatatttccacatcagaacaaaggagaatagctaaactacttgatatttatgaaaatgttctccacactgttgtgtacattgtagaaccctaaaatacaaatttagacagatgattttaaaacgtgcttatgaagaggttcttagtgacttatctcagaactggaaacttacccagaaatttcaaatgatgttaacaacaaggagtgtgaccaggatttcctggttcccacagagtaccatgatcttcccacaaatagaatgtagacaatcaatctgcttttgaaattacatttactcagctgtatgtataataactctagatactggtatattacattaatttctgaatctgatgtcatgaataagtatttgagagcatgctaagttctaggccttgataaaggctccaaagaagtatcttcaaatatcacctgagttcaaagagcttaaaattttgtctaatatctaagaagatggcacatgctgagtcacctgatcattaaaatgtaagtgactaatcagaaatacctctcttaataaaatttcaagggacaaggagggagtgaaacagaatgatgctgagaataattaggttaaatcacaattttgtccaaagaagaccaggaataacacaaaaccaaatggcagtcagatacaaaaccagaactctaatagccatttgtattagaaaaagtgacagaaaaatctaatgtgtaatgacaattaaggaaaatttggcggaaaaaataggcaataaataaaagtacaacattacaagttaaagggaaaggaaacacaataaaacaggacagtgattataagctcttttccaaaaatttacttctaacagaacagtcaagtttctctgaaaagtaactagaagtcatagaaaatatcctgaacctcggaggagcattagagacattacagaacagtgtttttgttgaagactgaagtacctcagcaagatgtatcagagactacattttg

SEQ ID NO: 42383 - DNA, 1022 bp, Homo sapiens
gcatgttttgaggaatgggtcaatatattttcttctgtagtgatcttcaattgatttggcatcattttggaaaagcccatcctctttccattccgcagatgggttttcatcatatatttgtgaatccttttctgtattggtatttttgtttacctgttcactaatacaacactgtcttggacattagagcattacaatagttctcgttggatttttcccattatctgtaaactttctttggttattattggccttttgaatttctgtacatactttagaattagcttgttcattttatatatatatatatgtatatatatgtgtatatatatatatgtgtgtgtatatatatatatatactttatattaattctaccatatatatttggatagatttttggatgggtttacattgagcttatattctaatctaaggagacttggtatttttagagcatcactttgtgaaagccctcaagcaaagagatccagatattagcagctgaaaggactggaagtcagctggagttcactgtaatggtaaagccagagtgaaatgaatcaggcactggcagtatgggctagagtccacacttttcatattcagattcatacatatcctatgttaaggtgattatgtcctgttattatttctctaaagcagtgaccaataacaatttataaaaaagaggatctagtgggacaagctgtgtgtggttgtttctgaaccgaaaactgttattcatcatcttcctcctgaactactcctacattcccctcaaccctcagtcagtactttgttggcctggtggggagactcagaccttcatcactcaaaggtctgaactcatatggttattacacccttttcaggccatgattgctataaatgcctatttctgactatcattggatgtggaagcaaatagacaccccagtgaatccctcaagcttcagacatgtttctctctccctccattatgaagtagatttgaagagcatcagatgactatgtaaatgta

SEQ ID NO: 42384 - DNA, 1148 bp, Homo sapiens
tacagttagtctacactaaatttataaaaaaaaaataattgccctacaaagtcactatggctacaaggccaatagacaataggaatttttcaattccattataatcttatggagtcaccacagtgcatgcagtccaccataaagcaaaatttgttatgtgatgcatgacatatatatatatatacacgcatgcatacatacacacacatatacatatatatgtacaaataaaagcagtaacaattgttctttgtgtactccatttgactgtaatgcttttaaaaccaaaaaacataatatattatacagttaagtcacaaaatattagttaaatatttttgctcaaggttcagttgcagagactggaatgctcttgaatgaatttgagcagagatagatttattacagcatatttaaagacttacaaaatcattgcagttgctgatgaaatagtcttagtgtaaatcaatacttcaggccaattctcctcctatgaattgtggacaagcagaacaactaaaatgatttatttcattgctgtcattcaagccaacactgaagaactctgttatgtgaaagccatcaggttttggctgatgccagaatatcatgcagagaaaaccccctgtatggtaaacacacctcaatgcagttcagagttctgaactaaggaatctgggaggggctgacctggaaattcattattcatctatgaagaacatctgagtcccctaacccccatcctttgtctgatcctctcagatacacgggttcaaggtcctttgttatgggttgaagttttccaggtggaaactgctaatggtaggatgataagtgaaaatgatgtataaactgcatgctttttgcaagctgtgtggttctcctgtccagcccaccgccagtggactcctcccctctatgtaatcccccagtaaaacgccatgccttgtttgctggttctgggtctcttcctcggcttcttaaacctgatgccatccccactggagtcaataggggctcagcatgacaccccacttctacctctgttaactataagacagaccacattgttttcctcactggataactggtcatagggaactttctataaagccgtaggtgtggataagttcaagacaaataagcaa

SEQ ID NO: 42385 - DNA, 1052 bp, Homo sapiens
tcacagtgatctgagaccgcaccactacactccaggctgggtgacagagtgagactctgtctcaaaaaacataaaaaaataaaaatagaaataaaaatttatgatgagcagtttgggtagtgtagtccttttgtattcctgggttcaatatttgctatttactgacgttcagaggtaggccaggagctgaattttcaaactgagactagtcctgagcagaggaaggaatggtcttactacaaaccttagaggtaattctatactgtggttgttctttgggactggcaaaagctactatatgaaatattgatgtgttgcacattcattaccactgaatctgcttggatataagctcaagtggtagtacagcttatgtcatattgtgcagagcttctcttgctttgaatcaaacttaaatcttgcaatcttgtgggttccctttaaatgagtggaatagtaaactacggaataatacatgttgcatccaaatttcaaagtctgataaatactgtgattctttacacagtgtaatgtgctgcaacttttctctaattctagaggagacacctgagatgcctcagactaaaggactcctaggtattttctgatatggtaaaaatttcataggatttattgtatgtcctctcttatgcttgtgttttaaggcatttatggctcctcttattttatgctcacttggtctaacaaacacatgacatcaacataatgggtggtataatattctgtaagatatccaaatgatctggacaatataatattagagaacaagagagctgacatcactctgaggtaggacaatgaaagtatgctgctcttcctgctatattggcattcttttgattatttttaattattgggataagacaaaaaagcattttctaagtcagtatctacataagaactgctggccgggcacagtggctcatgcctataatcccagcactttgggaggctgaggccggtggatcacctgaggtcaggagttcaagaccagcctgtccaatatggtgaaaccccatctctactaaaaa

SEQ ID NO: 42386 - DNA, 1029 bp, Homo sapiens
gacttcatcacaaatttgtgtgggtctaaaacaccttgattatcattcagtcttgggctaattaaggaaattgtactcaactgtctcttaaacactgtcaccagatcccttccacttatggaacttatctatagagcacaactattgcagtgtttttcaaagtgaatgcttccctcaacaatgaatctcttaatttcttaatgaaagatgtgtcttttagatcctcccaggagccatagttaggggctgatcattagattgcacacagtagatctaccccaccgtttccattttccagaccttacaaacccctttcattacatcaggactcagcaaacgttttctataaagggccagatagtgattattttaggctttgtgagccagtcagtctccgtcacagttgttcaactcactattgtagtgttgccataggcagtgctataaaagcagccatagacaattggcgtggctttcaataacactattcacaacaggtagtatgttggatctggcctgtggaccatagtttgccaactcctgctctacactgcatcaaggaagttctagcatttcaacctcaccaaatgtaggctattggaaagcttaatcctccattaatcaaactagcatatataatacttcaaggtactcaaggcaaaacattaagtctcatgtcaacaaatcgggcctagtctacctacaatctgttctaatatttcaagaatttgttctattctcatacatgtttcttcactgctaacataaattgaaaaaaaaaaaacaaacaaacacctatcatgtcttttgtgtgtaagctataatgtgcttaagcatgccttccacttctttggtccgtaatgagaactcggtcttatttgggacctagacaaaataagaatgtctaggagtcatgtagagatttggcattcctttatgaggcaacattcctagggcaatatcattggatgtttttcatgcaattgaatgtttcttccattggagaacaggaaagcctgcttctacttt

SEQ ID NO: 42387 - DNA, 1050 bp, Homo sapiens
acataaatgtaagactggcttctttttaaatcagtattctgtatctcgtctctttgtttttgtcccttcaacttttattttaagttccagggtacatgtgcagggtgtgcaggtttgttacataggtaaacatgtgccatggtggtttactgcacctatcaacccatcacctaggtattaagcccagcatccattagctattcttcctgaagctctccctccaactgcccacccctacaggtcccagtgtgtgttgtttcctgccatatgtctgcgtgttctcatcattcagcttccacttataagtgattttctgctcctgtcttagtttgctgaagttaacggcttacagttccgtccacctccttgcaaaggacatgatctcattcttttttatgactgcatagcattctatggtgtatatgtaccacatttttcttatccagtctatcattgatgggcatttgggtagattccaagtctttgctattgtgaatagtgctgcaatgaacacatgcatgccatatgcagaaaactgaaactggaccccttccttacaccttatacaaattaactcaagattgattaaagacttcaatgtaaaacccaaaactataaaaaccctagaagaaaatctaggcaataccattcaggacgtaggcacaggcaaagatttcatgatgaaaatgcctaaagcaattgcaacaaaagccaaaattgacaaatgggatataactaaagagcttctgcacagcaaaagaaaccatcatcagagtgaacagataatctacagaatgggagaaattttttgcaatctatccatctgacaaaggtctaatatccagtctgcaaggaacttaaacaaatgtacaagagtaaaacaaacaaccccatttaaaagtgggcaaaggacttggacagacacttctcaaaagaagacattcatttggccaacaaacgacccactatatcaagttaccaaggctgattgtgtgcctagatgctttatagcacacatcattgttttgaaatttctctcaaaggagtaga

SEQ ID NO: 42388 - DNA, 1054 bp, Homo sapiens
cccaaagtatgaaatagatattcctgagtccatcctgatataaataaatgatttaattaataaattagtataagaaacaagtatctggtgctgaagaatttcaagttacatagatagatagatggatagatactctgctctccaagcgttgagctccctattctctaagtgtgcattgaccacagtgacttccttccaaacagtatagtatagaaacgggagaaaaacagaaagtttataatggagaaacctgacaaaaactacctcagtcaggtgaccaaggttcatatcaacattgacaggcaatgggaagtatgtatcattataggatgtgatgaaaatggcactttacttgtgtggacttaacctcagatatccccagtctaatcatgggaaaacatcagacaaatcccaactgagggatattctactcctcaaaagtgtctgggtgatcaaagacatacacctttctggtatgtctcattctttcttgcattactatacttccttcaagggaccatttgtcttctaactgaagaacttctgttagtattattcttttatagtcattttgctgacattgaatcttttgatttttgctttatgaaaaaaaccttttatttcatttttgaaagattttttttttgctgggcagttattttctttttgccttctggcttctaacatcttgagaatttttgaaaataatgtgtcttttcttccagctactcttattattttctttttatcctttgttttcagcaattttgctatacgcacccaaatatgtttgtttttatatttatcctttcttaggtttatatcaatgtttgcttctgtagtttgatttttaaaattaattttgggaaattcttggccattagattttctggcattttcttctattctctctttcttcttctggaattccagttgcatatatgtcagatactttttttcacttcccatatgcctatagactcttttcagtatttcttatctatttttgccttttttttttcttttttttttttttttttttgagacggagtct

SEQ ID NO: 42389 - DNA, 1034 bp, Homo sapiens
aattttgatatctccttaagctttacgccaacattttgttttatccattcctggacttatacacaaaacccaattttttcctggctaacagagaaaccccgtctctactaaaaatacaaaaaaaattagccaggcatggtggtgggcacctgtagtcccagctactcgggaggctgaggcaggagaatggcgtgaacctgggaggtagagcttgcagtgagctgagatcgcgccaccgcactccagcctgggcgacagagcgagactccatcgaaaacaacaacaacaacaacaaaaaaaaaaaaacaatttttaatcttctccctattgaacttgttctcacctgtgatccatgtttgggatatattctctaatccaggtcacagcaacttggctgagtcccttactgaaagtcacagggcctgtcaaacagccctcatcaggtctcagaaactcccaatttcccttgctacttcaggcttaagagggtggaaacagcttagagttggtgctggtgctggaaatggaaataccaaatattgtttcctaaacattcatgcaattctattaataatcgctttattaaatttcccatttgatcatgtcaattaattctttccaggatcctgactgatacagtgcctatatttatgaattctttcagaatttaaatatctcatctttgattttcagaaaccacccacagtctaaagattatgtctatgactttgcttatgccactgcttctatctgacacttacctgacttctatttgcccagttcctagcatcttccagttcttccatgaatgccacctcttctctatgactttccctccaagatgaattatatgtcctggtttgcctgtgacggccccggctagcaactattttcctggcataattatcaattgcttccctttcatttttaaaaaagtactagttatagatgaaaaaattatactgtcaccttatctatgcatccttcaaccagaataaatttctcctgattcttatctccacattattttattt

SEQ ID NO: 42390 - DNA, 1027 bp, Homo sapiens
tttctcctttgtgaaaggtcagttggctatatttacatgggtctattttaaagccttctcttctgtttctttatatatatatatatatatatatatataattggtgtattattggtgtatatatattatataactataatatattcatatagattacactgtgttacaaacaacataaaacaatacaaaacagttgaaatgttaaggagaaaaaaggtgactgagagcattgggcaaatacttacttgaccataagcagtgtcactattctcaggtaagaatgaggcatccacaacagtcacccgcggtgacagccatgcccagctgagtaccaggttcatgagagttaccagcatcatgagagaacacagaaatgagaactgtacaaactgacagatttgtttcagaacaaatgtgtggcttagaaactctaaaaactgggataaattttaggaatctaatttcacacaaacaagtcataataatctgcatgtgaaaattgaattaaacttttgtttaggtatagttttaccaggatggggacatttagatttccttttttatcttcccattaatatggcatttatttatttatttatttattatttattttaatgatttttttttttctaagagatagggtctcactctgtggcccaggctggagtgctgtggcacaatcatagttcactataacctcaaactcctgagctcaagccatccccccaccatagccttccaaaattctggaattacaggcatgtttcatttactttttttaaatttacttttatttttctaatatttattccactaacaatatattattgagttaatggtgccttcaagcattgatcttttgtcttaaaagtatcatatgtataatttcatatgtgtacatttacataaacaaatttaaatgctgaattacatctacattttaaatttacgcacccatttaattgttacttaaaaaacagtttagtatgaaattaatgttatagaaaataaatgctatcaaaatatc

SEQ ID NO: 42391 - DNA, 1973 bp, Homo sapiens
ttttatgagtttcctttttgtttgtttgtttatacaaacagtaagttattatcagcttaaaataataagatagtatttgcgagccccacagtaatttcaaattaaaaaacatacaacagatacacaaaaaaattaaaagcaagaaattaaaacataccaccatacaaaatcaattttactgaaaataaaatagaaaataaggaagaaaagaccacaaaataaccagaaaacaaacaactaaatggtaagagtaagtccttagttatcagtaattatattgaatgtaaatggactaaactctttaatcaaaagacatagagtgactgaatgtaaaataaaagaaaacaagatgcaataagctgttgcatacatgaaaagaaatatatttcatctataaagatacatgtaggctaaaaataaagagataagtaaagatattccatgcaaatggaaaccaaaaaagagcagaagtagttatactaatagcagacaaaatagatttgaagacaaaacctataagaagagacaaatattgtcactatataatgataaatggatcaattcagcaaggggatataacaacttaaaacatatatgcacccaacactggagcatctggatatataaagcaaatattgctagagctacagagagggatagaccccaatacaataagagctggacttcaacaactcactttcagcattggccaggtcttccagaaaaaaaaaatcaacaaagaaacactggacttaatctgcactataaaccaaatggacctaatagattacttatagaacatttcatctaatggctacagaatacacattcttttcctcagcatatggatcattctcaaggataaaccacatgttaggtcacaaaacaagtcttaaaacatttgaaaaaactgaaataatattaagcatcttctccaaccacaatggaaaataactagaaatcaataacaagagaaattttgtaaactatacaagtacatggaaattaaacaatatgctccttaatgaccagtgggtcaataaagaaattaagaagaaaatttaaaaatttcttgacataaatgatagtggaaacacaatacaccaaaacctatggaatacagcataaacagtactaagaggtaagtacctacatcaaaaaagaactttaaataagcaatctaatgatacatcctaaagacctggaaaattaagaacaaaccaaacacataattcatagaagaaaatatataataaaaaacagagtagaaataaatgaatttgaaatgtagaatacaataaaaaaatcaataaaacataaagcaggttttttgagaagttaaacaaaactgacaaacttttagctataccaagaaaaaacagagaaaatgcccaaaaaaattaaataaaagatgaaaaaggaggcattacaaccaataccacagaaatgcaaaggatttttagtgactactacgagcaattatattccaataaattggaaaatccagaagaaatggacaaatttcgagacacatacaacttaccaagattgaaccatgaagaaatctaatacttgaacagaccaataacaagtaataagattgaggctgtaacaaattcttccagcaaagaaaaacccaagacccaaaggctaaattgctgaattctagcaaacatttaaaggagaaacaatgccagtcctactcaaactattatgaaaaataaagaaagaggaaatactttcaaactcattctatgagggcagtattacactgataccaaaaccagacaaagacatatccaaaaaagaaaactacaggccagtatctctgatgaatattgatacaaaaccctcaacaaaatactagcaaactgaattcaacagtacattagaaagatcattcatcatgaccaagtgagatttggcccagagatgcaaggatggttcaacatatgcaaatcaatcagttgata

SEQ ID NO: 42392 - DNA, 1005 bp, Homo sapiens
acaaataaaattaaatatctacgcattaaacaaagaagtgaaaaatctctatggtgaaaactatacaacacggatgcaagaaatagaagaggacacagaaaaaaacagaaagataatccacatttatggattggaaaaatcaatatttttaaaatggcgatattacccaaagcaatgtacagatttaatgcaattcctataaaaataccaatgacattcttcacagaaatagaaaaaataatctcaaaatttatacagaatcacaaaagacccagagtagccaaagctatcctgagcaaaaccaaaccaaaacaaaacaaaactggaagaatcacattatttgacttcaaattatactacagagctatagtaaccaaaaacaggatggtactggcataaaaacagaaacagaccaatggaacaaaacagagaacacacctccttgagaagctgaggcggaaggatcacttgaactcaggagttaaaaactgcagtgagccacaattgtgccactgcactccagcctgggtgacagagcgagaccctgtctctaaaaaaaacagtaaataaattaataatgttgatatcaacaatagtaatcactatcacatactttcataggcagacatgcatgcacatataaattaatgctcggactcttactgccaacatcagaatctacctttgtcttcaaggcatgagacagaatattatctggcccagaagcctatacgttcagttgctcaagcgtactggccagatagtctcacaggaattctaaatgggacttctatgcatagaggcaggcacaggatataggaggagaaattgaaggtgggtggtggcaagtggaagggagagaacatggtgcaaatgtgtcactagcactcaacacttctgagacataaatagaacgaagtattagaactgagagggaagagaaggtagaagatgcttgttcaagacagggccacttttttttaataccaatctgcactctaggta

SEQ ID NO: 42393 - DNA, 1046 bp, Homo sapiens
aaatactaatataaactatatagttattttataagatcatgaaggatatttgatgtaatctagacatttccttaacaagataatatatgtaacataatatgtataaatattatttggtatgtgtctatatgtttctacatattttgagtcaaaaccaaaaatcttgatgaaataatagaaaaatttccattatagacaagaataaaagtgcttgtacactgtgcctgatattactaagcagtgcttgggaaaaatgtatagctgtgatacagacgtaaaaatgttctatgttaaaatacaaaagttttctcaaactaatgatctaaactttcattttaagaaactaaaaaaaaagagcaaactaaattcaaagtaaataatggaaataataaaggtcagagtgaaaataaatgaaacagaaatgagaaaaacaatagagaatatcgatgaaaccaaaagttagttctctgaaaagatcaacaaaattgacaaaactttagctggactgaacaagaaaaaaggaagaaagatttaaattacccaaatcaggaatcaaatagaggacaccaccactgaccttatagaaacaaaaaagtattatagaagataaaatgaacaatcatatgccaacaatttgtataactaggatgaaatggaaaaattcccagaaaaaaaaagatgaaaagaaaaacatcaagaaaaacaagcctgtgaaacacgatggaagaagaaatacaaaatctgaatagacctgtaagtaaagtgattgaattaatacatttaaaactttacacaaagaaaagcctttacttgtgaatctatcaaacatttaaagaatcaatactattcctgaaaaaatagaagatgagggaaaacattccaacttattttatgaggtcaaatatcaccctaatagcaaaagcagaaaaaagtcagtgtaaaaaggaaaactgcagaatgacatctgttataaatcttaggacaaaaatcgttaacaaaatgctagcaaactaaatccaacaacatgtaagaaggattacacacca

SEQ ID NO: 42394 - DNA, 1073 bp, Homo sapiens
agtaaaaacagccagtctcaaacggtcgcaaaaaaccaaggcataattccacatatatagaacatttgtgaaatgacaaaattataaaatggaagacacattttttttccattatttaagaaggaatggggtcgtgtctataaaaggtcagcatgagggatccttgtggtgatggaaatgttgtatatcttgaatatattaatgttaatatcctggttgtaataccatatcagtttttcaaaatgttaccactgaggaagactggcttaagggaagactgatctctctgtactatttcttacaactatatgcttatctcaatcgcaaaataaaaattgtaattaatcaatgtgtgtgctggattccattatttctgtttaaaagttacactatcttatacattgagctttttttaatgtagtaagtaaacagtttttcttgcccagtttttcttgcccagttttttcttgactcagtatgtcaaaaaaaaaaaggctgagagcaaacatatgactgttttgtagtaagtactctggaaaatgtctgaatgataagtgtggatacacatgaggaattaaattacattttccagactaacaaaaatataatcttgggcttgaatgataaattcactggccagagaaagaataagagacaggctagcttaagcaatgggagttggcatgtgtcaagtttcctgggatcttcaagggttccctaaaagactatgggcaagatactgagtgggtttctagaaatgattgaaaaaataaaaaaaaaacagggcaagaacccaaaataatatgagtcacaatgtgaatataaaaatggccttaataaggaagatcctatttttaaaagggaagaaagaaagagagaaaagaaagaaagagagagagagagagaaagaaagagagagagagaaagaaagagagagaaaggaaggaagaaagagaaaaagaaaaaaagaaaaaagaaagagagaaagaaagagtagaagtgactaagtagtaaatgaaacagaactagaactggaatttagattttcttaatgctactaataaagcctattt

SEQ ID NO: 42395 - DNA, 1012 bp, Homo sapiens
aatttctaactgctaattttataaccttctccttcactaagttcccatagataaaaacaatttttttcatagattctcttggatttttgaaaagttcaatcatatcataacagctgttaataatactagttttatctcttgcttttcactatttgtcctttaacggatttctctaattgcattggataatagcttcaatgccatgttaagcagatgtgctgatagtgggctctcttgtcttttgttggaaagtctctagtatttccccataaagtaatatgctggattctgaattgcgtgtaaaatttgtagaaaatgtcgtctgagatttttttttttctgttacttatagttaatcaattttgttttaaggagatttttaaaaacaactactaccagagtcatatcacagaaattcctcaaaggttaatatcacagaaattcctcaaaggttaaataaatgatttagtaagagaagcagaggaacacacacacacacacgcacacagagagaaaagcgtgcacgcgcgcgagagatatattagtgaggagatagcttgcaggaaggaaacagaaaaagaggggttattccgtctattaatcaaagataataacaaatggagtactgttaatgtgtgcaccatcagttaatgctggaagaagcagcatgagagggaaatttccaaaccaaatatgaagaacttcattgggaaaatcaaataagaactaatattcaaagttctgtatttagattagtctaagagcccgtttgatgcactaggtaacctagagataaaattgaccatatgtgagggggaactccagtctttcatccttggagacatattctaggctcagttgaaacttgataatgaataagttattttaaatcaactaagaagagactacaaatattaattttctatttgttcaactctgcagctattcaatctggataattttgccatctcacactcaatacctcaaacttagtagaaatgctttcttcttc

SEQ ID NO: 42396 - DNA, 1022 bp, Homo sapiens
tctaataagatggatgttgttatcaaggaaaccattgtattcttactattttactcactgcatccctactcaggtccctgcattctttgacttccacaacagaaataagtgtgggctcacacattattttctataatttaaaagacccaataaaagttatatatttagctgtcataggacaacacaaactactgtctagcaaatgcagtttgttgtgccaaaaaaaacccctcttaaagcacaagtttatgagagaaacaaataatggtaaaagggtacttttttggaggaaaagcttgggaaaacaacattttatgctatttaaaattcatgctaacaaacaaaaatcaatagcttgacagactcaaagttcaaatcaacaggagaggtgatttaagttacatctatctacatttagggcatttggcaatttagtatctctgtttccaataaaggtcagtaaaattccttttccaaattaaaaaacaagattaggaaagaaaagagactattgactgaactataaactcttgcacatgtttctaagaaatggggaattaataaaaccttcttaaaatttaatgaaatattatatttaatagagaaaagggcactaactcaaaattcaaccagtctcttttcctgaattcaattcacacatagaaactaaataatatgagactgtgcattaaggaaagatcatgtgaaatgctttgaaaaggtacattgcccgatgtatacattttttacactatttatctatatttcttgtcttccattagcaagcaggacaggatgtacaaacataaagatatattaatatgttctgatcaccatcagtgcaggtaactaataactatctgtccttggacaaaaaatgactctgattatacatcaaagataactgaatatctgttgatctaacagtagatctctcaattgtattccactcctggtgaaaggtgagatttacctaaacagaaataaccataaaagctgaatttggtctattcttcctaatg

SEQ ID NO: 42397 - DNA, 1026 bp, Homo sapiens
ataatataaatgtccatcaacaagggagcggaaaaataaattgtagaatattcatatgatggaatagtactcaacaatgaaaaatgactcatatacactatctcacagatactatgttaagtaaaagaagctggacacaaaagagtgcatactgtatggctccatttcatgaagttctagaaaaaggaaactagaggggaaaatatcacatcactggtatactagggagggtgtaatcatgtggtaaggtctagaaaaataacatttttggatgataaaaatattttcatcttcatagaggtatgaattacatgattcaactgatttatcaaaacttattacattatactctatagagttatgcatttcattttatatgaaccttacctgaaaaaaactggaaacaaaaataaatgaataaatacaagagtaggtcttacatcgtgaagacaataaatatacatctgtgaatgattaaaactgtcatgatgctatgcaaatggatacctgtagcttaggataagctattcaatgaccacactacccatggattaactgtgctacttctcaaactggacagaagtggaaatgatgcaatatgaccaatgtaattgattcaaaacatgcttcctagaaagacaccaattttgtagatgtgaagagtttgaagaattgtttcatgagatataagtagaaaaaaatatttgcaagcatctatataaacttattcaccctgcatcttcttaaataagaaaataattcaaatgtttctagaaagggtaaggctgtgtgctgcaattatccaattttatgacaggtcaaccttgagtattcattttcctaagaatctatctttagagacatttcccaggagaaaaattttaaaagtgggatttttttttctctgatcttcagtctctttcttctccagtcatactggcatgagagatggaggcagagctcatcccttccccacttctgatgttttcccttcctgctagagcaatgatgtttcagcatgtttca

SEQ ID NO: 42398 - DNA, 1500 bp, Homo sapiens
ttgagtgtgaacagaatctgtaagtgtcatttctgagccaaagtggtgatcttctgtgtcttcttcaggatgtcttccaaggttactataacaccaagtgctgaggattttagcagcacaatttgtggcaatctgtccaagagaatcaattaaccaggaatattcacatggggtttgcagtgagttagaagcaatgtttgtagcgttaagttagtgagattttgcaatagtttctatcagcagctgatctaccctaagatacactgagcaattccattcttagctttgcctctgagaagctcttgtgtatgtgaaggagaagacatgttgaagaatatttatagtaatattgtttgtaatagccaaaatatgaaaaaaatttaaatgctctttataagaaaatagataaataattgtcatgtatttatataaaattctatacggtagtggaaatacatgaattcattcaaatgcatcaccttggatgaaaaaagaagataaatgttgagcgaaaaactttgttgaagaatagatacagtataattccatttaaaaaacattcaaaaacatgcaaaactaaacaaaatttagaggtacatccaaatgtagtgaattataaagaaaaaaggtagaataatgaacacaacattatgaaagtagttataactgagaggagagaaaatgaacagaattgggaagaggcacacaaaggacttgggagtcaatggtaacattctttctgaattccctctgtaatcaggtcatagaacttaatcttagcatcttggagttcacctaactttttctcaggttgtatccaagctgctggaggctcatatcatcccagagtcttagaaggggcacctctgatctccatggttatgaacagctatgcattgccctgctgagatttccttattcttcggtggttcccaactgccagccacatggatccctttgaatcattcctcattgctactgcaaggtgtcagattgggctctgttcctcacattttagtcccattcctcggtgcagtgaaatcattagctgttcccgtaagatatgaggctatctaaagttttgtgtttcttttaggagttggaagtctaactctgcctcactgcattctttttctatagttatgagttatctcagggcccagacttttgaaacaataaaactctttttctcattttttgttgtaacacctattcctgaaaatgtcacacaatctagctcctgtgaatggggagaaagatcaaggtaaaagaatgtgtgaatatttccaaatagtatcccatcagagttgtttcgatggtgtgattgtattaatgagacaatactccttgtgaggaacaaacatttccccaagccacattctggagatgaacggtgaagggccatgtgaagacacattgacagtaactgaaaaggaaaagatgtttaagtttctaagcagctctgcagatgggatttttatcaatctctctatcttgcct

SEQ ID NO: 42399 - DNA, 1060 bp, Homo sapiens
aaatagagaagacagaaatataaccctaactgtatcctttgtattattaatttcttacattagagataatgatcattttgtgaaggaaacatagatattatacacatccatttagtgggatgttattgtttttaacttgaaaacagatcataaagtaaacctgaatgaatgtttccatatggttaagaaattactcttaaagagaaataaaacactgtaatattgcaaaaatcaatacaaatcctagaaaaagaaagtcaataaataaccatttgcttatttttcaaaaagggaaaatacctgttattagcagttaaatgtttgttttaacatttgttaggactattaacttaataattttgaaatatccttattttaaacataattgcctccttggagcataacacttaagcttgaggttaaactaccgtgattattaattatgagaaatgacattttcccacaaaagtcagattcagaaaaaaatattttacattttattatagacagaaatattgttaaaaagtgataaattgcttactcacttaaaactgtagactgtattcgaaacacatttgtttttactatgtaataattaaactgatgatatactaacatttatctacctttaatggactcaataaataaaaaaggactgagactatatttttaaaatgaaaacctatagctaagaactctatgtgaaaaaagaatttgtattttacaagtaaaaataaagttatcctaaaagattaattttttttttttttttgagacggagtcttgctctttcgcccaggctggactgcagtggcgctatctcggcttactggaaactccgcctcccaggttcatgccattctcctgcctcggcctcccgagtagctgggactacaggtgcccgccaccgcccccggctaatttttttttttgtatttttagtagagaaggggtttcaccgtgttagccaggatggtctcgatctcctgacctcgtgatccacctccctcggcctcccaaagtgctgggattacaggcttgagccaccacgcccagctga

SEQ ID NO: 42400 - DNA, 1028 bp, Homo sapiens
cttatccatacccacaaaaattatggaatactgttataaacaagctgacatattttcatgagggcccctagggggcagtattgcccccattgagaaccagggatctatggatgggatacaactcagaaatacttcccccactcccaccctcctcctgccttttattggaccttagatactctgatggtagtgcaggatggaggaagaagtgaaagggcaaacatctccttaactagggtatgctttcccccaggctggctgtaatagcagtcttagcttgtttgtctatagatcttcactcttccccttaaattttgactaaagttggggtggggatgtttggcaatagggataataatctgacctagtctcttaggacttttttgtggagaagtggaccaacctgaaagcttagaatatgaggggcagctttagtgctatttgtcatcaactccggactttctatgtaattctggggtatgaagaaagaaatccactcctttacactagtttgagagagacgtgctggaatgaaaaacacctcagttcagacatgctggaatgaaaaacaaacacctgtattgtaacctcagctccactgcctctcattgtttaatttagggcattcaaactccctggaatgcctttgcctcatctgcaaaatggaatagggagtaaagtagatgatattaaatttgaattatttgaaccattgacttcaatataacactaaacatttggaatctccatgcagacaatattcactgttcttctttgtgtccttgaaataagtgaaaattttggtcctctttttttctcatataagacctgtgccatcaaatttggtaagaattctagaatcttctaataatatgtttgccctaaataaagtgttttaaatgtttaatattattgagcatggtgaatcacagcattttagagttaagaaatcatttattgataaaatgaagttagaaaaattggatgtttttctatgtttaggtaaatgcatatgacataggttaggt

SEQ ID NO: 42401 - DNA, 1055 bp, Homo sapiens
gtttgaaacaccctgaactagctgttacagatggaatgaataccattatttgcatgatttgggaaatggtagcaaaagatacgaaagcattctggtttcagtgctaaaaactcagtagtattcacaggagaaaatttaatgtgaaatacatcactgacaagataataaccaaataacttgatttgttcacagactgcaatgattcttatgaatgtgtattgcaataagattttgaagcctgtagatgggtcctgttgtcaacctcggcctcctgttactctcatacagaagctagctgcttgttttttcactttatctattatcggatatttaattttttacataattcatcgtaatgctcatcggaagaataagccgtgtactgatttggaaagtggagaggaaaagaaaaatattatcaatacccctgtgtcttcattagaaatacttttacaatctttctgcaaacttggcctgattatggcatatttctatatgtgtgaccgtgcaaatctgttcatgaaggaaaacaaattttatacacattcatctttctttattccaattatctacattttggttttgggagtattttataatgaaaatactaaagaggtaagagtcattttctttttaactcatgttacccttcttgtctcattacatactctgtgttaaagaactaatatcatttatcatgacaaaatacacaaacaggtatagagatgaagatgaaggaagattgtagttacacttcacttagtggactcttaactgttcctttttcggaacagtttggagaaaggtcagagtcacgtgaaaattgttgaaaagttgggaaatatgacctgtgaaaaagatttcatgacttagtgttattttgcctgcttgttgacagagaatgttgaagtacttctgattttataatggtcttcaagcatgagatactattatcttttataaagtaaaagaatataattaacaaatgcctatgcacacaaacatattttatatttatatatttatcagtcagacatatatacataccaatcaga

SEQ ID NO: 42402 - DNA, 1050 bp, Homo sapiens
ttttgatgtgaagtctttggtcacaaacataacaccagtcacaacaatgattctttgggcaaagtcaatttacttttaagaattactttacaatgtgatttccaggaatgaattttaataactaagacaaatgtctataggggaaaaaattattactgctattaatggcaacacttattcactaggctacaaagataactaagtacagatgcagaaaaacttactatatgagggcatgagggacatactacacaatacctggctatagctcctcatgactgtcgaggtcatgggacacaagaaaggtctaagaaaatgcccagacctgaggagactaaggagacatagtgattattgtgtcctagatggaatcctagaacagaaaaaggacattagtggaaaaacgaatgacatctgaaaaaagtctgaagtctaggtaacagtaaagtaccgaaactgggttcctcattgtgacaaatgtaccatggtactgtaagatgttaacaacgggagaaactggctgaggcgtatctgggaactctctattatctttgtaactttcctgtacctctacaatcattccaaaataaaaagtttattaaagaataaacacattagccaagatcaaattaagttggccttacatttctagactatgtgatagttttaacagcctatttatattgtctctgtaatttgaaaagcaaaagaaacacagtacaaaatgaaacacctcatttctaggcatgtgctacatctccaggttctgctccagcttccctgtccactgcctctttattcattttgcttataacctgaatcagagatccttctgaggtcaatgaccgacactatctatccctgcctagatatcaggataggtaaataatctaatctcagttctgacctaatttaactttgtctcttatcagtgtctcaaatttatcatctgcaaatgattaaacattttttcttactgactaatttatggtgccagtctggagctctgtgaaacattctaccaaaaagaaaatattactatgtaattga

SEQ ID NO: 42403 - DNA, 1024 bp, Homo sapiens
cacgtcgcgcgcaggccactaacctgtcagcaagaatgtgccagtggtcgcggggctcatcctgcgtgtcccccgaccctgtcccgtccaagcacaggggtctcccagctcccaccaccggggcaattgcattcttggcctggctaggccgtccgtcctcgattctcccctcccctccctttcttcttccctcccagcttggccagttcagcatcagcatcccgcaccccctcggtaatcccgtactccctctagcggcgggccactgcagcgtggccaccgcccccacccccatcccccatccccgcacccccctccaccccctagcccgcggagcacgctgggatttggcgcccccctcctcggtgcaacctatataaggctcacagtctgcgctcctggtacacgcgcttcaacttcggttggtgtgtgtcgaagaaacctgactgcgccctgaggagaacagcggagaaggtccaccgagcctggcgaaaggtccgctgagcgggctgtcgtccggagccactccgggctgcggagcacccagtggagaccgcgcctggctcaggtgtgggaccccatccttcctgtcttcgcagaggagtcctcgcgtggtgagtatgcggtgaggacgttttttttttaaagatcacgttcattccccgtgcttatcgggagctgcgggagatggagtagcaccccagaatgtctccacgcaaaacttgtcacgccttcactggctgtaccccaaaacaaatggggaaaccaagccttaaaggcttgggtttccaggaccaagtccagatacgggctgtagacagagatgagctgcggacagtgatgagctgcagacggtcaggagctatagatcgatttgcaatttgctcttcaaatgcgctaccaagtgccatgctttacaaacagataagcgcttcaaatgcgctacaaactggcgcttcagatgcgctacaagcacgcttcacgcgggcgacaaactgatgggagctacaactggcgcttcatt

SEQ ID NO: 42404 - DNA, 1026 bp, Homo sapiens
cctaagcctgcctctgccgggctggcctatagtcccacctccctcagagccggctagcacacatgcgcagtgtgaaccctcagcccctcccttcaggcgccggtcctctgcacctgcgcaccttccttgcctgagccctggctgtacagccccgcccccctgcggtttctctgctgtgttggttttgctttttggctactagagtctaatagaataataaataaaacaattaacaataataattataactggaatttatgagcacttttaatatgttctttgcatatattcaataacataatcccacaatttaaactcctgatagtggcttatgaagggaccttgtaaactgacatggctggtgcctctaaaggcaatttagccaaatgtttttactgcaaatgaaaaccaaaacttaacaatttatttttaaaaactttaaaaatattttcacatttaaggtttttttagaggcactagtggacctttgggaatcggatgttttggtggatacaaaattggtgctgttggtttggcctctgagtgaggataaggcttttatttgcgtgcctatgaagctgggtgttttccttgaatctctaggtgattaaccctagcctatttgcctatgtataataaattgtgcctgcacatggtaggcattcattaaatatgtgttaaatgaccagagtaaattggtttattcagtgtcttgcttggtgtctgtaggtctcttctgatttgctcctttcctatggtgctttgctgtcctgggttgccttgtttgcgttatctctcacatttaacagaataaaaaaaaagtgtatgtgtttttaaactccaatgatataagctgtaattataatacaaagcaactaaattaattttaattattccaaataattagcttttttcataaaaagctagttattccaaatattagcttttttcatgaaaagctagttattccaaataattagcttttttcataaaaagctagttattccaaataattagcttttttca

SEQ ID NO: 42405 - DNA, 1034 bp, Homo sapiens
attgtgattttaatactcccttcttgctttaatgagattctattagttgcagtattaactatttttggcctggcttctttaataacaaaagttattattttggctttaatttgcataattgattttgtatccatgtttgccttgaagtttcttgctgtgtttgaatacaaaactacttgtttagagggtttcaacattcttttatagtttataaaggtaagcatgctgttgataatgtattgttgaatcataatgaacaggtggcctttgaggaagacaaggtcatttgaacatcaaaaagtactttgctttttgttatatatggtgctgattactaactttctcttgagagtttattttctttgttcactaattattaatgtaagcacgtagagcaagggataatttaaataccaaatcctttgtgtctgcttttgctgctttgaatgtataagttggatttatacatacatttatctttatttacagaaataagcgggttttgaaaacaaaaaaaagaaggagtggaagagggggccaggatccaggcctccatccccacagaagtgaagctacagctgggaggtctcctcccaccccaaccgtcaccctgggtcccgactgcccacctcctcctcctccccctccccccaacaacaacaacaacaacaactccaagcacaccggccataagagtgcgtgtgtccccaacatgaccgaacgaagaagggacgagctctctgaagagatcaacaacttaagagagaaggtcatgaagcagtcggaggagaacaacaacctgcagagccaggtgcagaagctcacagaggagaacaccacccttcgagagcaagtggaacccacccctgaggatgaggatgatgacatcgagctccgcggtgctgcagcagctgctgccccaccccctccaatagaggaagagtgcccagaagacctcccagagaagttcgatggcaacccagacatgctggctcctttcatggcccagtgccagatcttcatggaaaagagca

SEQ ID NO: 42406 - DNA, 3495 bp, Homo sapiens
caaactccatttccatggttctgttaattctcaaggagcagcaactcgactggttctcccaggagcaggaaaaacccttgtgacatgaaacatctcaggcctgaaaagaaagtgctctctcagatggactcttgcatgttaagactatgtcttcacatcatggtgcaaatcacatgtacccaatgactccggctttgacacaacaccttaccatcatcatgccatgatggcttccacaaagcattaaacctggtaaccagagattactggtggctccagcgttgttagatgttcatgaaatgtgaccacctctcaatcacctttgagggctaaagagtagcacatcaaaaggactccaaaatcccatacccaactcttaagagatttgtcctggtacttcagaaagaattttcatgagtgttcttaattggctggaaaagcaccagctgacgttttggaagaatctatccatgtgtctgcctccatatgcatctgggcatttcatcttcagtcccctcattagactgtagcattaggatgtgtggagagaggagaaatgatttagcacccagattcacactcctatgcctggaagggggacatctttgaagaagaggaattagggctgtggacactgtcttgaggatgtggacttccttagtgagctccacattacttgatggtaaccacttcaaaaggatcagaatccacgtaatgaaaaaggtccctctagaggatggagctgatgtgaagctgccaatggatgaaaagcctcagaaagcaactcaaaggactcaaagcaacggacaacacaagagttgtcttcagcccagtgacacctctgatgtcccctggaagctttgtgctaacctgggactgcctgacttcctttagcctggtcccttgctactaccttgaactgttttatctaacctctctttttctgtttaattctttgctactgccattgaccctgctgcaggatttgtgtcattttcctgcctggttgctgagactccattttgctgccacacacagagatgtaagaggcaggctttaattgccaaagcacagtttgagcagtagaaaacaacatggtgtatatctcaaattgcctgacatgaagaggagtctaacggtgaagtttcacttttcatcagcatcatctttcacatgttcattatcatctgctcttattcttgcatgtttaaacacttaaaatttttagtataatttttagtgtgttttgaagtggtgactaggctttcaaaaacttccattgaattacaaagcactatccagttcttattgttaaactaagtaaaaatgataagtaacatagtgtaaaatattcctttactgtgaacttcttacaatgctgtgaatgagaggctcctcagaactggagcatttgtataataattcatcctgttcatcttcaattttaacatcatatataatttcaattctatcaattgggcctttaaaaatcatataaaaggatataaaatttgaaaagagaaacctaattggctatttaatccaaaacaactttttttttccttcaatggaatcagaaagcttgtcaatcactcatgtgttttagagtaattacttttaaaatggtgcatttgtgcttctgaactattttgaagagtcacttctgtttacctcaagtatcaattcatcctccatacatttgaattcaagttgtttttttgtcaaatttacagttgtcaattgatcttcaagctgcagggtgcctagaaatgggccgttgtctgtagccctggcatgtgcacacggacatttgccaccactgcaagcaaaagtctggagaagttcaccaacgacaagaacgattagggaaaatatgctgctgtgggttaacaactcagaaagtccctgatccacatttggctgtttactaaagcttgtgattaactttttggcagtgtgtactatgctctattgctatatatgctatctataaatgtagatgttaaggataagtaattctaaatttattattctatagttttgaagtttggttaagtttcctttcactcaattgatttattttgttgttaatcaaatttatgttaattggatcctttaaattttttttggcattttccaacaaaaatggctttattcataagaaaggaaaaaaatcaatggaatttgatatctaaagaagttagaaagggagcaaaataaaaaacataaaggagatagatgaattagtaagcaaatcagtagtcgagtttttcaaactggcaaaattaattaattgacttttagcccaaatttacattgttaattaaatcaagaaggaagaagatctaagagctcccattgataggcaagcctagagagaactagctaaatttatcatgctaggatattgaaacacagaaagtttacatacatttatgaagggtcaatttagtttggacagtgaggtatttgtcttagtggaaaaaaggagaattagtctgatcaaatcgtgaagtaatacagtgaacttgcaggtgcacaaaataagagggccacatctatatggtgcagtctggaattctgtttaagtttgtaggtacctcttggacttctgaattgatccagttgtcatccaccacagacatctcacatcagatacagacagttccaagattgacaacagagaacaacctgctggaaagacctgggcagaaatggagagccctgcgggaaccatgctacattttcatctaaagagagaatgcacatctgatgagactgaaagttctttgttgttttagattgtagaatggtattgaattggtctgtggaaaattgcattgcttttatttctttgtgtaatcaagtttaagtaataggggatatataatcataagcattttagggtgggagggactattaagtaattttaagtgggtggggttatttagaatgttagaataatattatgtattagatatcgctataagtggacatgcgtacttacttgtaaccctttaccctataattgctatccttaaagatttcaaataaactcggagggaactgcagggagaccaacttatttagagcgaattggacatggataaaaaccccagtgggagaaagttcaaaggtgattagattaataatttaatagaggatgagtgacctctgataaattactgctagaatgaacttgtcaatgatggatggtaaattttcatggaagttataaaagtgataaataaaaacccttgcttttacccctgtcagtagccctcctcctaccactgaaccccattgcccctacccctccttctaactttattgctgtattctcttcactctatatttctctctatttgctaatattgcattgctgttacaataaaaattcaataaagatttagtggttaagtgcaaactgtgtcctgatcatttcagcatctaccagcatcaagggaatggggtggggtagggtggggaaggctg

SEQ ID NO: 42407 - DNA, 1021 bp, Homo sapiens
tctgaaattggaagtttaaattattgctttttgtttaatgagatgagcagattactctgatcttacagttttaagcagttctgggattttataagttctggtgaagtcctaattaaattgccttacaatataatctggtgtttggattatcactttttgttaagtattcttaaaccttactacaatatggttgataaattctgttaatattttattgtatactgggtttctagtagtgatatatagatgattgtatataattataagaactatttaaagaaaaagaggcaacattaacagacaaaccatgtaaaattttgactcttttctataaaatggttacactggaaaaagaaaattggagttcaagaaaaaaataatttcactggttgtgattttgcatatttatgtaaatttgtgaatgatttgaggcagtgatatctttttttagttaatcatgtacccaatcaagtttgagacgaggcttatgtttttccatagagactatgacacttgtggaatttttatcttgctggctccttctctgtataacgagttctgtgagtagtagcattagtgaactggagctccctcaggagattgtcccatttgcagatgtggcaatcagaagagttttagtttgagttactgggttttgactcttattacctaatacaattctttatttatttagttttgagatggagtctaactctgactgcattattagcatttttttgagacggagtcttgctctgttgcccaggctggagtgctgtggtgtgatctcagcttactgcaacttccgtctcccgagttcaagcgattctcccacctcagcctcctgagtagctggaattacaggcacgcaccaccatgcctggcttaatttttctttttttcgtagagacggggtttcaccatgttggccaggctggtctcaaactcctgacctcaggtgatctacccacctcggcctcccaaagtgctgggattacaggagtgtgccactgcgtctggc

SEQ ID NO: 42408 - DNA, 1283 bp, Homo sapiens
tgataaagtagtttcacctttgagtaaaacttgttgattgcactaagtggaccatttttgccatttcattctggaaaccagagattgcggattttaaattttcttttaatctcctgaatcagcctggattataacatgctgtattttctgtctcatgataaccatattgctgtaaaatatgagaaaattataaacattgttttgtttaaataattgatagtagtaaagtaaatattttaggctatgtttacatttgtaaaagaagatttgagcagtaatttcatcccttagagaaagcccatttgggtaatcaagtctaaattaaagtaattttcctcaataattaggtttaagtgttgatgtctgggtaccagagaagacaatggacttggagtgtggatacttttagactttcctgtctgtgttttcttagtggtaattatttgttatgggtgatctttttcctctgggcgccagtttcctcttctctaaattgaaaaggttctattagatgatctaagatctgtttgagctcctaaaatcagtcttctttaattctgtatctaaacaataattctagttcttatttctgttttgcccaggaaagcttttaacattaaatcaggcttctgccagtagtagtctttgctctttagcaatactggaggtccagggataaaggacatctctgttttcatcttaccatttactatcttatgtcatgttctgtattccgtattctaaagggacttgagtattgtaaacaggaaaacctgagcaaagattgcatgaaagaaccttttaaggtactttgccttcaagtaatgttaaagttgtttaaacagtgtactaataaaacctttcactaagtatggggagactgtgtaggggtgtgtgtgtgtgtgtgtgtgtgtgtgtgtgtttgtgtatatattttttccctccaaaagtgatctaacaacttaaataattaagaattctaaacatactggtgggaaatgttaccaaatggtaaaacattaattctgtaatatgttttgtttagtaaatgaccagtccctggtcattaattgcttccttgactttgggcaagtaatttctctagttgttaaaagactctttagctcttgtatatacttagggtattctgaataaatttatacatattaaagcaaaaataggaggaattttttttgttttatccctctggcttttttcaattggtagtatgacagttgacaggcatgtaagaccattccatgtccatgtattagcatttttaa

SEQ ID NO: 42409 - DNA, 1034 bp, Homo sapiens
tagagagtttttattaggaataatgttagatttttaagttattaatttggttaattacattaattttttaaaaaactaattgctgggcgggtgtggtggctcatgcctgtaattccagcactttgggaggctgaggcagacggatcacgaggtcaagagattgagaccatcctggccaacatggtgaaaccccgtctttactaaaaatacaaaaattagctgggcatggtggtgtgcacctgtagtcccagctacttgggaggctgaggcaggagaatcacttgaacctgggaggcggaggttgcagagttgacatcgcgccaccacactctagcctggtgaccaaacgagactccgtctcaaaaaaaaaaaacacaaaaaacccacaaaacccaaattgctttttcaaggtaagccaaatttgcatttttgggataaaactcacatggtcataatatattatcctttcaacatactgtttaatgcagtttgctaatgtagtgatgaattcttccagcttttatgtatctgaaaaaaagtatttttcttgcctttatttttgaagatatttttactgattatacaattctaagttgatattttttttcattactttaaagaagttgctgcattatcttcttgctgtcattgtttttcaagagaaatggcctctcatcctcatctttggctgctcttaagagtttccttttattgctgattttgagtaatttggttatgatatgccttggtgcctttttctccatgtttctcatgcttgggttttgttgagcttcttggatctatgggtttagagtttttataaaacttggaaaaatttggccattttttccccccaatgttttctttcccttctttttcttttccttaggggactcaaatcacacatatgttaggttgcttgaagttgtcccatattttacttgatgctcttttaatttttttattataaatttttttttcctgtgtgtctcattttggatagtttccattatgtcttaaatttactacacttt

SEQ ID NO: 42410 - DNA, 1033 bp, Homo sapiens
ggttttatgtccatatttaccatttctaaaatttgtgcccattgtgtccattctatattgatttcaatgaattgatttttctcagcattattgttcaaactttcttgcttctttacatttctgagactctgtgattggataccattctgaaaattaccttattgagtactagatatttttgtatttctataaatattcttgagtttttttctgggatgcacttaagttatatagaaataattttatccttttggatcttgctttaaaaagttttgaacagtacaagaacagcatctggtccatggctcataattatttcactagtgagacaaagtccttctgaatacccagtctatttctccataaattacaatgttttccagtctggtagaaggactggatatatcttggggaaaaaaatgtaccttgacctctaacttatgctatacaaaagttaatatgtgatgaattgtagacctaaatagatagctgaaactttaacatctctaggaaaaaaacagaataacattttcatgtcctgaagataagaaatgatttattatacagaacatagaaaatatgcataaaagacgttgataaattgaacatgataaaaattaaaagctttttataaaaagtcactgttaataaatggataagaaaactagatactgggagaaaatatttgtcatgtatgtatctgacaaaaaaagtcctctttagactttttaaagaactcctacagatgagttaagattttctcttttttgctggtttttactaatgtgatactgatgtggctttggtgtggttttcattatgcatatcttacttgagcatctgtgagttattgttttcataaaaatttgggaaattattggccactgtttcctcaaattccttttgtgaccttctcttattcttggattcaaagtacacatatgtcacttgtttactattataggctacttaggctctattaattttttgcagtccattttttctcactcttccatttttgttagtttgtatt

SEQ ID NO: 42411 - DNA, 1037 bp, Homo sapiens
gtaacttctagctgtttaaacaatcttggaatagtttatattaaatccagtccaacatttggtttattctgttttctcacacttcagtatataagatttctgcttatccgttttacaaaaactgtatgaagatggctacatacttcttggtgtttttttgtttgtttttgagacagaatcttactctgtcacccaggttggggtacagtagtgtaaccatggctcactgcatccttgaccttggggctcaagtggtccttccatctcagcctcccaagtagcagggactacagatataagccactatgcctggcaaatgtttggtagagacagggtctcaccatgctgccaggctgatcttgaacccctgggctcaagtgattctccccgcttggcttcccaaagtcctgtgattacaggtgtgagccactgccatccatcttgttttattccttattcctcttcaattgttgtgtttatgtcatttaatctcctagaaactatttggactatattgtgatgaatgatgtactttgaactctaagtagtagatcatggattgtgactttgaattgttggggaagtttcatattgaaggaagcagggaatgtcaacagctttcactgtgttacttggcagaaatcttctttatgggcagtctgcagtctgaatctaagagctacagtttaattcttcctgaaagctgtcctgtgttcagtcactgcttcatcagtatggcctatggtatagaaatgggacagccactctagatggatgagaggtggacaggcaggatagatacagcactaggttcatctcttcagtctactggttatagctagactttaatattgaagaattatgttgctgctattctattatttcattttcttcttacttaaaaaagaaaatcaacagaaaacaccaaataatttagttatacatatgtcctcagatagtcttagaaaggtttcctttgaaatgcatctgtagtggctactagggactcaatgaatattcatccaatgaacagatga

SEQ ID NO: 42412 - DNA, 1044 bp, Homo sapiens
attatttggagcattttgtcagattatgctttcaatttccccattttagagtcattatctaattctactttataggtatttagtaactttgttctttcaagagtattatgaagtcattatatgtattctatcatatggaaagagaatattagtgaacaatgacttctactttgagactttgaacaccaagagaggcaggcctcagatgatcaaggtaatgttaattggctaaaaaaattgaggaatattttttgtgagaatatcaaggggaaaaagaggagacagggacatttatttatgattcatatcaaactggaaggtagttttcaattgtgactatacactaaagattgtcacttgattcacatgtattcagggcttataaaactaagtcatcatacttagaaatggtttcatgctatcacggtgtctgtcagaattagcaggcaatatctcattataggaaattttaagtatattagtgattttttaaaaaatgtaaaattttgagattttaggatttggagaataactacctgagcccatcctctttgttgtgaattagcaatgggacagaagtatttgtaatatagtgagagaaactaggaaacaagctcactagggtgatattgaggccatgtaatacagaataatctatttcgggagttccttgcaaaggtataatagtaccagatctttaggaatgttttagtttttaaattttacttttcctagatacaatatctagttgaaattttttttatgtggcagttctaggagtactgtggatgcgtgggaaaagaggaatgtgaaaagcttagctcaacttaccttccacttttatttcttttaaatgtcacaaaatagagtttacaaaaatgttagctatctggggtcattttgaatagctgattatctagtagttttaaaattaaaagaaaatgttttattataaaagaaagaatatgcttagtaaaatttaaatctgtattatttaatgttacattatgaaatacattaaggtaattattttaatataaaagc

SEQ ID NO: 42413 - DNA, 1047 bp, Homo sapiens
attcatacctttcttagcacacttatagtgttttttatagcttatcacactcctgtgtctctaatgcctgcaacacatatcctgtatatgcatatacacatatttacatgtatgtgtacatgtgcgtatttgtgtatgtgtatggtatccttaaacagagatcatgtcttatttaaatttgtatcccagtaactctctgtccttttgctatagtcaggatcaaattacttttgctaaattactaactggattattcaaccaaaccaatgaagcaagcatattattttccctatttatatttttccagcatttttgctatctttcttctgattagattacttagtcccttcagttgtacttatttcattgcattttatcagaattgacaggatgcttattttcagacattttttgatctagtttgttctttctttatttttgcccattaaggcaattatcaccttagttttcgttcacttctgatcattctatctattgatattgtacaaacctgtattttgcttttatttttttcttcccagtaaatactagctctgtacatatttgatttttaaaacttgttttcaaagtttttttataatctattatttagtattcctcttactcactcttaattttttgccctttaaaaaaatatttgccttctcaagtgctcttgccttattaaagttgcattattaatcctttcacttcatgaaagtatgtgacagtgattatctttctgtttgagagattaagctttcagctttactttttttttttttttttttttttttgctggaaagccacctctgttcatccttcaaatgccatggctcaactttaatttggctttcaaaatacaaagtatattataaattaaatatttgaaagataaagaatttcttcttgcctttatcttccgtatacgtccctaagtccaccaacttgtagtgccatgaaagttgcttggcaggattgccatttgtagtcatttgtcactcagaaacattgatgattattgctatcaaagaatatattgagtac

SEQ ID NO: 42414 - DNA, 1072 bp, Homo sapiens
agtttgggactatgttaaatgtccaaactaaaaataattagtgttcctgaggaaggagagaaatctaaaagtttggaaaacggatatttgagggaataattgaggaaaacctccccaaaacaaagagaaacaaatcctcgaaatacaccaaaatagaaccttcttcaagcataaatctcacaggacctttataacaatagcacaatagaaaaaaaggtattcaagcaataaatagcacaatgagtagaatagtacctcacatgtcaatactaacattgaatgtaaatggcctaaatactccacctaaaagatacagaatggcagaatggataagaattcaccaatcaagtttctgctgtcttcaggaaactcacctaacacgtaaggactcacataaacttaaggtaaaggggtggaaaaagataccgtatgcaaatggacaccaaaagcaagtaggagtagctattcttagacaaaacaaactaaagcaacagcagttaaaaaaagacaaagagagaaattatataatgataaaaggactagtccaacaagaaaatattacaattctaactatatttgcagctaacactggagctccgaaatttattactgttagacctaagaaatgagatagatggcaacacaataatagtgggggactttcatactctactgtcagcactagacaggtgggtcatcaagacagaaagtcaacaaagaaacaataggcttaaactataccctacaacaaatggacttcacagatatttgtggaacattctacccaacaattgcagaatatacattctattcatcggcacatggaacttctccaagatagaccttatgataggccacaaaacaagtctcagtaaatttaagaaaattgaaattatctcaagttctctaagaccacagtgaaataaaattggaaatcaactctgaaaggcaccctcaaaacaatgcaaatacatggtaattaaataaccctgctcctgaatgattgttgggtcaacaatcaagatggaaatttaaaagttattcgaactatatgataatagtgacacaacct

SEQ ID NO: 42415 - DNA, 1084 bp, Homo sapiens
cgtgtgattcaacttagtatgaaaagcactacactgaggtgggagacctgggtcatgtcttggatcttccactcacatttgtttctcatctgtagaatgaaatgggtgggactagattatctctaaattccccttcagctctagctttctattattaagcctttatgataatatataatgacttgaagaaaggatatctacatcacaaatgtggcagacggtgaaggccactgcgtggatataaaagggtctgtgggaacgttcaaaatgacctcttaaaaacagctggcaccaaagacagatgtcttaggaagttgccatagcattaacatgtagtagttacagggaaatagttgatggtacaccttggcttagctaagcttcttgttaataaaactaaatcactcatctaggggcagtgcattggataaggaattgttactactttttgctactcctttgcagatcaatcattagaaatgaagtattttctccagaacaacaaaccaagtccatgctatagcaaatgacccaaggttactaaatgagctaacaagcaagaacaaattagaatctaacattctgctcagttctgagcactgaacactccacagcatacatttcttcaattctattaaacataccattcagcaaccctaatagctaaaaactagcaaaaggcacaaagggttgccattaaacatgatcacaattgtcctgcaaacctagagataaaaggtaagagagccataatgtaaatggaaatacacatttgtttcttttttttttaacccaagagatacgggctttaacacttttttttttcctgttgggcaggtgaaatggactcttaaaactgagctttaacaatacacagcagtagacaaatatgtcaagatgatatcatatatatgatgtaagtaataagtatccttagtagatactgaaaactcagtaaatgtgcaaatacctatattgaagtaggttgcaaattcttacttgtacccaaaatagttcactgaataaagaccgtggacaaaaaatgggacctttgagtactgtaactaaggtggaagatgagatc

SEQ ID NO: 42416 - DNA, 1050 bp, Homo sapiens
gctgaagggtatgcaccttaactgaagggttttaagtcaggaagcagcatgactaggttttcgatatagaaagatctctctatggtctgaatgtgccccccaaaattgatgtgttggatacaatctctaatgcatcagtgttggaaggttgggtccttggggaggtattttcatcacaagggctctgccctcataaatggattaatgctgccataaaaagaggtttggggagtgggttcactctctcttgctcttctgctcttttgccatataagaacatagcattcctcacctttgaaggacacagcattcaaagagccatcttggaagcagagaaaccaggccgtaacctgccagcactttgatcttggacttcctagcgtctagaactgtgagaaatacatttccgtcctgttcttctagtctcaggaattcccttacagcaacacaaaatggactaaaacactgcttgcagtatggaggatgggttccaactgaactaccaggatgtccagacgagacaggctggggatgggctaggactagaggaatacatagaaggtaaaattagtggggttgggacggaaaaagggagttgtgccatattgcacatagacttgtggtatgggtgtctggaaaaacacctgagattggtaattcaagaggagtgttttgaggtgtgtgagtctgtctgtaaggagaatgtatgtccaacatacaaattatgttgtagaagcttaagaaagaagcattacagaaagaagcaactatttaacctactctcaaaaggttcaacaaagcccagaagacttgaccatgttcataggcagagaagaaagatcagcaaaaagtaaaaaaaaaaaaaagacaaaaggaaaaccaggagaattgttagagaaaattatgacaaggggacaagtctgaagctcctgtggaggatggccccagctgccacaaggggagtgtaaaaggaggtgagaaaatacaacctcatgtaaagaacaaaattacatcatgtaccacgtatttatttttaagggcatcattaaa

SEQ ID NO: 42417 - DNA, 1082 bp, Homo sapiens
tctcccagccgggccccttcccgccgccgcggaccctcagcttccgacgcgcagttcgggctgagtcccgggcccggcgcaggcttcgttcgacgagttagtccacactgcgctctccagcctcctgggtctgtgcgcccttttccttgctccttccctccaggctgtaacccacgtttgacccggctggggacatttctgggccggaactggggagcgtgttttgcttcccagcccacgctgggcaggcagtggcctactttgcgtggggcgccccgtgctcctcagtgactcggagggaagctggcctggctttcgctctggttaaactagtaacagtcaggctctttccagtgggctttaaagtgtccctcaccttcatccctgaccgggccccctatctagcttttcgctacagtgttggctgctcctttgttcgtggaggggaagcaaagaacctcgggctgatggttctcagcacccgagggggacaaagttgccgtgagaggcgcagcctgctcgtgggctggtctgagctgttggttgtgttttgtttgaggatttggtcctcctcaggagagtcatttcaaaacatgccgaggatgcttgatgcactgagcttggagctggtgacatcaagtcaactggccgcgtaaacacctgggtggctcaagcacagcttcaggtactgttaagccgggcacaggggccccgctccgcccggacagctgccgccttgctgcgctgcgcaccccagagagcctccggcaccgcctccgctgcggcaaagcgggctgtttgtctgagggcctctggcgctcccttggcccagacgctgcacattgttcgggccagggactgggtcaaggagattacgcagacgctgggagcacacgggcagagtggaccaagagaggtcggggcatcatagggatttttcgaggtaacccttattgggctttggggagactcgttgcatgccacgccaggagcagggagatggcagcagtagcctcccgggtgaccgctcctctgtattatttgcttacagatcaacaaaaaactacagtgattgaaaacgg

SEQ ID NO: 42418 - DNA, 1058 bp, Homo sapiens
cacctgttgtttgaatataacttaatggttacgtttacatcaaactaagagtaactgttgtggacttctaacttaatatgtagagtctggtctacacgatcccagtccctcacacacatctaaacttaattatggacttgaatggattctgaatttgttttacatcaggggcaacgttgggtatagttgccactggagaaaagaaagggatcaagaacactagaggccccatatttggaagagagttctctaattctcttcatttgtgatcctggaaaactggcaatataatagtagagagaattcagctgggggaagtttttgttcagggaccaagtggggcaacgtggaaggaaagtattttaagtatagaaatgtaaaagcatgtttacagagtaaatagtgaatttatgtaatttctcaccataagagaaaaaatttaagttcaggaagagtttttgggaatctatgaagggagaatgtacgataactggtttgtaaaatgtgcattgtaatctcaactcttaggaggtaactattagaagtgaaattgagactccatagatcgggggtcttactacggcattttaaaagttctgactgtgctcatttttgaggaatagttgtttaaggctttctatttttctctctgtgcctaccacttattttctaggaaatcagaataagcattgaagattaaatagataaaacatgttggtgagagaatatgagacaaagagcacagaagagtgtgctctcaggagctacctgaagagacttcatttatttttctttttctgtcccatgtatttttctgagttgtctcttgcctagttcctgttgtttttcttaagtacctgttctgtgtctgttgtggaatattttttaactgttttgtttctagaaaaaggcagaaacatttttcagatagttttgatcacttactatttccagacaatgtgctaggcatttaagacacaaaaatgaataataaatgtattttactttcacagtgttcaaagtttagtagaaaaggatagacaattgtaatatagtat

SEQ ID NO: 42419 - DNA, 1026 bp, Homo sapiens
acggttctgtcttgcctgggttccaggcaccactggagtaccgaaaaaaaaaaaaaaaaaccctgcagctagctcggtgtctgcccgaatagctgcccagctttgagcttgaaacccagggccttggtggtgtagacacacgagggaatctcctggtcttcggattacaaaaatcatgggaaaagcatagtatctgggccggatagcacagtccctcatggcttcccttggctgggaaagggagcccctcacctccccgcaactccttgcgcttcctgggtgaggcaacaccccatgctgcttctgctcgccctccatgggctgcacccactgcctaaccagtcccagtgagatgaacagggtaccttagttggaaatggagaaatcacctgccttatgtattggtcttgcttggagctgccaaccagagctgttcctatttggctatcttgccagatccaagagaatccattttctttttcttctcttcaagtaaaggcaatgatcccggtatcacggactgactgtaactgctcttcttgattatgttcaattctttatacttgtgtgataatttagttattataacattttctttcccattttattttgttgcatttgttcgagaggaggaaatgcttcagacttcaggtagccattcctttgtaactctcatgggatgtctttttcttatatatgattttgaagtggatcatcatttgtatgtatgtatcatatatacacatgtattattaagtggcatgtcacctatatttagagtttccttagtataattaggattggatgggtatttggctagtttttataaatgtatgcttctcttacctaatttgtggacctcattttgttactcttgaacatcttgatttatagttttagcttgcaggagaaaaggaatgaattgcttctctgtttagtgaatggattgtatgtgtcagggatacatttcccaagtatgagtgggtcagttgggtctcagtcaaattgttaattctgcattttact

SEQ ID NO: 42420 - DNA, 1034 bp, Homo sapiens
aagagagcttctgattgttttgttaagcccctgtttttcagttggtgcactttttttttcctttgagataggatcttgctctgttgcccagtctgctctcgaactcctaggctcaagtgatcctcctgcctcagcctccttagtagcagagattaacttttttcttaaattgaagtagtagatacatatggcttagaataattaattagtgtagaagggcttataataaaaagcagtgtactctttcctgtttatctcttcaaaggggacattttttgttttattttggtctctttcatgttccaaatgtcttgagaattttggttatctgtccatatttatgaataaaacaataagaaactaaccaagaactatacatatagataggcttgttgattgggaaattacttttaggttaatcttgcctgtatttgcttcctgctcctgatttcctacctacctggtgtttgagttcacttggttttggcagtttggctgtctctttaagtgtattctctgtttgtattcggaactgtggcctcctgtgtctgctttggttcattatttacactgttctgctttccatcttcagaaaatctgttgaaattgcttggctgctaatggctccattcttgttctctagtcattatggattattccttttaaaaattgctttactgctagtttagtctggctttggaagggagaggagataaaaaataagctctcgtgatatccccagtctgccatctttacttggaaatcctttcatgttaaagatgaagaaactaaggcctatagaagtaaaatgacttgtttgatactgatgcaggattttttcagtgccgctttgccagccagaaatctctggccggcagcacccctgcccaggcctcacttagttctgagctggccactagtctctatgctctgcccacccaggctggcaggctgcgctcagcttatgctaccagcctggatcccatgtctgctgagggcgagccaggcacagagcagcaaaggatatgtgagca

SEQ ID NO: 42421 - DNA, 1033 bp, Homo sapiens
tttcatatggtcatcggccttttgtatatcttcttttgagaattgtctacttacattctttactctttttgatgggattgtttgtttttttcttactgatttgtttgagttcattgttgattctggttattagacctttgtcagatgtatagattgtgaagattttctcccactcttgtgtgttgtctgtttgctgactgtccttttctcttcagtttaattaggtcccagctatttatctttgtttttattgcatttgcttttgggttcttggtcatgaaatcctaagccaatgtctagaaaggtttttccagtgttatcttctaggatttttatagtttcaggtcttaggtttaagtccttgatccatcttgagttgatttttgtattaggcaagagatgaggatccagtttcattctcttacatgtggctagccaattattctagcaccatttgttgaaaaagttgtcctttccctgctttacttttttgtttgctttgtcgaagatcagttggctgtaatatttgggtttatttctgggttccctattctgtcccattggtctatgtgcctgtttttataccagtatcatgctgttttggtgactgtggtctcacagtttgaaatcatagtgtgatgcctgcagatttgttctttttgcttagtttactttggctatgtgggctcttctttggtttcatatggattttagaattgttttttgtaattctgtgaagaatgatggtgatattttgatggggattgcacggaatttgtagattgcttttggcagtatggtcattttcacaatattgatgttacccatccatgtgcatggggtgtgtttccctttgtgtgatctgtgatttctctcagcagtgttttgtagttttctttgtagaggtctttcaactccttggttaggtatattcctaagtattttttgtttttttttttttgcagctattgtaaaaggagttgagttcttgatttgattctccacttggtcgctattggtgtattgaagagct

SEQ ID NO: 42422 - DNA, 1042 bp, Homo sapiens
ccacgaatatagaatatgaaagcttttacccatgaacctttttttgttgtttaatgtttccatttcttctgatcctataaacatcttagtttccccgtgtttttgtttgtttgtttgagacaaagtctcactctgttgcccaggctggagtgcagtggcacaatctcggctcattgcaacctctgtctcccgggttcaagcgattctcatgccccagcctcctgagtagctaggattacaggtgcctgccaccacgctagctaatttttgtatttttaatagagacggggtttcaccatgttggccaggctggtctcaaactcacctcaggtgatctacccgcctcagcctctcaaagtgctgggattacagatgtgagccactgcacccagcgagtttccccatgtttatgagtaattctttgaaatggaaagatgcatgaccagtgtcattggaaaaaataattaaaaaataatatagaccaggatcactataagaaacccagtgtatggactatgaccttaaactgtgataaaataggactaacaggagatttttaactttagctaactttttaggaacaaactatttcattctgtagttaatttaaaaatacttcaacttataaaaatttgattcatgaagctttaaaattgttacagtgtaaggctcaatgtaaattattgaaaaatgtatacacgtgtaaacaacctgtttttttcttttttctgtttactgttagcaattcaatggtataaggaaagtatacttgctgagattctaattgaacagaacatagtataaagttacacatttttatttaaataagttctctattattttccagcaaaatggcatacacgtcttttagattccttcaagtctgtattattcacataattagtgccagcctctataacaaataattccaaagtcttagtggcttaatatgataaaaatgtatgtcttgttcttaaaacatagtttgtagatgttcctgttgaggcagctctcctgggggtaatctcctctaagcagtgat

SEQ ID NO: 42423 - DNA, 1039 bp, Homo sapiens
gccatttagttgtaattttgttttagaaaacacagatgagcaaatactagatatgtgattaaacaaaataatgagaacttagattttcttttttaaagcttgtgttcaaattatattaattacaatctgcaaaattgctttgatctctgctgttaaggacaaatgaaatactggagctgtaatttccttatccccaaatttttcctatagctattccttcctttctttccctttcatttagttacttaaataatatttattataaaatatcaaaacagtacagggttgaggtgttcagaacaaaatatgaaaaactattcttcaaaagtttctggccatcctttcagcctctgtttaaatttgtacatgttttgtagcatattcaaatagcatatatccatgatattttgcaagttgattattttacttgggaagcttttcatgtcagtacatgtttgaccttgttctttttaactattgcatgctcttttgtagtctagatgaactatagttaatgtgaccaatcgttatacctctttctatatgcatgtattttttaagggatgaatgggtccagtagcttttctgccttcatagtcctgttactcagagtcctcaactctccaaaatccattgttttcttggttcttgtctttctgtgactcttatcacctttccatattcaaatccaattctcttccaacactgttcattattggaatcttaaattgtggcccatatttgtttattgaaccagtcagtctcaatctcaatttttgtatgtcagttatataaggaattttatgccactttggttctagcctgtggggaatttcaatgatttacattataaataaaaatattaatggtacacaaagtgaattattaaataaaggttcaccagctatgtgctaaagtgacagttctgaaatcccactgttttgatgaggaaattactgtgaaacctatttaaaaatgattttggtatgtcttacttggattttaaaaatgtatattgtaaaaaattattataataaga

SEQ ID NO: 42424 - DNA, 1058 bp, Homo sapiens
tggcctaccagaggatcagatcatgtggagcaaaggtgagtcatcctagaccagccagctctcagccaaccacatttatatgagtgagcttagccatgacagctaatcccagtccaaattgccaattacaagctaaattaatggcagttcttttaaatcagtacattctggggcagcttattatatagttagggctgatacactgtactgccttactgtctcaaaatcactcattcccccttttctgactattagtctgatactttagacttacaatttttttctgtagcaatctatatatggctttcttgtctccagcctgtttttttagtatgttacttgcagccagtcaccttagtgatatgcaaatcctatttccctgcttaacatttggagtggaggagggtgtttggattgtacttaatggtagtgatacatggcacaattggcttcttaccattgtacttggtggttgagaggaatctgatacagcttattgaaaataaattggaaatatatattaagaactttaagaacattggtactttttgaacccgtaaattttatttctaagattctatcctaaagaaaagatattcaggaatgtgcagtttttcacataatcatgttattaaaaatgatatttgagtgaatttggaacagcagaactcccccaaatacttaaaaggttaagtgagttgtgatgacatgtataacgaagtagtttaaatgtaggtttatgaagaatttttaatgacatggaacatttcctgacattgataggtgagaaaatgatgctatgaaatatatgggattttaaataaaattttagattttcttttcagtaatgtggcaaacaatgctaatctgagcagttctgctgaaaatgaaaacttttaggtagagtagaaaaagtattttttagaagcttctaggagctggcaataccctaagagattaattataaggccaatattgctaagtgaaactggcaaagcctcttttaccctaagatgaatttctactttggttttgatggtcctttgggacacagtggg

SEQ ID NO: 42425 - DNA, 1049 bp, Homo sapiens
gtcttgttctttagttaatggagagttatgaggctttcagaatctggtcatattgattaatccttttagtccacaccactacactatggaataagcaagaagttacacccttcagataggaactctcagtaagggtaacgggtttaccaaggttacagggttataaatgctggagtccttacaagaagccaagtcttattcataattcattctattccataacacttctctattgtatagtaagaatagcatagtctcttaaaagtcacttctacagctaaaattttatgattctgcccttcagttcccttatgtctataatggacataatacttaccatacttacttgactcagtattgcacatgataattcacaccaatggcttacttaggtagtcaatattccaagagggaagtgggacctaatagcctgcagtttccatgagacttggaaaagactcaggtgactggacctggcgggaaattttcagaactaactattcaagacactgagaaaaagtagagctctgatctctcaaaggttagaaaagacttaccatgttagcagtgataaagacttgcaatatgcagtaggtgggtagaaaagaatattctatgagggctttgtgtcaagttttggagttgggatagaaaggaaaaatgtcataactaaaaatatcagtctgattaaaattgtaacatgtgatatgttataaccatatttacaaatggtctagaccagtagtttggatgctaaaaaaattatctttccctgtgtcctttcatttttctttttctttttattttcctctcttttaatttttttctccctcattctcttcttcctttctcttcatcattggatgaaggaaagcccttcccctaactcatctgaacaatttttaaagcaaaagaagagttagaaccatactatctggggtgatgtgtcttgagacagctatagcaatagcatctacagcctttcaaatcaaagagttataattataagagggagattgtgctcagagttgggggcacaatttgagata

SEQ ID NO: 42426 - DNA, 1074 bp, Homo sapiens
cttagagaaagcatgcagttaactgaaattcagcttttaaactgaagatcatttatctatggtgtcttcatcatctagattcattgctagactcagaagctgaaaaagatattttcttattcagtcataataaagctatgtaaatatatagattgcacttgcccatcaggcaagaaggcatttcttggttgaactttattttgggcctcttctttgagctgggatgccgttttgccccctacgcccgccccgtctaggagcctcttttcctgagaatctgtgtttctgtaagggcccttgttgttatgtagactaagacttgttggtcctctctaggaagcttttatgtaaagggagaaagttcactgttttcacacccagttaaattgccaaactaagattacagttcagttcttttccccagatcatagttatcagatcattcttctcttagaaaacatggatgcgccttttctaagattctcaggattcacatcataaacggggactagaaataaagaaagatcttgtatatgtgaacgaatttctctaagctcacactttcttattaatattaggatagtggtgagacaaggaaacccagttctattgttctgcagcatattaggtcacagagtacagaggaagcttttagcagctccagataaaggacctcacggaagcccgtgaagccagtgggactcagctactgattaaacagcagcttgtgaaaccgagcctctcgttttagattaaacaaacagacttgtattttgaaaaagatttctaaagtaaaggaaatgctttctaaagtatgaattactgtgtttaacagcctctgggaaaattattttcaacaggctttctatgcaaattattttaggatttatagctataaatcttgaaatttgattttggttgggattgctgcaattacttttacttggtgatattttggggttaactaaatatgctcatttgaacagtaataggaagtccgtctgcagttttgtagctgattagcactgaagttatcaaatccttacagttttgctgataatcagtgtgctgagt

SEQ ID NO: 42427 - DNA, 1050 bp, Homo sapiens
attactgttttaaaactttgtatttactaaaatgagggaaggaatattctcggaggagatgctggacaaccatctctgatctagaagactgctccctctagggattttagattccattatcagcttttctttgaatcttcttatgaagatactgttgcagaaaactggggaagttatggtaaaattagcatgtctgcagagcaaaatattggattgatgtcttttaaaattgtagcaagtggctaattcggagccctgccttggcattacaattgtttgtcacaaagagcaggcatatcagaaaagtaacctcattattaaattcttttttttttttttgcaaaagttagctcagtgcagtgattccaaatgtcatttattgtattgtgattcaggtgggaaaagtgagcactatttatgccagatgtctcaggtacccgcagccacagcattgatcagtatctttcattttctctgcctttttttccttccccaaccacaaaagagtgactctgtattcctctgcccacctgggcctttggtaggagggggtggtggtggtaaaccttctgtttaatttttgacaatttggtaggtaggttttgcattttattatatgtgtttttttaaagttttttttttttttttttgagacagggtcttgttctgtcactcaggctggaatgcagtggtgcagtcatattcactgcagtctctacttcttgggctaaaacgatcctcccacctcagcctcctgaatagctgggactacaggtggataccaccatgcctgactgatgtaaaacatattttttctatagagatgggatctcactatattgcccaggctggtctcaaactcctggactcaagtgatcctcccacctcagcctcccaaagtgctgggattacaggcatgagccactgcacctgggtagttttaatattttaaaaggcttgagttaccatcaggtcaaattaggtgtgcaggaccttgtgctatggctaaagtagcccctgtctccctgcatctggtgaagggagacggtc

SEQ ID NO: 42428 - DNA, 1929 bp, Homo sapiens
aaacaaaaaaaacaagatctgggtgctgggtttgctcattgcttctgggcatttttaatagatttttgatcctctgcttcctgtacctaatctttggggttgtggggaggggaggagagagcaactttgggacctcttagagacagatgagctggaaggactctgtccatgttttctccctgtcacttaaactattaaataccaccataaacattctaaataccatgtttgtggtactaactgcattataatgatattggcagaatcttatttttctttttagagtaataaatatatgaaaaatagattcgatttacctcctccaagagcagcttaatctctgagaatatgaacgaaacctctttggcttaagaatttagttagagaggattattttggggggtctttcagtgttggaattgctgaaaaggtttataggcaactccttgaattggtaaaagttcagatgaaatttctactggcgagtctcttgaagagcatggggctgtagacttgctttgatctgtttactgagctttgctttgctttttttttctttttattatagaaaatttcaaacatacagaaaaatagagtgaagtggtatagtggaccctcgtgttcccgtcacccagcatccacagtattttcattcatgattcatcttgtttcacctttacccttccctctgccctagcctttgttgtattgatgtaaatctcagtgacggatcagtgcagctgaaaatgcttcaggaagaagtaagtgtgtttttataaaacaggatggcttgcgtgcagatcacctaggtatttgtagaaatgcagattttggccgggcgcagtggctcatgcctgtaatcccaacactttgggaaaccgaggcaggcagatcatgaggtcaggagatcgagaccgtcctggctaacatggtgaaaccgcgtctctactaaaaatacaaaaaattagccaggtgtggtggcgggtgcctgtagtcccagctactcaggaggctgaggcaagataatcgcttgaacctgggaggcggaggttgcagtgaaccaagatagtgccactgcactcccgcctgggtgacagagtgagaatccatctcaaaaaaaaaaaaaaaaaaagaaatgcagatttctgggtcccaaactaaccagctgaatcaaaatgctgaaggctgggctggaatcctgcatttataatagttttctggttatttctcccctcatcccctcactgccacaacacacatatttcatcttctactacgtacaaaataataccagttatttactggaaatctgttgacttgtgtaactagtgagaatcaaggaaaggaggaaaacattccatttgattaaaaacttgagattttaaaatgaatgccaacacctgaaatctgaagagctcactcatcctgagcaccacgtgtaaatatctccctgtgagtacatatgccatcaccacaaaggaattcaagcactccggggcagaacacagctaaagcttgaaataagtatttttttatttttttaaaaacttcactccttctctagatgtctgtatgaataatagcttctttacattttacgaatatcatgtataaatatcagggaaaacagcaggtagtccgacaatcagatgctggtaccgtgagctgagaatcttggtgccagtcctggaccaccaggcctcagctcactgcagctagagtcagggtggcaggtgactcgtagggaaattttgagagcaggtataaaaccgtgacattcttaattcccttggtgataaatgggtgtgctgtaacgtgagaacccctgattcgtaatctatacggtaacttgcagggtgttttgttttgctaggataatatgttgttagcatcttgcttttaaaaagtttatttttctaagctaactca

SEQ ID NO: 42429 - DNA, 1027 bp, Homo sapiens
ggcattcatacagtccttatccagttctgtaataaataagtagtttgtgatgcttaaaaaaacaaaacaaaaactctgggtgcaagagaggaaaaagtaagtcaagatcagctatgtggagtttgaggaagtataaactaccctaattaatgacagacttgggttcaaaggacagtgggctgtttttaagtgttaaaggttaaccacatagaggcagagcagtggggtttcaaggaaagcgagggagcttgcacccagcacacctaaactcagtctggcctgccactgtcccacctgggttcatgggcatatcagtttcttcatctgtgacgtggagctggtcgtattacctcagaggtattgtgacagccaaatgaaataatgctgtattttatcaaatgtcagatgaggttgatgataagtcacacccttagttttgtaccattaaaaagaagaaatgctgccagttaagctaacttgaagtgtgagatgcacctgaaattcagagatgcagtggacaaactgtgtgttattttttctttttattctcccttacaatccaaatgcgtctttaaaaacaatcaataaaaaacagtgtacgtgaaagcgctttgctttcctcaggagtcaaatttaatttttattatgtgcatcgggagtgaagcacagttcttcagaaataattccagcagtctggcgcagtggctcatgcctgtaatcccagcgctttgggaggctgaagtgggtggcgcacttgagcacaggagttcaagaccagcctggacaacatagtgagactcccatctctcaatagaaaaaaaaaaaaaagaagaagaaattccagtggggaagcacaggcttcttgtctggatgagtgaacagctcactgcaaggaggaagagaagaaaatcatccttcttggtcttcataagaattggctctcagtgcctcaagctcctcacttagtttaggttttccaaatggacacaagtgtgtctgtggttagggagttcttgttctcattgaa

SEQ ID NO: 42430 - DNA, 1025 bp, Homo sapiens
aatgttagccaatggtttttaatgcttgctctctttcattttaggaatttgaagataattttgatgatgagatagatttcacaccaccagcagaagacactccctctgttcagtccccagcagaggtcttcacactttcagtaccaaatatttcactcccagctccctcgcaattccagccttctgtaggtaagaccatacagcctaatgccacgttttcatgaattgtttctgagatctgagaatgggagcctagccatcataaatattggactgcccatctcctctttggtttatttctcttccttctgctcccagtgaagctgaattctagtggtcaggcccattgtattcctgcaatagctttgtcttctgctttctggaccctgggtctggtatgagaataaaacgaatctccttgattcattgacattgaacacctggccagaactcccaggctctgttctggaggtggtttctctgctagttctggccacggctgaccttgctgagtaggactctgctggcttccactgggatgccctgcatttgggtaggagaggaaagtttggatatgttaatcagattgacttttctaagcttcttcagacagaggtttggttctgtgttagttgatgtcttgtgaaaaaatagaatgtgactagaaaaatagaatgtgactatagtttttttttttagagtttgaaatttaagccctttttagagttagaactttttgtggtcttaagaaattcttattctgtgattaaaataataccttttaaaaaatattttaagcttttgctttgaccaaagaagtaggttcaagaagtagggttttctgagattgccgcaagaaggctgtgtaagtctgtagatgctaggactaccttttctggtgtgacacacgctgtgggctctgcctagggcagaataaacccccgaactgatgccactgcaggcaggcatgactataagaaaaagccagatggaacgtgacatagttggtgcatttcatttaaata

SEQ ID NO: 42431 - DNA, 1050 bp, Homo sapiens
gtatcattggatggagtgcgatgggtgtttaagtttcagggcaatgattgattgtaattagctttcgtcagtttactttctcatatgtatagcagactaaataacaaaacttagtggaagtgtttttgaggaacatttgagttatgttggaactgaacttataaattgcacttctgtaaagtcatagtgaatttccttgaagtagaatacatttttaaataaatcgacacaaataagtataaatacattttaaaataaatagaaaagaaatatgcataaatatgtgaatattgtaactatctggtgaatggtttaaaatggtccttttactgaagaaaaatatttgagttttccaagcttttggtgaggtggtaagtaaaagaatagaaggtcacctgcttattgcttaacttgttcacctgtgttccatttcccggtaaatgcagcagactcctttatcattttgatggaaatgacacaaaaaactgttctttgattttaggttctcttgggagagatttacacgggcactagcgtagcaagagtcatcgtgaaggagttaaaagcaagtgccaacccaaaggaacaagatacttttttgaaaaatggagaaccttactagtaagtaaaccttgtcatgtgttctgtaagactagtctgtggtctgttgaaggtcaggtgtttaaaactactgtgggatttctgcctgtaacatacatgattaagtaagttccaaggtctcataagacctaaaatgtccaggcgtcatctgaaaatcacttagcattccaagaaccaggagaactcagcctaaaccagaaaagacaacagattccaacacagatgacagagatgttagaattacctgacaagaattttaaagcactcatcataaaaatgctttgtgagcaattgcatcacgtttaaaacaaaaaaaatagtctcagcagagaaatagaagacataaagaagacataaatggaaacctcaggactaagaaatacaggaactcatcatttcagttacagcctcaggggcatggggaaatat

SEQ ID NO: 42432 - DNA, 1048 bp, Homo sapiens
ggagcctgggcacttggggaggagtggggcaggacccagtcctgccactgtttgcttcctcaccacctctgggtttcaggtcatgagaagcattgccttttcccctgggaacaccagttgcttgctttcgagttttataatgagagccaaggaccttctgcaggcgtaattgttcatcttttaccaagcctttgcatttcaagtatccaaagacctacgtggaatgttagtatggagagagaagaggagggagggactgggacagtcatcctgccatccaggaaatgcctgagctcgacatcgcccaagctagcctcaggctgctgcccctggcctagcaggatgcgtgcttgcccttgttgggatgctggcatccagctccttgttctggtctcaggagggagatgtcgggaaggttcacagggtctgtttatagaccctagaggtggtcgttggtggtgcccagtgacggagcctctgttggcaaaacctgtatctctgcagtcgcagctgttggcccagtggatagagcagccttacttaaagcattttcacttttctgtcctcatatggcatgttcctcctccctctctccctccttccctctctccctccctccctttctccctccctccctttctccctccctccctctctcccttgcttaattccaagaaatggggaccaacattcttcttacaattagaagattctttgttgttcataacagtggagtcacaggtgtcccaaggtttttcccaggcagttcagcaggcctgaaggcttctggatggagtgcagaaaatcacttgtaagcacaaagagtgtggcaagtgatgtgaggtagctaactggaatccacattgaggaccagctgcgtgcttggaacagcagctccaagtgtcactgcatcatcgttgagagttattgacggtgaaaacacaaacatattaccgaacactaccttgctagctttgtggccctagcgaagtcacttcaattctctgcctcagtgtccatatttgttaatgaggaaaataatagtacc

SEQ ID NO: 42433 - DNA, 1306 bp, Homo sapiens
tcatgcccggctaatttttgtatttttagtagagattgggtttcaccatgttggccaggaaggtctccatctcttgaccttgtgatctgcctgccttggcctcccaaagtgctgggattacagttgtgagccactgcacccagccggtcaaatgatttttaacaagagtaccaggactattcaatggagaaaggatagtgttttcaacaaatgctgctgggaaaatgggatatccacatgcaaaaaatgaagttgaacccttaactaacaccatatacaaaaattaactcaaaatggatcaaagacctaaatgtaagatgcaaaactataaaagtcttagaagaaaataaggaaaaaactttatgacagtgatttattcagcagttatttattgggtatgacatcaaaggcacaagcaacaacaacatagaagactacatgaaaatgtttaaactttgttaatcaaaagacactatcaatagggtgaaaagataaccaccaaatggagaaagtatttgcaaattatatatctgaaaagggttatataaagcatatatggagaattcgtgcaactcaacaacaaaacaaacagcttgattagaaaatgaaggaaagtgtgtatttccttctccaaaggaaatatacaaatggcaataggtacaccaaaagatgcccagcatcagtgatcattaggaaaatccaagtcaatttcccataatgaaataccaccttacacccattaggatggctactatcaacatcaaacaataatatgttttggtgaggacgtggaaaaattggaacccttgtgctctgttggtgggaaggtaaaatggtatagtcacagtgggaagcagtatggtggctcctcataaatattgaaaatagaatttccatgtgatgcagtgatgccacttatgggcatatccccaaaatggttgaaaacagggtcttaaagagataatttgtacacccatgttcataccagcatcattcacaatagctgaaatatggaagaaatgtaaactaaaaataaaactttaagctttccaattgtctgaatgaactcatcctctcagccaaggacatctcacagttcaggacatgatggggagggggcgatcagattccccattatactctccctttggaattcaggcacaactgaccagcattaacattaaaacagagatcttacgactttttgtagcaataagacaccatattccagcctgactaaagtaaagcatcacatgacagatagcaggccctgtaagaaattgaagtattttgcccccaaatatat

SEQ ID NO: 42434 - DNA, 1043 bp, Homo sapiens
ctctagtgtctcgagcacttgctagatgtcaggcacttagcacctgcctgtatcctgcatcatctcttttttttttttttctttttttgagatggggtctcgctgtcaccctggctggagtgcagtggcgcgatctcggctcactgcaacctccgcctcccgggttcaagcgattctcctgccttagccttccgagtaactgggactacagggtccctccaccacgcccagctaatttttgtatttttagtggagacgggtttcaccctgttggccaggctggtctcgaactcctgactttgtgatccgcccacctcagccttccaaagtgctgggattgcaggcgtgagccaccgagcccggcctgcatcatctcatttaatcctcaccgcagaggggaggtttgtgttctcctcacttcacagatcaggaaaaaacttcacaaagttgttgcttgcgtagaatcacatagctggtaaatggtagaatgaggacttcaaaccccggtctgtcagagtctaaagcctacagtcttgctccctaactggcttcactgttcagcgcataagtcccagtatatattgttttagtgttttgctcagagtctatgttatatgcatcagacacagcgtactttcttatccaagaaggatgacttagcaagcgttcatggctcgcagatgaggtcatgaagcccaggaggcttcagcaaaactccttacccactttctgcccagaaagtcactcttcatgcctgcttttttttctgacctggtttttggattgggtatatgttttctgagaataccatggatttaaattcttgaactcaccaaaagtataattctattcaaaattctgtgtgctttctaacaaaacaggaggattatattgaaacagatgataaaaaagttttccctctgcgatggactgctccagaattagtaaccagctttcaagacagactgctaactgcagatcagactaagtatagtaatatctggtacgtattggcttaccgttttattagtcatttctttggc

SEQ ID NO: 42435 - DNA, 1117 bp, Homo sapiens
gaggtgaagagggagacggctcttagctgcgttcaaggcggggccctcgggagcccaggtgcagagcgaggccgtgtccaggagccggcgtccctcagtgccccgtgcacccgcggccgcggcctcccaggcagtgctcatgcgctggccgtcgggggaggcaggggcacagcctccatgtgcgcgcgcgtgtggagctgtgtgcaccgcatgtgtgctttccacaggggcgtctctgcgtccacgcctgcacatcccggcgcacgtgtgggcaccacagaggacacgtgaggggaatggtcaccagtgagccatatttattatttctagagaaatcacgaactgctttctgtaattgcactgtggataaatgttccgagagtctccattgttgtacaggatcttcagttattcgaggggaatgaggcaggtcaagccgatgctagccactagtttgattttttttctgttttatagtttgcgctgcatggtacttgtgaagcttaaatattttgagtgttctactgtgtctaggattgttgggattgtacatatggtactctttcataaatgataaatgattctgaatgttagtgttttatgttcatataggaaatattttcattgagtccaaaataccactgttttgttgatggacttgaatgcatttttgtctcttcttgatgaagcggctttgccgcagcaaatgaggcttctctctgaggagctgagaggtcttgcagcctctccttgtcattctcccaccccacatcccattttttaaagcccttttggtaaaaaccaacaggttgtggccgcagacctcagatggacccggcccatccctggggacgtgctggcgtggcaggtccagagagctgcaccctgcacggggcaccgcaccgcttccctccgcgcagctcttctgcctggttttcggaggccaggctgctgggaagcttccgtgttcctgtcagtccttccttcaagaagccggggaactcaggcagactcatctccgcagagcataccagccgtgggggaccgttcgacttgatgatgtgtgcacacttcaggtggtggggacttgagctttaaaaaaacctccacagccgaa

SEQ ID NO: 42436 - DNA, 1074 bp, Homo sapiens
atagtgaaacctgtctctactaaaaaatacaaaattagctgggcatggtggtgcgggcctgtagtcccagctacttgggaggctgaggtgggaggatcacttgagcctgggaggtggagcaaatcacctaattttacatgaatgggataacttatcaagtgacagcatcacacgatttgtgtgtgtgtgtgtgtgtgtgtgtgatggggtctcgctctgtcacccaggctggagtgcagtggcataatcatagttcacagtagcctcaacctcctgggctcaagcaatcctccacccccagcctcttgaggagctgcgagtataggtctgcaccactatgcctggttaatcccagcctcttgagtagctgggagtataggtctgcaccaccatgcctggctaatttttttgttttttttttttgagatggagttttgctctcgttgcccagcctggagcgtggtggcctgatcttggctcactgcaaactccgccttccagtttcaagcgattctcctgcttcagcctcccgagtagctgagattacaggcgcacacaaccacgccttgataatttttgtatttttaatagagacagggtttcaccatgtgagccagactggtctcaaactcctgaccttgtgatctgccggcctcggcctcccaaagtgctgggattacaggcgtgaggcaccgcacccagccactaacttttttttttttttttttgagacggagtctcactctgtcgccaggctggagtgcagtggcgcgatctcatgattatttgagggagccttccttggagctcagcacatgtaagggcagacccagtagctgttatcagccccatctgtcaatggaaagagaaagtaacttgcctaagttcacacagctagtcagaattcttgggttgctgaggaaggatgaaccatcataggctggaaatgaaataggtcaaaactccttcaaataattttataaatgttggctcaacttcttgagaatgaaaataatacatgtctatttataacacttattaatttggttttacctacatttttcttttttcttt

SEQ ID NO: 42437 - DNA, 1894 bp, Homo sapiens
ttacaggcgtgagccaccatgcctggctatttatttttttgagacagagtctcactccgtcacccaggctggaatgcagtggcagaatctcggctcactgcaacctctgcctcttgagttcaagtgatgctcctgcctcagtctcccacatacctgggattacagcacccgccaccatgcccgggtaatttttgtatttttagtagagatggggtttcaccatgttggcgaggctagtcttgaacccctgacctcagttgatccgcccaccttggcctcccaaagtgttggaatcacagtcgtaagccactgcatccgccttttttttttttttttcttttgagacagagtctcgccctgtcactcaggctggagtgcagtggcgctatctcagctcactgcagcctccgcctctcaagttcaagtgtttctcatacctcagcctcccgagtagctgggactacaggcatacaccaccacacccagctattttttctctatttttagtaaagatggggttttaccatgttccccaggctggtctcgaactcctgaactgaagctatctgcttgctttggcctcccaaagtgctgggattacagccatgagccaccacgcccggccaggattacattttccatacgagcccagtgtatacattacagcaattttattggtgtagtttcagggaagataatttattactccctctgtagggatcgtaatctgtgagggtcttatctctggctctgtttagtcttcctaattatttatttattaaaaacaattttatagagacagggtctcactatgttgccctggctggtctggaactcctgggctctagccattgtcctgcctcagcctcccaaagcagtgggtataggcatgagccaccacacccagcctagtcgtcctaattatttacagaaaaaaaaaaaggcagaagttgccaggcacggtggctcatgcctataattccaacactttgggagtccgaggcgggtggatcacaaggtcgggagtgcgagaccagcctggccaacatggtgaaaccccgtctttactaaaaatacaaaaattagctgggcatggtggtgggcgcctgtaatcccagctacttgggaggctgaggcaggagaatcacttgaacccggggggcggaggttgcagtgagccgagattgtgccactgcactctagcctgggcaacagagcaagactctgtctcaaaaaaaaaaaaaaagctgtatgccatgtgtgagtcaagccacctagccacattcctctcaagggtcagaataatttaaaattccaacagctgtaaatttgaattctttcacgtactgaactgtcaaaaacccagtcattgtcccttcgagctcatcagctcagcagcagggctgggatggatgcctgggatgacatgaattcctcctgttccttctgtctttctttaaacaagtcaccaggggccatatccatgtcccatggtgggtaaatggtgttgtgtccctacaggcctcccgctcaaggctctctctggccaggaatgtggatttcttaatgcacagtttgaccagctccttcactgccaggcatagatctttaggtactgtaagtgttcagtaagcacccgtgaaaggtcagagatgggggcagacggtggaagtgattcagagaaacaagaaggagaatttgattgtggtatgaaaaggcttccacaagcagccaaagataaaatatgcctattgatctacaggatgtcaaattaagaaaaacggccaggtgtggtggctcacgcctgtaatcccagcactatgggaggctgagatgggcggatcacaaggtcaggagatcgagactgtcctggctaacacggtgaaaccccatc

SEQ ID NO: 42438 - DNA, 1085 bp, Homo sapiens
agagccttttgagaacgaatggacatagggactgtaggagaaaagtttcccaaaatcggctgaacaatcccccttttccaaatgcataccactgtgtctggctaattttaaatttttgtagggaggggtctttgttgcccaggctggttttgaactgctggctttaagcgatccgcctcagcttcccaaagtgctgcagttgcaggcgtgagccacggtgtcctactccactggagattgctgaagggacctccctgagtaggctagagggaggcaggtgggcatgaagtttttttcttttttctttttttttgagacggagttttgctcttgttgcccaggctagagtgcagtggcacgatctcagctcactgcaacctctgcctcccaggttcaagcaattctgtttcagcttcccgagtagctgggattacaggtacccaccactacgcccagctaatttctgtatttttagtagaaacgcggtttcaccatgttgaccaggctggtctcgaactcctgacctcaggtcatccacccacctcggcctcccaaagtgctgggatgacaagcatgagccactgcactttgcaactttttctttcagcagtggaaagcccgacttcagaatattctggtttatttttccataatccccggagaagcagggaacaggttctgtgggtggggtttgggctccccagcctgctttgcccagcaggggtgggggcagtggccctcatgagtccagacccccaggaagcagctggaaacatccagggggctgggatgggagtagggtcccccagatggccaagttttctccccttagcaaggcacaggtagtcatgcttccctgtcgcaggcaggcggctgcactgccttgctgtaggctccccttcccccctaagcaccaggtcccatcatctatcagacagccccaccctgttgtgtttttctgtccactcactccagcactggctggatggggggtttgggcccccaggaggcccagaaggagcccgttggggtctgcctgtctggtgggagcaaagcttttctcatttgggctgagctggctagtg

SEQ ID NO: 42439 - DNA, 1084 bp, Homo sapiens
tagagcgaggccaccaagcggctgactgcggccagggtggacacatcttgtgatcccccatctcccgcaagaatccaagaatccaaaatgtgtgtgtggacactggctgaccacccatcactcgatgcctggtccacacccccttcccgactgtacggagcttccagggtgcccaccacatagccatgcgcccaggttgggggactagttgacctggctttcagaggggtcccgggcagctcggagcaccgagcaccactttttcccttgggctgcagcagagaatgctggtggccctcactgcagagggcaggacagagtgaacagggccagtgcaggtggccttgctcctgagcagaatggaacagccctaaggaacatttccaagccagctggaggccagttactcgcaacaaaagtggccctcactgacacctgtcttcagtgtgaaaacccattccagtcctcgtctgtggcccggacttgtcttccagttcacttctgatctagttcaacccctttattctcaaaagggggacgctgaggcccaaacagggaaaagccaactgctccgagccactgggatctttttggaagccgaggcacccatgttgtgacgcaaacgaagatgcgtgcaggcctgcaccgggggcactggcggctctcaggaggggctcacgccacgtgagggcgcgctgtgaaatgcaggcttgcttttacaaaggagagctgtgtgcttatttaaaatgttgggagggagccaatacttcctcacttggaactgcagtagaaaatacgtaaattaaaaaaattcaggccgggcacagtggctcacgcctgtaatcccagcaccttgggaggccaaggcaggaggactgcctgaggtcaggagttcaagaccagcctgggcaacataacaggatcttatcattgttaataaaaacttaaagagatatcacgtgacctgtggcaaacccctagcttgagtcctggcaagtctcccctgcccccttgggagaagcccctgctctcagatcgtctaataagacgcgccgtcacaggacagctgtggggcttcccaggt

SEQ ID NO: 42440 - DNA, 1050 bp, Homo sapiens
tggaggtgctcagcaaagcccatcagtgtatttcaagccatgggagtggatgagatggcccagcacaggcaggaaggatggacccagggtgactcccaagaacactgatgtttaattgatgggcagaagaggggtgcaaagagctggtgaggcagaagacaaacagagcacaggtcaagcagccggggccagagaacattccagaaaaagcatacaacagcgttaagggctgtaagataagaacggtaagataagtgtaagataaggacggaaaacacatggcttgggtttagcgaccaggaggggcagggcacagggagggagtttcagagggctgcaggactgcgaggagtaggtggcctgggctgggtctcctcacagcagcaaagctcggggacaacagaaatcacggcagacagcactgtgagccgcggtctcatctctgactagtccacgagagctgaggcttagggcagggcctgcgacacagctagatggtggtgtgttacagaaacgacaaggcaggggtttctgtcaccgggagagctcagccacgttcagggctaccttggcgtgggcacggtcactgcttctgtctcattttcttccagcaacttcgtgtacgacgacgggaaccaacccctcctaccggcaaagagggagaaaagaccctatcagcagtagacatgtggacggcaacctccctgaacaacctggtgagagctcagggcagacaggtccactgctccagaaacgcccatgtgtggaggaaatgaaattaaggcttttaataggtaaatatggactttcacatacactgaacaatgtgtattgttaacaatttttttttaatagagacagggtctcgctctgttgcccaggctggagtgcagtggtgcgatcatagctcacagcagcctcgaactcatgggctcaagcaatccccctgcctcagcatccgagtagctgtgactagaagtgtgcaccaccatgcctagctaaaaagcaatatatgttgtatgtataacattaatttgatttggattaccc

SEQ ID NO: 42441 - DNA, 1188 bp, Homo sapiens
tgatgaaaaagtaccttcagtttgtggcagctctcacagatgtgaatacacgtgagttgatcctttttatcattaagaaatgcataaataaggccggatgcggtggctcacgtctgtaatcccagcactttgggaggccgaggcgggtggatcacctgatgtcaggagtttgggactagcctggccaacatggtgaaaccacgtctctactaaaatacaaaaattagccaggtgtggtggctcacgcctgtagtcccagctacttgggaggctgaggcaggaggatcgcttgaacccaggaggcagaggttgcagtgagctgagatcgcaccactgcactccagcctgggtgacagagcgagactccctctcaaaaaaaaaaaaaaaagagaaatgcataaatatgacacatttatctcagctcagatgttgtgtactttgagattaatcgtaacagtaacttttattctcattttccttttctctaccttgtagagaagcaaagtgatgagtaatactggctggagccccaaagaggcacgtgtgtgtgtttgtgtgtgtgtgtatatgcttgtcagtgcatgcacgtgtatgtctgggagtacaaatgggtgcgactggttgtagggaactagctatgtgccttctattaggccatgacagtcaaactgataagatctgattgcttctcttaaattactaaatccaagttttgcattaacataatttccttaacataatttcaattacctgatgcttgttttgccgttcacagctgatgaaacaaagttgaaaatgatgcaagaagttagtgaaaattttgaggtatgagcattatattttctatttttcattttgaggtaaatattcttattcactttcctgtcctgctttgtcagtctttttactagcaactcaaagatcattgtctttgttcaagtaatttagtatatttcgaaactgaaatctgaaactttgtacacagcgttttccatcttcacgctggtgatagcgaaccccataccatgttgaggattgtcagttttgttttggttggtttaaaaacattttttcattttaaaatatggtagctcttttaggctaccatgcctgttgggatgcactcagatttattcttgtacttttctttctttcttttctttcttttttttttttttttgagatgga

SEQ ID NO: 42442 - DNA, 1032 bp, Homo sapiens
gatagagatagatatagatatctagagagatatggatatctagagagatatagatatctagagagatagtatatagcagtatagttagggcttttccaagtaatgacttttgcaatctgtgtatcaacatttaccttaaatgaaattcagatgactgaattcttcaaagaattaaatactagaatgaccatcaagaagcagttctctaaattactaccacccagaaaaatgtttaaatgaagtgagtgaaatttaaaaactcccagtgatttcaggagtcttacagattcattattaaatgggccatctttcaagacaaaataaaccctcaggttaggaatcacatgaacaatttatctggatcaaaaaactggtggctgagttgagatagttgcagaataaccaggcagcttgttgaatgaatcttcttttaattataaaaaatttttttagagacaacgtcttgctatggagtatagtacctattcacaggcgccatcatagcacaccacagcattgaactcctgggctcaaatgatcttcctgcttcggcccccaagtagcagggactacaggcatgcaccaccatgctcagcttgagtgaatctttttaactggagaaattctcttttttttagacatggtcttgttatgttgccccagctggtcttgaactcctgggcccaagcaatagtcccaccttgtcttcctaaataaagtgctaggattacaggtgtgagtcactgtgcccagccctactagagacatttgaaatgcagatatttgaaagctgtataatcagtagttaatatggacttacatgcaaatatgtttgacttcttgataacctggcagttagttcagtgttgcagcatgaatcttctccctcttttccttgaatccttggttgtgggtgtttcataaaaagtcttaacctttaagggtgaaaggtgccaaacacagttcttctgccccacaaatgcactgtctgcttggagagaagctatttgattcctgcacagctcctggggc

SEQ ID NO: 42443 - DNA, 1118 bp, Homo sapiens
aactcatgcagtcttcacaatagtcctataaggaaggcgggaaataatatccccagagtttaggtaactgtccaaagtttctacttcctaagtgggacccagaaactgccctagtatcttcatgctgtagttttatttcctattctcctttttttttttttttttaaaaaaaatagagacaggatctcatgctgttgcctaggctggtgtgcagtggcatcatcatagctcactgctgccttgaactcccagtctgaagtgatccttttacttcagccctctgagtagctaagaccacagcataggcacgtgccacaatgcccagctttttaaaaaaaattttttgtagagatggagtcttgctctgttgcccaggctggtcttgaacttctgggctcaagggatcctcctgcctcggcctcccaaagtggtgggattaccggcatgagctacagtgcccagcccttcctattctacttttaaaatcagtactaggatcaataatggattagattagattataatataattagtatacatctaattagcacataatgaatatacatctaactaatacattggtttgctcaggctctttgttttccagatcaagaaactgagacctagaagctaaataacttcatagaggtttcatacttagatcgtggcagagacaagctagtacaggttccaggttcagcatttcccaaaggattggtatttctaattttaataggaaaagttagcatttagttttcctgaattggatttcagaaatacaatcatcctaatttaaaattatgttattactaaataatacaagtagcacaaatttgcttttggctaaaatgttttatattcctttgcagttattataatgtgtaaatttgaaatgaaaatacatacacataactgaatggggtcttttatttttgcacaattagaatgtcacgtcatctcctcagtattctacattcctagaacatatcatccctcgattccttacatttctccaagatggagaagttcagtttcttcaggagaaaccagcacaggtaatgtaaaaaaataacatgagaagacaagggtgctgtgggattgtgaccagttacgaatta

SEQ ID NO: 42444 - DNA, 1030 bp, Homo sapiens
gatggagtgctttctttcctgcctcactgtggtaggaatgtaatagggtttgtatttaatcatttattagccagggcaaaaagagtagaaaatacttttaggcaagctttgtcttctgttgttgaagatggagaacatggtccctgtcgtgttatctttatggtcctgtgggaagagtaaacgtctagtgtgtgttggtttaggctttaaggggcattggaaaatgaatggctgagcctaaatactgtggagttggtgcagcataaaaatgtagaacatactgtttttttccaccaaagagtcaagcgtctttttgttttgttttgttttgttttgtttttgaatgaatattgggtttgactttaggaaaaaatatttttatgacttttatgtagaaccgctactttgagaaccctcaagtgatccccgagaacacagtgcctcccccagaaatggttggtatgataacaacgattgctgtgaaagtcaacccggagcgtgaggacagtgagactcgaacagtaagtgtttcgctgagttatttctacccgtggctcctgtagtttcggatactggcctgttaaaccatttttttttctcttaaatacttggaggcatttaagacaaacgtgtgtgcctggcaaagcatcactggtccttctctgcagcctgggaggggtgaaagtgaccttttgggtgtcattgatgccaggctagaaagataaggttgttgttgaaacccagaatcaccctgctgggaagagcagcagaccaggtgtggggtgtctgttctgtcccttagctttgagtcttttgacattaataaagtcccttaaactatagataaaagcatatagctcagtgactgagagtgtgggctctaggacagagagctccagtacaatgtcctggccccactggggttttctgactccaagaaagttaatgaacctgcgttctgaccttatttttcctctcattatctgaaaaacctgtctcacggactttgtgaaggtaatgctggcatggt

SEQ ID NO: 42445 - DNA, 1044 bp, Homo sapiens
gtcttcatgcaccctcctgacttggagcccgtctggctgtgtcatttgagggcagcatctgaggaggaatcttctttggccatcgccacggccctagttggggtcttgcactgagcagatgttactcgaattctttctgcggattgagtagaacggcctggcactggctttgtgggattcacattgtaactgctatggaatgggctggagaactggttggtgtgtttccttaaaacttttatgttatttggaattgcacgaaaggtgtagacacctttgctattgttgctgtgttgtttgggtctgtgtggaaatcaatcttttgggtttagtaatggttacaggcttttaattaatactaacatcactcataattgagaggtaatatttttgttctcttcttattcaggcaacataagctttacaacaaggagttgtatgctgacttcattgctgctcagattaaaacattgtcatttttagcttacattatcaggatttaccaggtaaggtcattgacttttatgtcaggtttattgagatagtttacatacaataaaattcaccttttgtgggtgtacagttctaggaattgacaaatattggtaatcattactaacacatcaaaatacggtacatttccatcaacctccaaaattccattgttatatatttgttgtcagtttcttcccaccacctccattccttggcatacacaccgatttatttggtccccatagttttgtcctttctagaatgtcatctaaatggaaatgtccagtgtctagtctctgcaaccttttgagtctggcttctttcacttagcagtaatgtggagataggaccttgttttactgattactttttattgctgtgtagttgtctttgcttggcagccttaacaaaaaatcccataggctaggttgcttacacggtagcaattgtctcacagttctggaggctggaagtctgagatcaaggttctggtttctggtgagggctttcttcctgccttgcagacagctgccttctgctgtgtcctca

SEQ ID NO: 42446 - DNA, 1058 bp, Homo sapiens
aaagaaaattaggcatggtggtatgcacccttagtcccagctactgaggtgggaggatggcgtgagcccaggaagtcgagggtcacttgagtcaagcttagtcttaacggttttttttttggagacgagtctcactctttcatgctggagtgcagtggcttgatcttgcctcactgcaaccttctcctcccaggttcaagtgattgttctgcctcagcctcccaagtagctgggattacaggcatgtgccatcacacccagctaatttttgtatttttagtagagatggggtttcaccatgttggccaggctagtcttgatctcctgacctcatgtgacccacccacctcggcctcccaaaggtcttactgaatttttaagaagctgataacatttgaatttttcttaacactctcctatccctgtaactgtgtcatctcactctgttcttacaggagttggtgactaagtattctcagcagatggtgaaaggaatgctccagttactttcaaattgtccagcagagactgcacacctcagaaaggagcttctgattgctgccaaacacatcctcaccacagagctgagaaaccgtacgtccagcctgtcttgtcttgaatgctgatgctagtcctgtggccatctttggggactcggctgacattccatagttgtgctgtgaggtttccatgtatccttgcttccttcattgctgtcttgggttcattctttcccctcttttctctccctctctgcctccctgtattagtctgttttcacgctgctgataaagacatacccgagactgggcaatttacaagaaaaagaggttttatggacttacagttccacgtggctggggaggcctcacagtcatggcagaaggcaaggacgagcaagtcacatcttacgtggatggtggcccgcaaagagagagcttgtgcagggaaactcccctttttaaaaccatcagatcttagccgggcacggttctcgtgcctcagcctcccaagtagcagaaattacaggcatccaccaccacgcccggttaattttt

SEQ ID NO: 42447 - DNA, 1070 bp, Homo sapiens
gaagggcgctgccttcagggatgggcccttcccctccctcctcagcattgaatgggatttaggtgttagttgtcctggctagggcttggttgcatttttatagtgtttggtaagcaagtctagaaaatgatttctagtggtttagtaagatcagagatccctagactgaaagagaatcagaacaaaaaaagaaaaagcaggtgacaaagttgagacagagttgacttacagttagtttatattttcatttagcttctgatttacatagccagaatcctgtaattcctgtataattaggaatgctctcaaggtacatagttaacagggatctgggttcattgaatgcttttggggtgtgtgctgattggaaacactgtcccaggaattcattacacttcttggtatggtgagctcttggcaagggattgacccttctcatgtatttccttaacttccttagagaagtgacataggctacccaggaggcagcagggacatcctttactgttgactgaaatggtgatgaatctgccatgggagtggaccataacctggctccatgtccggatttaaccctgtctctagttaatccctgctggagcccctgttcacacagtctgatttcctgggctctcagctgtcccccaaggggtgttcctccctcccggtctcattcaagctgaccctgtgctgggaactcagccccttgccctcctctatcctcctcatcctttggatttgggacctggttctgctgccccgtgaggccatccctgatggcttctcttctccctgagttctcgtccttcatcctgccttcctgtgccgtgcaggacgtgccttttcttgggtccactgccacacgcctttctctttctagccagcctcagctctcagtggcactgtctcaggaatggggtcagtaaatccttaactgtcctcgtgagtggtggggagggggactttatcagaaagaggctcctcgccatttataatacaaaaaaattagttttaaaaactgtttagagaatagacctcaactgtggtttactaaagtctgatagtacaac

SEQ ID NO: 42448 - DNA, 1050 bp, Homo sapiens
caagggttgggtgggcctggtggagggtagatgaggtgagaggtcttagactacttttctgacaattattaagaagcctgtttgaatctacgggaacgtaagagaaattggaattttgcttggtttagagaaaagtaccaagattttatgttaaggagtattgctagacatgaatatttggcattgttaaatggaaggtgatttaagaaaatagatttatggccgggtgcggtggctcacgcctgtaatcccagcactttgggaggctgaggcgggtggatcactggaggtgaggagttcaagaccagcctggccaacaaggtgaaaccctatctgcactaaaaaaaattagctgggcatggtggtgcatgcctgtaatcttagctgctcaggaggctgaggtgggaggattgcttgcttggacctgggaagtagtggttgcagtgagccgagattgcaccactgcactccagcctggttgacagagcgagactccgtctccaaaaaaaaaaaaaagaaaagaaaatagacttacatagtgacctgtagtaatttttaggacctctgataattcagacaaaaaatggggggaaatttacagttttttgcgacagttgagtgcggatatttcttaaatgcggagtccacattaacttaattcttttccatagtcctgtaatggaggtgccttcgtgatctgtgtttttcctttgccaccctttctaatgtaagatttgaagtgtatgagacaatttatgtcatgtttgtaagttataaagcctaataaatagacttaaaaacctgagaagttgccatcccacccaggactggaacctcactgctaagtcgcatccacctgcgtgctcctccccacccatttttttttttgagatgaagtttcgctcttgttgcccaggctggagtgcagtggcgcaatcttggctcaccaaaacctccgcctcctgggttcaagtgattcttctgcctcagcctccccagtagctgggattacaggcatgtgccaccacgcccagctaattttgtgttttt

SEQ ID NO: 42449 - DNA, 1599 bp, Homo sapiens
gggtgagacctgggaatccactgtctgaaagcttcccaggtgatgctgtgtggctgtgttggggttttgttttgtagttgacttctctctctccatacctgcacgcatatatacacgcatgcccttatatgtgaggagagtatttttgaaggtcatacaaggccctagcaacagtggtttcctctgggcagtggaatggggtgggtggcttgaagtgcttttcactctgtatccttttctgctgttttaagtcttttaccaggttggaatcttttaagggggaaaaatgatattagcctatactagttttccaggatgtgaatgaagagaagggggaaatagtgatagagcacgatatctgttatttagataacagatagagaaatatctacttgtgtggtaaaatatctggaaggatagccactggaattcccagtgatgttcagcttcctactttatgcttttctgtacttgaaaaaaaaaagtgtgttcacttaaatatttgaattatagcccatctgtttcttgaacacttgtctgaggccctggggaggctgatctgaaccaggaagacacggccctgccatcatgggatttgcagttagataaagtaaccccctgttttgaggagaaaaaaaaacgtgatggtatcagagtgggtgagaaaaaaacatggtggtatcagagtgggtgagaaagtgtctaagaattctttccactaatgaagtaaactgagttttgccttaaagaggctcagtcatactttgatacttaaaatctttaggatttgagcttagtttgtcagttgttaattgtgttgcagtgtgtggaagattgctgtgttctgttatttgcaaggttattatgtcttcacaggaagagtgggctaaatgaaattgttttatcttttgcagctgttgaatttgtgtgaggctgaagattcagctttaacaaagctgccctgttataaaagccttccgtcactcgtacctttacgaattgcggcattaagtaagttaatgaaaatctacggggtataaaagtgaaaggagactgaccacaggaggtctatagaaaaaaaaagtggccttttgttgttgtctaatttttatgactttttgtagtctttttaagatgggatcaaaaaattatttttgtatgtttatcaaactgtgtaatgagatgccataaaattacatgtgttgttaggattgaagtaattttgtgctttatagtaaagtctgttgttgttttatgaatcagacgttctggtttaaaaggattgtcgtatcattcatatggtgccagaatcagagtgtatatatagtaagggacatgacagccttagaagcttttcaatgactcaagcatttgttaatcctgcagtctctagcttttcactgggaaacctcagttatcattgtcaagcacaggaatgatgcaaagtgtaggaaaatagactagatctgtattggctgagatagaaacaatcattttctttctagtggggagtgaaggtgaatacccaatacaaacttttttggttgactctctcctgctttgttgatttttatgctcttaataacatatttccagaat

SEQ ID NO: 42450 - DNA, 1043 bp, Homo sapiens
ccgagatggcatcactgcaccccagtctgggtgacagagcaagaccctgcctcaaaaaataaataaataaaaacaatgcattcagatggcttaaaattgaaaaggtgtaaaaggatgtactgcagaaagcctccctcccaccctgtcctccagctacccagtcccctccctgagacagccagggttaagactttgttgtgtatccttttagagatgttttatatatgtaagaggacatatgtgtatatattttttcctataaaagggggtacaatatatatatacacagtccttgcttttcccatttaacagccatcatttcatgtcagtacctgaagtacttcattctgctttatggctgcagaatacctcatgacatgaacttgccataatttatttaaccatggcctcactggtgaacatttagattgttcccagccttttcattatataccatgatgcactgaaagacttgttcataatttcacatgcttttatctgtggtgtacatttctagttgtagaatttctggatcaaaagaatgtatgcattttaatctttcaacaccttgtcaaattgctctccaaagaaatttttaccaatatacactcctacaaaatagataagtgtgccttctttcatacagtcttgggtgagaacattggaagtcctttgggtttttagaattaccagagaaataattatgcaggaaaaaacccatttgacagtgtttaaaattgaaatgtaagcggatggaggatttcatctgttagctttcttttgcattcaattttgcttctggtaaatggatttataaataataaacaggatttaatggtccaccactgcaaacatgaatgtatttttcatgcttatgtttcccaagtagcctttgaccatttgacgttttaagatactggagctacttttttatttttggtgtacctttcccccaactataaacaggagtttatatctactgatggacagataaggtagagattgcattatgtagagagagatattgcaggtatggatacatt

SEQ ID NO: 42451 - DNA, 1049 bp, Homo sapiens
atggcagcctggtaaggtcacctttaccacttgtgagcacgcatgacagcaaacagcacgatcacatcgggtgtacaccgtcggcccctccacacccctacaatggacaggaatgctgaaggccacgggcagtcagtttccttaggacacagcacagttagaacctaaggctagtaagttgtggcttttacatgtgaacccttcgcttcactgcctagccttgccaacatagttagactatagtagggtctgtagtgacgttgacctctgtcacttgcaaaattaatcgacctgtttataatttctggttttcttgatcaggaaatgaagatttgctcagcaattataaacctttttcatctgatcccggctgctcctcagacactggtgaagcctttgctagaggttgtcatgaaaacggagcgggcgatgctgatcgaggtaagggccatactgaaggctgcttctcgctctgccaccctccggtgcttatagcgtcctcacttgatcgtattttcaatggacggaacagcataaagacgttcgatgtcaacatttgcttgtgggtgttcatgcactccagtaacaagggaccttgttaggtagacagcctcaagctctgagaagaggaagttgtgagatgcagcattcccacatgttttgcaggcggggagtccattccgagagcccctgatcaagttcctgactcgacatccctcgcagacagtggagctgttcatgatggaagccacactgaacgatccccagtggagcagaatgtttatggtaagagctgtgagcagctggagtcaggggtcccttcaaatgcttgtgagctgtcgtgctctgaaatgttcagttcatatttcactattcagtgtcctggctgcttttttttcagatccatttgaatattggaaacagcattgctgtttggttgtgtctgtgaaatgtgcaggtctaggaaccactctttataggactttggtggtggtagcaaataaatgttctgccaggattataaaatcataaagtatgattattattta

SEQ ID NO: 42452 - DNA, 1035 bp, Homo sapiens
tcttctctgtgttcccatgacctcacatcggggcctcacctctcacttgagtgactgcagctgccgcttctcagcgcctctcttgttggccctgttcactttatttcccatcctgcagtcggagggagatgagccatgtacctccctaactcgctgctggttaggcgggacatgggatccctgcagggagcttggtcttacctgtctgcatgtcctggcctagttcagcacgggcacgtagtaggtgcattataaatactagaatgaatgtattcattggtcaaaacttaacagaaagcaactaagttgtttcctaataagaaagtcctaagaagtttttaaaaaattgttttggaaaagtagcatgtcttgacaccaagggattgtcttcttatttcttaaagccttccttctcatcctccataaacgtctcttccctgttttaggtttttcatagtctcctcaaggctcacgcaatggaagctcgagcgatcgtcagacaggcgatggccattctgaccccggcggtgccggccaggatggaggacgggcaccagatgctgacccactggacccggaagatcattgtggaggaggggcacaccgtcccgcagctggtccacattctgcacctgatagtgcaacacttcaaggtgtgtaggagggacggtgggctgcggggcgcgcgtcttcaggcattcactttgaacctttaccttgtcttgttctgcaataatcaggtggtcgttcatcttttagtaaggctacttctggttcattgattagtttgtgtatgtgtgtatggctttatcagcatggaaattgctgtaatatagagaatatgtcacaggtgtgtgtgtctttgcgtctgaggctacatttctgttgtaagtactgtgcccagttaacccttgtatgctgctaagtttgcaccttaaggtgggagatagtcctcattgactctagatttccatcacctgccttggaaagttattcatgttgctggcacctccttctctggccaaattacccttt

SEQ ID NO: 42453 - DNA, 1028 bp, Homo sapiens
gagaggcatgtcgggggtgtgtgtgtgcacgtgcgcacacgtgcatgcactgtgggaccaagctcccatgttccggcgtgatgctggccctgcgtccgcaggtgtactacccggtacggcaccacttggtgcagcacatggtgagcgccatgcagaggctgggcttcacgcccagtgtcaccatcgagcagaggcggctggccgtggacctgtctgaagtcgtcatcaagtgggagctgcagaggatcaaggaccagcaggtaggggtgtcagcctcaggggtgccccgatcgtcttcctttgacttctccctagaaatcagtcagtaaaaccaagcgcctgtgtgtttttaagccggattcagatatggacccaaattccagtggagaaggagtcaattctgtctcatcctccattaagagaggcctgtccgtggattctgcccaggaagtgaaacgctttaggacggccaccggagccatcagtgcagtaagatcatgtgcctctgtatgggtgctgcgcattctgctgggagttggttcgtttattccctatatttagaatgtgagctcggtgctcagctgcattcaggagaggaagctgggaacagccacggtcaccagattgaaactccaggacatgtcactcatgcaaggggttcccaggtcaccagacatgcttgcctcatgcgttcagttcataccattaaagttctgttgatgatggttgattacttgcagaaaggcatctagagaaactctttgaagtaaggagttgattaagaacatgtgcccatactgagatcagtttctgagaaggacatgtgttctgtttcacgaggcagccaccaagagggtcctgggtattgccccttgtggagtggtggccctaggagccctgagtctgaccccagctggtgtcatggacctgctggcttgtggacgcaggcctggccaccctacttctggcttcgtaggcctgaggctgagctcttctcccaccctcaccatcccccatcttatgtggca

SEQ ID NO: 42454 - DNA, 1151 bp, Homo sapiens
aagacctggtctcttaaaaaaaaaaaaaaaaaagaaaaagaaaagaaaagaaagaatggctttgggacttgagctttcatgctggccccaactacacgtaggagtgtttaaccttaatacagttctcttgcattttgtggactcgtttctaaaacttacctaccagttggcttgggataagcatttttaattgactgttgcaacaacctttaagatgagctttggatttttaaaacagatttaatgatggagctataatttgttatcaagtaccatgtagcacttaggtaacaaggagctagtcccaaaatgctaattatcttattttggtggctgtttttttgcttataaaaaccatgatcctgtgcttttctggtggcagcaaaagctattttcttgccttatccacatttggtttttctagttcttgacaggatttggaaacttttgctattgagattataaaacctattgcaagcacttgttattctggactgcaaaggccatgttgcttctatttgacctctgctatgaaccacgaactctgtcttctattttattctgtttctttggtttgtttttattaatttttagtgcttccatcatctgttagttgattccatgatacatagtttgaaagatgcttgtctttggaaggatatttgttttttgtttttgtttcgtttttttgagacagtctcactctgtcgcccaggctggattgcagtggcacagtcttggctcactgcaacctccacctcccgggttcaagcgattctcatgcctcaacctcccaagtagctgagactacaggcgtatgccaccatgcctggctttttgtgtgtgtgtgtgtgtgtgtgtgtgtgtgtatttttagtagagacggggtttcaccatgttgaccaggccagcctcaaattcctggcctcaagtgatccatccacttcagcctcccaaagtgctgggattacaggcgtaaccactgcgcctggcctggaaggatatttgtatttttgtatcttaagaaaatgggaagagaaaagcaaaattcattgcaggaacttttttagaattttaccaatttcaaaatattaatattgtttattatcgaatattaatattttagtaagtatttttaaaaaagagtttga

SEQ ID NO: 42455 - DNA, 1047 bp, Homo sapiens
cggctgggctagaccagacgtggctgaaatctcggcagatctcacagaaaatcttgcccacagatgtccccatggtcttctcttgatctgaggcttcatagcctgagtctcagggcccatctgtgtcaccctttgtaagaggattgctcaggccggagctgcagacgtcagccatactgttcccagatgcgtgtcacagaggagaccctcgaactcagtgcccagcacaggtgggcacaccatcacccctgagcctggtgtgccgcccacttgctgcatgtccttgggccgctctggcagacctgtgcccgcctcttagcagggtgtggttctcagggtacttgggtgtgatttaattcttcccttctccttgggttcttttgtgtcccattttcctcgttcaccttttacatttgatctcatttcatcatttcagcatctttttactgagagcctgctctgtgtcaggtgatgttctggacactggaaacacagtggtagctggtcctcagtagggtgtatgttctagtgaggggaaataatgaacagaaagaagtgctaatccctcaggaggcgagatgggtgccggggtaaagcagccagggctggtggggttggagagggtggtgtcgtgttatttcatcttctgtgtatttatgggagttgagatttttcatggagcaagatggggttacaaatcattgtgtttgttgtttccaccctgatgttctccttcctggagctcctctaccctgtgaagtggtcaggtgccaccagctcttcttagactcttggattctaaatgtggagagggcggtcctcaccccaggcacacaggctctttctctttcacctcatttcccaggtctggccattgttccctgtgggaattctgtggaggcagcaacccctcgctgggctcttttgacactgtggggccaccacggggtcctcacccctgcacctctttgggacagtgtgtacatcagaacaagccatggacttggggagcaggagcggactgtaatcctgagacacaaaaccctg

SEQ ID NO: 42456 - DNA, 1074 bp, Homo sapiens
cgcgtcctcaggaaaggaaggccacagttaaaacgttgagaaaaacatgtcggtgtttctgcgggattgaagacatcctcacagtgattctggttttgaattttgcctgagggattgttttcagtgcccactgtgccaccctcagttacagagtccatcgctctgttttcagcaagcttttggcgggagctggagggacagggttaggaaatgttttccgaaatctgaatgtaatgagttaaatttgaaatataaacagaaagcacagattgttctaggcaatttcaaaaattactgtcaaccaagatacagagtattgaactaagtgttatgtttaggagattaaaaaacattttaaaacaatagattctgcctcaaaggagcattgaacctgagacagcgggcatagccatagaaacaaatttacatttggagggagactgtgattcagagccatgctcatcagacagaaaatcaggataatgaggatcgagggaaggaagatatcgtgtgcgccatagaagccaaggacagaatttggataggctgaggattgtggccagggccttccaggtgagaaggtggtatcagaagtttggtgccaacagcgcatctggaatttaagggtagtctacctcccaggctcataggacggtgactcaaaaatgtgtttacattttatgggtccaaagaggtcatgagaaccacgtttgcaggtgcttagtgtggctgtggggtttagcaggcacgttgggaaaaggcacgcctgcagcagggatgccaggctgtcccgaccttaggcattgctggacaaagagccgggcagggagggtggcaaagggcatggacagcaggaggaggagttttgaggactgcccattagctaggtttggtgtctgtaccatcgttctcccagtctcctgtctctcaggagccacaagctgaggttttaaaattggagacaccataaggaaagtagtgtttggggtgaacagtaaatgaaatgtgggatctcaggtgtctgtggtgtaaatgagagtgcttcctttggtaattgcatcataagatctttgc

SEQ ID NO: 42457 - DNA, 1050 bp, Homo sapiens
tccattgatctgctatgtagagtctcatatttccatatgaattttaggttattttcatgtatttctgccaaaacagttggaattacgacagagattgcattgaatctgtagatcagtttgtgagcattttgccatctgaagcaagttttccagtttgtgaacacgagatgtctttccactagtttaggtcttctttagtttaattcaacaatgttttttagtttttagtgtacaagtcttgcacttatgttaaatttattcctcaatattgtcacgtgaatggagccattttcttcattttcacattgctcattgctaacatttggaaataccagggttttgtatattgatcttagatttctcaaccttgctgagtgtatttgctctaatagctttttggggattcttcttttctgtgtataagatcgtgtcaactgcaggtagagatggactgacatcttctcttccaataaggatgccttttatttctttttcttcccaattgccctgactagaacctcaagtacagtgctgaattaaagagatgagatccttgtctttttcttgatcttggggaaagccattcagtctttcagccttgagtatgatgttagctgtgggtgttctgtagatgccttttataagcttgaggaacttcccttctgttctaaatttgctgggtatttttatcatgagatgttgttggacttttttcaaatggctttttctgtgtcctctgagatgattgtgttttttttccttcattgttttaatgtggtatatcacattgattggttttatttatattgacttttttgttttctgtgttgaaccacccttattgctgggataaatcccacttggtcatgatggataatccttttaatccgctgctggagttgggttgctcatttttgtcgaggatgtttgcgtctgtatcataaagcacctgggtctgaagttcccttgctatgtctggtacattgctggtgtaatagtgaagcggtataactgctgtggaaacagtttgacggttccacaaaaagtaag

SEQ ID NO: 42458 - DNA, 2003 bp, Homo sapiens
acagcgtgagtgaccgactaggcagtttgttccagcttagcagctgccagggcctataggcagagggagatgcccacagcacagaggaatccagcttcagagccgcttcctcctcttgtttattttgttatttattctactccttcattcttctctttttttttttttttttttttttttagatagagtttcgctgttgttgcccaggctggagtgcaatggcgcgatctcggctcaccgcatcctccgcctcctgggttcaagcgattcttctgcctcagcctcctgagtagctgggattataggtgcctgtgaccacacctggctaatttttgtatttttaggagagatggggtttcaccatgttggccaggctggtcttgaactcctgacctcgtgatccacccacctcggcctcccaaagcgctgggattacaggcgtgagccaccacgcccagcccaggcttttttgttttgttttgttttttaactaaataaaaaagctcctccagactgttgtaagcctttaatttctagagttctgacaaagttgattttgatggttttgccagcattctcactgcttaaggagcagattttggaactcctttgcagtctcagaagtgcttcttcccatttgacggatgaggaaacaaacaaactgcatgtgtcgccggtggcctcccttgttcttgccggcagaagggcctgctttctcacagccattcccacagagcacgtgggtaggactaagctgggaaaagaccccgtagatggcctgtaccagatggtcgaacgggaagtccattaactgagtgaactcttactgagttggtgatgtctgcagtagtctatgagtctctagtacagagttcagtctctcgtgtggtgtgtgtggttagaccagctccttcagtttgtgaaacatctgtcattagtataaagtcttggttggaagtggtgctgctgttgtccagctgttgtgttctgttaattggcctgatatattccatagtcagcaagggtggaaatgttcagatatttacctgcattcttgtcaggtatcgcatattaggtaactgcagctttgacgcagaccagccgcattggtgctttagagcagacagtggcgaaccctggagggaaacagccatcttgtgcctcctcgccttcagtctcctaacaatgcgtgcgttaaatctgtcaccagaatttacagaatttgctcttggtgctaagttaaagaggaattgcaatttgagaatttttcttttccaaaaaaaatcagtgagtgagatgggagtgtcacggagcgctgtgtttcaggtcctccgcgacatcctcaaggaggttcagagtaacatggtgccgcgcagcatgctcaaggagtgggcgctgcacaccttccccaatgccacggactactggacgttccggaagatgttcaccatccagctggctctgataggcttcgcggaattcgtcctgcatttaaatagactcaaccccgagatgttacagatcgctcaggtaacctgctttgaacagccagatcctctcctcgtgacatcgcctttctgctgaagttcctaaagtgtctccttctgaaatttaggacactggcaaactgaatgttgcctactttcgatttgacataaacgacgcgactggagacctggatgccaaccgtcctgtcccatttcgactcacgcccaacatttctgagtttctgaccaccatcggggtctccggcccgttgacagcgtccatgattgcggtcgcccggtgcttcgcccagccaaactttaaggtgggtctccacgtcgtcctatcacaggcgcaggctagagccactcagatgcccgcgcgtcacggccttgcaggagctgctgatgtgcctcacgggctctgcgctctccacagtggccagcacccctgtgtgttatgtcctttgctgtgagggcaagggatggttttctctttggttcactcttgtctgtagt

SEQ ID NO: 42459 - DNA, 1054 bp, Homo sapiens
agccagacaaaaacactacaagaaaactatagaccaatatctgttatgaatatagatgtaaaaatcctcaacaaaatattagcaaattgaatccaacagcatttttttttttttggagacggagtcttgatctgtcacccaggctggagtacagtgccgcagtcttggctcactgcaacctccacctcccaggtttaagcgattctcctgccttagcctcctgagtagctgggactacagtcgtgtgccaccataccaggctaatttttgtatttttagtacagataaggtttcactgtgttggccaggctggtctcgaactcctgacctcgtgatccacccacctcggcctcccaaagtgctggggttacaggcatgagccacaacgcccggccccaagaccatattaaaagaattattcaccacaaccaagtggaatttatcccaggaagggaaaggtggcccaacataagaaaaatcaatcaatgtaacacatcacattaatagaacacagggaaaaaaacatgtacatctcaactgatacagaagggcattttacttataaacattccctctgagatcaggaacaagaaaaaaattcccacttttaccacagctattcaacattgtactggaaagtataagccagagctaatagataaaaaataaaaggcatccaagttggaaggaaaaggtaaagctatctcctacagatagaaaattgcaaagaattcacaagaaagccactagagccaggaaacgaatttttgcagttttagggtacaagattgacacacaaatgcagttatgtttctatatactagcaatgaatgtccacaaaagagcttaagaaagcaattatgtttataatagcatctaaaagaataaagctaaccatgcaggtgcaagacttgccagttgtctgccgaaaacaaaatattgtataaagaagttaaagaaaacttaagtaaattgaaaagacatcccatgttcatagattggaagacttaactttgttaagatgtcagtaatgccaggtgcagtggctcatgcc

SEQ ID NO: 42460 - DNA, 1035 bp, Homo sapiens
tccaccaccactccctcgatccagaacgaaaggaagagagggaaagagagggagggagggaagaaatgctaagggggagaaaaagaccacaggaaaatatgtatgagtaagccaaatcaaataacaatcctaggccgggcatggttgctcacgcctgtaatctcaacactttgggaggctgaggcaggcagatcacctgaggtcaggagttcgagaccagcctggccaacatggcaaaaccccatctctactaaaaatacaaaaactagctgggcctggtggcaggggtctgtgatcccagctactcgggaggctgaggcaggagaatcgcttgaacctgggaggcagaggttgcagtgagcagagatcatgccactgcactccagcctgggggacacagcgagactctctctcaaaaaaaagaaaagaaccattctagaaccagagccgttctggtcttaactcaggaaccacacgtctctactttcaggtttgaattatgttcacctcaaaaaatgaatcaaaactctgcttccatgttggtaaaaggttcttccacatttgaatgcacaagcggagcctgtcccgacttcgcctcagtggcctgtgcaggacgctggtgaaggccgtggtgccacaggaggagtcccctgctggccggctgcccacccttgagctgggcgtgcaaacactgcactgacttcttcatctctaaaaccagcacgctaagggtggcagcatttgtggcttaaaaagctagttctggaaagattccagttttgaccgggaggaggctggacttcggaacctactccttagaatgacaccattaacacatacgatcatcacaccagagttccctcaaatgatcacaaagtgtgagtgtatgaacagctcagtttcacccttcatctccttcaacacagcacacccagtgatcacgatctctgaaaatacaggattggaatcatccatcttaattcagttttcactttacctctccatgttttgcttaccactgtctttgattaagtc

SEQ ID NO: 42461 - DNA, 1034 bp, Homo sapiens
tttttggaatagtccaggccagttcttctatagaatggcacacaccctggctttaactgtttatttcctccttgtgttgcttgactagttcctttatcctttatttcttgtaaactgaaaattagatctgaatcttgattggatttagagtaaatatgtttggcatagagacttcattggtaggttgaccatattcccaggtttctccaggatagccctgtgacctgttgtgttggcataattattatttatttttgctctcagaagtgttctggtttggatggtacgttaagtcactatttataagtgacgatgtgtacttcatgtggactgccatcaggaggcccatccagttagattgatccactatttataacatggtgattacgtggtgattgccagatttcttcaacgtaaaggcatctttttctctttgtagttaataagcaatctgtgggatgataatttgagactaggaatatcctgtacccatggtttaagagtccattgacgaccctgaacagaataaattccacattagttgttacaatgctagatttattcagatggttaagttttgacaatgagatagatttttttttttttttttgagacagaatctcactgtgtcgcccaggctggagtgcagtagcgcgatgtcggctcactgcaagctccacctcccaggttcgccattctcctgtctcggcctcccaagtagctgggactacaggcgcccgctaccatgcccggctaattttttgtatttttagtagagacggggtttcaccgtgttagccaggatggtctggatctcctgacctcgtgacctgcctgccttggcctcccaaagaaagttctgggattagaggtgtgaccaccatgcccggcctttttttttttgagacagagtctcgctctgtcgcccaggctggagtgcagtggcatgatcttgattcactgcaacctctgcctcctggatgcaagcaattctcctgcctcagcctcccgagtagctggaactagaggcgtgt

SEQ ID NO: 42462 - DNA, 1047 bp, Homo sapiens
gggctaattttttttatttttagtagagatggggtttcaccatgttagccaggatggtctcaatctcctgacctcgtgatccgcccaccttggcctcctaaagtgctgggattacaggtgtgagccaccgtgcccggccgctcacttttaagagtaagagggggtggggcacgatggctcacgcctgtagtcccagcactttgggaggccaaggcgggtggttcacttgaggtcaggagttcaagaccagcctggccaacatggtgaaaccccgtctctactaaaaacacaaaaattagccaggcatggtggcagacgcctgtaatcccagctacttgggaggctgaggcaggagaattacttgaacccgggaagcagaggttgtggtgacctgagattgtgccactgcactctagccagggcaacagagcaagactcggtctcaaaaaaaaaaaaaaaaaagagtaagagaggcctgtcgtggtgaacactctgccaaggaggtgggcggtgggcagtgcatcctccagggactgactgagtcttgtttcagggccatgactgctgcccaatgctctttaactacgatgaccgcggctgcctgaccttcgtctccaagttagatattccaaaacagagcatccaacgcaacatgtctgccatggaacgcttccgcaacatggacaagagagccacaactgaggaccgcaacacggccttggagacgctgcaccagaatagcatcacgtaggtgccgtctgtagagaggtggtcaggtgacaaggtgccttcctgcccctcgctgtttccttactgggttcctacaaaagctctatgcccctcaggcccagacattctttcagggacaagtgcagcaagaagtctgtatcttcccgaccgccaggctctcatttccagctcgtggtagggagggagtcgccaccacctggtcattctgtccttcaaggtgcagattacaaggcagcagccagcaggagcagtgcagaccttgttgcaatctgaggtggtggggcctcagggcagctg

SEQ ID NO: 42463 - DNA, 1002 bp, Homo sapiens
agcaggacagggaacaccgtgagctgatttagaccactcagggccacttggggtcattccctgggcatctacaaagcggcagaagagtaggatggaagccagggaagcagcaacagggtcacctcagttaccctacacttgtccctgtgggaagagggctgccggtacagaccccttgaagctttgtatctgcttgaactaaaaccaccgcctgtgtttgctgaggttgccgacatctgtctgagaaaatacgcaggagcagcaaggttgggggggctcagaaaagttcgagcacttcctgtgtgcacactgtatgacccgattcacacacctggacacatttaatcctcccaactaccctagggggtcgaattcagtggaaaagagagcggcggctaagggcacctccaatggggagggtgtcggggcaaagcgacctgagacccccagccacatactgcaggacaaaccaatgtcggcaggtgaggacagggtgggaatagtgttccaggcagaaggaacagcgagtgtcaaagcctctaagcctgacagggtgggagtctggcctcggatctccagagatccaggaagaccctgcacaaatactagagagaggggtctgaaggagagaagaggagggaaggtttttgttgttgtttgagaggaagtctcgctctgttgccaggctggcgtgcaggggccccatcttggctcactgcagcctctgcccccggggttcaagcaattctcgtgcctcagcctcccgagtagctgggattacagcagcgctccatcacgccatggggctccttgcagctaattttttttttttttgaaacagagtctcactctgtcgcccaggctggagtgtaatggcgcgatctcggctcactgcaacctctgcctcctagattcaagcgattcttctacctcagcctcccgagtagctgggattacaggcatgcgccaccacgcctggctaatttttgtattgtttagtag

SEQ ID NO: 42464 - DNA, 1032 bp, Homo sapiens
ggtgctgccccccaaggggacagcccccatcagtagggagatgggaataattgctgggctcccatgggacaaagtgtcaggaatgaaccccctaagtagagtcagtggtgagggtcattagcttccttttgaggatcttcccaagcttgagattctgaactggagtggatgcccttcaggatgagatcggagggcctatttgcactgggttcctggaagagccaagtgctggaggaggggagggccctgcctggcaggaggctgggagagagactcggcctcccagaggccttcaaggtacacagaactggggagtaatgagaaaccaggcatgggagctagctagaggggagggagagggactcccgagtgggaagagcagatgcctcactacagagctgaggagataatacctggcgaaccgcagatcctagctcaggagggatgtgccacactcagaagcctctaagctgagcctcaggaatgatgactaaggcagcccaaagactctgcagggcccttcagtgaaagcaaaatgccaggcagggtgtctctgcaaccccaaaggacagaaggagggagcaacaggatcccttttactggagaggacactgatgcccagaaaggcacagccttatcgaaggctgcacagctgccaatggcagaataccacagtggcagaacacccaggttgctgggtttttgaagtcaatgccaagaggaagctactgaagggggacagaagggtccttagcagctgcaatcacacccaagctcatggccttccccacgaggctttcacagacacacccctcagccattatcctaaattcccagtcaggagagaaactagcaggcttcaacctcttgtaaggcccttgaggtcacctggtggctgccaaaagtcagggcaccagtcaaggactgatcctgtgccaggcacttcagtacatgatcttgatcctcatacgactcttgaggaagatatttacagcttcattttcacacaggacttgcagaggcctgggacag

SEQ ID NO: 42465 - DNA, 1047 bp, Homo sapiens
gacgggagtcttgctttgttgcctaggctggagtgcagtggtgtgatctcagctcactgcatcctccgcctctgggttcaaacgattctcccacctcagcctcccaagtaggtgggattacaggcatgcgccaccatgccctgctaattcttttgtatttttagtagagatggggtttcaccatgttgaccaagctggtctcagactcctgacctcaagtgacctgcccacctcagcctcccaaagtgctgggattacaggtgtgagccaccgattccggccagccctgtttaacttcttgaggagccacctaactcttctgcagtggctccaccattttacattcccaccaggaacgtaggagagttccaatttctccacatccttcccaacacttgttattgtgccataattttgattatagtcatctgtagggtccagccccacagggtcggtgggtttctccccgtgtgtggagacgagagagcgtagaaataaagacacaagacaaagagataaaagacagctgagcctgggaatcccaccaagacgcggagaccggtagtggccccaaatgccaggctgcactgatatttattggatacaagacaaaggggcaggataagcagtgtgaaccatctccaatgataggtaaggccacatgggtcacgtgtccactggaaagcgggcccttgcctgcctggcaccaaggcagagagagagagacagcttatgccattatttctgcttatcagagacttttagtactttcactaatttgctattgttatctaaaaggcagagccaggtgtacaggatggaacatgaaggcggactaggagcgtgaccaccaaagcacagcatcacagggagatagttaggcctctggataactgcgggcgggcctgactgatgtcaggccctccacaagaggtggaggagtagagtcttctctaaactcccccggggaaagggagattccctttcccggtctgctaagtagcgggtgtttttccttgacactaacgctactgctagaccaaggtc

SEQ ID NO: 42466 - DNA, 1017 bp, Homo sapiens
ccctaccccaggagccctggccctcctcctggtggggctccctagaggagggtcctctcagcccgagaacgcagctcagtgtgtcaggctccaactgtttttctgtgacttgctcgccgtgtaggctgctaaacatctggctgaaccaagcgttcatcctgacctgaagccagaacctcagaaaccaaagtaaggcctgatcatgccctcgccccactgccccagagacctcctcttgtctctttgatgttttgttttctattttatttttcgtttttgtgtgtctgcatggtgtttttcgggcagtggcttctgccatcatcaccacatgtttctctgctgcccactgtcctgaggtgggccgtcgtggaagccctgcttcctgccgtttgcgggacgagtcccgccctcttttttcctgtccccatcggtagtctgcgtgcacgtgttttccacagtaaaaccgtgttgtgtaactctttccagcaaagtaacaatccgccattacaaaggtcgtcctccttgatccagttaacgagtcagaactcttctcccaatcagcagagaaccccgcaggtcatcggggtcatgcagagtcaaaacagcagcgcgggcaaccggggaccccggccactggagcaggtcacctgttacaaggtgagtccctgggctgggggacagggtggggtcttcccttaccgtcagtggccattccctcatgccccatgtgtttggtgaaatgagaaaaatgaaaacattcatttttgctgattgtaagcataaagttacagtctagttaccatccactgtggtgggctagagactgtcctatttcctaccacactgcactgaggcacggtaaaggatggtgagaacgcctgcctagtgaatggacggggcctgcaggcaggtgagggaagcccccaagaggccgggaacaaaatagaaacactgatccagggaagggtgagcccttggagccgctggctgtcctgggggcatccttggatcctgcag

SEQ ID NO: 42467 - DNA, 1020 bp, Homo sapiens
cccgggaggcggagcttgcagtgagccgagatcgcgccactgcactccagcctgggcgacagagcgagactccacctcaaaaaaaaaaaaaagaaagtttacgaatttgtgttgggttggattcaaagtcgtcctgggccatatgcggtccacaggctgaggtttggacaagtttggtgtagagaatgaaagggatgaggcctttgctccagccttggagccattgatcaggatagtttttagagtgtacctctttgcttaaaaggcagagggtccaccctgggcaacatagcaaggccccacctacaaaagaactacaaacaactgggcgtggtggtgcactcttgcagtcccatctgcttaggagactgaggcaggagcattgcttaagcccaggagttggaagctacagtgagccatgattacaccactgcactccagcctgggtgatagagggagactcctcaaaaaaaaaaagaaaggcaaagggtcttctaaactgttttcagggaaggtgaactgtgtttgaggggcatccattaaaatgaaagtgaatttcattaaaattcatcctgagttagaaagcaagtctgtaggctgggcgcagtggctcacgcctgtaatcccagcactttgggaggctgaggtgggtggatcacctgagatcaggagttcaagaccagcctgaccaacatggtgaaaccccatctcaactaaaaatacaaaaaagtagctgggcatggcggcgggtgcctgtaatcccagctacttccggaggctgaggcaggagaatcgcttgaacccaggaggcggaggttgcagtgagcagagatcacaccattgtactccagcctgcacaacaagagtgaaactctgtttaaaaaaaaaaaaaaatcaagtctgtaattgttactgttgctgaatcctgctagcaaatcaccaggctagaggtgagggttgagtgacccctttagaacactttcagagggggcttgtcagcaggtggagctggctgtagga

SEQ ID NO: 42468 - DNA, 1062 bp, Homo sapiens
aggccgagacaggtggatcacctgaggtcaggagttcgagaccagttggccaacatggtgaaacctcgtctctattaaaaatgtaaaaattagctgggcgtggtggccacatgcctgtaattccagctacttgggaggccgaggcaagagaatcacttgaacccgggaggcggaggttgcagtgagcagagatggtgccagtgtactccagcctggatgacaggagtgaaactccgtctcaaaaataaataaataaataaaaataaaaatacaaaaattagccgggtgggggcgacagagcagagactccatctcaaaataaataaataaataaatttataaataaataaatagttggctaagtacagtggctcaagcctataatcccagcactttgggaggccaaggcgggtggatcacctgaggtcaggagttcgagaccagcctggccaacatggtgaaaccccatctctaataaaaatacaaaacttagcaaagcgtgggggcgctgtgcctgtagttccagctacttgggaggctgaggcagaagaattacttgatcctgggaggcagaggttgcagtgcgccaagactgtcactccagcctgggtgacagagcaagactctgtctcaaaaataaaaaaaataaacaattgaatacaaggatttttaatatctgcctaatacttatgccttcatcgcattaatgtgctacgcttgatttaattgttcccttttgatattcagtttatttccagtttgatgctgcaataccactgtgctgaacgtctctggcacattcatcttggttgcaattgtactttaggctatatttctaagagtgaaatgaccacagccaaaggtatgaacattgttcaggctttcaataaagactgccagatatttacaaagattgtgccaatctctattctcaccaccgcttttgattattgtccttatctctgcttgccactgagccccgggccatgtctctgtaactcactaacggccacatcccatttacttccccatgagtaggatttcagtttcccaaacctgaga

SEQ ID NO: 42469 - DNA, 1034 bp, Homo sapiens
agtagagacggggtttcaccgtgttagccagattggtcttgatcttctgacctagtgatccacctgcctcagcctcccaaagtgctgggattacaggcgtgagccaccccgtgcgcccagcccttctcaacctttaagtgtttgcttacgggacacttcctccagaaagccttccctggcctcccagtctaaaataggtctcctgtgttctgtctcatggaattagtttcttctcctttccaacatacagcccagtttgtaattatgtatttatttgtgttttgatgtgtttgatgaacgtcttctccaactagaagtaaaccatgtttattaagtaactgcataatcagtgcgtggctcattgtagatgcacattaaatatttggcaaaggaatgaatgaaagtccaccatgattctactgatttctttcgtggccttctctgtaactgtactgatcggttttggttgtggttgttagattgttgcctgccctgatgtgcttcctcggaagatggcaacacctggagcagtgcaggagtcctgcagcccccatcccctgaccgtggacacccagcctgagcaagcgccacagaagcctcgtctcctggaggaaaatggtgaggctcagtgattcagtggaactgatatagctcaagagtgggtgccttggccatgtggcaggcactatctgcgggagagagactctaggctgagcagcctctctacagcctgcagggtctagaagcagggaaaggccagggacctggagttgagtccctggtgttcaatgaaagccattcctagaatggctaggaattacaccagcttctttttttttcttttatttatttatttatttattattattatactttaagttgtagggtacatgtgcacaatgtgcaggttagttacatatgtatacatgtgccatgcttgtgtgctgcacccactaactcgtcatctagcattaggtatatctcccaatgctatccctcccccctccccccaccccacaacagtccccagagtg

SEQ ID NO: 42470 - DNA, 1106 bp, Homo sapiens
tttgtctctgcaaaccatattaaaacatcagtgttttgagtaaagtatcttgctgatacagttgaacaaaggaactaattatagccactgaaacatccacggttctatcagtgactgctgaacattaacctagctcttgaaagtagtaggttcttctcaggatatagaaagaatgtcttttttcttttagattaattcataccaaactgaaatcctttgggcattgagaaacctagaaagatcacctttcttttctaggctatgaattcacaggaagaggaaggtgaagatggggttagctgcataacctgctatccagttttattaagaatattgcccagtcgtgactgggcgcggtggctcatgtctgtaatcccagcactttgggaggccgaggcgggcagatcactaggtcaggagttcgagaccacctggccaatatggtgacaccctgtctctgctaaaattacaaaaattagctgggcgtggtgatgtgcgcctgtagtcccagtgacttgggaggctgaggcagaagaatcacttgaacccgggaggcagaggttgcagtcagccgagatcgcgccactgcactccagcctgggtggcagagtgagactccgtctcaaaagaaaaaaaaaaaagaatattgcccagtcgcgttggctcacgtctgtaatcccagcactttgggaagctgaggtgggaggatcacttgagctcaggagtttgaaaccagcatgggcaacataatgagaccctcatctctacaaaaatataaaaattagctgagcatggtggtgtgcaactgtagtcctagctacttgggaggctgaggtgggaggatcgcttgagcccaagaggttgaggatgcagtgagccatgattgccccactgcactccagcctgggtgacagagtgagaccctgtctcaaaacacacacatacacgcgcgcgcgcacacacacacacacaagagaacatttaacatgatacaggtatttgtaagtgccacactgagaggagaccctcttcgttcagtggaatgactgattttcagtctccttcctctgaacattttttgccagctcttccttccctaacctccc

SEQ ID NO: 42471 - DNA, 1098 bp, Homo sapiens
tggaataagaacatggtccctagagggaggaatgaaagagggggcagatgtgactcagttcagtcctagtctgagcccctttattaaggatagctcatctttctcaaataagcagagtgatggctgcttactcgctgtggtggtttttccttcaggcaaccttcacttcatcccagttctcacatccagaataatttctaagatatgctgcttttgccacatctcacagtcctttcctggctctcacttcctcttaggttcaggacctttctttcccctgttcccttcacttagtttttctttgctttgtcacctgccatccattctgttgtaactgcagtgttttgtgactagactaaatttggtcaaggaagcaaccatttaattccttggttgaacacaatgcctgtatgaatgtatatatactgtattttgactacgcagtcacactttgctgtatcgtataggtaggttggtctttttcttcctttgttttataagagctgtgtcttagattgcctgtggttaactctagtgcctgaaataacttgtgtgtcacccacacagatcaagtgccacaatgtgtagagtgctgtgggggattgtgggactgtggaaaagatttcgaggaaacagatgaccctttcttgttcttgggggccttacacactggttgagacagcacccattcacaagagaaacgctgatcaagtgtctagaacagtgcctggaaagggtcagaagtctgctaaataaccctagcccaggacaagtccccacaagtctttatgctttgctttgcccatctgcaaaacaggtatagtcttactcttctgtaagaggactgtcatgtgatgaagataaagtgaaatacaagctttcctaagaaaatcctgtatcacaggtcaaaacacgcataaggcatgcaagtactgagacgaagcagagtagacacacccaatacctgaaaaatgttcattggttttactagagtattgaggagggtcctgctgacaccccttgggctggagaggcctcctctgaaagggagccctgggaaagggctgctctcactcttcactcctttctcctccctca

SEQ ID NO: 42472 - DNA, 1035 bp, Homo sapiens
ctggtcttgaactcttggcctcatgtgttccacatccagccttaaaatcaaaaggttttaataacttaattttaaacggaaaaaatgtaaagcaagtgcatattttgaaagcatagagtcggccaggtgctgtggctcacacatgtaatcccagcactttgggaggccaaggcaggcggatcacctgaggttgggagttcgagaccagcctgaccaacatggagaaaccccgtctctactaaaaatacaaaattagccgggcatggtggcgcatgcctgtaatcccagctactctggaggctgaggcaggagaatcacttgaacccaggaggtggagttgaggtgagccgagatcgtgccattgcactccagcctgggtgacagagtgcaactccgtctcaaaaaaaaaaaaaaagcattcacgtcaatgtcaagagaacctgctactaatgctttctttgataggcagtatgataggttggaaagaatataaactgggatcaagcttgggttccacttaccagctgtagtatgttgagcaaattatttaatctgacactcattttcttggtttataaaacatgaaaaataatgtctaccttctgggtacaggattgaattagattatgcatataagtacctggcttgtgtcgggtgcggtggctcacgcctgtaatccagcactttgggagggtgaggtgggcggatcacaaggtcaggagttcgagaccagcctgaccaacatggtgaaaccccgtctctactaaaaatacaaaaattagctgggcatggtggtacatgcctgtgattgcagctacccaggaggctgaggctggagaatcgcttgaacccgggaggtggaggttgcagtgagccaagatcatgccattgcactccagcctgggcgacagagcgagactccataccccccggccaaaaaaaaaaaaaaaaaattaagtacctgccttgtgctagttactttaatattttggaaagaatagcaagcgatatgagccatagaccagattttttaat

SEQ ID NO: 42473 - DNA, 1117 bp, Homo sapiens
tgaggcgggcagatcacttgaggtcaggagttggagaccagcctggccaatgtggcgaaacccagtctctacttaaaatagaaaaattagccaggcatggtgttgcgtgcctataattccagctacctgggaggctgaggcgcaacaatagcttgagcctgggaggcagaggttgcaatgagccgagattgtgccactgcactccggagtgagactctgtctcaagaaaacacaaaaaaacaaaaaacaacaatataccccaaagtgatgttggtattacacagatctcaaaacccagagaagtttgatagctcttcattccctagtacatcgctgatgactcactgtcattagtttgcaactgatctcaagtgctccgagagctctctgggatactaggagagaatatcctgagatttttttagggagctagtcaaacccctgctctgaaacagggttggacagttttgacaatggcaggtcacaggtcaaagctctcaaatttcatatgtcctgtcaagataccgctgctgccatcactagatttgcatttccattacaccgtgaccaaatttactcttaatatttttctgataaccagaacttgctggtgggcatgtatccttgctaagagtcactatcacctctggttatagcagtggagcaaagtggtaatgggaaaattcctaggtttttggcctgagcaaaagggtggatagaagtagatgacaggtggggaacacggggagaggggcacggagagttttagcaaaagagctagcatgtcaaggcctgcatgtgagagtatggcactttccaggtaataagtgaggtatggagaaatgcctcactgtaggatgtagtatgtgggcaactgaggaggttgaagaaccaagttcaaaggaggcccctagggattagagaaccaagcactataggattcccacatctaaaaatgttgccttcattcatccattcattcagtaaacatttagcagtgtaggactggcattgtttcaggagggatgccctggatttggagatcttaacatgtaactagagaaaacattggcatcctgggctgtggtgggaactagcacccgaaaggtaactctgc

SEQ ID NO: 42474 - DNA, 1034 bp, Homo sapiens
tgggtgccaggtgtgcgggaagcggttcagcaaaggggagcggctggtccgacaccagagaatccatacaggggagaagccctaccactgtcctgcctgcgggcgaagcttcaaccagaggtccatcctcaaccggcaccagaagacccagcaccgccaggagccgctggtgcagtgagcatagcaggtggcaggcagcaccatcattcatctttctcactgcagggccttgcggggtgcaaggtgatggctgcaggaaagcactggtcccatcgccttcccacccattcgccaacgcgggaaaggcaaggcctggcttacttagagcttccagagagcatagctgcttccatctcttacccaagtggtgctaaacaatttttcttccaatgtttgagggaagcagtctcctgcggttcagttcaggctgagattttctccttcagtggactgtctgtgtccccctgccgaacaaagctgggagtaaaggcaaaaccttgacacgtgttggtagctgggacctcatcttcctgagggctctgtcttgcctgcagggtcatagctcagactcttcccccaccccctctcttttccattgaacaaacatttattgaacatcctctgagcacctggccgtgggaatgccgtggtgaatgagagactagacgtgatgcctctgggggttgtgcgttggggatgcatgcgacagcccatgacccgaggcattctcagggtatctgtgctgtgtgcccgtgagaacatcttcccatgaccactcctgccctcctgccccgtgctggatcttccctccccagctgggatctgctcccaggcaactgtgtgaattttacattatttggagcctcatctgtgtcaggctataacattctatcctcatctgtaaaacttccccgtccattattccttgcactataacaactgtcaacacaccaactattaggaagttagtattttgctattgatcactgaataaacatcagagtattttaaaaaacagttctctagaaagaact

SEQ ID NO: 42475 - DNA, 1033 bp, Homo sapiens
ctcgctctgttgcccaggctggagtgcagtggcacagtctcagctcaccgcaacctccctgtcccgggttcaagcgattctcctgcctcagcctcccaagtagctgggattacaggcatgtgccaccatgcccagctaatcattctgcattttctgtttgcatacccatggcgtgatttaacatatttccctgccttctgtattatctaaaaatgtagaagtgtttagtggtgtaatcagattcatatttcacattttggcaagaacacattatagattgtgacatgccctgtttctcttcatatgattttagaagcctagatctgcttctttcgttagttctgtaaatgcttcatcatttagtagttggaatattgtaagaaatttcccttcattaacttaggttacccttagatatagttcatacagggaaggcaagaaaatgcttgatcctcctctttatttgcctgttttcagaataatgagctagttactttttgcttcctgtaaaggcagtcaagtctgtagaaatcaatgcattcatagctttttgcttttattggtttttttgagacagagtcttgctctgtcacccaggctggaatgcagtggtgcaattgtagttcactgcagcctcaaactgccaggctaaggtgctaccccttccttggccttgcaaagtattgagattacaggtgtgggccactgcacctggcctgcactcatggatttaaacatacttggtattgatcagtctgctggagttataatttgatgctcaaattatttcacctttgaccagtggaggcccctggaccttggctcctgaatccttttgacataaccctaattctcattgacagcttctttgctttctggcatgacaagatgttccaggcaaatgttccgtatttcctgccccttttgagagtgaaagtgggtgctatttattatgctgggacagtggtgtaaaccgggactctccaggtcaaacgggtatttggtcaactcatagatgggcctccttttgtat

SEQ ID NO: 42476 - DNA, 1036 bp, Homo sapiens
cggatcacgaggtcaggagatcgagaccatcctggataacatggtgaaaccccgtgtctgctaaaaatacaaaaaattagccgggcgtggtggcgggcccctgtagtcccaactacttgggaggctgaggcaggagaatggcgtgaacccgggaggcagagcttgcagtgagtggagatcgcgccactgcactccagcctgggcaacagagcgagactccatctcaaaaaaaaaaaaaaaaaaaaaaaagatttaacatgagggtttcaagtttcctccggtttaggcatttatacctttgtgcttgttttgtttcaggatgttactatagcattgatgttggataacccatatttatataccttaaaatgcaatcatttaaaacactaaggattacatttatggtggaactttgggaattttagaaagcaaccagtgttcttagatgtgtttattagccttatttctagaactatttctactaaagtgaaactgagaacttcgtactttagttgcatcttgaaatcaaaaatccctctgcaccaacaggagcctacatgagaataaccttttgcatctgctttaagtaaaatgtttgtcaagagttttactttaaatagttcattttttttatagtcttacacttctcatacgtctttggtaaaagctccattatacaatatggccaaagcgtgaaggaccaatactgtccaactataccaagatgtcccgcttaattttagttttcagacacactcataaacaaaacccactccaccttttcctgtatactgcctttgcagtctacatttcttaaattccctatttaattccttgaggatcactaaaattattccttaaggctatataggagccagatgctgctttacaattctgcatcaagcattaacatttggttcaaaatattatcatagtggttgcaatccagttactggtcctagccagctaaccaagtaatcttgttaggatctagatatcatcagcgagcacactgcttacacatgaagaaaaatta

SEQ ID NO: 42477 - DNA, 1031 bp, Homo sapiens
aggcatgagccgctgcgctcagcctctcagttctttatacagtgagatgataagtgtagctacctgctaagattgttatgtggtcaagtgaaaatgcttaaatacccggtacctagaaagcactcagtaaacattggctcttactgttatagttatgagagggttcttgaacagtgataagaggcaagtcgcgttttagctagctttaaaggttaagtaggatttgaaaaggcagagaggactgcggggggaagtcccaggcatggagtgtgatgtgaggaaaggatggcagtcaaaatacaaggcatatataggaaatactgatgagagggcttttgttgcatagggaaggtttatggggggattgatgggaaaagaagcttgagggaaaattgggaccaggcactggaaagtattaactgcaaggctgtagagttttagaaagaataatctgaaaggtggattgtgggagagaagggagaaaatgaaggcagggaaccaaagaaaggaagctggacttcatggaactagattaaaaaaaataagtatggcctgtaatcccagctactcaggaggctgaggcaggagaattacttgaacccgagaggcggatgttgcagtgagctgagatcatgccattgcactccagcctgggcgatagagcaagactccgtttcaatatatatgtatatataatttttgtgctgttatatgtacatgatccctttttcaccaaaattaagaatatgtttagtgagagccataaaactaaaaatgcttttgctagtttaaaactcggtttaacccatcatgataaagcagtttaatggtctgtttctaaaacttcaatttgatgcttagttttgatggctgtagaggtgaaaagaataaattcagaaagatttgtagcttcagatggaagaatcacagtgtcagttctgcttagtaacttgtgattgatccaacctatcaaccatgctgaatttttgttgttgaaatgcagggtatagtcttacaaactaatcaggtgg

SEQ ID NO: 42478 - DNA, 1032 bp, Homo sapiens
ttctgtcctcatccctgagatcagttctactgaaatggcaacaacaactccaaatacatctctcccttcttgaaatccctaaagcactatcgcactcctaaatgcatttctccacaagttagcacttgattgtatactgtcttttaatccttcattgtttcatgtatgaagtttttaatcaccccctaacccccaaaaaagattcggttgtcaagggatatatttctatccctgccagcacagtgctggacatagtgagtactgaacacctaagaggcactcattcagactgacttctacaggacttctacgtgtgtgataaaagcctgtgaatcgtgagtccctgaaatatggtagcctggcccagcttctaaagaggaccttcgtagccacaaggcatgctaaacctctagggtctgatgctgtttttgttccaaatataaacgaaaggcactagtcagccgcctgcatagactttctaaacagtgagtaaataccatggaatgtcagaaatgactttatcatcgtcatcttgaagaaaaatatgaacactgatgaaggtcattttttttttttgacatctttctgtggcaaagctcttagaattctttgcagttagctgctgaacagtatgatgatttggggattttctgaatcatttgtacttagatactggagttcagaagatgtgatttttgttgcttttcagaaaaaggaacgtggtagggagtgttttttcccacgcttttccagtaactttgcaaaagcattaattgttcactggcaattactaaatgtattttgttgctctgagaaactcagcagtgtactgagatgtggctggctgtgccatcgtcatagtgcacagtgacttttctgtttcttatcactaaagactgaggtgaggttatgaaactttcattggtcccatcgttgtgcgcagggtgcaactggctacctagaagctgatggcaggagactgtttcacacacaggagattgtgagctgtgtaagtagtcatcgccactcaag

SEQ ID NO: 42479 - DNA, 1051 bp, Homo sapiens
atagtttggtgcttatcacatcaagagattggtaaatttctgaggaaagacaggctaatggggcactgaaatggaacaactcctttaaacgtgcagccttttgaatttttcctcaaaaccaagaagttgacctctgagctgtcaggtgaccactgtgtgcaaaggggatggattctcttgtcagtagacggtcttctccatgaagcgagagtaggaagtgtactggaatggccaagtgggactgcttcagctgaccaggttcttttaaaccgtagtcatgctttcccactaactcttaaatccttatgcttagaaaattgaggataaggctgggcacagtggctcaggcctgtaatcccagcactttgggagaccaaggcgggtggatcacaaggtcaggagatcgagaccatcctggctaacatggcgaaaccccgtctctactaaaaatacaaaaaaatagctgggcgtggtggcgggcgcctgtagtcccagctactcaggaggctgaggcaggaggatcacttgaacatgggaggcggaggttgcagtgagccaagatggcgccactgcactccagcctgggtgatggcgtgagactccatgtcaaaaaaaaaaaaaaggttggggggaggataggactggccaggcacggtggctcactcctgtaatctcagcactttgggaggcagaggtgggcggatcacttgaggtcaggagtttgagaccagcctggccaacgtggtgaaagcctgtctctactaaaaatacaaaaattagccgggcgtggtggtgggcgcctgtagtcccagctactcaggaggctgaggcaggagaatcacctaaatctgggaggcagaggttgcagtgagccgagattgcaccactgcactccagcctgggtaacagagactctgtctcaaaaaaagaaaaaaaaaaaagaaagaaagaaagaaaattggggataggagaacagcaaggtgggcatttcccggaattgtgtgcagatgcatccagtcgtggcattgcaagaagtctgtctgatgaagct

SEQ ID NO: 42480 - DNA, 1115 bp, Homo sapiens
ctttaccctcaccttttccatgtcattctctttcccagtgattggggctctgattggcaagcaggagggccgaaatatcgaggtgatgaactcctttgagctgctgtcccacaccgtggaagagaagattatcattgacaaggaatattattacaccaaggaggagcagtgtgagagtggaatagatgtggggaagaggagtgggagttaaaaaaaaaatgtacagggtggggaagatggagagggttggaaagaaacaggagaggagaccaagaacaggggagaaaaagtgaagagtagctggagagatctcagaaaaagaaaacgttcagagttctttctcaaaagaaagcaaaggatgagaggagacaggatagaagggagtagttattctaaactgagccaggatttgaggagggaggagagaagctggtgaaaatacaccaggagcttcacattgaggaaggatggtttaaagaattactatgtcaggccgggctcagtgactcatgcctctaatcccagcactttgggaggccgaggtgggtggatcatgaggtcaggagttcaagaccagcctggcaaacatagtgaaaccccacctctactaaaaatacaaaaattagtctggcatggtggtgcgtgcctgtagtcccagctacgcgggatgctgaggcaggagaattgcttgaacctgggaggcggaggttgtggtgagctgagatcatgccactgcactccagcctgggcaacagagcgagattccgtctcagaaaaaaaaaaaaaaagaattactatatgttctggccccttcccctctagttaaacaggtgttcaaggagctggagtttctgggttggtataccacaggggggccacctgacccctcggacatccacgtccataagcaggtatgcatgctcacacctgtgcatgctggggcagagaatggagaatgaggggaaggagaaaggtagggggcactgacttcctgtgcattgtccctctcttccaggtgtgtgagatcatcgagagccccctctttctgaagttgaaccctatgaccaagcacacagatgtgagtaatactccatgcctactctgtcatgattgtc

SEQ ID NO: 42481 - DNA, 1068 bp, Homo sapiens
actcaccggtagtgggtgtagatgctctgagtgaagggcagctttggggtagaccactgaaccacagcaatcaggggaacttccaggccctgcaggagggacaaagggggttggcacaggtattaagagtgcccctcccatcttgagtcagctgcctggtctttccctcccactgccttatcacttttctttgaacacaccagccccttatgctcacctccttggcccctggagggggctgctcaccccctctcagctgaaacaggaagttgtgttcctccagggcattcagcgggcaggggaagcagccagaggtcccgggtaggcggcagaaggagcccatggagacttccccagactggtgactagctcagaaaagaggacaaggcatggtctccccatgccagagctcagcccctgaagccatccccaccacttcacagcctcgcccctcccaggacctcaccagacattgtccaccagcagcacagagccatcgggcatgacaggtagataactggcgttgaagttggggaggattcggatatcccagatggagatttcctcctgagaggagctgttcagcactgtgggagaggaccagcttggctcagaatagctggacccctcaggccccacctttacccagaaaaaaccggacctaccccaccagcctgcccagaggaactgcatccaatcagttcccttgttgctcccggaggctggagccggcagccctgcttacccttgagcacggtcaagtgttttccagccacagtgaactgccggcatctcagaaccggagggggcagcagagtcagcagcgtgctcactgcgggagggggtgggggcaagaagtgatggtctggaggctgacctcacctccaacccagaattctcaccttcctcttctcagagcccattagccactttccagtgtgacccctcccctctgtcccccaattcccagactctagccctttgcctctgcgctgccctgcccaccttgggccttgaaagcgctctgctcgccccggaatgtctccccaggagatcgggtctgcagca

SEQ ID NO: 42482 - DNA, 1049 bp, Homo sapiens
cagtgtcccagtcttagagatctgtcctggcttcttggggtggcggggggttgggggagcttcctgagggacacctgtggcttcctagacagaattgggggatcccagcgggatggtccctgctgcaatcccaccatgtcctaggacagcagcaagggttcctggggcttcagcctgagaaaagtccctgtgatttgacctggcgtccctctgccgggctccctgctgtggcctgggctagagtcctgatgccctccttccacagctggcatcaggcagggctggaaagtaggaggacttgcctgaaatctggctggatttcagagccttgctctgtcacccaggctggagtgcattggcacgatcttggcttacttcaacctccacctcccgggttctagtgattctcctgcgtcagcctcccgagtagctgggactacggatgtgcaccatcgtgtccgctaatttttgtattttttttttttttttcagtagagacgggtttcaccatgtttggctgggctggtctcgaactcctgacctcaggtgatccacccaccttggcctcccaaagtgctgagattacagacttgagccacggtgccccgcctgaataggagcttcttaatcaaaatttcagcatggctctgggtcaaaattgaccagctgatttaataagttgatgtaaaaattttacagtcagctacccctgggagggggagtctctccctagtcagtgaggcaccagatgccagagcattggcaatgtacaaggggctcagccctgtggctcatatgtgtaatcccagcacactgagaggatgccttgagcctgggagattgaggccagcctgggtaacagtgacaccacgtctctgcaaaaaagaaaattaggggagaactgtggtgcgtgcctatagtcccacctacaggcagagcgagaccatgtcccccactaaaaagaggccaagaatgcaggaaatatagataatatgggccctgtgatgggtggaggccaaatagatcaatacagaattgaagaagacaca

SEQ ID NO: 42483 - DNA, 1048 bp, Homo sapiens
aaaaaattagccaggcatggtggccgacacctgtagtccaagctactcaggaagctgaggcaggagaattgcttgaacccaggaggtggaggctgcagtgagccgagatggtgacactgcactccagcctggctgatagagcgagactccatctataaaaagtaaaaaagaaagtcttcagtgaaaggagattcgccctatcagctatgaaagcacagaggggaggaacatggagtaggggctgcctgcagtcagatcctgccctcacaaccttgccagggaaacaggctcgtgggtacaaaggttgtgtgcctcaacttcctcatggaagcacgtgagattattttataaccatagagtggagacagtcagtatgaccaccaaacccaggagccatatattaaaatactgataaatttaactatataaaaaaatttttgccgggtgcggtggctcacacctgtgattctagcagaaaatcagatcaggagatcacagaaggtcaaggaactactgagagagcaggaatggagagcaggggggtcagcaggaagcttggagaatctgcaaaatagtagattacaaaggatcaaaagtcagtgaggttcaacaagaggtagggtgggataatgaccaaagacagagggaacacttccaggttcattctgtgaggtcagcaacaccatgacctaaaagccagataaagaccctgcaagaaaaacaatacacaaaatacagatgaaaaggctggtgaatattgatgggaaaatcttcaacaaaattctagcaaaccaactttcacagcatgttaaaaggactgtacgccatgaccaagttggagatagccctggaatgcatgtatcacccaaaacaggaaaattaatgtagtgcaccccattagcagaatgaaggacaaaacccacatgatcatctcaactgatacagaaaaaacattggacaagattgaacacctttccttttttttttttgagatggagcctcgctctgttgcccagcctggagtgcagtggtgccatcttggctcact

SEQ ID NO: 42484 - DNA, 1050 bp, Homo sapiens
gagaccctttgttatgctttccctggaaaaggcaaggaagggtatgcaggtttaggattggctagttagaataacgttagcaggctctggggattagaggctgtcatttgttatttggtgtctggcccaggatgatgaaggcagagaaatactgccttctgaagggtgagaggcagctagaagagctggttcagtgttggggccctggattagctggtttgcatatgaaaggcacactcagccaggagccgtggctcaagcctgtaatcccagcactttgggaggccgaggtgggcagatcacaaggtcaggagatggagaccatcttggccaacgtggtgaaaccccgtctctattaaaaatacaaaaattagttgggcatggtggcacgcacttgtaatcccagcaacttgggaggctgaggcaggagaatcgcttgaacccaggggtggaggttgcagtgagccgagaccgtgccactgcactccagcctggcagcagagtgagactgtttcagaaaaaaaaagggacactctcagaggggtcatttgctagctctaacaactggctggctctggcaggggcagtccctctctctgctcttggaggtccaagatgccagaatatcagcaatccagtggggcttggtgaggtggctcacacctgtcatcccagcactgagggaggccgaggcaggaggattgcttaagcccaggaacttgagaccagcctagacaacatagtgagaccccatctctcaaaaaaaaaaaaaaattagccgtgtgtggtggtgtgtgcctgtggtcttcactacttgggaggctgaggtcagcaaattgcttcagcccaggagtgatggtgatcgcgtccctacactccagtctgtggacactctagtaccttgaggacagtacagcctgattacagaagctttacagcaagtcttgaagtcaggtattataaatcttccaccttcattcttcatttgtaaaggccttttggctattctaggtcctttgaattactgtgagaatattacagttggcttgt

SEQ ID NO: 42485 - DNA, 1045 bp, Homo sapiens
gaggctgaggcacgaagatgacttgagcccaagagtttgagacttaacatgggcaacatagtgagacccccatctctaaaaaaaaaaaaaaaaattagccagttgtggtagtgcacacctatggtcccagctactcaggaggctgagacaggaggatcgcttgaggccaggaggttggggctgcaatgagctgtgatttcgcaactgcactccagcctgagtggcagagcaagaccctgtcttaaaaaacaaagcaaaacaaaaaatatttttctgttgttgcctgcctgttccttccccaatgttagaataagtttatccagtttaggaaaaacaaaaacaaaaacaaaaaacacaacactcttttaagtcagttgcattaaacctattatgcaattgacagaaactgaaatcaggctaatacacaatcttcccatccaggaacaaggtcctattttatatccctcagtaaatcttggtagtattctgccaaacatcatataaatgtctcataagattgtttaactgtctgtagtgagctgagatcatgcaactgcactccagcctgggtgacagagccagatcctgtctcaggaaaaaaaagaaaaaagatttttttaccctccatatttcctcgttattaatatgcaagattactttatgaatccttaataattgtcattgtaaaagtaatgcataggcagccaggcgtggtggctcacacctgtaaacccagcactttgggaggtcaaggcgggtggatcacgaggtcaggagatcgagaccatcctggctaacatggtgaaaccccgtctctgctcaaagtacaaaaaaattagctggttgtggtggcgagcacctgtagtcccagctactccggaggctgcggcaggagaatggtgtcaacccaggaggcggagcttgcagtgagcagagatcgtgccactgcactccagcctgggcaacagagcgagactctgtctcaaaaaaaaaaaaaaaaaaagtaatgcataggccaggtgcagtggtttctgcctgtaatccc

SEQ ID NO: 42486 - DNA, 1049 bp, Homo sapiens
aagctgggggggcccagcgcggaccgaacccccgtccccgcccacactcgctggtatataagtcggcgtggcgccgcggtgggtgttgagaggcccgcgaactgacgggccagtgagcgggcgtcgggagtgggcggatgcgttggggttcgggtcgtgggtgttgaggcggagaggaaggcgtggtgtggcgtctccaggtgattgcgattgggggaaggtagaggagccagagaacgactcagccgtttcgggggaagaggaagttggacaacatcggctgttttagtgctttttatttttccccaattcagcagagaatattttcaaggggggtgagttataatgacctatcgcgttttactgagcccagttccactcccgcccttccttggctttgtagggtctcccctccgctccctcggaagcgcttctaagaaggtgggcagagggggggaggtttgctaccaacagctcatgaataattcatgagccccgcccttcgtcaggaagccccgcccctccggatcgcgctgacgcacgctgcgtttaccaaacttaaggaagcgacgtcacaggcccaacccctaagacggggggcggggcgccagtttcagcacgtgctgcctctacccgcgcaagcccaaaagggtgtgcgcaggcgctgcccactaggggggaggaaggaggcggggtggggaggttgttggatttagagccgggcggagaccgctgagactcattcctcaggaacaagggtcgggtgtcaaggagaccttttcacaccagctcccgtcccccgcctacggtgggtgggatcgcgcggcagagacaaaggagatcagtagggccggacatagctgcgcagggaagtagggtgtcagtttggggtggtgggcttttgcgggggctgtgggggggttatatttaaactcccagagccgttaagttggttcgtagtctgatgcgcgcgcaaccagggtggtggcggagtgcgcatgcgtggttcccgggcgaagggaacgcgcgctcaccgtgcgcgctcgcgg

SEQ ID NO: 42487 - DNA, 1030 bp, Homo sapiens
ggcggcggagaaggagccgtttctggtgccggccccgccgccgccgctcaaagatgagtcgggcggagggggcggccccacggtgccaccgcaccaagaggccgcctctggggagctccgcggcgggacggagcgtggtccgggtcgttgcgcgccatctgcggggtccccagccgctgcggtcggtcgggaaagccccggggccgcggccacctcctccagtggtccccaggcgcagcagcaccgagggggcggcccccaggcgcagtcgcatggggaggcccgcctgtcggatcccccggggcgagccgctcccccggacgtgggggaggagcgccggggagggggcgggacagagctgggtccccctgctcctcctcgaccccgcaatggctatcagccccaccggccacctggggggggcgggggcaagaggagaaatagctgtaatgtagggggaggcgggggaggcttcaaacatccggccttcaagaggcgcaggcgggtgaattcggactgtgactctgtgttaccctccaacttcctcctggggggcaatatctttgatcccctgaacctgaatagcctcctggatgaggaagtgagccgcactctcaacgcggagacccctaagtcatccccccttccggccaaagggcgagatccggtggagatcctcatccccaaagatattactgacccgctcagtctcaatacttgcactgatgagggccatgtagttcttgcttcgccactcaagactggtcggaagcggcatagacaccggggacagcaccaccagcagcagcaggcagccggagggagtgagagtcaccccgtgccgcccacagcccctctcacccccttactccacggggagggcgcctcacagcagccgcggcacaggggccagaaccgggatgccccccaaccctatgaactcaacacagccatcaactgcagggatgaagtggtgtctccccttccatctgctctgcagggtccctcaggctccctatcagcccctcca

SEQ ID NO: 42488 - DNA, 1050 bp, Homo sapiens
agagggcaggcaccttttgggagttagtctgagaagaaagtggccacgggctaaagtgaggccgcgggactgtatcggcctcagagcaggttgcctgggagcaggggttctttgattccctcagttgacctcactgccgattcttgccctcagggtaattatgtgctggatcgagatgacctggtggaggcccaaacacctgagtatgatgtggtgctctgcctcagcctcaccaagtgggtgcatctgaactggggagacgagggcctgaagcgcatgtttcgccggatctaccggcacctacgccctgggggcatcctggtcctagagccccaaccctggtcgtcgtatggcaagagaaagactcttacagtgagttgggtgttgggggaatagtcattcctttggttgaggcaagaaaaggccccgaggtgggcatcgcccttggccaggggaggcggcagcgtgctgaagtggtcccttgcctctctccttaggaaacgatctacaagaactactaccgaatccaattgaagccagagcagttcagttcctacctgacatccccagacgtgggcttctccagctatgagcttgtggccacaccccacaacacctctaaaggtaaggctggtttattttgtcagggaggctggtcctggctgaaagagtgcagacccccatggggattcttgaggtgctgccaaccccttctgatcactctctctcccctcaggcttccagcgtcctgtgtacctgttccacaaggcccgatcccccagccactaagtggccccctaaacagaaagtgtgaagaggctgccctcgctgctcataaggacctgggggaagaggaaagtgtcccaaggtctttcctttctgactccaaaaatagtttcctttcttggatctgcaaagaaagcttttcttccgtcgctgcctcagcctcctccctatgcctctggcacctgcgcagcaaggctggctgtgctggagtcaccatcatcttcctctcccccagcctcccaggctggatggcatggactgttt

SEQ ID NO: 42489 - DNA, 1033 bp, Homo sapiens
gggcttaggatgccaacagcgctgctgagaaacggaggaggaggagggtttgcttgaggttggggcgagagtcgctctggctgttcttcccgctgggcgttgtacacccctcctcctgaaccaagccagaggtcagcatggggaagggaggaaggaagggatgggaggaagaggggggtgggtgagctgaaagagagggactagagtgccagatggaggagctcttttctagagagccgggagttggggagggggtatttattttgttatttatttcagtctggagggcgattctgggcctttctgacctactcctgagctaggagtggagaatcagggccaagtttgcactctccccaatgccaatgcctaaaggccccgccgtccatgccaccccacagccaaggaggggtctgcatggggagtggaccgagagaagaaggggcccagggaagcagagggcccaagaccattcacagtatttacaatttgccagaatttggtagtcagtgtggcctgctctgaatcaggcatcttatttagttctggggtgagggtctagtgccagggatgggcaggatgatgggggaggaggagggaaattttagcgggtggagggggtgggcagggtatttatttaaattaaaaaacaaaacagaagagatgtcaggaacttttttttaattcctttcttttcagaataatatattaaaagactcatgatcctaaagctggcttcttctatttcacagcgtgctctgctattcttacacttgctccttttcccatcttgcccctggttggtgggagttgaaggttgtgcggggaggggtgagtagctgtggccaagtcacagggcgaggtggagttccaggtaagtctttgggaatgcactgggccatgactccattagcattttttttgtgcacagaatgtgttcttggcattgcactgatgcagaaggaatatttgggcatgaagcttgccttcaagtaccttgtgatctactcagatgacctccactgagatgaca

SEQ ID NO: 42490 - DNA, 1053 bp, Homo sapiens
ggccagttttctgttcagtgggttacaaatatgtctccttcataaggggatagagtcgtctgggggcagtgagcaaaattactagaattcccagctggttggattggccgatgtagcaaagttgatggttccagccaaagttgaatttcctaagatctgaagaaaaacacacattttaatattggtgggtgggtatgactctgcctgcatccctgcatgtatgaactcattcttgttctctcttttttaatgagaaatattttctcagctgtagcaaaaacctacagcgttggtgtgaggggttgagagaaaggctgctagtttctgctgttcctaaatttacatacatactgccacaattgtaggtcccacacctgacctagttttattcatttggttttcttccagtacctaatttccttaacctagatgtggatctgtttaatttccccaacatacacatatgcttgtttgtttagttacatttctaattcttggaggatgaatctgtcatttgaatcttaagacgtggtaaaaattgctgctaaaaagcatctatttgcaaagcagtgctttaaatgttctttcttgttctggtttgcctgaatgcgtctgtgaatgaaccactgttcctcagaaagaaaatggatgttgaggcctgagatctcattgacacaaggatggacgctaactttgacacccagttttttcagcaaagtatgacatatttccttgatgtggctgtttgggtccatcttcaatccatcgttcttcaggtgtttgtaatagacacttatctcttctatttctgcccaactttactgtgatcacaggagtcagaattaaggtgggcagagctctgggctgggtgtcaagaatgcacttgacagctctttatttgtgacaagttcctgccctccttgtgccttactttccctgtcgggcttgctggtggttcttagttgaagcattttaatctccatgggaggaaaggtacagtatgttcttcaataattcagtacttttccatctgtctgggttggagaggtacac

SEQ ID NO: 42491 - DNA, 1863 bp, Homo sapiens
tgatcctcccgcctcgaccttccaaagtgctgaggttacaggcgtgagccactgcccggccaggtgcaccctttgtacaggaaaaggggtaggaaaggcttcgaggtccctctgagccctctgatcgcgtccctttcccacgccagggcacacagcatggcagaaaaccgagagccccgcggtgctgtggaggctgaactggatccagtggaatacacccttaggaaaaggcttcccagccgcctgccccggagacccaatgacatttatgtcaacatgaagacggactttaaggcccagctggcccgctgccagaagctgctggacggaggggcccggggtcagaacgcgtgctctgagatctacattcacggcttgggcctggccatcaaccgcgccatcaacatcgcgctgcagctgcaggcgggcagcttcgggtccttgcaggtggctgccaatacctccaccgtggagcttgttgatgagctggagccagagaccgacacacgggagccactgactcggatccgcaacaactcagccatccacatccgagtcttcagggtcacacccaagtaattgaaaagacactcctccacttatcccctccgtgatatggctcttcgcatgctgagtactggacctcggaccagagccatgtaagaaaaggcctgttccctggaagcccaaaggactctgcattgagggtgggggtaattgtctcttggtgggcccagttagtgggccttcctgagtgtgtgtatgcggtctgtaactattgccatataaataaaaaatcctgttgcactagtgtcctgccatcccactgccactgattctttcctgtgtaaattctgtgtgtgcctgaatagggatggtaggaaacgctacaggtatctaggtgaaaggggaacccaagtgtttcttgcctctatagagagcatagattatgctatgagcagtgtaacaaaacagtacagtgcagaaacccagtcatcccaatgtttgtttgtttgtttgttttttgagacagagtctcactctgtcacccaggctggagtgcagtggtgcaatcttggctcactgcaagctccacctcctgagttcacgccattctcctgcctcagcctcctgagtagctgggactacaggtgcctgccaccacaccctggctaatttttttgtatttttagtagagacagggtttcagcgtgttagcagggatgttctcgatctcctgaccttgtgatccacccatctcggcctcccaaagtgctaggattacaggcgtgagccaccgtgcccagccccaatgtttgttttaaagattttcgtcttctagttgggtgcagtggctccagcctgtagtctgagctactggcggaggctgaggcggaaagagtgcttgagcctgggagtttgaaggtgcagtgagttatgatcatgccacctgcactccaatctagatgacatactgagacctagtctatgcaaaaaaaccactttttttttttttctgagatgaagtcttgctctgtcacccaggctggagtacagtggtgccatcttggctcactgcaacgttcggctcctgggttcaagtgattctcctgcttcatcctccccagtagctggaattacaggtgagtgccaccacgcccagctaattatttttgtatttttttagtggaaacaccatgttggccaggctgttctcgaactcctgacctcaagtgatctgcccgccttggcctcccaaatgcaaaaaatttttgaaaactagatgggtgtagtggtttgcacctataatcccagctacctcgttagctgaggcaggaggatcgcttgagcccaggagttcaa

SEQ ID NO: 42492 - DNA, 1108 bp, Homo sapiens
aggccatagacagcctgactcctccctaagcagcaccctggcctcatcttccacctctctcttctccatcttcccttctgctcacctgtagggagaccccctgaaactactgctacggaataaaagatgaaatgctcctgattattgtaaatacaaaattgcatgcaggattgtgtacaaacaatgccaggttggactgccagaatgagccaacagcctgtgatgtgcttccgcctgcggagagcctatgaacggacctgcagtcagggaggtttcacatcaccaagatttctatcccagaaaagcagatgttcatagctctgggaatggaatgcgacccttgtggagagcctataaacggacgcatgggggcggggggcacctgtccatatggataagatagggctataaacgccctcatcttgccatggctcttctaggcctctttagggttaaggcatactcccttctgagaatttctggtctaactggttgtctagcttcatgtcctgtttccatggattgtctgtaaccagcttttgttgcaattgttactgctgattagtatcttgctaatcataggttatggaaagattgtgtttctgttttaaggctctgttagaaattactgatgcacacactatattgtaaattcttatctctgtatactgtacttctgcatacaaatgtactgtacttctacatataaatgttatgttaaagaattaattcatccccatgtgaccatctcacctcataatcaaatgaccctaaatccctcactaacctacccccgccctcactaaacttaataataaatgatggtacatctggtgcattgttgacaccacgggaccagaaggcggtgaccccccggaccagctttcactatcttgtgtgtgtctattatttctcaacctgctgatccgcctgggaacaaagagagagccctgttgcattgcgggctgctggccagatcccgcaatactcacctgactctccattcactttgctgaatcgacaatcccccacccacctcatacctcttcccattgatgtcctaccccccttcaaggctgaggtcattgtcacctcctccctcaaatct

SEQ ID NO: 42493 - DNA, 1027 bp, Homo sapiens
tctggcctgcgtttctcctcaggcatatgagcccccgccacctcctgcctaccgcacgggctccctgaagccaaatccagcctcgccgctcccagcgtctccctatgggggccccactccagcctcttacactaccgccagcaccccggctggcccagccttccccgtgcaagtgaaggtggcacagccagtgaggggctgcggcccacccaggcggggagcctctcaggcctctgggcccctcccgggcccccactttcctctcccaggccgaggtgaagtctgggggcctggctataggagccagagagagccagggccaggggccaaagaggaagctgctggggtctctggccctgcaggaagaggaagaggaggcgagcacgggccccaggtgagccctggggaactgggatttcaggccctacagacaatgggacaccgactgggtggggtggctggtggtgttttagggggcttttttgttttttgagacagagttttgctcttgtttgcccaggctggggtgcagtggtgccatcttggctcactgcaacctctgcctcccgggttcaagtgattctcctgcctcagcctcctgaataactggattacaggcacacgctgccacgcttggttaatttttgtatttttagtacagacggggtttcactaaaaccccagtttgttggccaggctggtctcgaactcccgacctcaggtgatccgcctgcctcagcctcccaaagtgctgggattgcaggcctgagccaccgcgcctggccaaggggctggttttggagcagagtcagaggtctgggacgtggaataggtaagggcagggcagtgcgggggagcaggatagaactgcccattggggctgagcgcggtggctcatgcctgtaatcccagcactttgggaggctgaggtgggtggatcacctgaggtcacgagttcgagaccacactgaccaacatggagaaacctcgtctctactaaaaatacaaaattagccaggcatggtgg

SEQ ID NO: 42494 - DNA, 1049 bp, Homo sapiens
ctcccaccgttccccaaaaaccaagccttcctgaccggggtcccctccaggctgggcagcattgcagagattgacctgggtgtgccgccgcccgtgatgaagaccttcaaggagtttctcctctccctggatgactcggtggatgagacggaggccgtcaagcgctataatgactacaagctggatttccggaggcaacagatgcaggatttcttcctggcgcacaaagatgaggagtggtgagtgcccctacttccctggacctctgccctggcatgtccccctggccccgctggtggagccacagccctgtcctcttcccagttttccctgtccagaactttctgggggcgggggtcgggaagtatgacagcattggctgatggggtctccccctcacttcagcaactgccacggcccccgccccgccctgtctcctgtcctgctgtcctcagagagtgggacacctccaggcagcaggccagagccacttggccccttggggcagcagacagactgcttcccacttgttggtgttgggtcattgtcatccctgatcaccaggaccctgtgtggctgtggcgtcctcctaaagcgacgagtgaatccagacaagaaaagcaaagatctcggtcgtttgacagaaaaagaattttaatttttttttccttttgtggatgttttaattttaatcaaccatcttttccccccttcctgctcctcctcctcctcatcctctttctgctcctcctccttgaaaagagccagaactgggaactacacccgctcatcgacggagctcggagcaaacccacctccacccccaccatacccagcccatacatgagcccctgggctgagctgcgcggccccggccaggcagacaggccagggcactgctgtgcacaatgcagcggtttagctgaatgtgattgctcaggcagctagccagtcaggccccactgcggagtcccgcgtgggcatctcggccgggcgcccagccaggagccagccggtggcccaccagccagcatgggccctgggcgccg

SEQ ID NO: 42495 - DNA, 1027 bp, Homo sapiens
gtccctgtccgtgttgtactccccccaggtttgaccccaggactcccctacccacaccagactccccagggcctgatgccctatggtcagccccggcccccgatcttgggctatggaggtaagtacaggagggagatgaaggggcttggtgagtgtgtggctttgggagaagaaaacagaggatggaattgaggacatagttttgcaactcaacactgatctctgtcatagctggtgctgtccgccctgcagtccccacaggaggccctccatacccccatgccccgtatggtgctggtcgagggaactatgatgccttccgaggccagggaggttatcctgggaaacctcgcaacaggtgaggagggcagacgcccaagctttgttgccgcctgcagactcccttttgggagccctcagctctcatcctgtacctctcacctcacaggatggttcgtggagacccaagggccattgtggaatatcgggacctggatgccccagacgatgttgatttcttttgagccgtcccccgttcctcagtcctgtatcatccatacttgtactaccttgtcctatgaagctctgagaattttttgtacgatcagccttactgctaataaaagcacttccacagggctcctgactctcgtgtgttacataactcctccatccttccagagtaactcctgaggtgttgctcagccctgccacttttattattgatgtcaaaagcgccaggctttgcagggacaccagtgggaggtacataggtgcgtgtctgggacccgagaatctcagttctgtaacttcgtcctcagtccaaggtgcgctgctgctgttgggagctaaggctggtcaagcacaggttgtagaaggagttggggtcaaaggctgcactcacctcttgccagcccacccacccagcagcctgtagttcactggggctttttggagtgccccagtagtgagggtccaataccaggacataggcttccgtgcctgaccctacgcagactcccagcaa

SEQ ID NO: 42496 - DNA, 1089 bp, Homo sapiens
gggaggcaggggttgcagcgagctgagatcgtaccactgcactccagcctgggcaacagagtgagaccctgtctcaaaaagaaaaaaaaaaaagagagaaatcaggaacatcatgaaagatacagcaaaatgttttaccccagcccactgcaccacacctgggattgtgacaattaacttgataaattgttccttttcctgttcggaactgactaggttgtgcgtggatggaccagtgaaaagaaaatcctgtttgggtagggaagagggaagtagaaaacctctttcgtattcttggtgtcaagaaatgggaagagaatgagggagcagagacctgggttgagtgttggctctgcactaaacagctgtgtgatcttggtctagtgccttaacctctctgagcctcagtttgtacatcagtaacattgggataatgacatccacatgcccacttcacagagctgctgtgaggactggatgagaaatgtagagaagtatttcggacaccataaagctcaaatacaaggtgttggttaggaaaagtttcaactgacttgtacccacctgatacccctccatcagcataagcgtgtatgaggatgttaggtacatgtgttgtgagtgaaagctctggaacacccgagtagagctttctgcaaatcagcttctccttcagaggagaccattttgttttgctttccagcagttacttgaagaagccttatctgaagtcacaacagtgacttcaggaatagaagggaccaatggccagcttgctgaaatgtaatgccattcttaaaagccagctaagaatcagaccgtattagttaaggacccataagagtagacatttagaaaaagtgaaaaatggcaagagtggcccaatcttttgagagtttagagaaaatatcatttggaaagggagtagctctccttctattttagccttattattacggtatctataaagcaatgccatattctaaatctgcagaaataaaattctaaggggcgaaagtccaaggcagaagtcaaaagttttgcaaggaaaccgatgaggttgctgacctgagctgggcagggttgaac

SEQ ID NO: 42497 - DNA, 1033 bp, Homo sapiens
ggacccggaccaattcagcctggggcaggggaaaagagcaacaataactaactgttagaggattttcgggaatgttagcacaaagtgctccgggaattctgcagacaatcctacggaaacatacacatgccgtgctgttctgccctccgagttgtcaggggtccctggccttcccagcctggccttgtctctacctgcctcccagaaaccagggtctagagcttctcttcggagtcctgtaacagactaccctgaaacaagctggactgagtccaggttaattctgaaatactggaggagagcggtgtgcgttctggccccctgcatctccttgtttgccccacccctaactacctccagagtgatctatgtaaagcaggagtccccaaccctgaggtcacagacaagtaccggttcaagaccagttcaaggaaccgggccgcacagcaggaggtgagtgataggcgaaaaagcctgaagcttcatctctacagctgctgccctcgctcgcattactgccttagctctgcctcctgtcagaccagcagcggcagtagattttcataggagctccagccctgttgtaaactgcacaggcgagggatctaggttatgcacttttatgagaatctgatgtctgatgatctgtcattgtctcccatcacccccagatgggaccgtctagttgcaggaaaacaagctcagggctcccattgattctacatgatggtgagtagtaggattatttcattatatattacaatgtcataataatagaaataaagtgcacaggccagacacggtggctcacgcctgtaatcccaacactttgggaggccaaggcgggcagatcatctgaggtcatgatggagtttgagaccggcctggccaacatggtgaaaccctgtctccaataaaaatacaaagaattagccaggtgtgttggcgggcacctgtaattccagctacttgggaggctgaggcaggagaatcgcttgacctgtgaagcggaggttgcagtgagccgagatca

SEQ ID NO: 42498 - DNA, 1094 bp, Homo sapiens
tgctaaccattctgccccgactctagctctgtgtacgggcatgtctgtgttttgaatggctgagggttcaaagccagaaggagttagttctcctgagaagaggctgcagcctcctggtctatctgcagagctcatcgctttaggaaagtgactccccatgaatctgatgatgtttctgagacttgccttccatagctgtcattcaaactaggaccatttatcaaaatgagccgagtgcatagcacgttccgggcgccggatgcttggatcacattgatgaataagggacttcaggggctcccaggtgtgctgtgtgtgtgtggtggagagtgtgcaggggccagaggaatgaacaaatcatccaatactgtgagataaggacttcgctaaaggtacgattgaggtgttgtgagattcacaggaggtagagatctgggtgatcctcctctggttcaaggcctggctccctgggtctaagtttctcagaatcccacttcaccatgcatcctctctcttctgtagattgcatctttcttccccactggctctttcccatcagcacctaaggatactccagcatctctctcctttaagaaaacagcctcaggccaggcgcggtggctcacacctgtaatcccagcacttagggaggtggaggtgggcggatcacgaggtcaagagtttgagaccatcctggccaacatggtgaaaaattgtctctactaaaaatacaaaaattagctgggcatggtggcacgcatctgtaatcccagctacacaggaggctgaggcagaagaatcgcttgaacccgggaggcggaggttccaataagccgagatcatgtcactgcactccagcctgggtgatagagagagactccatctcaggaagaaaaaaaaaaaagaaagaaaagaaaacagcctcattgcgtctacatcattcttttgctgttggcttttctcagccagctttcttggaagcactggttgctctgcctgactcagtttccttgtttatagggtcttctccaacctctgcggccaggtctctgccctgcttactgtctcatttgcacctgcgggatgttacttta

SEQ ID NO: 42499 - DNA, 1039 bp, Homo sapiens
ctacaccagaaaccgggcttgcttttcctggcaccatcctctctgaggaggaaatgaatgaatcaacaattacaatacagggttgggctgggtgtgatagcttatgcctgtaatcccagcactttgggaggtcgaggtaggaggatcacttgagcccaggaagtcgagaccagcctgggcaatatagcaagaccccatctctaaaaaaaaaaattagccaggtatggtgtcacacacctgtagactcagctactcagggggctgaggtgggaggatcgcttgagcccagaagtttgaagctgcattgagctatgatcccgccactgcactccagcctgggtgacagagccagaccctgtctcaaaaaataaatgaataaaataaaataaaatacagggttgcactgtgtctggggctatggtgaaaggcctctgcatgatggtagagggaagaaaagatttctattctcatccattgctaagtccatagttaatacccctgtgacacaagatagattaacaagagaaaaacatgcacatttgtttaagttttatgtgacataggaaacttcagacatgaagacccaaagaaacagggagacctgtgtatttttatgctaaatttgataaaaaagcggacagctgtggagaagtgtgattgcacaaaaagagtatgatctcaggccaggcgcagtggctcacgcctgtaatcccagcactctgggaggccaaggcgggtggatcccttgaggttaggagttcgagaccagcctagtcaacattgcaaaaatccatctctactaaaaatgcaaaaaattagctgggtgtggtgtggtgggtgcctgtattcccagctactcgggaggctgaggcaggagaatggcttgaacctgggaggcagaggcggaggtgagccgagatcgcgccactgcactccagcctgggcaacagagcaagactctgtctcaaataaaaaaggtatgacctcatcataacaaactgggtgaaacttagcaaggcatgttcagattcttctctgt

SEQ ID NO: 42500 - DNA, 1055 bp, Homo sapiens
gtcccccccaaccccacagcctgaggctgtccgtgtcataccccatagggagctctgaagcccggtcttggggttcacaggccagcctcagcagagacattgaggacagtgggggctccaggtcagacttgcacaggcaggtccctgcacaggcagctttgcggtggcgggaagggctggagacagccctcacccgcccgccctggccctgccgtcagcagctgcagggaagaggaccgggcgcatttatagaattcctgcctgcaaaggccatgcagttgttttaaattagcatacaaatcgacattagtgtagtacatctgttgttaatccacatcccggtggaacggagatgccaacacgccttttattaggcacgtcgatcccataatgtcctttctccctgcctttgtcttctatcagagtccgtaatgggttccaggatgtcttttattttgctatggaccacgtttcctcctgcccagcggatcagaaacgtaatggattccaggatggaatttatgttcctttggaatcagaccctgtacgatgaattctaaagccttcgggcaaatctccagggaggccgtggccctgtgtttgcccccatggtcatcagacaggcaccgggaacccgggcacagtcccagggctggagggggaggaagggagcctgggccgacagctcccaattaagggaattccaggcaggcgtgggaggagaggccaggggtgctggtggagacagacagggaagctgggaagatgcagggcggggaggagggggcacagatattctagaaacccaggaaccggcagcaccagtgtttctggggctggtcacagacactggacaccagtttgcgaggtcctggagaaaaggaccttgaccctgagtatcccagcaggcctggggaggagggcagggtgttgtgagccagagactgcccttggggctaaccaggccgggactaagatacccagctttaccctttgctcatggcatggccctggagagtcactgtctcttgctgaggcttggattccatagcctg

SEQ ID NO: 42501 - DNA, 1034 bp, Homo sapiens
tccttccttagtctcccgagtagctgggacgataggcgcccgccaccatgcctggctagtttttttgtttttttgtttttttttttttttgagatgtagtctggttctgtggcccaggctggagtgcagtggcgcgatctcggctcactgcaagctgagcctcccgggttcacgccattctcctgcctcagcctccggagtagctgggactacaggcgcccgccaccacgcccggctaattttttctatttttagttgagacgaggtttcactgtgttagccaggatggtctcgatctcctgacctcgtgatctgcccgcctcggcctcccaaagtgctgggattacaggcgtgagccaccgtgcccggccgatgttttcttaaatattaatggcagggccctctggattgactgtgttatttgacccattccagttttcaaggcgtggtcttgaaaagctgtcgatcaccctggttttgggatgtgtttcagaaccaagtttcgatggtgtgtcagtgttggattttcctgctgaggacagctaaggtttggtatggagcagttttggatttgctgagctgtaatcagtccagcttctctgctgtcttctgagaaggttgatggaggagagtggtctttggcggggatggaggtttccctgcaggaaatgaaccaggactgaggggaacctgtgccgttcccctcatttgtcctgcgcctgaaacagctttgaagcacctggcttgtgacttaaaagatttttaaaaagcatttgtgctgccctattcgggtattacacagtgagggtgaaccattcttttcgaaagacgtctaaggccgggcacggtggctcatgcctgtaatcccagcactttgggaggccaaggcaggcagatcacttgaggtcagaagttcgagaccagcctggccaacatggcaaaacctcatctctactaaaaatacaaaaattagcctggcgtggtggcgcatatccataatcccagatactcggcaggctgaggcatgagaattg

SEQ ID NO: 42502 - DNA, 1044 bp, Homo sapiens
gtgagccgccgtgcctggcctccactctttttagacacctttgttgagttgttgttttgggcctgtaagtttctctggcttattaccactttcccctcctgtttctagggaagaaatgattatttagataaaaaataatttgataaaaggtagcagatgataccaaaggtaaatctttgtcttgaagagcctgaagctgtgagcattggtaaagccgtgggctgcagtgagggaagggccggcttggagccgccctcagcctagcctccgggtgttacctggagcccttgctgtcaggacggcctgtcacttctcgcccttctcctgccctgccaagcctgtcccttcctgtgttgtgacaacttttttttttaaacaagtatttctacagctccattattttgagattcttggaagaaagatactatgtaaatgaaaattaaaaataaaattctcgctggagggaatcgtatacatgtaacgtttttgatgaggtttggaaaagactttcgttctccctctggaactgggaacattctgtggctcccgtcaccatttctgtgtcactctgaaaggtgtggcagataatggtgaaacatattattttctgtttttcaccaagtagttgacccagaacttgaacccatgcagtcctgggtccagtgaattatttctgctgcatacagttctgctgtgtcctcgccgagagcgtagtcagcaaccgcccggagaataccaacctttcaaaagaaaaagggctggagtccccaacatacagagattacagctaaaattacgaccagagctgttaatcaaatcccatcttcccttcctattcacacagtagagatgttataagtcatacaggtttgagacagaaaattgagagcagaggagcatgtgtttaaaccagcatagaaacattcatttaccagaattgctttatttcagccgtatctcaactcgttgcttacacagtaacgcatgctgtctcgtcactcagccaagtgggagacaagttcaggtttctgctccatgggatcc

SEQ ID NO: 42503 - DNA, 1029 bp, Homo sapiens
gcctcctgagtagctgggactacaggcgcctgccaccatgcccggctaatttttatatgtttagtagagacgggctttcaccatgttggctaggctggtcttgaactcctgatctcaggtgatcaacccacctcagcctcccaaagtgctgggattacaggcgtgagccacctcacctgggctcactcaccacaatttttgagatcttgttgtctatgtcattccctgtgaattttgtttgttatgacagccgtattgaaatccatcttcagggccaggcgcggtagctcacgcctgttatcccagcaccttgggaggccgaggtgggtggatcacctgagatcaggagttcaagaccagcctgaccaacatggtgaaacccccgtctctactaaaatacaaaaaattagcagggcttggtggcgcatgcctgtagtcctagttacttggaaggctgagacaggagaatcgcttgaacctgggaggtagaggttgcagtgagccgagattgtgccattgcactccagctttggcaacaaaagtaaaacgctgtctcaaaaaaaaaaaatccaccttcagaattgacctgtgttaatctgtccagactgccgtaacagaataccatagatggggtggcttcacatatttacacaacacatatttatctctcatagttctggaggctggaaagtccatgatccgggtacgggccaacgtggttcctggtgcgggcccttttcctggcttgcagatggcctcgtttttgctgtgttgccacatagcagagagtgtgcgcaggcaggcaagccagctctctggtatctcttgttttaagtacactaatcccatcatgagggctttaccctagtgacctcatctcatccttacgaccttccaaaggccacacctccaagtaccatcatattggaggctggggcttcaatgtatgaatttgaggggggtggacaacacagttcagtccgtagcagcaccctagctcacacgtccatttccctggggctggtcacc

SEQ ID NO: 42504 - DNA, 1052 bp, Homo sapiens
gctggctagaatctgaagtactcaattacatggtggtggtgatagaggctgcccttttctttctctttctaccaaaggagatttttggtagaaggtttaaccaggtgaaggaactaccttaactcccctttccatagtttttagagaattttttttggtataaataggcgttatcctcttgcaaatacttttccttaaaacctattcatgtccatgcagtttttatcctttagtttatgaatgtggtaaattacattgattgactatatgatgttgaatcatttattgctttctgggataaactcttcttcctcttgtattttaaaaatattgttggatttgatatacagttttcaaatctgtgttattaagtgaaattggcctataattttcttattcagttggaattgaggtttactagtctcatgaaatgggtaaacattgtgttggaacaatttatataacatgaggattatctgtatcttaaaatttgatagctcacctttgaaaccatcagggcctgagactttagaatggtggctgggaggcatttaacatttcactttttttgtttttggtctattgaggttttctattctttattttattttattattattattatttttttttgagacggagtcttgctctatcgcccaggctggagtgcagtggcgcgatctcagctcactgcaacctctgcctcccgggttcacaccattttcctgccttagcctctcgagtagctgggactacaggtgcccgccaccacgcctggctaattttttgtatttttaatagagacggggtttcaccgtgttaggcaggatggtctcgatctcctgactttgtgatccgcccgcctcggcctcccaaagtgctgggattacaggcgtgagccaccacgcccggcaggttttctattcttatgccaattttggcattttataattttctaaaaatgttttcattttatcttggttttaaaacttaactgttctgtgatcatagtattttttttttgtaaatctgttttgaactctagctgtctc

SEQ ID NO: 42505 - DNA, 1029 bp, Homo sapiens
atttttgtatttttagtagagacagggtttcaccacgttggccaggctggtctcgaactcctgacctcaagttatccacccactttggcctcccaaagtgctgggattacaggcgtgagccactgcgcctggcctgtctttattctttaatgtcaccaaaatgtatctaaataatgatttcttccacctacctatcttatttggcactttactgaccctttgattctgatgtcttatttttttcttttattctagggagttctcatacatttatctctccaaatattttctctcctctctttattttttcttctttctaggacacccactgtacaggtgtcaacccttcttctgttgtccatctctctctctctctctttttgaaatggagatggggtctcactatgttgcccactctggtctcaaactcctgggctcaagcagtcctcctgcctcagccttccataatgctggaattacatgtgcgagcccccatgcctgacctgttctctgtatctcttaacattagcctcattctcaaacatgaagagagtagccttggtgtagactggccacgaattggcgattgttgagatgggcgattggtagtgagggtacccatgaattggcgattgttgagacaggcgatgggtggtgaggtactgtttgtatgtatttgaaatactgtctgtgtatagctccagttgaattacctcctactgagacccactggccttagcctgtggtgtggggatgaaagtggggagggaatagaggaggaggctggctagataggcttggggctggctgccaggacagttaacatgacttacatggcacatcgtacatttctatggaacagtgctgttccgatttagccccttgctaggcaaagtgattcatgaaccagcaacagtggtatcacctgggagctcgttagaaatgcaggatctggccgagcacagaggcttatgcctataatccccgcactttgggaggctgaggccggaggaccacttgagttcaaga

SEQ ID NO: 42506 - DNA, 1041 bp, Homo sapiens
ttctctgaagggtgggtagttgagttgggggtatgagaggggtgacagtggatcatcttagctttttttctatttcacgtcattgttcatggatacaagtgcaggtttgtgacataggtaaacttttgtcatgggggtttgttgtacagattacgtcatcacccaggtattaagcccagtatccattagtttttttttttttttagttatttctcctgatcctctccctctttccacccttcactctccaaaaggccccagtgtgtttttcccccctctctgtgtccatgtgttctcattgtttagctcccacttataagtgagaacatgcagtatttggttttctattcctgagttagtttgcaaaggataatggcctccagctccatccatgtccctgcaaaggacgtgacctctttcttttttctggctgcatagtattctgtggtgtgtatgcgccatgttttctttatccagtccattattgatgggcatttacattgattctatgtctttgctattgtgaatagtgctgcagtgaacatacatatgcatttatctttatgatagaatgattgatattcttctgggcctatactcagtcatgagattgctggatcgaatggtatttctgtcttcaggtctttgaggaatcatcacactgtcttctataatggctgaactaatttacactcccaccaaccgtgtatataagtgttcccttttctccacaaccttgccagcatctgttactttttgactttttaataatagctattctgaccggtatgagacagtatctcattgtctcatgcaattttttttttttttttttttttttttgacagggtctcactctgtcgcccaggctggagtgcagtggcgcgatctagatcttggctcactgcaacctccgcttctgggttcaagctattcttctgcctcagcatccctagtagctgggattataggaatgtgccaccatgcttgtctaatttttgtatttttagtagagatggggtttcaccatcttggccaggc

SEQ ID NO: 42507 - DNA, 1019 bp, Homo sapiens
agctatgactttgtaaatattagtattctttgtacactacttaatgtatgcctaaactctcctccagcaacatagatctcttaaaatatggaaggccatcagtgaggtagggtttcatctttcttggtgacagcccttcttggcccccctattctgcccagctgggtctcccattcctcatcatctcgggggcttcctcccatctctctccagctttggatctcctgactcgtgtacgccatggctttgttcttcctggttaacctctcatttgctgcggggatgttctccgattgcttcctgatagatggtgaccatatctgcgatccgacaagatcttctttattctgtcctcaaatcccaggttggaaaacacttcctgcagaatgggaaagatttggctccccgttttctagcatccgtcaagggcgttctgcatttttgtcctttgttctaacaccttgtagagttgtctttttcttcttcttctcagatttcatgaacacgcaccttggcgtggttcttatggcctggtctctgttttctgtcttccagagttgcgttagtcagatgttgcactttgtggcctgatctgctaatttttcttacttttcatttgtctttcttctctcttttttttttttcttttgagacagcgtctcactctgtcacccaggccagagtgtggtggcaccatcatggctctctgcaacctccactgcttgggctcaagggatcctcctgcctcagcctccccagtagctaggactacaggtgcacaccaccacgcctggctaattttttaagtattttatagagatagggtctcactatgttgcccggactggccttgaactcctggtctcaagcagtcctcccaccttggcctcccaaagtgctgtgattacaggcgtgagccaccgcacccagccttacctttcactttcatgcctctgtcttttttgatgtgttttctgcaggaatttctcaaccttccagtctttctaaacttttatgca

SEQ ID NO: 42508 - DNA, 1027 bp, Homo sapiens
cttgaactcctgacctcaggtgatccacctgcctcgtcctcccaaagtgctgggattacaggcatgagccactgtgcttggcctctgcattgaattcttactgtctttactttgtaaaatgttttttaaaaatatataaacagttgcataccatgcattttggttgcaaaatataatacagtgaacacccaggaaccctccacccaaccctaagaatcagagctttgccagtcaattgcatccacctgtatattcctcccacctcctattccctgccccctctctgggacaggtgacccatcctaagtagtgtatttattatgctcttgcctaaaataatgtattttctgcacccatgaatagatgcttaagtagtatatgattactcttccctgagtttgagctctataaaaatggtattattctgcaatagacttgcaggatttgccttttgaacttgagttactgcaacattatctgtgaggttgtctgttataactgtggtccatttattttctctgatgcttaaacccagttgtgcggctagacccaaatttctttagcctttgtcctgtcgctttgtctgttttcctcgtttccctctttgttttggtcccagttagaggtttcctcaaatgcctagtgacgtgttgttgtttgttcatatatcagagcatggcaatagaaagggtgtgtgtgtgtgtgtgtgtgtgtgtgtgtgtgtgtgtcggggtaaagagcagttttggtggcccccaccgtaagtaattaacccaggtgtctagttgcggggagcccccaggcatgggtatcagtggctcattctcttggactggtcagtttctctagcaaggagccctcagtgttcctgctgggtggtgcagttgggaactgttagtctgaccacctgtcttctaggcaccaggctggggcatgtgctgggatattcactcagccccctgcccatggtcatgagaaaccccagtcttctgcccacagtgcaggagggacctgaccgcagtggcat

SEQ ID NO: 42509 - DNA, 1021 bp, Homo sapiens
gcattgattcctgcaggttcagctcctgccccaaggcagcgtccagctggctgagtggggttctcccagggtctctaagcacaggacagcctgcttctgcatgggggcgcacaggggaccgcagagtcacactcagacccttctaccacctcctgacttgtggactttggtggtgggtggcgacaaactggagtccactgggtctgtggcagagaaaggtggctttgctgggggctgggggagaggaggcgtttttggatcgcagcatataccttgtctagaattgtataaaaacctacaggaaaaggctgatttttttttaaaaaggctgtttttttaaaaacaactaaaggcacaaaaactccaagtgtgagaatatccagaatgcgtttatataatgtgcaccgttgaaaggaacattgaaaaaacaaaaaactccgaggaacaggtcattgggtttggagaagtttccttcagaaagttctcttcctgctcgttcactgtggattaaagctcgttggcaatttcggaagttcacgttcttgagactcggtgcctttggaacaatggctcacaatgaggacggtgtgcgttcccggcaagaatgagtgttgggggcttttctccttatcacccgttccccagacccctctcatcggcctcataaagaaacagatggttcatcaggaatagctcagaaatcacgttggctcctggctgtataaagagtgggaactgggatcataaacatttgaaatctcctaggaaaggacaatgattccctcaatgaaatattgatgtaaagggagcattttaaaaggcagaaatgatgaacctgattcaggttgaagctggtagtgtactttaacctttttgagaattgttaatttaaaagcaaatagaatgaaatatagactataaaagcagattaaatcatttttatgcatcctgggttttttggtgtcacgtgacaggaagagttactacaaagaagaccaggttttggaaagacggtggggtt

SEQ ID NO: 42510 - DNA, 1027 bp, Homo sapiens
gtggcgggggaggtcccactttaacaggaggcaagatggccgggagaaagctatggggaacccaggcaaatggagatgagcagaccccaagaaccgtaccctagggggctggctgggtcgggggaattagggtcctttgggctccttgcagagccgaagattgtagtggggagcactgcgtgtgcctacaaggctgagcctggcaggcagaattatgtgttgttttgagataacagccacaacagagcagtaaagaatactgcttataaaacggacatttttttgtagctcaaaaatggtcaaatatcagtaatgtcatgtggtttgagtaatccataaagcagagcccttctcgttagggctgagaattatcctcccctctccctgccacagagccggccacgtggcctgccccggcacctgctccgccttacatgtcattatgcgtctccgagacagcgtctctcacatctcaccgtttaaatgagcgtctagcaagtattctatggagtgcaatgcttgttggatacatctggcattttcatcttcgcagagtgggtttgtgacggggtgaaaaacaaaaaaacaaattcttgattcttgatggaaatctctcagtcctgagagatttataaaaaaggcttgtaggaaaactttgtacgcgtagcttttatactcatagaccaaattataattttttattcaatcttattttctgaataggtaacgtgttcacttggtctaaaatcaaaattttagccaggtccggtcactcgcacctgtaatggcagtactttgggaggctgaggtggggggcggtcacttgagctcaggagtaacatggcaaaaccgtgtctttacaaaacacacacacacacacacacacacacacacacattagctggacatggtggcacgcgcccgtaatcccagctactcagatggctgaggcgggaggattgcttgagcccaggagttcgaggctgcagtaaactgtgattgcatcactgcactccagcctgggtaa

SEQ ID NO: 42511 - DNA, 1030 bp, Homo sapiens
cactggttgctcctctggccacaccgcaggattgattactaaccgtggaggtgacgtcgggttgttgcatgtgtagaaacgaggcttgcttagagctttcgcccgttgggtaggacagcctggcttaccgggaggagggtatcctcttccctatggatgcagcccacgatccccatggcaacataccttccagggcacagcgtggcagagccagggctggtggtgttcctgctggtgtgacaccaagggtgttgatcttgatggaaacgcccacgtctctctttgttctgggaaagaaggaaaggtttcctggtgtctgatgaatgtctaatgtgttccacagggaggattaggcacccgcgagggttcagtggggagtaaagtttgtctgccatcggagatttcaccttctagactggcccttcccagatgtcactgggaaaagctctagtccaggagggaaaaggtgggctgtgacggggaggtggccagggaggggtgctgtgtggtggctgggactctgacaggcgggagaagccacaggaacatcaggaggtgagcgccaggatggctggagccttgaagggtttttctggggacaggatcctgctctgtcacccaggctggagcgcagcggcacgatcacagctcactacagcctccaactcctgggctcaagtgatccctccgtctcagtgtcccgagtagctgggattacaggaacgtggcaccacagtgcctggctagtatattttattttattttatttttatgtgtttttttttttttcttcaagtgtcttgctctgttgcccaggctggagtgcagtagcacgatcttggctcactgcaacttccaccttctgtgttcaagcagttcttctgcctcagcctcccgagtagctgggattacaggcatgcgccaccacacccagctaatttttttgtatttttagtagaggtgaggtttcaccatgttgcccaggctggtcttgaactcctgaccttgtgatccacccgcctcagcctcc

SEQ ID NO: 42512 - DNA, 1304 bp, Homo sapiens
agctcgggcaactttaaaaaaaaaataacaacaaatataggtagtttcagcttaaagtgtttcaaaagttggtttgtggccagacacagtggcttacgcctgtaatcccagtgctttgggaggctgaggtgggaggatcgcttcagaccaggagtttgagaccatcctgggcaacatagtgagattccatctctacaaaaaaatcaaaagattagccaggatggtggtgtacacttgtagtcccagctacttgggaggccgaggtgggaggatggcttgagcccaggaggttgaggctgcagtgagccatgatcataccactgcactccagcctgggcaacaaagtgagatcctgtctcaaaaaaaaaaaattggtttgtaataacaattaatcatcttacaaatatttattgaacaccttccatgtgccagacagtttggccctgggaataaaaccctatctccattctttaaaaagtttcttatctttcttagtaagcaaatagaacccaatggcagagcgtgttaagtgctaggatagaatgactggaatcttctgactgtagactttccccacagaaacactcttatgtcagtggtgataaagttctctggataagccacatatggctcagtaaccctttttatagataaacagttctgctttttgagccttggttcttaacctttaaaatatccatgaaagttgaggacctacgcacctgggaaatgcacgtttgcagtttctggggggctcccagacactcatccatgcagccttagtttagaacaccagttctctgggcccatagtcccagtttcagctcaccattccaggagaaccagtgggtcacctctactctccttctcctccttgtgtcctggggtggaaggggatgaaggagggaggaggggggattctagagctttggggtgggtgacagatgagtaccaaggcctgaccgctgggcagggacagggtgtgcctggccttgggctgggtgctggggagtgggagatgggtgaaggagcaaggccacctgatgtgacaaggggctccacgggctggcagcaggggcagcacctctgcactgggctggccacagcatgtcaggagggagcagcagcagctatctggaagcctggtggtgttagaatcatgtatgtgagcagtggaggctgaaagcctagctctcgcaaaccccagaaagtgtctcttagcttttccgtttgccgtttgcttttccatggctttgatcgcggtcaaactccgatttcccgcgtgtgtgattccagagttcttc

SEQ ID NO: 42513 - DNA, 1049 bp, Homo sapiens
gtgctatcccatttcacccaggaggtgaaatgaattcagatgcacagagcatatagtaggtgctcaacaaacaccctcctctcttctttccttccttgctttcttttacaagtagtcctgagcccttttctagggccaggggcagtcagatacagcagggatggagggagaagattccagatctcacagagatctggcagtggccaagtaaacaaatgatgcacaagataatttcaggtggcggtaagagctcagacagaacaagatggcagtgagtgatcaaggatgggcgaaggtactttggggagtcagagaacgtgttttgatcttaagaatgcaaaatgactttttgtatcacctgtcaacacaacacacacacacacacacacacacacacacggaggctttagtgcaaattttgaaataaccattgattaattttggcaagctgttagcagtggagtcccccacatttcttccatgtaaagccctgatcatcttggctgtaaccactcacttactttgaagcgtcagattcagtctctctgctttctaagaccagggatgctatttaatctgggcattagaaaattcagttggccaagtgcggtagctcatttctgtaatcccagcactttggaggctgaggtgggaggactgcttgagaccaggagtttgagaccagctggggcaacatagcgagaccccatctctacaaaaaaatgaagaaattagccgggcgtggtggtgcatacctgtaattcaggaggctgaggtaggaggatcccttgagcccaggagttcaagactgcagtgagctatgattgcgtcactgcaccccagcctgggcggcagagcaagaccctatcttcaaaaaaaacaaaaacacacacacaaaattagtcaatgaattgtggagtttcaaagagaccttattttgtttgtttgttttctgggccaaaggcccagaaattcttaggtaattcttcggtaattaattcttaggcaattcttaggtaattaacgaggagctaatctcccagttgctc

SEQ ID NO: 42514 - DNA, 1021 bp, Homo sapiens
aaaaaaagttctttctgttttctatcatcaaagtttaaaaagcgatgtttggatattttaaaagccggaaagaccatgtatggcgtgctgaggaagtttgctttgtttgatcattttctcttcccctcacccccatcagctggctaataatgttttccatgttaaatgtgtatcacagcctgttgaaatccctgtggttaatcagaagagaagttgtttctatcctatggaaccttaatacagttgtcaggaggtttgtgaacagaaattcagaattcatcacactgtaacgatgatctaaaggtcaagttgtacagtataaatttgaaaatctctctctgacttcctttctacctaaattagagcctaaaagtcatgagaattttgtcttctttttgtttattttagagatagcatagtcgatgttttaaaaagttgccaccttttcactataatgcgctcccattatcagagatgtttattctggttgtatctctctgacaaccttcaatacttaacagaataatttagtttggattcaaagaagtgcctcttctatttctgtgtttgtttctagaaactttgaggtggaggaattattgttccttcttcttggcaatgttcagggtttcacgaatctgacttttaaaagcccagctctcagccccgagcctctcatgagttaaagaaagggttttgcagcttttggtagacgagaaacacattttatggctcttcatgaagttgcccgctccgtccacgtcctgtcctcttcctccttcccagtttctgggctccctggctcttgtcatgaggctttcagttttgtgtcccagaaagcgcttcccccggggacagtgccatgccaaggctgggagaagggaaaaaggaggtgtttatcgccttgaagatgccttccagcctttattattaactcccttccaaagtaaactttcgggtttttttcaagtctgttctggccaaagtacagttgggtttgccgtgttctctaggagtagag

SEQ ID NO: 42515 - DNA, 1474 bp, Homo sapiens
ccaggacaggaaaattcccagcagggaaacggcctgtctgtaatgcagacacattgggtcataggtttgctttcacagaataagtgaaatggaacaaaagtcttttttgaattctcattccaagaggcccagtttctgcaggtgtgtcttttcgatcttaccttgtattcagtattatttcaagcaatctccattttaggcagtgtctactccagaccaaaaaacctggctaagaaagaaattttgttgattttgagacagggtctttctctgtcgcccaggctggagtgcagtggtgtggtctcagctcactgcagcttcaacctcctgggcttcagcgatcctcccacctcagcctccctagcagctgagaccacagatgcctgccaccacacccggtgaatctttaaattatttgtagagacagggtttccctgtgttgccccaggctggtctcaaaccactcctgggctcaagtgatccccctgcgtcgacctcccaaagtactgggatcacaggcgtgagccaccgcaggcctcccagactctgggtcagagggcagcttgagctcctccaccgactgctccaagcctttgccccagctcttggtgcctggggtggtgggagcagcatgggcttcgctgcacacggacctgggcccagatcttggttccatcggctgctgggagatcagttcccttctctgcacctccattcagcttggacgggaatctgtccttcctagaacagctgtgattaataactgagaccacacccatgttcgttgtggcttagcgccatgcacacaggtacctagtggatgttaactttcctctccatcctggtcagtgctttttttttttttttttttttttttactttttctttttctgtttttgagatggagtctcgctctgtcacccaggctggagtgctgtggtgcaatcttggctcactgcaacctccacctccctggtgcaagagattctcctgcttcagcctcctgagtagctgggattacaggtgcccgccaccatgcctggctaatttttgtatttttagtagagacgggttttcaccatgttggccaggttggtcttgaactcctgagctcaagtgatccacccgccgtggcctcccaaagttctgggattacaggtgtgagccactgcacccggcctctggtcagtgcttctgttgagttcaagaaaaatgaccaattcatctaaaaccccgagctggcagatgctctcccgcgcggcggcggctgacgtcagtgctactttcagcgtctttggtgcagtcttggtgttcgctctcaaatgggctcttttcagtatcacatatcatatgcaggatgcagaggggcccggcttacataccgagagtcagaggactcatgcggccacaagtaggttgggaacagtgtcccctaataggatgagttttgggctttaaaatttaaaaaaaaaaa

SEQ ID NO: 42516 - DNA, 1907 bp, Homo sapiens
cgggccacccagggagcaggtgggcacacccaggttgcatctgtcgccacactggtgcaggccgtgttgcacatcactgctgccgggttgaccccacttggtatgaaatgagagggcctcttttctgaagcaaggtgttgcaatttagcctggggatgaagctgcttcttccaatacccagagttaacaccaaatgccacgagagtgagaaaataagacagcattgcactttcccagaaattgtcaccccagggtgccaccccacctcccaagcccactctgggactccttccacacacagtcacccactggttaccaagcctgcggggcaggtgctaggtgcgtgctgggagtcaggggtggatgaggtcttttgcagacagggcagagcgacctcagggcagagccatgagggcctgtgtgcagcggcttccacccaggcaggctccggctctgcaccttcagctacaggatacacttgctttcgacacctccactgtcatttagacacaaagcacaccaccaccgaaaccactccacagaatgtagagtttcttgccaggaaaataaaataaattaaaagtcactaatacttttatttaaattgcgagtacatttcctcgctgttgcattttgtaatttatacctgggagttaatttattgttatttacagttgcacaaggactcatggaaatgccttgtgtatcgagtgttctcattatgctgggcacggtcccaggtgccggggaggcaggtcatagtcctggcctcgtggagctgatgttctgaacgagagttgagtacccagtgggacatcctgagagcccaatgcaggtcctggtcagggctgtggggactgtggggaagacctggatggcaagaggagtagggacaagatctacaggattctgcatgcagggctgcaggccaagagggaggagttgggggttctagtccgctaggttcagggagccagacgtgtctgctgtcccaaacctcctgtgctcaggaacgtggttctgatgagcctgtatcaccttcccttccctccacctatgggtctgagtggcaggaagagttctagctgtgtcagccaaggccggggacaccagaggcacagggcttggtttaggagtcaagacaaggcatttgcttatttaaagaatgagttctatgcacttccaatgagtggttctgtggtcaggagggcggcacctggagagaggtcaaggtagaattgtggatttggaagggtggaggatggaaggccccagaggaaaccagcagtcagggactgaggaggtgatggcattctctagtgtgatgtgtggacagacagagtagaagaaccaaaaccagtcttggagcgacaggtgggtcagacggcagctttctctggacccgggtcaggaagagaagggtttccagcaggagggaagattgcgcttaggaagagaagggtttgctgggctcgatggctcacgcctgtaatcccagcactttggcaggccaaggcatgtggatcacctgaggtcaggagttcattttgagaccaacctggccaacgtggtgaaaccctgtctctactaaaaatacaaaaattagcccagcgtggtggtgtgcgtctgtaattccagctacttgggaggctgaggcaggagaatcacttgaacctgggaggtggaggttgcagtgagccaggatcgtgccactgcactcaagtctgtgtgacaagagcgagactccgtctcaaaaaaaaaaaaaaaaaaaaagagagaagggtttccagcaggagggtcagtggcggtgaagcttgcagctggcaaatgttgggttggatttggggtggggagtgaggccaggagctggtggaggggggcagaggaaggaaagatcactcactgct

SEQ ID NO: 42517 - DNA, 1137 bp, Homo sapiens
aaagccacaggaggcatagacttgctcagagaattcatactcagttcagcagactccagtattgatgctcaacccatgctgctgctggggagggctcaggggacaatgttaagtgagaccaaggaggtggcacccctgaaccagtctctccgtgagctcggcggtgagaaaacagtgcacagggagaggagccacagaaggcccgggatgtgtcacccagggtttcagctgggaggggacaaagccgatttgggtgggagagtggaagtaggtcccaagaacttttattttaaatgttttgatgacagatttaaaacttgagtaacttcattgtaaaatggccaggcgtggtggctcacacttgcaatcccagcactttaggaggctgaggcgggaggatcccttgagcccaggagttgggagaccggccttggcaacatagtgagtgagaccctgtcttgacaaaaaattaaagaattagccaagtgtggtgacatgtgcctgtagtctcagccacttgggaggctgaggcaggaggattgcttgcacccaggagctcgaggctgcagtgagccgtgatcatgccactgcactccagcctgagcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaagtgcacaatacagtctctaaaattaaagaaaagaaagatttatttccaaaaaagcccacagtgaaataattgtctcagtctgtggagagagctaatttggacagaatcacatattttgattcctgggatttttttaaaaggaatcttttaaagcagtaaatgaaatatttttggatgtagacaaaaatgacttacttagccattccactggcaatgtggaaaggatgaagaccaattttgagttagcaaggacaccttcagaaagttcagctcccaggaattgttgaccctagccatccatgtc

SEQ ID NO: 42518 - DNA, 1026 bp, Homo sapiens
ggcaccactgcactccagcctggacaacagagcaagaccccgtctcaaaaaagcaaattctcaaagaggccttaatataccttttttaatcataagctttaagagcctggtcatgcaaagataattcagtgagatgaaagattgtttatttcctactgtgcattggtcacaactttgattccacagaagggcagtgtgctgtcctaacagagctgagtgtgtggagtcttaagagcttcctccctctcagcaaatgtgtattaaatgtttctgctttgccagttccagtgccagtgccctgtgattagaaggtgagcttcaccgaggcctcctggtgttgtggagagggagccccgggaatggctggatgcagaaggtgaaggttgagatgcaggagagggagcagttagccttctggcttgggctgtggtgggtggtgccctccatgagattccaaaaaggactagtttggggaggaatgaaattggcatttggagagtgtaagatactagtggagtctccaagcagagctgcccaggagacaggctggccatgaggagagtagcattcacctggatatagatttgggagccactcaccgggagagagattccatctgtgtgtccctgggcagcgtgatcatgggaatactgcttaacctcaaatccttggctttctctgtaaagtaaatgtaataagatctccacagggtttgctgtgagggttgaacgagctcagtgcacatgaaaatgccctatacactcgaaaccagctataaatattggttattattgttaggatgctgacgttcaaatataaattgccaaaatcatttgggaagcattgcatactccattcccacatggagagttgcagggcatgtgattatctgtttgttcatttagtcacaatattgatcaatatagaacaaagcagtatattttaaaaatcaaccaggagcagccattctttgaagtgttatgcaaccattaaaaattaggtttggccaggcgcggtggctcaagc

SEQ ID NO: 42519 - DNA, 1192 bp, Homo sapiens
agaagtcaagaggaaaggaagctagctttgctttatttcaagtttctcattcttttttgccgtcattcttttttgatcacaaaatgcccacctgtgctctagaaaccacgcctccattggacaggctttgggagtactggctccagtgatttgggtggttttgcactgatttctcatccagcaagcaaacctcaacaccttcagactgtccccagcaaccagaatattatcgtttcagagtttcgagggaccatagctgtcagcctgtctgtccaccctgcctggcgctggccttaattggaggatggttgcatttggaccagagcagaggcagatatctcattcctccaatgaaatacgagggcttgtgcaacaggcttcttatctcatctccacctgatcccaggagcctgattcctttccagggagcagcagatgagacttttctctttccaacaccagtgtgtgtgagcgagtgaatgagtagggtttaatggtgattaaaggcgtggtcttcattttgacaccttttgttctataacaagcctgacaaccatgaacctacttcttgccagacagaaaagtcattcccgtgccttgcccctgagcctcctcggaaatggcagagctgcacatgaggaattatgcttcctcgaacagcaacatatgagtcgtgcctcttccctaacaccgctttgcagtttgtgactataatctaatgaatccagctgacgttgatcaggtccttggtgtgggcgaggcactgtgcggcggggagggggcttccttcctttgttcctccctagtgcaaagcagtgggtatcacagacgaaactcacaagccacaaagaggttcccaggtcgagctggcctttgtgcccatgacgtctccctcccagacctgttctccttccaccatccttggttcccagtcagggcatggtggtgggggaagggcagggtcagcagggcatatggcctggccctgtcctgcagtggggttgactgcggtactgctccagaaaaatggactttgttgccagcgttaaaaaatgatgacttggccaggcgcggtggctcacgcctgtaatcccagcactttgggaggccgaggtgggcggatcacgaggtcaggagatcgagaccatcctggctaacacagtgaaaccctgtctctactaaaaatacaaaa

SEQ ID NO: 42520 - DNA, 1045 bp, Homo sapiens
ctgatcaggtgcacagcctaggggatcctctgggccgagcggacctgccagggaagctctcaagtggtctggatagaacaagcagggggcttctgcaacaagccggcctagctccaggacacccccatccaagagggatttgacagatccatcccagccccataacttggttcctttgcagagggatcatttggaatttttttattttattttattttattttattttggtgagatggagtctcactctgttgcccaggctggagtttagtggcgcaatctcggcttactgcaacctccacctcccgggtttgaatgattctcttgcctcagcctcctgagtagctgggattacaggtgccctccacttatgcccaggtaatttttgtatttttagtagagatggggtttcaccatgttggccaggctggtcttgaactcctgacctcaggctatccacccgcctcagcctcccaaagtgctgggattacaggcgtgagccaccgcgcccggccagaaatctttttccatttgccacacttgtgacttagccaagtgtctttttcaaagactaataaagccttcacagcttccgaaacaccgcgctagatctggtagccgcggacaatttggattccttctccagtgggaaagattcaaaactgcaggtttcagaagcctttaaaagcttcttgtctgtgtgatgttcattgaatgcaaattctttcgcaaataatggcctgcaactgctttaaagaaataaactcatcttgctgagcccgggcatgtatgcgtcaatggtgaaaaactgcaaacacacattctgttagcagaatcgtttaattaaaccacattcttgaaatggtctgcactataggaagggatgttgtgtgcaccacactttctaaaaagatatgtaaaaggtccccagaaacatataatcagaatttatcctagacaagtaatttcctctccccatgtctgtgtcctcatctgtaaaatgaggtagtggggccaggacgtctgtaaggtccttgtagtgatgc

SEQ ID NO: 42521 - DNA, 1048 bp, Homo sapiens
agattgtcgtgggacaatgtagataaaaacctcgatatacagcctagtacacaaaggacggtgtaaatattctcttccgtgcttcgtagatttcatttttgaacgctcagattgttctccggcaaaaaaaaaaaaaaaaaaaagtgcttgcagtgagaacctgccctgcactctcaggcgagctgttgggtgcaagtcctgcaggactgagctctgaaggccacccacaccctgggttgtgcttggatgatggcatccctcctggcacaagcgcagatgggcagtcgggagggaacatcagcctgggaaaactagatgtcagtgaaaaatgctggaggtggctggcgttcgcaaaactcagtcgtaaaaaacagcacgttctcagtacaaaatgagcactgttaaaaataaaccgcgcaagaagaaatatatgaatacgagggcatggcaaacagttttgcaaggtattaagatcgcattaatcttaattttattatatattaaagtttctaacttttcaaataatgcagttttcgttgttttaaaacgtctgagaattatagagctatttggtgtggctctcaggcaaggactcctgccatttattggggccctggttttatttaatagccagatgaatggaatagttaataaaagaaatattgctttattccctgacatttatgtccttggtttccaataaagaattgaaattatgaatagttgatggtttaaattgatgttttatgttgaacgctagctataatttgccctctgaggattgtaataccgagaaacagatggtttctcacagtaacaaattgctatgtgtatacacgctatagtcttggctttcagatactttcacctttggttctgagctgctctgcagacgggagaggggggtcgtgcggggagatcagcctctggaggaaggggtttcctgccctgtgggggagacacagacaggccctgggggttcagggaaactggggaaatgtagctagcctggcatggtgtcagtacctggggccaagaggagcgttct

SEQ ID NO: 42522 - DNA, 1032 bp, Homo sapiens
ggtggtatctggttccacgtgtccccaatggcacctcgcctggaacgatgtctgcgccgaccagtgataacaatcgaaatagcaggcgtggctgaccgtgtgccgaggctcggcgtgccgcactggccagccgtgatttcatctcagcctctagcatcctgctggggtaggttaataatccctggatttctcagatgggaaatgttaggaaagtctgtaagcccccatggaaggtcccggagcccaaattcaaacccgagtggagcgttctgttgcttcactgtgctctggtgtgaattttaatgtaaggccctggcatttaagagctcgaagacaccatggaggtggagagctcagccctgtcattggatggaagctgagactggtgagattctcaccggggcttttgcagggagtttgggggaattttgaaggtggtacaggtgttctgaccccaacaccatctcctccagctgggccacacacttatttcctgctcctacccccgtccttcccaccccttggattctgggtgtacagaagagtgggcacatgctaaggtcagccctgggttagcctcatggacaaggtgggcctggagcaggaacccgcctgatagaagacactcaaagtctgtccgtacacgctcggtgtgggcatcgcttgcacgcaggtgcagcttttgctgtgggaaaccactttaaatgaattgatagcctcaccacagtggagccatggcccgactgtggagagactccattgtagagaaatatttgagtgaaaggtttcatgtcagaatagcatctgcatgcaaataagaggcatgggcgggtgcagtggctcacacctgtaattccagctacttgagaggcagaggcaagatgatctcttgaacccgggattttgagaccagcctggacaacatggtaagaccccatctcttaaggaaaaaaaaaaggtttaaattagctgggcgtggtagtccccgtagatgaagttatttgggaagctgaggcaaaaggattgcttgag

SEQ ID NO: 42523 - DNA, 1137 bp, Homo sapiens
gggcagcatagcggatgagttctgggacaccagctaaaatgtgggcaagagaagccagggcgcgtagcagatgtgtgtgtgtatctttatgggattcaagtcatgtctctgttttgttgaccaacttccgctagaattcatagccatctagcctatgtattggatttttatttctgtgatgtctgcttcttttaaaaatatcagttggggccgggtgtggtggctcatgcctgtaatcacagcactttgggtgaccgaggggggtggatcacttgaggtcaggagttccagacccacctggccaatatggccaaaccctgtctctactaaaaataccaaaattagctggacgtggtggtgtgcacctgtaatcccagctactcgggaggctgaggcaggagaatcacttgaacccgggaggcagaggttgcagtgagctgagatcgcgccactgcacttcagcctggggaacagagtgagacttcatctcaaaaaaaaaaaaaaaaaaatcagttagtagccaggcaccatgcacacacctatagtcccagccactcaggaggctggaggatcacttgagttcaggagttcaagaccagtctgggcaacatagcaagacctcatctctacaaaaaataaaaaattagcagggcatggtggcacatgcctggagtcccagctccttgggggaggcaggagcatctcttgagcccaggagtccgagaccaacttgggcaacatagtgagattccgtttcaaaaatatgtatcagtaggttaatctagactttgtttacatgggccaagtggccaaggtcacatcttagagttgtggactgtataatcaggtaagtgtggctacagtcacagaaagtcagggtagaaagaggcttggaggggggtgcacttcttctagccagagctttcctactgagctccttaaagcacaggggaaagtgggacggggttggggggcaacctaaaacccaccccctcccatcttcaaccagtgcgaccctgtttttacctgctcagcagtattgtgcatccctgtaaaattttatttgaaaatggccttctgcagttaaaactacaaaaaaaggttgaaagtggccaacttaaactccactctgtttct

SEQ ID NO: 42524 - DNA, 1078 bp, Homo sapiens
tgcagtgagccgaggttgcaccattgcactccagcctgggtgacagagtgtgactccgtctcaaaaataaataaataaataaataaataagataacaaggcgtgctggagatggccacaggcctccagcagccgcaccatcagagaaatggagtcagagagagctgcagctgctctgatggggggtgggagtatgcaggatcctctgggggtggctcaggcctcccaggggagcacttaccttttcatttcatagtatgtcggagctgctgatgcaggaataaagcaaagtgcctggcactctgcgcgactgctattttttcattcattcatatatttgtccttcctctacacatgtatggcagattaacaaaagcacctccacggcctagctatgtggcccccacgggtttcttagcctctctgagcaagttggacagggctgccttttcctctccctaactctgacttctgtcccagcctcttccatctaatgtcagccctcatccctgcctgcccctcccggtgcagactgggacattctcaggctgtttgagccaccccttcatcctctgtgcttttccctggcatcctggactcccttctccccttcatggtgctcctaggccattcccagcgctcctgttactctctctgtcctcccagccccaaacccgtccagctctgtatccatctgcctggctgccattcatgctgcagacgtagcactcccagagcccatctgtctccacacattgaggcttccagccccctaaccccggtagtggccacagtgcccagtgggccaccccagccaagcccaagagtggccacatgggagcccttcttccatctccctcccctcatccacacattaccaagtcttgccaatttcatctcctgaggacctcagcttctgtcattctctccccattatactgcagttgccaccgttatttctctcctagaccttggctggcattacttggacattcatttctttggaatctcttggccagctttgcacacctttaactagactaagaagatttgaggccaggggcagtagctcatgcctc

SEQ ID NO: 42525 - DNA, 1021 bp, Homo sapiens
aaggcaggaggatcacctgaggtcaggagctcaagaccagcctggccaacatggcgaaaccccgtctctataaaagtacaaaaattagctaggcgtggtagcaggcaactgtaatcccagttactcagaaggctgaggcaggagaatcccttgaatccgggcggcggaggttgtagtgagccaagatcgcaccattgcactccagcctgggtgacaagagcaaaactctatctcaaaaaaaaaaagagagagagagagagaccctagtttagctcttttggaaagcagctgccctgcattgagacacatgtgtcttaagcttgcttctggacgctagcactaaaatagcaatcggactctggatgcctctcacaggcaacttgtccacaaaaccacttccaaatgttttcccaagtgcatgcgtctgacccaggcttctttctcatccgcctcttgtggaaggaagatcgcatcttgagttctaaagatttttaaacaatctcatacctgcagagcaatgtatatttcaagaccattgacattggaaaacattcttgtttaatcaatgactctggtcctgctttagatttctccaaaaatagccagatcccgtgggcacgttgaagctgcagcccattgtgcagaattgcttaatgtgtacctcacctggttttggccttcacacaactgttgctcccttagcaaggggttcatttggttgggttttatgtgcaggaatgctggtgggttgggtgagtattagtatttaagggaaggttttgtttttgttttgttttgtttgtaagagctagggtctcactttgtcacccaggctggagtgcagtggtgcgatcatagctcactgcaacctcaaactcttgggctcaggtgatcctcccacctcaccctccctgagtagatgggactatagggtgtgcatcaccatgccaggctaatactgtttatttgtatttttgtagaggtggggtatcgctttgttgcccaggctggtcttgaactc

SEQ ID NO: 42526 - DNA, 1027 bp, Homo sapiens
tcgaactcctgacctcaagtgatcctcccgccttggcctcccaaagtgttgagattccaggcatgaaccactgcacccaacctgtagcctctttctacaagtaaaataattcaggtgagttcaggcccacgccaggtcttaaaccctggccctctgcccatcttccagcctccaccccttctctctccttacagaatcttctgttcttctgcacaccagcgtggcagacaggttggccaagggccttggacttctttatctctagtacatgttcctgtaaatttaaacctcctcagttgggtaaaagctttggaattactaacattccttttgtgctgcctaacgttcttgccatttaaaagattagcaggcataatttcagtgagccttcgtgactggcgtgcctcacttagcttaatccctggttggtacatgttaaaacctataaagacagcctctccagcacacatggggagcttgaaaatgaaagaaaggttgctctgacctctcagaactgcggacttcttaaaaaagaaagagtgaggtgggcggcctcccttgctgccggtgctagattccatgatatgaaacagcaagggtgcagctgggtgcggtggctcatgcctgtaatcccagcacttcggaggcgggggtgggcagatcacctgaggtcaggagttcgagaccagcctggccaacatggtgaaaccccgtctctactaaataatacaaaaattagccaggcatggtggtgagtgcctgtagccccagctactcaggaggctgaagcaggagaatcacttgaacccagaggtggaggttgcagtgagctgagatcacgccactgtactccagcctgggcaacagaacaagaagactctgtctcaaaaaaaaaaaaaaaaaaaaactgacttggatatgtgcttacataagaaagggagattcaccaagtgaaccatgcatagcatctcttaaatctgtatcatggaattcgtgattgggcctctctttcatatcaggcaacata

SEQ ID NO: 42527 - DNA, 1060 bp, Homo sapiens
cccagaaggcagaggttgcagtgagctgagatcttgccactgcactccagattaggcgacagagcgagactccatctcaaaaaaaaagaagaggcagctaaaatacagtgcagtggcccaggtccatttcagatagaaacagccaggcaaaccccccattctagtctattttattctaagcagattatctcacttagactgacatcagcaaaagctttagtctgtagcacattcaaaatgaggtatatgtgaccaggagttagtagaaataaaacatcgttgtaggccaggtgcggtggctcacacctgtaatcccagcactttgggatgctagggtgggcacatctcttaagcccaggagtttgaccctcgcctggacgacatgatgaaaccctgtctctacaaaaaaatacaaaaattaaccaggcatggtggcgtacgcctgtagtctcagctacttggtaggctgaggtgggaggatgactctagcccaggaggcagaggttgcagtgagccagggttgtgccactgtgctccagcctggtcaacagaatgagactctgtcttcaacaacaagaacaacaaagaaccacctcgttgtattcttaaataagtttaaatcctgaagcgccagttggcgttattgatgttttaggagtgcaggaatgggtgaggtcccaggcttgctttagatagtgataattagcactgactgccacgctgtttttaggaggccttaaccaatgtttcccttctttctccttctcaaatggctgcttcctgacctccgcctcctgctccaggatttgcgcaagcaggtagcgccgctgctgaagagtttccaaggagaggtaagcttttctattcattttctatcctgagccacccttcgtggctaattggtctttttattcacattaaagaaatgctccgggcaaaaggtgctgcccagatggtgccttcccggctgctccgacccagcgtcatgcagattttgcgctctgtgatgtaattttccattgggtccttggtgaaagccctcctggaaaaggaagctatg

SEQ ID NO: 42528 - DNA, 1923 bp, Homo sapiens
cctcttaagaaataacttgagtgctcgtattagagaataaatgaaaaacaatctatgaactaagcatcggctttataaaattacagtaggctggtatgatggctcacgcctgtagtcccagcactttgggaggccaagccaggaggatcatctgaggccaggagtttgagaccagcctggcctaacctagcaagactccatctcaattaaataaataaacaaacaaataaatgtacaacagaataagttcaaatagaatgaaagaaatgacaaatataataataaacataagaatagaaatgaatgaaaaaaacaaagagccaggagagaaacattgcaaaagtcatttatttgaaaataccactgcaactgacaaaccactgtactcatcaagacaaaaaatgttaggaataaaattggggatgacattgcagctgctgcagagattaaaaagataaagggaatgttataagcaactttctgccaataaatactgaagtcgaaaaagttccaaaattctgtaactaccaaaattgattaaagaagaaacagacaacttgaatagctttgtaactattactgaaatatttccataaggtctagacagtttccaagagagttttatcaatcattcatgaaatagagagttctcatacttagcagactccttcagaaaatagaaagagcgagcacttcttaactccttttatgaggctaatataaccttgataccaaaacaagacaagaacagtacaagaaaggaaaattaaaagtcagtcttattggccacgcatggtggcttacgtctctaatctcagcactttgggaggctgaggcaggcagatcactcgaggttgggagatcgagaccagcctggccaacatggtgcaaccccatctctactaaaaatataaaaattagccgggagtggtggcaggcacctgtaatcccggctacttgggaggctgaggcaggagaatcgcttaaacccagcaggcggaggttgcggtgagctgagatcatgccactggactccagcccaggtgacagagcgagactccatctcaaaaaaaaaaaaaaaaaaaaaagtcagtcttattattgaataaatacacagaagtcttttcaaaggtattagtaaattaagtccatcaagcttggtatatcccaagaaggctgttttgtttaaaatgttcaaaacttattaacataaatccatgtcattagcagattaaaggaggaaacaatttcagtagttatatgaaaagattttgataaaatttaaatccattcatgattaaaaactaccaacaggctaggcatggtggtcaggagtttgagaccagcctggacaatgtggtggaaccctgtctctactaaaaatacaaaaacaggccgggcactgtggctcacacctgtaatcccagcactttgggaggccgaggtgggcggatcacaagttcaggagatcgagaccatcctggccaacatggtgaaaccccagctctactaaaaatacaaaaattagctggacgtggtggcatatgcccgtaatcctagctactcagaaggctgaggcaggagaatcacttgaaccagtgagtcagaggttgcagtgagccgggatcgtgccactgcactccagcctggtgacagagagagactccgtctcaaaaaaaaaaaaaaaaatacaaaaacaaaaaattagctgggtgtggtgggtgcaggcctgtacacctagctatgcaggaggctgaagcaggagaatcacttgaacccaggaggcagaggttacagtgagccgagatcgcgccaccgcactctagcctgggcaacagatcaagattccatctcaaaaacaaacaaacaaacaaaaaaccctactaacaaactaggaatagagggaaacatcttaggaataga

SEQ ID NO: 42529 - DNA, 1084 bp, Homo sapiens
agccaccgagcccggccccagcaagaatcttaatgaaacttttgaaaagctgattccagaatttttatacatatgcaagaacaaatggtaaataatagtgaagataatactgaaccactccaagttagaggaattgccctaccagattattaaagctgcagtagttggcagagaatgagataaataaaccaaaggaacacaataaagaaatcagaatctggccgagcgcgttggctcttacccgtaatcccagcactttgggaggccaaggcaggaggatcacttgaggtcaggagttccatacaccagcctgaccaatatggtgaaacttcgtctctactaaaaatacaaaaatcagcctggtgtggtcacgtgctcctgtagtcccagctacttgaaaggctgaggcaggagaattgcttgaacccgggaagcagaggtagcagtgagccgagattgtgccactgcagtccagcctggcccacagagtgagactccatctcaaaaaaacaagcaaacaaacaaaaaaaaaaaaaaacaccggaatctggcctatgcatatatatagaagctgaataaattgcaaagatggtatggatcagtgaggaaaggggggacttttcatggtcctctgacgattggcaaatccttatagattaaacgaagttgagaccgagtgcactggctgctatctgtaatcccagcactttgggaggctgaagcaagcagttcccttgagccctcgtgttagagactaacctgggcaacatggtgaaaccctgtctgtacaaaaacttacaaaaattagctgggtgtgatggcacacgcctgtagtcccagccacttggaaggctgaggtgggatgattgcttgagcccacaagttggagacttcagtgagctgttgatcgcgtgccactgcactacagcctggctgacagagcaagatcctgtctcaaacagacaggcaaacaattaactagagttggagccctaccttacaccgtgtggaaacacaaattacaaggagagtcttagatcaaagctttaaactttatagaataaaatataaaagatgatgactt

SEQ ID NO: 42530 - DNA, 1029 bp, Homo sapiens
gtgagtgccagggctctgcagggatgggcttgcctggcagggagcaataccaaggaagttagtagggcccgggtcatgccagggccttgtaggcagaacccttaagtctctttgtagggaccctttggtctcccctttgaactaggccctttcaaagacgtacagtagaaagcaaattccccatgggcaccggcaggatgatttgacagattctaatcaaataattggggaaataaagttgggtgaactacagcagtctatgaatgagttaaaagtgactacgagtctgctgcccatcttgcagcccatatctgttgagctgtaacatatttaagcattcagatctaaaggccattgctaaataaagccagggcgtccatgtggttcgctccaaagagcatttcacagggagccagtccaggcgctgccgcccaccacctctgtgaccttgggtgagtctcggggcctctttctgcccgactttgctcatctgtaaaacgagtgggttacccagatcctcccccaaggagctccgtagctctgaaacctcatgagactcactggagcagtactttggttgactatcgctagcagaaccgaaaaggacattctccagcaatgtaaatctgttcaaaaatgggatgagctggctgggcacagtggctcatgcctgtaataccagcactttgggaggctgaggcgggtggatcacaaggtcaggagttcaagaccagcctggccaacatagtgaaaccctgtctctactaaaaatacaaaaaaaaaacaaaaataaaaaaattagccaggcatggtggtggcaccagctacttgggaggttgaaacaggagaattgcttggacgaccacctgccagggagattgtcacctcttatccattctttttttttttttttttttttttttttgaaatagagtctctctgtgtcacccaggctggagtgcagtggctcaccataatctctgcttcctgggttcaagcgattctcctgccttagcctcctgagtagct

SEQ ID NO: 42531 - DNA, 1032 bp, Homo sapiens
tcctgcctcagcctcccgagtagctgggattacaggtgtgtgctaccacgcctggctaattttttgtatttttattagagatggagtttcactgtgttagccaggatggtctcgatctcctgacctcgtgatccgcccgccgcagcctcccaaagtgctgggattacaggcatgagccaccgcgcctagccgaaaggttcttttcaaaatatgactgctcattgacagtgcacctggtcaacaagagctctggtggagatgtacaagatgaatgttgtttccatgcctgctaacacaacctgcattctacagcacatggatcagggagtaattctgacactcaagtcttattttttaagaaatacattttgtaaggctatagctgccatagatggtgattcctctgatagatctaggcaaattaaatagaaatcctttccttctggaaaggagtcaccattttagattccatgaagaacatttgtgattcatgggagggggttgaaatagcaacatgaacaggagtttggaagaaatggattccaaccctcatggatgactttgaggggttcaaggcttcagtggaggaaggaactgcagatgcgggggaaatagcaagagaactagaattagaaatggagcctgaagatgtgactgaattgctgcaacctcatgatcaaacttgaatggatgaggggttgcttcttatgatgagcaaagaaagtggtttcttgagatggaaactactcttggtgaagatgctgtgaatattgttgaaatgacaacaaaggatttagaatattccataaactgagttgataaagcagtgactgggtttgagaggattgactcctattttttaagaagttctactgtgggtaaaaatctatcaaacagcaatgcatgatacacagaaatcttgtgttaacgaaagagtcaatcaagctagccaatttcattgttgccttaacaaattgccacagtcaccccaagcttcagtaaccacaaccctgatcagtctagcagccatcc

SEQ ID NO: 42532 - DNA, 1052 bp, Homo sapiens
accatgcacccttgtgcccctcaaaatctcaccccacttgattgtccagctgcgtcacccacagctcctgcatatgtatccgcgttcccacctggcagactctcgtgggtcccctatgccccatggtgtgttgtagccgtgttggtggactcttaatctggactccaggaatagagcacaagctgacatgcaaatgagtgtcttaaaacagaacacataggccagacgcagtggctcacgcctgtaatccccgcactttgggaggctgaggcgggcagatcacctgaggtcaggagtttgagaccagcctggccaacatgataaaacctcgtctctactaaaaatacaaaaattagtctggcatggtggtaggcacctgtaattccagctacttgggaggctgagggcaagaatcgcttgaacctgggaggcagaggttgcagtgagctgagatcgtgctactgcactccagtctgggcgacagagcaagactctgtctcaaaaaaaggagaattttatgaaattctttgctcctgggatttgaatgtgttcgtccgtttacatgcagcatcttacccgtccacctgggtgaaatgctttttaagactctgctctaaggtcacaactttactgcctgaagttcccttctgcatgtccccagggatttaattacttgttaattacatacctgtttccctcctagaccctgagcttctgggggtaggaactgtctcttcccacccacctctgatccccagcagtgtctagcacatggccagctcttaagtcagcatttggagaagacaaaagaccaggaagggcacgccagaccattctctatggaagacccacccagtgttccctgctgtatagtgaatggctccatactcccaaatctctgctcctcccttgtttaccttcatgaacagggtccttttgtgtttgcaggcatttcctctaagaggctgaagcccagttgtcaagcatctcccttgctacgggaattcactagatgtgtaatgctttgtaaattacctcttgacaaatgttga

SEQ ID NO: 42533 - DNA, 1111 bp, Homo sapiens
gcttctctgcaaacatctgattggttgcagaaagcaactaatcaaaggtactttcaatttcccatctgcagggcagaaaaggtggaggtttgcaaaggaagtagacgctggtccttttgttacttaggcgtggcaagtgggggtttttccttcgatttagttctaggaagtcagggtgaatcagcctttggttccctgcctgcagaccctattttcctgcctcaagagcactgtccctcgggcatcagcagcctggcgggcatcactggcattttcttgtgcataaggtagtgactgagaattttctctctggactatgtcatgtccatactgacgcagggataaagaatttacagaaaaagcatgacctgggctttgagaaattttattttgtgtttcgaaagagttcattctttgactttttgttggttcctcaggctcaggaaggttctgctccattctattccaagaagttcttgctaccacttctgggagcaggatcccagaaggggagtgttttccagctgagaactttgtccagttggtgatttagtcggaagaagactggcttacttcatctttgccagagacccaaagactgtttagctgctgttttctaaataatatgtaatctcttttctttcttttttttttttttttttttttttctgagacagagtcgcactctgtcaaagaggctggagtgcagtgacgtgatcttggctcactgcaaccttcgcctcccaggttcaagcaattctcctgcctcagcctcccacatagctgtgattacaggcacccatcacgacacccagctaatttttgtactttagtagagacggggtttcgccatgttggccaggctggtctcaaactcctgacctcaggtgatccgcctgcctcagcctcccaaagcgctaggattacaggcgtgagccaccatgcccagcctagctgctgttttctaaataacctataatctcttttcaaaaagtcaaatttgtacctcaatttttccctagtgaaattttccaactgggcagtcactttaaaacattgctaggtttctttctctgcagttacgttctgtgttaatttcccatagaaaaaa

SEQ ID NO: 42534 - DNA, 1043 bp, Homo sapiens
ctacagtctgcagttcacggtggcatgagtctaagtgcttacagggcggccagactcttcctggctaatcgccaccgacccctctggattaacctgttgagacgccacttcctgacagagaggtcttcctggcctccccagctggtttaggggacccttcccatgcacacacacaccctggccggggaccctgccattcacttcatcataattccttggtaactgtttggccgagagactggttcagtgcggttttgtccctatttcctttatatccaccccagtgcctgccatgtggcagaaactccataaatattgctaaatgaatgcagaaattaatgaatcaaattatttcttcaaaatgctgagtgtttttttggtctcaggctcctactgttcccactgaaccaccctcccgaggttgaagcttcccagtgagggcgagcactgcagagcactaagacaagtcaattgcaggagaacagaatgtatcttttattgagttgtagcagtttaatagctgtctgaactctcattttactttgttgtcattctataaagatttacatgcctgcatggacatttatacagcacttagcattcggagttgcccaaaccagcacatgtgcatctgaggacttcggctctggggccggcccttggtgtctgggatctgtgtttggtttaccagacgtcccgccggcgccccaagcccagcacacagggtaggatctccctccaccccagcttatcccccaccatccccacccgccccacttctcccttggtgttctggctcctccctcttcttcatcttccaccttctataatttccttcacattaaagacacaaaggccaggcatggtggttcacgcctgtaaccccagcactttgggaggccgaagcaggcagatcacctgagatcacgactttgcaactagcctggccacatggtgaaacctcgtctctactaaaaaaatacaagacattaggtgggcgtggtggtgggcacctgtaatcccagctacttgggaggctgtgg

SEQ ID NO: 42535 - DNA, 1011 bp, Homo sapiens
ccgtagactttcttgactccacttcgattgcttcttccaaaatgcacacactattatgaactattttttttctgagaaagtacttaaacccacctaaaactttattaatcatccctcagttacaggactaatttaagactcatcaataagatgatatgatattttaccattgatttccatctccccccacccttttttttctttaactggtactacagaaaccaaagctcttcttttcagcaaaatccattgatcctcctcagcctaaacgtttaaagttcaatttaacatttagggagtaaaaggtctctgaagggactcataaccattgattttgtgtcagagttgaagagctaaggtttaaaacacaccgatcctaccaggttatgagagccttgtacctacagccatatggaattgtatgcttctcttactgtaggtttttttttttcttttctgcagaggttacgataaaagcacttaaagagaaaatccgagaatatgaacagacactgaagaaccaagccgaaaccatagctcttgagaaggaacagaagttacagaatgactttgcagaaaaggagaggtgagcatgacttccaggcacacacagactgacatagcatttgcccctgaacttcacatcatcagacatgttgataaatggatctgcaaaataagcccaggttgtaaccccaaatctataaggggtaaaatgtttcaaaaatgatattctggctgggtgtggtggctcacgcctgtaatctcagcactttgggaggccgaggtgggtggatcatgaggtcaggagttcgagaccagcatgaccaacatggtgaaaccccgtctctactaaaaaatacaaaaaaaaattagccaggcatggtggcgcacgtctgtaatcccagctacttaggctgaggcaggagactcacttgaacccgggaggcagaggttgcagtgagccgagatcgcgccactgcactccagcctgggcaacagagtgagact

SEQ ID NO: 42536 - DNA, 1021 bp, Homo sapiens
gtgtgcatgaagggagagagactcactcggttagatgataggcatggctcagagataatagattcattcattgattcaacagacattcacagaggcttcctctgtgcctcgccctgtgcaaattctgagactgttacggctccatggggagacaggccattgcaatccagcatgcccagtgctgcaatcaaggggacagggcgctgacggtcagcaggtcagacagggagcctgcaggtggcaggcagggcactcccattgggatagtcagaagaaagtttggcagggtgcagtgactcacgcctgtaatcccagcactttgggaggccgaggcaggtggatcacctgaggtcaggtgttcgagaccagcctggccaacatggcaaaaccccatctctactaaaaatataaaaatcagctgggcatggtggcgtgcgcctgtaaccccagctactgaggtggctgaggcaggagaatcgcttgaactctggaggcagagattgcaatgagccgagatagcaccactgcaccccagcctgggctacagagccagactccatcgcaaaaaaaaaaaaaaaaaaaaaaggtcaatattgggcctatttgcagaggtgcagttcctaggctcatagtaccggcagggtttccacgcctgggtttgaatgagccagagcggggaaaggtagctagagactgaaggtgagggccccctcgaggggagccgtggccttggggagggaagagggacccagggcagcgccagggaccccttaactgatcccctctctcctcccaccagccaggggagctggggaagggcatagtacatccctagcatcaggggagcgcagggaaagaattgtcgaggaagccttcctaaagagggtggtatgggattcgggattggaagatgagtcaagtcaggttttgcagaggtttgtgaagatgcaagcctggcgaagcctgtcttggggaggacctgccagaggttccgaacgatttgcctgtggggtaggatggg

SEQ ID NO: 42537 - DNA, 1025 bp, Homo sapiens
gggattacaggcgtgagccactgcacccagcatgctaggtggttttgaagaggcaggaatgggatgtgtgtgtatagcacctggcatggtgagagtctgaggctaagctgtcgagagatagaagctattcccagcaagctcagagcagggcgtggtatgcgtttctgaaattaacggccttggaggaaattgactttcaccgcatcaccacgacggactgggcccacattgtctgtctgtcgtggggagatgtcacagggtacccatccctctcccgttttggagagaagcccgcaggtctgtggtactgaggctgctccgagaccccggtttatcgtgagcagtcatcgccatgcgtcagctgggacagcacgggctgactgtggcagacaacggcagtaaagttttccatgtgtaggcttgaagcaaaatgtaattagcctttatgtgcagaacaagggcccattgatgaatacagctggtctttgttttgtcctgtcgttgagagtgggaggtaaaagtgttcttcttcatgtttattaatgcaagattccttagacaaatggcaagcacagtttaatatttgttggaacatgggggctttgccaaaacagttgttgtgtaagaggattgcaaggtttccgattataaccatttctgggttaaataaatgaattatttctgccctttttttcttttttgaaatttttttagagtcagggtctcactgtgttgcccagagtggtctcaaactcctggcctcaggtgatcctcccgtcttagcctctcaaagtgctgggattacaggcatgagccactacgcctgacattcttttttctttagttaaaaacatagctccttctcagatggtcaccctgtgtacggatcttcccgcttctcttagcaaatggagatttaccaccctaatagccttaaccttggagactctagcaaaggaacgtgctgtggattttaacatctaaacaattccttgggatggatggccgtggaggtggcagatccc

SEQ ID NO: 42538 - DNA, 1066 bp, Homo sapiens
ccaaagaaaggaaatggctgtgttgcaggcatacctgcactcacacgtttatcacagcgctgttcacacagcagcctaggtgaggaagtgacctatgtgcccagcttcagatgaatggatgaagaaaatgtgtagatccacagtggaatatgatggagccttacaaaaggaaatcctgccatttgcaacaacaacgtggattcatctgggggatgttacattaagtgaaatgaaccaggcacagaaagacgaataccacaagatctcactcatgtaaaacgttgatcacataaaagttaagaagaatggtggttaccagggggtgaggagaggttggttaaatgatacatatttataggtagacaggaggaataagtttgagagatgtattagacagtgactatagttaatgccggtatattgtaaaattggttagtagaaattttttttttttttttgagacagagtctcccctctgttgcccaggctggagtgcagtggcatgatctcggctcactgcaacctccgcctcctgggttcaagcaatttttatgtctcagcctcccaagtatctgggagtacaggcacagggcaccacgcccagctaatttttgtatttttaacagagacagggtttcgccatgttggccaggctggtctcgatctcctgacctcaggtgatctgcccacctcagccttctaaagtgctggatttacaggcatgagccaccgcgtctggccccattttttaagtgttgactgaaaactacctcaaaagaccggctttatcccacactctgtacaccacaggcttagcacgtcgtggctctccaggaactcttgagccttccccatgatgatgagtgggtcagggttaccgcagagctgaacggcctctgtagcgttcagcctgcagcctgcccaatgaggacgtttgcgctctggaaaggtaaactcaggatgctgttggctcctaagcagaaagcaggcgccacccagccttcaagtgcttcaacagtgaagagttaggacggaggcccagcctggaacattcacgccaccttct

SEQ ID NO: 42539 - DNA, 1028 bp, Homo sapiens
gtttttttttttacctgacatgttgtaaatatttcttgcttatcattaaatattcttcagaaacacagtgcatactgcataacattccatcacgtaggtgagccctaagacttaccacttatttccctgctgttcaggagcctgatttattacactgctttcattgccctttggggtttaatctggggagctttgtccctgttctttctatgccttcatgttctgccagtggctgtggcatctttttcgtgttttttgtttgtttgtttgtttgttttgttttgtttgagacggagtcctgctctgtcacccaggctggagtgccgtggcatgatctcggctcactgcaacctccacctcccagatttaagcgattcttctgcctcggcctcctgagtagctgggactacaggtgtgtgccaccacgcccagtgaatttttgtatttttagtagagacagggtttcgccagttggccaagctggtctgacctcaggtgatcggcccacttcagcctccagaagggctgggattacaggcgtgagccaccacgcccagccggctgtggcatcttgaggtagcctcccaaggccatcatcagacaagagcgtttggaagcccagaattctccaagggctcatggcagtactggcacggggcctctgttcctagactgctgctccatgacgtttgtagatgcctctagtgaaaagtcagggacagtggatgatatgcacggctcagagaccctgactctggtcccatctgtccccaggtgtgaccccacaaagcccctccctcggccgcagcaccggattgggccgggtgccaggcaggacggaggagctggcccttttgtcagcctcttgcactttcttgcccagttctacttcccagagacctggatctcggatgctgtcccccagcagggcctgtttgtggagtggccttcaggcagggctgcatccagggcaccgggcacagcatgagtcacggtgggaagaacctgggtcgcaacatcgtaaagac

SEQ ID NO: 42540 - DNA, 1041 bp, Homo sapiens
ccttgggtgtggttcatggtaggtgccccatgggcgttattggtgggagacctccctgtctcagtctgagctgggcccatcgccatcagggcacgacagccacagcaggtgcctttgctgggagtaatcttgccctggctcgcatgagactgcagaccagcccttctccgtaagttcaggcgtttgtgctccgatcagcttttcctataggtttgtcccccaccccttgcccaactctttgaccccccgagttaaggggattccagacctagagccaagtgaccttcctcagagcctggccctgtctccaccgcttcagcaacctgctctttctggacagggtccagcgagccccacctctgtccgtttcctctaccccctgtgctaaggaagcctcacctgcagtgtaggttgtggtgaaaaatgtccccccttaaggacagagcaggtcatcacgtgcagccctggggtagaaggggagagttcgcttgatcaaacctaactggagcttttcttttaaagcaggaagaattaatctgtagatatttctcctttcaatgccaaagaactttatgatctggtattgagactattggtgggttttttttgttttctttgtttttttgttttgttttgtttgagacagggtctcgctctggtacccaggctggagtgcagtggcacgatctcagctcacttcaacctctgtgaccggggttcaagcgattcttccgcctcagcctcccgagtagctgggattacaggcgctcgccaccatgcccggctaatacttgtatttttagtagaggcagggtttcatcatgttagccaggctggtttcaaactcctggtctcaagtgatccacctacctcggcctcccaaagtgctaggattacaggcgtgagccactgggcccggccgagactattggcttatgaatcaagtctaagaagatacactagtctttgaaggccgctctgtatgtttttccaactgccttgtagatatactttgttttaacagctcgttttaacagctcc

SEQ ID NO: 42541 - DNA, 1031 bp, Homo sapiens
ctggtgcaggtggcaggcatctggaccaacacctttcccatcaggaaaccccccaggaggagcaatttactagctcactggcatacaacattcgttttccctgggtgtgtagttagaatgttctacggagacctgaagtgctcgtttattgctcaaccactgtgctcctgttatggagaagtagcagaggggtcggcacctgtcagttatgtccgagcctcattcacacctgtttgttgaacatcagggcactggcataaatactcactgtcccaattggtgacagtaaaggatcagatctcttgagacttcatggtcaataagaagccacagctttacactttgaactgcatgtgaaaccccgtcccgtccgggggctttcagcaattcacagcctttttgtggtgaaaaaaagtggcccgcccaccacccctccggggcctcctttctgagcagtggtgatccgagttgctggtgggtctcaaactcctgggctcaagctatcctctcgccttggcctaccaaagtactgggactacaggcatgagctactgcgcccggctttgaagccagcatttctttactacctacgaggcctgctcagagtccgtgctcaaaaagatgtattgaatgaatatgggctttgacgcacaggctggagcgcagtggcatgttctcctagcccacagtggggctgggagggagtcattgaagtgagctgccctcttcctgttcacctgcctggtgtttatgtcacaagactgccctagtggaggactctccaggttgaggttaggggttggaaaccacagctgaccctcaccacggagagtgggtctccatggaggccttggccactggtgcagcatcagcgtgggacacgtggtggtcagcatttggtctccagctgtggtagctgttcccgacctccttcctgcagagtcagtgacatggagttacctctgggagtcgagatgttcactgtaattgcatgctgcgggtagggcagcagggccttagcccatcatcag

SEQ ID NO: 42542 - DNA, 1035 bp, Homo sapiens
tagctgggactatagacatgtgccaccatgcccatgatatttgtgtttttagtagagacggggttttaccatgtcggccaggctggtctcgaactcctgacctccagtgatcctcccacctcggcctcccacggtgctgggattacaggtgtgagccaccgcgcctggcccctagttgtaattattcacagaaattacgctccttaactttgacagaaccacttgcatttcagaatatagcacaggaaaatgaataccaagtataaaaattatcagaggtcaggcgcggtggctcacacctgcaatcctggcattttgggaagctgatgggggaggatgacttgagttcaggagtttaagaccagcctatgcaacacagtgagagaccttgtctcttaaaacactagccaggcatggtggcatgcacctgtggtcccagctacttgggaggctgagctgggaggattgcttgagccagggaggtggagggtgggtacagtgagccgtgatcgtgccactgcgctccagcctggacaacagcgagatcctgtcgctaaaaaaaaaaaaaaaaaaaaaaaaaaaaattctcggggaaaggagccccaggagggcaggtcggggagcactttcactgacaccccctttattaccctctacatctgtgtgtataccaaaggccaccaggtcatcaagctgtagtgtcaggccctggtccttggttgagacaagatgcctgaatgtttcactgacaggggccatgctggggaaatacacagtgtggttctcccaaataacccacactttgcagtaggtcaagttaggatgagaagcatgtccccagctgaagggggccgccctgccacactctcacccctgtttctccatgcagcagagccggcccagccttcctccgcatccggcagcgggaactctgatgacgccatccgctccatcctgcagcaagcccgccgggagatggaggcccagcaggctgccctcgaccctgccttaaagcaggcaccactgtcccagagt

SEQ ID NO: 42543 - DNA, 1071 bp, Homo sapiens
acgatctcagctcactgcaacctccgcctcccccattcaagccattctcctgcctctgcctccccagtagctgggattacaggcacccgccaccatgcctggctggtttttgtatttttagtagggagggggtttcaccacgttggccaggctggtctcaaactcctgtcttccaagtgatctgcccgcctcagcctcccaaaggtcttctgcattttagactcagattgagagtggagagacagatacaagccacctccagcaaccagccgccacatgtcactttcacatgcctggacctctcagggctcggacagggctttgatctcagggggcctgcctttgtctgtagtcacagcctggagcacagagggacacctgtaacagtagtgagcgcccctgtttagttctcctgggggttcatgatggcacaaatccacgccactggcttgcaaggcgcactggaagaaagaactgtacagcctctgagtttcgtggtggctctgcctccgccagcacccagaacaaaacagggagatgccacagcagccggcaccacactcggtttattagccagacagccatgatgttgaccttgctgtgggttaaaggacacaaaacctgaagagaaatctgtttatcatttgggaaattcatgccatccttgacagtatctggtgagcaagatggatgatctgccaggccggcccctcgcatgggtgaatcacgccatccttacggtacggttcctctgccggcttcagacacaaaaataacatttgtggggttttatatccagttctctggtgacccggggggtgagcagagagaagaaatctgatttgtaagattcacattgccctaaagatttatacggaccatttctgcctcttacgcttgtctcttctacatctttcaaaaaccggtttggcatgtgtttttctctttgtaacctgatttcccaggtcaaggacacagccttatgcgatggcggaagtttgtgccggttcaggacgataaacgggttgatcgcttaagttgcaaatgttttatttgaggttttgctctttc

SEQ ID NO: 42544 - DNA, 1862 bp, Homo sapiens
gcaagtaattgaggcaaaagataccagtcgacagcctccctggggtagatcccttgtacctccaaagtacaaatacctccctgctcagtttccttcctgtcgccatctttgttttcttcccattgaaaaaccatcctgtctgatgtggacgttcaggtctgctggttggcggtccgggcccagagtgcagcagagctctgggttaaatattcctttctggccaccgcccaagcccaggtggccagctctcataccccatctccctccttggccagggccagcatcaggcgtgcagctcatgaccagtttacacaggctgcaaagagatcgctgtgggcctcggctgactactttaagattatgccacagccaggccctaaaaagagaggggaacaggagtccccaggtgagctctctgacgggcaggtgccttcccgactaaggttggactggatgactttgttcctcctgcatgcatgtcctttgatgcaagggtgatcaatgaactctgttgacattctatgcaatgtttttcattcctctgattttagcaaagcaaatcttactgaaaaatagcagagccaggggaacagacgcatgtccttctgggagtcacacaaaagcagagagattttgaactgaggggcgacagcctttgccttaaatgcagtatgacaggcgcttcttggcagaccagtaaaaacaaaagcccatagaccttactcatcccaaggccgacaagccagctgtacagggcgagatgtagcaacacggggcatgagcggtgggcgtgctgggctatttgctgtggtactttaggctggaggtttggctcctgtgctgccggtggggggccctgtccctccccagatgtcctccctcttcttcacactcctcattgtcccttctacctcactaacctgtcttctccatctgatgtcacccagaaccacaccccacagaactgtgaggcacgtgggctggagagagcagaaaagctgccagcgcagcagacacgaacatccctctgcctggtgggccggctttgtgtgtctctccttttgtgagcgcaacacggacaaacagctgtgctctgcaaggcacacggatgtttcccttccacctgttcccaaagctccagcagctgtttcttttgcaggcagggcgtggtctcggggctccgagggtcttgtctttggtccgccttcctttctgtccagtcctgctcagctgttaagatccatcatggccattatccttgtcccggactgccccaaagttcccagctggctttggggaacactgtagctcttgggtgtctcttgtctctggcatggttttagcgtcactgcgaacactcctttgcaaacatcaaacatctcaaagacggaaaaggatagatggcttcctccagcctacacgccccgtccacagtggcatcaccctcttatcccaaaagaatatgccagttcccatccagcaccgaagaaaatcagctcctggggctggtggttggaggtgggtctgtccactgtgggggccaaagtgttcccctgctggagacagtttgcaagtaagaacctaaggatggggacagcatcctgtgcttgggcattgaccagccaaagctcacatttagaaagccctcagtgcttctgtggtttcacctgggcatcgacgacattagggaagcctttgtgaccacaagggcagggcttgtgccctgagtggcgaggtggtgacctgaggccagtgtgatgtggttggatctcagcgtgtactgaatgccagtctggccggcacactcgaacgctaagagaatggtccaatttgatgatcttatttctatttcgatcaggttt

SEQ ID NO: 42545 - DNA, 1050 bp, Homo sapiens
acagcacaagacgcactcacagggtggcggaatcttccggaaaactctctataagctcagctccccccaccccacccccactctagcgttttgtcacgtcttacattttagcagtattttatattttctgtaacgcaccaagtcttagatctttctagagcttgtttgttcatcctcacaatcacagatttttttctccaatcctcacagagacccaattgaccaaaaaagaaaaaaggaaaaaaaaaaagtcgtcttttttttttttttttgtacaaatcgctttgagatgcctctggtgtgttgctgtgtgacatctctctggtaacattttatttcttgctatttgtttttctacattaagagtcaaagttgacctggctggcgtgggggtgggggaggcacccgtcggccccttggtgttgtccctctgtctttggttagccatacgatgtttgttctcagcactgtacaacggtccctatataatacggagaagcaatatcactgtatgagactcacaccatgtattattattcactagcaccctaggtgtgataattgaagtaaatatcttttatacaaacacaagaatgtgtgggttgtttttatttaaagtgctctggcctgaggacgagcagcaaacactgtcattcgaggtccaaagggcacctcaagaatcgccgttcccgaggtcgtcccctttgcacctgtccgcaggtcctcgggcgtgtggcttccgggcacacagaaaaccgtgtggttctaggatacatggggatctcgggcactgctctgtcaatctgcatctggttcacaggaagggcttcgccagggcctgcgttcctacttgctgttgtcaccagcactgtttgcctacccttgaaccaagcccttaccctccctggcgtccgcttccttttctgtaaaatggagacaccatctcctgtcatataggcttgctgtggggaaccaggaatggtggccagtgctggtgcggcactgggctggtggtggcagccccaatcgatggcacttgggcgaccagga

SEQ ID NO: 42546 - DNA, 1083 bp, Homo sapiens
atggagctaaaaaaataacatgggtgaacaaggtgccacccacatgcaagcttccttcccatgtcatgtaatgcctctcctcatctgctccatcaatcaataaaggcataatcactcctgtgatacctttaagaaaagaacacactctctcaaagctgggtgcagtggtgcacgcctgtaatcccagcctcctttgggaggccgaggcgggcagatcacctgaggtcaggagttggagaccagcgaaacccatctctactaaaaatacaaaaattagctgggcgtggtggtgcttgtctgtaatcccagctacttgggaggctgaggcatgagaatcgcttgaaaccaggaggcagaggctgcagtgagccgagactgtgccactgcactccagcctgggtgacagaaagagactctgtctcaaaaaaaaaaaaggaacatgctctctcattcaaggttacccttctatcactccaaggattcactccataatcttatctttcttgatatgttacattcactaaaacgttcacatcaaatcaagtttgtagacacttgtccttaccaccttacaaaaagtgagatggtatcaacagaggtgagacactgctttacctgcatgtcacttttggcagctttcacagcattgaaaagatcattggctggtggctctgactgtttccggctatgacgatgtaccactcgggaccctttctctggatgtttgccatctaatatgtataaaaagatcagaaatatgaaaaaaaggtaacaatgacattaacacttggtctcatcattatcacacaagtaggcttatgctgccacttccatggcagagtctgagttagtcctgaaataattgatttttatattatgaagtttattaacttttttcccttaaaaaaaaaaagtccttgagtccccttcctgtatccctatatcctaacgtccttttctcttcttttctcttcaaaatttctcttcttcctatttccgtcccttaacactttgtaaatcttgtccttttatgaaccatatcacctgaacctcttttaggtttttttttttttttttttttga

SEQ ID NO: 42547 - DNA, 1030 bp, Homo sapiens
gctcacgcctgtaatcccagcactttgggaggcccagggaggtgaatcacttgaggtcaggagtttgagatcagcctggccaacatggtgaaaccccgtctctactaaaagtacaaaaattagccaggtgtggtgtgagtgcctataatcccagctactcgggaggctgaggcaggagaatcgcttgaacttgggaggcggaggttgcagtgagcagagatcatgccactgcactccagcctgggcgacgagtgatattgtcactgtctcccccttgctaacctcctaggtgcttaggataaaacgtcaaatatttaacatggcttcacagacatcttgtatcatttggcccctggctaccttacctcacccaatttcctcctttgctctgtactctagctacactgtccgaggagttcctaaaacatcacgctgggtccgaccacaggatcttcacatgtgctgctccctctatctgcatcgctctttcctcttctcttgtttgcttaactcctatttaccctcgggcttaatcagcactttctcacctctcctagtctgttgctcttatttaagatcaaacagcagagaaatgtgaagtccactgacttccgggtggaacagggttcagtatgccaattaaattattgggtgctggctgggcacggtggctcacacctgtaatcccagcactttggaagggcaaggcgggtagatcacttgaggtcaggagtttgagaggacaacatgatgaaactccatctctactgaaacacaaaaattagctgggcttggtcgtgggcacctgtaatcccagctactcaggaggctgaggcaggagaatcacttggacgcacgagggggagggtgcagtgagccgagatcgcaccactgtactctagcctgagcgacagggtgactccatctcaaaaaaaaaaacaaaaaaaaaattaggtgctgactgaaaataaatttgaaagcaaggtgtatgacagggaaggctactacctgtgtaatattctcttactta

SEQ ID NO: 42548 - DNA, 1081 bp, Homo sapiens
acagtaactcttcactgtaataaaaagttaaattcaccaggaagataaaagaattctaaatttgcatgtacctagtaatattgtcttaaaatacataaagcaaaaatcaacaactctataagactaaatagctaaacgaaaaatagtgggaaattttaacatacttttcaacagaaactgataaaatagttagacaaataattagtaaggatatagaagatttgaacaacttaatctatggacatatatggtcacagtgacatgatgaagctggcttgtatcctctcatgagaaacaatttttaaaatttcaagacttttgtgaaccagctgatatcgcgctagtagcttgacattgaccactatgggaatatttatataatagtatgataggcaaatgctaccaatcacagttttatccccttcccctctgaagccagttagtttttttactttttctttttttttgatagagatggaagtcttgctatattgcccaggctgatcttgaacccctggactcaagccatcctcctgtctcagtctctctagtagctgggacaccatgtctggccagttgttaagttttgtttgtttgtatttgagactgagtctcgctctatcgcccaggctggagtgcagtggtgcgatctcagctcactacaacctccatctcctgggttcaagcgattctcctgcctcagcttccccagtagctgagagcacagacgtgtgccaccacacccagctaatttttttcttttgtttttttttgtatttttagtagagacgggatttcgtcatgttggccaggctggccttgaactcctgacctcaggtgatccacctgcctcagcctcccaaagcgttgggattataggcatgtgccaccgcacctggccatgctgcatcttctttgccctaaatgaccccttggtctgaagagatgacataggagatcccttccccacaagtcagatgcattttacaagcccttgaatgatggtgctggcagaggtactgcagatagaaaaggccagtccatttctggtgtagtaccaattagagtaagacaaatcaat

SEQ ID NO: 42549 - DNA, 1022 bp, Homo sapiens
tatatctgctgataaatatgtccacaatttagaccagacttagacactgaagttattaccagctccttcacacccacatgccttaactctctcttgccttcatgcattccttcactccattcattcgcttaactttcatccagcagatatctgccaagcaccagctctgtgacagacactgaggctgggggtgccagggagacctttaccaaccggacagacactgccccgcactcctggctctgtggctttctgatagtccgtggcctcacatgttcatttattaagtgtccttttattgattgagtcttcattctttctcttaatgtccttattcattcattcatccatcacttgctcatctcactgacacgtctattcagtcttcatatatgttttcattcctttattctccaagcatcctggaagtacccactctacaccatgccagggttagatgctgggattctggcccagcccaccacactgccaagcccatggggacacagatggtgaggacatagtggtaactacttcaccagttattgggattcagagctgggagagcaccaagaagggagcaattcacttcctggaagtgaggggtgggagaggcaatctgagaaggcttcttggaggaggtagcattttggccaagttgagaagcctgtatgggagttctccaaggaggaaaagatgctttgttttgtagacaaaaaccttcgttctgtggagtgtttggagaaaagtgaggtactggttgctaatgtgtgtgatcctgggtgagtttgtgtgcatggccccagccaggccaagccctccccaggttccagtgacagacctgggccactaaggacccttaattccaccctgagctcctagaaaaccacccactattgggcagccaggaatgacctttggagaacaaacacttcaccctccaggtaccatccacttgtccacctgttcatcctcttggggactcagtgggagggcgaccctgtccctaggagcccatgtcc

SEQ ID NO: 42550 - DNA, 2496 bp, Homo sapiens
ccctgcatgtgctcagaagttatatcaagctgggcgtggtggctcatgcctataatcccagcactttgggaggctgaggcgggtggatcacctgatgtcaggagttcgagacaagcctggccaacatggtgaaactccatctctactaaaaatacaataattagccaggcgtggtggcgtgcacctgtattcccagctactcaggagactgaagcaggaggatcacttgaacctgggaggcagaggctgcagtcagccgagattgcatcactgagctctagcctgggggacagagtgagactctgtctcaaaaaaaaaaaaaaaaagttatatctaatgtgctcagaagttaacaatagagcaaaatttcatcaaggctgtgtgtgagggtattatctagttacagattacagaggcttggctgggcatggtgacttaacacctataatttcagcactttcggaggcccaggcaggaggatcgcttgagcccaggagttcaagaccagcctgggcatcacagcaacaccttgtctctgcaaaaaataaaaataaaaaattaactgggtgtggtggcatgcgcctgtagtctcagctactcaggaggctgaggtgggaggagtgcctgaacccgggagttcaaggcagcagtgacctatgatcgagcccctgcactccagcctgggcaaccaagcgagaccctgtctctaaaaaaaaaaaaaaagttatagaagcataatcattaatcccgtcagagattatgtacaggaagaggcaggggctaggatcattgaacttgtcttttctaaaaatgcagtgttcaggcaagagaggtggaaacctgtgttctctctcgctcttcccagcttattgttcagggcgttattggagagggctgcgctcagtcaccgagtcacggcctttgtgaaatcctgctcgcaagcagaatgagcagacatggttccttaggtttattactgtgcctcacactacgagacggtcattcattggcagaggtgtatttgcggggggccaggtatagagtaattcaaggcggacaaaggaggaatgtcccagtcttcaggaagctcagtgacatgtttgcgctgtcttatgtaaacaggagattgtcagaaatggaggagggggcaccagatccaaggaagtgcccggacaaagccgggaggcgaggagagccgacggggaggaggtgccgagagcatcagcggggctgctcggtggcacgaagacgcccgcggggactggagaggtcggctagggccaggctactcaggcacggagggccacctccccttcagggacgtgagcatctagctgcactgatttgttgttcaggaacaggaaatgaaaccccgcagctttgaacacaataacccacgccagcctcaggctcatgaatattcagcaggctgcttgcgccttgcaaccccgcctccgttcccctctgcggagactgcgtatgcgtcgccggcgcgcggctgtgtcgtcatacttgcgcgccgacgccgccgctcgcttgtgaaactggaaggctgccatggctagcccagccgcctcctcggtgcgaccaccgaggcccaagaaagagccgcagacgctcgtcatccccaagaatgcggcggaggagcagaagctcaagctggagcggctcatgaagaacccggtgagacgaggcccaggctccacggcccgtccgaggcccacccccttcctctgcagcgcttcagggttcccgcaggtccaccttccccgcctccaaactcagaaactcagtatccgaccctccaagagcagtctttggggaggaggaggagaaggaggctgtcccggagatagtgaacttcccgtctgtccttgtgtgagagcccagcttgaatcaaagcacggtggagcggcttcccgtgctccaagaccccttctggtttaactttctgtgaacaaaaagcgttagactgaaaaggtagaatttgtgggttagcaaaagggtatactctaaacaacactgatcgttagagagacagtggccgagacgtttggagctggtcactcctctcccgctcacaccccctctgggcctcggtcccctcaatcataaaaacaattgaacgggaacgtcctttatacctttaactagaaaagcttgactcttcttatctagtagtgttaaagttggcggtttctagctggaaactatggcttaggtttttcagttctgctctggaaagcgtagccctgggaaggtgtggactgtgttatacccaagagtacataggatgaaaaaagccacgacagagggaagaacacaaaatcagctctgtgtccaagtagcaaagcagtcctgcttcattagtcaattaaaattctttggtcttaagagatgtaacttgggctgggtgctgtggcccctgcctgtaatttcagcgctttgggaggccaggcgggaggatggtccgaggccaggaaggagttcaagacc

SEQ ID NO: 42551 - DNA, 1976 bp, Homo sapiens
gacagagcaaggccctgtctcaaaaaaaagaaaaaagctgaagaaaaaacacttttacaaaaatatgattgttctacatatacaactttgtaagcacctttatttcatttaatgtatcatggatgtcttttcaactcactagaaatttagcgtgtcaaatgtgaaatcatggaggaggtgagaaagtcacttaaccacagtctgcccctcctgatactgcatttgagtgggatttttagtgactttacattcaacattcatagaacaaataattcacgacatctacaatatgccaggtactgggccagttctggatacagtggggagaaaggaaggcatggtcccttccacgacttccactttttgtttctttagtcaccctcgattaagggtgacctgtgttggtaactgaatttcatctagaactgtggactgttctggctacaggttcaagtgctggggccggcagtggagagttccacgtgtacagacatctgcgccggagagaatatcagcgacaggactacatggatgccatggctgagaaggtcagtgagccagaaggctggctgagcccccatgtttgggcagtgtgcgtgtactttctttagaaaaaagcatttgaagaggctgggcgtggtggctcaggcctgtaatcccagcactttggaaggccgaggcaggggatcacctgaggtcgggagtttgagaccagcctgaccaacatggagaaactctgtctctactaaaaatacaaaattagccaggtgcatgcttgtaatcccagctactcaggaggctgaggcaggagaatctcttgaacccaagagatggaggttgcagtgagccaagatcgtgccattgcactccagcctgggcaacaagagcgaaactccatctcaaaaaaaaaaaaaaagagagaaaagaaaagaaaaaagcgtttgaggaagaatagatactgctagttgtggctggtgtgaggtctgccttctacggacagcacaaaatgcagagtctctactaaaaatacaaaaccccgtctctactaaaaatacagaaattagctgggcgtggtggtgggcaactgtagtcccagctacttaggaggctgaggcaggagaattgctggaacgtgggaggtggaggttgcagtgagcctagattgcaccattgcatgccagcctgggcgacagagtgaaactccatctcaaaaaaaggaaaaaaaaaataacaccaagaaataatcataaaatattgtaatatttagccataaaaaggaacaaactactgatctgtacagcaactgggatgaatctttaaacatggtgagtaaaagaagccttgcacgaaagagaccatattgtgtaatttcatttatatgacgttttagagcaggtacaattagtttgtgtgagaaaaaaaaactggttatctggttggggtcacggttgactgggaaaagacgtatgaggggactttctggggtgatcaaactgtacactcgagatctgggcatttggttctgtgtagatactaactttatttattattttgagatggagttttgctcttgttgcccaggctgagagcagtggggtgatcttggctcactgcaacctccacctcccagtttcaagtggttctcctgcctcagcttcctgagtagctgggactataggcacaacccccatgcctggctaattttttgtatttttagtagagatggggtttcagtatgttggccaggctggtcttgaactcctgacctcaagtgatccacctgcctcggcctcccaaagtgctgggattacaggcgtgagccaccatgcccggccagctattactttaaaaggaagaagaaaagcatacacaaatatgaaaccctatttaataacgtgcatgcttgaatgttcaagaatggaacttcccgatgtctgcagcttactttgaaatgcaccaaaacaaacaaacaaaaa

SEQ ID NO: 42552 - DNA, 1032 bp, Homo sapiens
ccatcggagacctatgtattgattacctgccctgcctctgggacagccttttaaagttaaaatggccctggggacccgggtagtgcctccgtcacccccagtggtgtgacttctagaactctcctactttgcctgagcaaaacctcccacagtctgcccagaccagagcgtgtctaaatgatgtgggttttgttgcagcaaaaattggatgcagagtttcagaaaagactggaaaagaataaaattgctgcagaggagcagaccgcaaagcgccggaagaagcggtaagcggcatggcctaactgtgatgacacttaagggccaggggtggtggctgggtgagctgtccttgcagtcagtagtagttcctctgcatgacctgtaggggtcatgaatgtagagcaatgacttctactacctgagcagagagcaagttccttatgaccctccaactggttacagattgtccagagcttgcaagtcaggacttcagtgatcacattgatttctgtgtctccttcaggtctgtatttttttttttttttgagacaaagtctcactgtgtcccccaggctgcagtgcagtggcacaatctcggctcactgcaacctccgcctcctgggttcaagcaattctcctgcctcagcctcctgagtagctgggattacaggtgcctgccaccatacccagctaatttttatatttttagtagagacgaggtttcaccatgttggtcaggctagtcttgaactcctcacctcaggtgatccgcctgcttcggcctcccaaagtgctgggattacaggcatgagccaccacacacggccgcatctgtattttaacaaggtgctgcaaccaaacttcccatttagcatgtttcttaaattacggtttatgactccctcaagtgactacatggtatataggctgtatgtttatatgtgtatctgtgtgtttacataagtggtctctcaacttttacaatgagagctgaggaggattctaacaacagcccctaaatatcttgaaatg

SEQ ID NO: 42553 - DNA, 1104 bp, Homo sapiens
aacagggtactctatgtacagacttagcacagtgcttccatgtaatagtgttggacaaatattagctattaaaatatcctcaccatttaaactttaaaaaaaaaaaaatctgtgcccaggctgccgtgcagtagcatggctcactgcagccttgaactcctgggcccagaaggtcctcctgcctcagcctcatgagtagcgaggactataggcatgtgtcaccaggccattttttatagaaatggaactcgctgtgttgcccaggcttgtcttgaactcctgggctcaagtgatccatcctcctcagcctcccaaagtgctgggattacaggtgtgtgccattgcacccggcttccccgtttgaactttcaaagctaatcatgctgtgtggtatgaggttgaggggaaaaagggatgccccaaattaatgaaactaaatcttccagatgctttcgccagcgccgtgcgtgttctgtgttctttctgcggtcccatcctgggtatgacagtgaattttaggctgggctgtgcctttggctgtgcagggcctcctgcttagaggccctttgtctgacctttggtgacacagcagtagcagcgctcagggtctgtagtgggcgtgtgggtggccagggcaagccctgcacatgtgcctcaaggagcattggctggcccgggtgagcctacccatttgtgagttgctgaggccaccgtgcctgcggccggcgtcctggcatggctgagccgggccatctgctgccttgtggtctctgcctctgcctttccaactctcacttgtcctcctgctcccgcgtgaagagggggaggggaggagttgggaacacgtcctcatgctcggcttctggctggcagtcatgatgggggacagggaacctgtgctgctcacaggtgtcaggaggggcttcctgggccatgcttgggaggagctgggaagctggcgtatgtgtggggggcagagccctctgccacacaggtttcggaaatccttttgcagacggcagtgagaacttgagacttcagtgagagtgttgtcagcctggcgttagtgttgaagagctgggtcgggaagttgcccacccaaga

SEQ ID NO: 42554 - DNA, 1104 bp, Homo sapiens; identical to SEQ ID NO: 42553

SEQ ID NO: 42555 - DNA, 1050 bp, Homo sapiens
ctcttggaaatagaactcaggccaattctttttcattcatggtggagacacgtgttttctccttctccctcttggaagttaatttctgtttactatttggtgtacttgactaaagttagctacgattaccatatattaacatatatttcagtagagagaacactcttggaaattaacctggagcgagttccaggaggccgtttcttgttttcttactccacagaatgtcacaaatccactgggtgtggtggctcttgcctgtaaccccagcactttgggaggcctaggcaggaggatcacttaaggccaggagttcaagaccagcctgagcaacatagtgagccccacatctctaaaaaataaaaattgaaaagtgcacctggcctagtggcatagtcctagctacttccaaggctgaagtgggagaatcacttgagcctgggagattgaggctgcagtgagccatgattgtgctgccgcactccagcctgggtaacactaagaccttgtctcagaagtaaaaggctggatgcagtggctcacacctgtaatcccagcactttgagaggccaaggcaggtggatcacctgaggtcaggagttcgagaccagcctggccaacatggtgaaaccccatctctactaaaaatgcaaaaattagccgggcatggtggccagtgcctgtaatcccagctactggggaggctgaggcaggagagttgcttgaacctgggaggcagaggttgcagtgagccaaaatgatgccactgcactccagcctgggcaacaagagtgaaacttcgtctcaaaaaatataataataaatgaaaaaaaatagcaaatgtttattgagcaccaactaagtgcaaaatccaagggattccaaggcccattgctaggcactggggatggtggtggacaagacacagtccttgccttcagggggctccaggtctgagcaggaacaggattggggagagcagcacagcctgctgtgtgggcacctgacccaggcctctgcgaaggcgagcgctgagctgaagtcaggtgg

SEQ ID NO: 42556 - DNA, 1050 bp, Homo sapiens; identical to SEQ ID NO: 42555

SEQ ID NO: 42557 - DNA, 1069 bp, Homo sapiens
tgggtatggtagcaggcgcctgtaatcccagctacttgggaggctgagacacaagaatcgcttgaacctgggaggccggaggttgcagtgagccaaggtcacgccactatactccagctggtcaagagtgagactttgtctcgaaataaatagattaattaattaaaaagataaaatcaaatcaaatcgctgcatggtacagggtttcctgagaaaaggcgcccatgtctgccccgtctcaggcaccacccaaaagtttggaactctcagggatctctgagcagggcctcagagattgattggggttggatcagtttagcccagttagcgatgcagacgttcctggaatctggcctccagggtgacaaaggagagcttttggcctggctcccagcggccgccttccttctgagtcatcccctaggacaagagtcagtttccgacaaagctgcggctctgacaaggggcccatctcctgttgactccaaagccgctgacccacacccctggagggaattgtcccagaggttaaggactcacagtgaggacacaacagtatgctcacaggtcctattgggtggaagtgatttatttgttttttgttttgtttttagagacagggtcccactctgttgcccaggctggagagggcggtggtgtgatcatggctcactgcagcctctacctcctgagctcaagccatcctcctgcctcagtctcctgagtagctggaattataggcacgtgccaccatgcctggctaattttttttttcttttttcagagacaagttctctgctctgttgcctaggctggagtgcgggggtgcaatcatggctcactgcagtcttgaactctcaagtgattttcccacctcggcctcccaaagtgctagcattgcaccttgtccagcctgtttccttatgtgaaaacaattattgtttttctttttgtttgtttttgtttttgttttgagatggagtcttgctctgtcacccaggctggagtgcagtggtgtgatttcagctcactgcagcctctgcctcctggattcaagcgattctcctgc

SEQ ID NO: 42558 - DNA, 1035 bp, Homo sapiens
atgagccactgctcatggcctaatcttgtagttttaatagtatatattagctttttcaaagttgttcccatttttaaaaaattacttcaaatacctgtgatatagttgcatggtaatattttcattttttaagtatgaaaggttagacataggatttgaaaacctaagtcatgatcatatatactggggaagaggcttctacagtctttcacaggagtacttaacagaatcgtagtctcctttacttcccatctatgttagttctctttaggtgatttaggccagtagaaataactgctctgtttctaaaaacgggcagaaaggctattgtttttggtcccgttgctgtggtagaagaccccttacctttacagtatgcactttccaggattcagcaatattacggacataactgaggagttgggtttctaggttaaaatgctttggagcttataaactgcagtactaacttgcttttttctttttttacttctaggtttagatatcaagtcatcagggtctggctgtgtaaaagttcaaagtattgagggtgataattgcaaaattgaaacagagcatgggactagtatcttgcagtctgttaaggtatagcatttttctaattttatttcactattatttttttaaaagccttaagctatgaatcgtactatcaaactcaagagattcttctgtttttcagaacattgtcattcattcatctctcagaaagtccttggcaaacattttgccttgaaatcagttctagtaaagtacagaggttatagcagttttgaggttttgcctcaaatttcttttggatttaatttcaaagtgtacagtgaaactaatagtattttcctagtattctgaaatcttactaaagaaattttagtttccacaaatgattttcttccattttattaaagagtaaggaagaatctttatgcactataaatgtgcttaaatattagatgactttaatcacatttttaatgtaccaggtagctcattacttaaggattaagtagttat

SEQ ID NO: 42559 - DNA, 1030 bp, Homo sapiens
atgaataaaactctattttaaatatttagatttcctatgtaaattaggctctattttaagttctatggaaacatatcttgatagataaattgctgagtattagttctctcattttctctgcacttcaaaagtcctttgttcttcaactatttggcatacatgcataaacttttcctttagtaactacttttttatttttgaaattttcaagaagtacaatttacatgaactgtacaaaacacaggtgataactttgatagcactcaaaatttcagaagaaatgtcccaatctgctttaagaaggacttgtagtcactgataaatttataaatctggtttgtaaacttagaaagtcagaaataatatacaattttaaaacagaatcttttattggattaaatagatcttttcatgacattcatgaaaatgttttattgaaattctagtatttattcctagcctaggtcattatgaagttttaatttgattatcattttgatgcttaatttcgaatctggacacatacaactttgttttttttgttttttttgttttgttttgttttgtttttgagagaagtctcactcttgtcccccaggcttgagtgtgatggcttgatctcggctcactgcaacctccactacccaggttcaaacaattctcctgcctctgcctcccaagtagctgggattaaggcgcctgctaccacgcctggctaatttttatattttttagtacagacagggtttcaccatgttggccaggttggtctcaaactcctgacctcaggtgatccgcacgcctcggcctcccaaagtgctggaattacaggcatgagccaccgcacctggccacaacttttttatatgaaatattagaaaagaattacagcttttttttttttttgtggtgcaaaccatgtaggtttttcagggtttagacctctgacacaaaatattgatatttactacagtgtctgtcctaagtgcagctccttagagacattcagagacttggcttcctcagtttg

SEQ ID NO: 42560 - DNA, 1086 bp, Homo sapiens
aacaagcacataaataacaaaaggtaattttagtttgtggtaagtacaatgaagaaataagaaagggtaactgaatagagattggggaaaaagaaagctacttcagttaggcaattgggggtggtctggagagggtacatttaaaccaaagccagaaaaatgagaaagagttatataaaattctggatacaggctccctagatagaggaacagcaagtgcaggccttgaaaatggaagtttactattttcaagggaaagaaggctggcttatgaggaaagtggtaggatatgaggtaagtaaggctagatcttaggaccttgtagacagggtaagagttcagactttattccaactacaacaggatgttagggaagtgatatataatttatattttaaaagaacaacctagctgttatttcataatgtaccagaagggttcagaagtgaaagcaggctattagaaggcttaatttgttcattctactgttgatggacacctgggccatttctaattttttggcaactgtaaataaagctgctatgaatatattaatgtaagtcattttatggatgtatatatatttttcctcttgggtaaatacgtaggtatggcattgctgagttgactaggtaggttctatgtttaactttatgataaactaccagaccttttcccaaagttccactttatactctcatcaacaatgtatgagaatttgagttgctccacatcctcatcaacatttattattgtcagttttaaaatttttttatatcatcatttgttgaaaaaacttcctttctctgatggattactttagcatccttgtctaaaatcaaatcactatataagtgtggctcaatgtctgatctcttgttcctaattcattgatttatttggtgagccttatgccggtgccacaatatcatgattactgtatctttggtaagtctgtaaatcaggtagttgaagtcttccaaatttgttccttttaaggattactttggatataataggtcctttgattttccagtcagtttctaccaaaaaatacagttttgattatgtttgggattgcactga

SEQ ID NO: 42561 - DNA, 1013 bp, Homo sapiens
aacaaaattgatagaccgctagcaagactaattaagaagaaaagagagaagaatcaaatagatgcaataaaaaatgacaaaggggatatcatcaccgatcccacagaaatacaaactaccatcagagaatactataaacacctctacggaaataaactagaaaatctagaagaaatggataaattcctggacacatacaccctcccaagactaaaccaggaagaagttgaatctctgaatagaccaataacaggctctgaaattgaggcaataattaatagcttaccaaccaaaaaaagtccaggaccagatggattcacagccgaattctaccagaggtacaaggaggagctggtaccattccttctgaaactattccaatcaatagaaaaagagggaatccttcctaactcattttatgaggccagcatcatcctgataccaaagcctggcagagacacacaaaaaaagagaattttagaccaatattcctgatgaacatcgatgcaaaaatcctcaataaaatattggcaaactgaatccagcagcacatcaagaagtttatctaccatgatcaagtgggcttcatccctgggatgcaaggctggttcaacatatgcaaatcaataaacataatccagcatataaacagaaccaacgacaaaaaccatatgattatctcaatagatgcagaaaaggccttgacaaaattcaacaacgcttcatgctaaaaactctcaataaattaggtattgctgggatgtatctcaaaataataagagctatctatgacaaacccacagccaatatcatactgaatgggcaaaaactggaagcattccccttgaaaactggcacaagacagggatgccctctctcaccactcctcttcaacatagtgttggaagttctggccagggcaatcaggcaggagaaagaaataaagggtattcaattaggaatagaggaagtcaaattgtccctgtttgcagatgacatgattgtatatctag

SEQ ID NO: 42562 - DNA, 1027 bp, Homo sapiens
tgttttagtatctctagagtagtgggtaattcaagaacaattttggccctcacctccaccagagaacatgtggtaaggtctggagggatgggatcttatgtgctactgacatatagtgagtagagggcaggcatgctgttaaacatctacagtgcccgggacacacacacacacacacacacacacacacacacacaccccactacagagagttatcttgtccaaaatatgaatagtgtcagggatgaagaaccagaatttaggaaataaatctccaggcttctgtttggggtggggagagacagttgcccagatttatggagtaggggctggaatctagagatctatctacttcttaagaatctctaactcagtctcccttattttcatccccactcttaacccagttccaaaggtacacggtgctcccaagcttgaagattgtggtgtaaatcagatttttttttccagctttctctactgttggcttaggattcaaagcagtctctggtctgctaaattagtccatctattttcaagcttccaaatttttgttgctcttatctcctctcctgttttccttatccatatgggccctcactcttcatctctagttctggtagcgtttcaagaggaacaaaattatatgtgtatattcagtctactattattaatccagaacctgagatctctagttctttacatggagatatgtccatagtatattaaaaagtaggttacaatgtattttggaaagtatgattctattattttaaaaaacaaggcaaaacacaaactttctgtaactatttctaatctttttgtgcatagaaaaaaatctagaagaataaaataccagcgatggttatgtccaggtggtgacaggacaatggatatttactttctcccttaagcttttatatgtagtccaaatttttcataatgagtacttacttcatttatatacagaggtcccagaaaaattataaaacacttgaaaataacacaaaagatgatggtatgtcct

SEQ ID NO: 42563 - DNA, 1152 bp, Homo sapiens
agaaagggaagacataagaaacttcattttgacctgtaccctgaacaattgctttgccctgagatgctattaatctgtaactttagccccaaccttgagctcacagaaacatgtgttgtatgggatcaaggtttaacggatctagggttgtgcaggatgtgccttgttaacaaaatgtttacaggcagtatgctgggtaaaagtcatcgccattctgcagtctcgataaaccaggggcacaatgcactgcagaaagccatagggacctctgccctggaaagctgggtattgtccaaggtttctccccatgtgatagtctgaaatatggcctcgtgggatggcaaagacctcgtgggatggtcccccagcccgacacccgtgaagggtctgtgctgaggaggatagtaaaagaggaaggcctcttgcagttgagataagaggaaggcctctgtctcctgcctgcccctggaaacggcatgtcttggtataaaacctgattgtatatttgttcaattctgagataggagaaaaaccgccctatggcgggagacgagacatgttggcagcaatgctgctttgttattctttactccactgagatgtatgggtggagagaagcaaaaatctggcttacgtgcacatccaggcatagtacctacccttgaacttaattgtgacacagattcctttgctcacattttcttgctgaccttctccccaccatcaccctgctctcctaccgcattcctcttgctgagatagtgaaaatggtaatcaataaataatgagggaactcagagaccggtgctggtgcaggtccttggtatgctgagcgccagtcccctgggcccactgttctttctctatactttgtctctgtgtcttatttcttttctcagtctctcgtcccacctgacgagaaatacccacaggtgtggaggggctggcccccttcacagtggcatgatcttggctcattgcaacctccacctcctgggttcaagagattctcgttcctcagcctctagctgggattacaggtgtctgccaccacgcccagctaatttttgtatttttaagtagagacagggtttcaccatgttggcagctggtcttgaactcctgacctcagggatccgcctgcctcagcct

SEQ ID NO: 42564 - DNA, 1027 bp, Homo sapiens
caggttttagattttctctccaaaataaaaatgaaccaggattgaattacccaaatggcaatcagatatttttcttgttgcctgtggcataacccacactttttacatttctctaagtttatttcaaaaagtggtgcctagtggcccaattacctggcactagtccagggtcctctgtggggcaagaaaggcgggggaattccttaagctaaaataatcagccagaaagagttgatgggtgtctatttgcacagccagccacctcactttttgttcttagtctttcccaagaaaatgacaactcataatgtttactgtaaggacagtcacagcatcctatgacctcttccatttaaggatctctaagaaataaagagttcacgaactattatcagtactgctttcacctcccatttgcggacataatagaataagaggtgatctaatcaagggaggctaccagtctagtggaaaaaaagagagcctggaatctgaaattgtatctatgtgaccaggaacaagtcatgttacctcaagtttcttcatatataagaggagaaagaaaataactgtctacctatctcataggcctattagaagattaaaagaaaatgtgtattccaaaagcacttggaagacatggaccctggcttttgtctgtgaaccagagagatcctggaacgatcctatctatgatgtatgtgatgagggctttaggatgaggaaatataatgaacaaaatttaactggaattgatagggagggttattacaaattataacatggagaaatcatagctcctgtgagacatgccacaggcccttggtttatgtcaggcaaggcacaatgagcaaagcctaggtgtgtcacatagaagagggatcaaaaacatatcaaaaacctaaacataggtttaaaaaacaaaagaagcaaacattctgatgtttattttccctttttttaaatttttgccttcagacaatctgacagtttttttttttttaacttttggcaagtttcatcttac

SEQ ID NO: 42565 - DNA, 1045 bp, Homo sapiens
aaaggtacatagggctaggtgtagaggtcctgagtgcaggaacttctgtccccacagagttggagtgcacccctctcctgacatatggatgtgttcgccaacctggaagtactctaaaccctgtagttcagggatttttatgggggcttcgtcatatagacaccatcaattattagctcaatctccagcccctctccccttcccaaaggatggggaatggagcagaaagttccaagattctaatcgtggcctggcctttctcatgaccagcccccaaccaagaactcaccaagagtcacctcattagaacagaagatacacccaggaaactccaaggaattaggagttctgcatcaggaaccatggtcaaagaccaaatattagaacaaaagatacctattacccctattgctcagaaagttacaagccctttaaggagctctgtgccaggactgtggataaagaccaagatatatatatttcctataaatcacatactcacaagaagagaaattttgacaacagtaagtgccaaaatactgaatagatcttggtagttcatagggcttgaaagcggggacaccaccaacattcctggcagccaagtcagatgcatggacatcgtctttaaccacatcttcacactcatccctcatctgaactatcaacaatttcatggattttgctatctaaatgttcatgttctctaatccatttccttctccccagcctccctgttacttcccttgttcaggttgctatcctgtcacccctggactataacaaaaacctcttagattcctaccttcactctccttttccccttctgctcttcaatgtaacttccactttccttgttaaagtgatttttctgacagataaacttccctggcattcccatgctggattaggtacctcgcctgaatcctcccatagcctcctacatacctttatcacagcattatgactaaaagcatccttttggaattagacattttatacactagctcatgtacttacctgtttcatgacttgggagaagttt

SEQ ID NO: 42566 - DNA, 1033 bp, Homo sapiens
gaagaccttgacctcagccttcccaaactatcctaatcagaaacttcttctgtgtgtcagtgccataaccctaccatgttgatcttgctttataaatggctggatgtctgtttggcccatcagttccctgtcttccattgggatcttcatttctaattccaattgagaaccaccagatccttctaagaagcatttcagcaaataaagcaggacaggagtttccaccattgcaatcctaagaggcagtttcacaacagctctacaggtgggcgtacagatgggaagaacactgggagcaaaacatactgattgctgacatccgtttacaccctccgtttgttcagatttgcaaagaactgagcagttaaggcaaaagatatcctgtttcagctgaatgagccatagtaggtggatgcgatgcctgtgtgcccatcaaccttccacctataagagggggagtgtgccagcacctaggaaagcagttaaggatgtgtgtgtgtgtgtgtgtgtgtgtgtgtgtgtagaaattcatattatagtcaagaaaggattaaaagtgaatggaaaagattattgaggtaatgatccaaattaattggttaatacatttagggccaaacctggatatcaaaagtatccatgctgtttttttgtttgtttgtttgttttttaatacacaagctggggtttcatccctaaagattcagactcaatagctctgaagtggggcttgggcatctatagttttttttgtatgtttgtttgtttgtttttgagaccaagtctctctctgtcgcccaggctggagtgcagtggcacgatctcagctcactacaagctctgcctcctgggttcacaccattctcctgcctcagcctcccgagtagctaggactacaggcgactgccaccatgcctggctaattctgtgtatttttagtagagacggggtttcaccatgttagccaggatggtctcgatctcctgacctcgtgatccgcccacctgggcctcccaaagtgctgggattacag

SEQ ID NO: 42567 - DNA, 1024 bp, Homo sapiens
gaatatattactgaatgactcattaccttacacaatttgccaaattcaacacagtcagttgcttcaaaggtgaaagggatctgaggctgctgtctgttattcccttgcagtcagccatataaatgtgactgagatttggataattcttgtctataaatttgaaggatgcatcagtaacccttttatttcctgtttttaaaaaacagaagaaaagacaagtattgtatttagaatgccacaagagtaaaagtaaacaataatgctgaaccacatttttaatataacagaccttcaaatcggatctttctgagtttacaagcagaaagagctctgaaagtacaatcggagatatgcggtgcaccagtgaaaaccagcgatgtaatacgagagcatttttcaactaaagcctttagaagaaaaaaatgattaaattaatcaagtgtacagaacaggtttagcaaggtaatgaagtcactttttccttcaatatattagagacagacatgttaactgttaattttcctaatttcaaagacaactggatttttccatacattttaatacacctacatttgactaatgtggaggaatcagaattaaatcacgtactaagagtatgggaaaatatgagaaatggactactgaaaaaaattactacatttggcagcttagcatggagaactaaactcaaagtttgtgcttaggctgtaacatcactaaaaaaaatcctaactgtgaaacaaggtttcttaggatatttaaggattcacatgttttcaagggtatgtgcatgtgtggaaacttttcaatgattttattactattttaaaataactaaaatgaaaagtccattcatatttttcagtaattcaagccattagaacatatatctatcttatgggacagaaaagtaaaggtacttcccaactacctacttttacacagttgtccgtcagagttggcatgtcattaatggtaagatgcataattccagtgcagctgtttgcaatgtacctgaagcctt

SEQ ID NO: 42568 - DNA, 1033 bp, Homo sapiens
tattaaaattcaaaaatcagcagagtgtggtggcagacacctgtaatcctagttactcaggaggctgaggcaggagacttgcttgagcccgcgaggcggaggttgcagtgagctgaggtcgtgccactgcattccagcctgggcgacagaggaagactctgtctcaaaaaaaaaaaaaaattaaataaataaataaataaacattactgagtgaaagaggaaagcaaatatagaatagttggtttagaaagttaaaacaatacttatcaagttatacaaacttttcccaaattcttatttagaagtcatttcatgaccatattttttttattacttctaaaaggaaagaaatcaaatcatgcaaatgcaaaaatataaattagttcctagtttaattattggtttactgataagtatctaatgactggctttccaaaaaaagtatgcatataaatgtatgtgcatttactataaaattttatattttactattttgcggatataaaggatgtgtagcacgcaacttacaaatgataaaacataccatattctttactgttaattccatgtagccaatcaattctcacacaatgttttcattgacttttgtcaatgaaactcttataaatgtagccagccaaccaatggttgaaattaaagaatgatgactgggcgtggtggctcacgcctataatcccagcactttgggaggccgaggcgggcggatcacgaggtcaggagatcgagaccatcctggctaacacagtgaaaccccgtctctactaaaaatacaaaaaaaaaaaattaactgggtgtggtggtgggtgcctgtagtcccagctactcaggaggctgaggcaggagaatggcatgaacccgggaggcggagcttgcagtgagctgagatcgcgccactgcactccagcctgggcgacagagcgagactccgtctcaacaaaaaaaagaaaaagaaaattaaaaaaacaaaagaaattgaagaatgattacagttccaatatgaatttttttatta

SEQ ID NO: 42569 - DNA, 1047 bp, Homo sapiens
ccaagtaaatagcttatatatttattttgtaaatatacacatatatacatttgaacagacagacagatctggaaagattaagcctaaaatgttaacagggattctctctgaggagcagtattaaaggtggttttttaaattcattttgtatgtgtaaatttcctaaattttttgcaatgagcctcttttacttttgaaaaacatttttaaaaattcaccctagcaacaataaattataacttttttctctacccaattttgggtacaattgtgccatcccatattttatacttgaactgtttgtgtttacatgtatcttagtatccactgaaacagcagtactgagtccccagcatatgctagatgagacacaccagtgagcacagcgtgacatggtacatgtcctcacgaagcttacagtctagtggagagacaaaaatatataacaagtgaacaaggtaattaaaagctgtgataagtgttctgaatgctgggatagaatggagctccactcctgtagaagaggaaccatcgtattcatctgctcatccctattccccacccagctctgtgccctgtggtgtatgggcactaaatgtttgatgaaaaaatgagttcccatgaaaaccgtatgatgatcttaaaaaagaaaatggttgtttttcccaaataaccacattctaaaattccaaggaaattgtatttttccagctgaaacactcccttttttccattagtattacagcgtgggggtacataaggttttatacatctaagttatgaaattttgggttttctgtgacaaaatttttttaatgtgagatacattttaaatgtgaatttaaaaattttaaaatgtgagttattcaatgtagttttaaaatgttaaaatatacatgaaaaagttttcatatattattaatataaaataatactcattgtttcatatttcaggtggattcatcattcctttccctttatgacagccacgtagcaaaggagattcttcttcgagtacttacgctatttcagaatataaagaactgc

SEQ ID NO: 42570 - DNA, 1074 bp, Homo sapiens
aaaagagaagcatagctataggaaattgaaaaaatgataagtaaccccctgagagaatcatacaatgttagaggcctgctacttaggcaccagacggctcgtgaggataccagactcccatttacatgcttaaccgaatcatacacttaaaattcatatactaagtccccatccccaagggctgacagtttcattggacaggcagggtaagctagaaaaaaatatatagcaaaatatgtgattcagagaataagtactaaaagatttccaaagggaagagatgatggccaacatgatttagttttcagggaataggcgaaatttggtctaggccatgctggaaggctagattttgttttaatagaagggaacatggcaaaggaattataatcagggagctatatatttctaaaaacgcttcctcagtgcctggcacacagtcggtgctaatatgaacactttaagcctcttcagatgaggaaggaagggaagaaacaactaatgtaagtttcaggaataagtgaatggattaaagagtgaatgaatgaggtaactaatgagtggaacatgaaatgcctggagtaccccaatctgaagcctggctttcagagttccccaaatctaattgggccagagcaggcttctcccccaagggtacttagttccccctactatgaaggtggctttaggaatactgggaggcaaaaattctacctctggcctcctctttgggccagaacttgctttcctccagcttgcttctgttgactccttttcagaggcctgaaccttcctctcacctgcccccagacacaggaagatttgggaccaattcagctggacatcgtatggtcgatctcctacctccattatctagggtgggaacctggatgtttcacacaatgtatcctctcactcctaagctgttccctctactcaaccttgccttatgcttcctggggtcagagatctgttcctgatacactcagctcttctctgtagcttccaccccttcccagaagacccttctcctatgacaggttcattctcccacagctccactccctccctccc

SEQ ID NO: 42571 - DNA, 1051 bp, Homo sapiens
aggtagtgaaataaagtcaatttctctctgggtaatgataataattgctcatcttccctgagggaagggcatgtttataaacacgttgctggctttaggacagtggctggtgacagatgtttctaggccaggcagagatctcagtggaaccaaaattcaagaagaaagattcttttatagagacagcctatttaaaatagatttggttttaaaagcaacatttaatatcagattagtaatgtgttttgctttgtctcttccacttcctacccccaaccagtcattatattttggagagaacagattaagaagtacacaggctgctacccaagttgttctgaatgttcctgaaacaagagtaacatgtttagaaagtggactcagagtagcttcggaagactctgggctctcaacatgcacagtaagtgactcaggcaaccttctctaagtgacccttcatttagcgtagcaaattgttgattttaatctttagctttttcgttggctggtggttcaaaaagggtgacagttattttgccttgacagatttccatgagttgtgaaccttttcttccagtggtacttagttacagggtgcatatgtatcctgttgcattgtctgcatcttgttcttgtagcttattattgattatttattttcagtagtattgataataatgaaagaaatatgtttgcagggctactctgccaagtgtttttactgatgtcttatttgataaaaagcaattgtttgtagtgggcatcctcacacctgttttatagttaaggaagtgagagaagttaaatggttttgttcaggtaactcagctaatacatgacagagccaggatttcaaccgaagttttctgacagtctctgatgttcttgatactacagttattaattggctggattaatgagttgggcaaagaatcctcattgaaggtggcaggtagatacttgtagcacccagcagtatcctgatcgaaatttttaaatctcatagttcacaggaatgaactatcaattcactcaggtcaagaaaatctta

SEQ ID NO: 42572 - DNA, 1078 bp, Homo sapiens
atacgtgtgcatgatgatcacttactcttattggtaagaaagttgatcatatatccttaatgtatgtatacttgtaagttaaatacatgtgctactatactaacatatattaaatacacatttaaaaaaaagattcagattaaaacagactgggaaataggagcccccctccctgcctttggaaactaccagggtagaccaccaatcccacataaaggaggattttcacacaggaattcttgtccttccatttgtctatgggctctttctcacccattttactggactctgttctcttatctggacagatgggttttatttggttttacagataattttttccttttggtcatgatctcagccacagcttactataatagtttgttctgtcatgttcttagtatttgaacataatcagttctgagacagtgccccttaaagtgaacttaattaaaacaagcaacaacagtttgtagtagagtaaaaaatgaaacctaaaccagacacggtagtacatgcctttagtcttggctacttggaggaagctgaggcaggaggattgtttgagcccaggaattttgagtccagtctgggcagcataatgagaccttgtctcttaggggaaaaaaaagaaacttaagattgtaagtttattttataacattaatcgtattaatgaaatttagatttatgattgcaactatgtactaattcttcaagaatgaagcacagttttttttttggagaggtatgcgctttttctgataaaattgcttaatggcctaatataacatgttccacttcacttttggctttttgcaaattagggtttgagaacacacaattctgtgattcatttggggcatattttagattgtaaggattcttttctctgttgcccaggcgagagtgcagtggtgcaatcgcagctcactgcaatctttgcctcccgagctccacccatcctcccatctcagcctcccgagtagcagggactacgggcacatgccaccacacgaagctaatttttgtattttttgtagagacaggattttggcatgttccccaggttggtctg

SEQ ID NO: 42573 - DNA, 1024 bp, Homo sapiens
gggattatataggtgtgagccacggtgcctgaccagttctttgcttcttaacatagcactgtcattgctgtgggaacttgcatagtaaatacttgggtgatacaaaccctctgtacattgctagctaggtattttcagactaatatatataactttgtaattttcatatagaacaatctatattaatatgcaaatttccatagcattttttaagtaggtagagtcattacaaggtgatggcaaatttatactttttccccaaggaaaaaatcttttgtactataggggtttatatgttaaattttaattttgtcctgttaagtatatctgatgtttttctcctaggctaatcatttagtattgagtgatgggtcagtgtcatgatttctgattttggtttaatagattttaatagtgaaagttaagattgctggcacgttttcttatattttattttcaattagctgtagaaattcttgctgatataatacaaaacagcacattgggagaagcagagattgaacgtgagcgtggagtaatccttagagagatgcaggaagttgaaaccaatttacaagaagttgtttttgattatcttcatgccacagcttatcaaaatactgcacttggacggacaattttgggaccaactgaaaatatcaagtaggtataacagaatttcttggtgtataagggaatttatgaatgttgaaaataaacatttacaaattttcaaaaagtatgtttcagaaagtaattttccccctggtaatctaagtgaaactgtagttagctacattttagtcccacctagctcccaagcacgtgagttcataggtacttcgggaataaaccagtaatggtgtattttttctttgatgtaaaaaaggtgaagttctttgatgtgttgcctgtatcctatttctgactgcattttaggatacagttatggtccaatttgatttcaggtatattatgtgaagatctgttttttttttggtttcctttaaaaattgttttactt

SEQ ID NO: 42574 - DNA, 1066 bp, Homo sapiens
tggagtggtatgcttattagtttgatcctgttgggagataccctaagaattttcatttacatagcaaataactgatagtgtgtaaggggaatgtggagcactggaatcagaatttccctctattttttttaaagtaggtttcatttaggccaggcatggtgactcacacctgtaatcccagcactttgggaggccgaggtgggcggatcacgaggtcaggagttcaagaccagcctgactaatatggtgaaaccccatgtctactaaaaatacaaagtagctgggcgtggtgacatgcgcctgtagtcccagctactcgggaggctgaggtaggagaattgcttgaacccaggaggcggaggttacagtgagccaagattgcaccactgcactccagcgtgggcgacagagtgagactgtctcaaaaaaaaaaaagaaaagtaggttttatttatagaaagacttaatgaactgttcaatacataagcgtacatagtagaacgtgcaagaaaagggcaaaggagtgaactgggagagagtcggaagatggtgttctgtactttgagaattttttgagattttaaattatttcttgagaaccaacttcgtccttgttcaagcatggaacgggtatgttcattctttgatttgttcaatcattcatttaatagatctaatttttgggaaggagaagcacatagggagccataagaatgttgaatgggaatccaaacatgcaggtgacttcagaaggtttccttgaggtcatgtttgaagccagtgaatgaaaaaaaaaattgacaacagatattgccagatttcctggcagtctgaatctagacagcagtacattttaattggtttccagttttttatttttttctttttaaaatacatttatagaaatagagatggattcttaactatgttgcccaggctggtttcaatctcctgagctcaagttatccttccaccttgacctcccaaaacttggggattacaggcgtgacccaccgcacctggtctccagttttcatttctttgtattttttaatattagagcaaa

SEQ ID NO: 42575 - DNA, 1021 bp, Homo sapiens
ttgtatatcttctttggagcaatgtttattcaggttatttgcccacttaaaaaatcaggttgttttcttgtgtggtaggagttctttatatattctggatattaactctttaccagaaatagattaccttcactatatttgtagatgtggccactacttattgtgtctaatatgccaggcgttttacaaacactgtaaagtttccttctcacaggtaatcagtccaaaaaccagcgtgccaaagcgtttccccagggctctgtccggactctgaagcactgcataaaggggtctgtctgagcccaatttacttccggtggggaagggaaagggaagacaccaccggaagcaaggaaggtgctgtgtaatcattaaggagcggaggcttttggagctgctaaaatgccggattacctcggtgccgatcagcggaagaccaaagaggatgagaaggacgacaagcccatccgaggtcagttgacatgggccggagctcggagctggggcgggactggagcggagctgccttggcactggagaggagctggattcccgctcctggctctgtgctctggcccttttgtgcccctagtaatttagtctggacaccggccggattaacttgcctgccttctcagtctccctcatccactacaagttctgtattatctgctgatggaaatttttattcattctcagctctcgggtcttgaagaagtcacgcaccctgcttggcctaataggccttgaaaagttctgcctggcggtgctcggtcacctgatcctctttcctctcctcctccttccccctgtgacagccgggagctgtcactgtgtagccacaattctgagacataattttcttaaaaaaattatttgaccagataatacattcacagggttcacaattcaagaggcagaaaagatatctttgaaaagcctcgcatccttggccccagccaccaacttctccacagaggcaactaatgttgctattttgcatatctttttagacatattc

SEQ ID NO: 42576 - DNA, 1072 bp, Homo sapiens
gagaaaccaggcacaagcttccaagggtcctcttccagtggagtcacacaggatgtacttaattcccccagcaacaggtagtgacaatatgtgtaaaatgttgctaaccagagtagctcgttagagatttggcacccagggtttttattatgggttggtaatgtaggcatctctgcctagaacataccaaaattctagactccctgaaggaagataagtgttctgcataaaccctgtagtttgtataaacattttaagcacagtgaaccacctttttcagttctgggaatggtaggaaccctctgaaattgttctcagacaagagccaagaaccaaccttataagcaggcctttcaaaggatagcagttaactcttctgtgcagataacagtaccacaaacttaataaaatttaaactgaacttcgtatctccctctgctaaccactttctattgtgacttctgttgtgtggtacctaggtccaaagcctgggcatcatgtttgatcctctcccgtcagcttctcacatttagtcatttgccatgtgctgtagattcttcctctgagggtttttttttaatccaactcttcctttctcttttcattgctaccatttttatttaggttcttatgacttccgagtggcctcactccaatttgttcttcatatctcagcgagctaattcttcctaaggcacagttcctataatgtcaactgtagtggccctgattacctcattctagaatttatggtctacttcactagagccccaaacctccatctacttaatttcctattaccgcctaatgtgtatactatgtttcagcttacctggtctagctgctgttacctaagcatgctttttcctacctctactcatacttagttaaaaaaaaaaaaaaaaaaaaaaaaaaaaaaagacctgccgtttttttccttaaaatatgtacgattgtatgattggttcttgtttttcatgatagatatattctataaagttgctgtgaatggtcagttgggaagtactgaacatttgatcctaggagaaatatatatatacatctcacatag

SEQ ID NO: 42577 - DNA, 1046 bp, Homo sapiens
atcacaccattgtgtttcagcctgggcaacaagagtgaaactccatctcaaaaaaaaaaaaaaaaaaaaaaagaaaaacggatttaaagtataaactcaggaaaagaatgaaaacccatttattactgaatttggtgtaagacaagatgaccatctttttgtagggaaaataaaaacgagagcaacttaagatatacaggagcatcactaataataaaggaatacaaactatggaaatcaagaaatcagagaacttcttaatgatgagatatttgggtttaattttccaggagaatgtatttgaaaattttatgacttggctaaagtcgaatggacctttggagttgggtatagaaaaggatctttaacagtgtcccagtttctgtagttctagtttatacctgtatattgcacactcaggatataatctagttagttgaattcattattagtggcttaggttccttattctaatcaagctttttgctgtgttaggtgtacaaagataatcaatgctgattcggaggacccaaaatacattatcaacgtaaagcagtttgccaagtttgtggtggaccttagtgatcaggtggcacctactgacattgaagaagggatgagagtggggtaagatttctatttacaataaatacttttctttcactaaggatactgtctcacattcatatccttggctttgtagtgaataaatggactgagttccttggaataccaaaggatgatctagtaatgtactatagttgaaaattctgtcttctgcatctgcttcctaacttcccatcggcttcgctgactcccctactcccactgttgtttattatgaatggcttcaaatttcagagttgaggttaccagtccatttaaggtaacatggtataggttgggggagtacttgctttaggatagttgtgatgctaagtgtgttaatgtctatagaatacataacaactcacttagtaaattaaaaaaaaatctcccctccctcctcaaaggtttgattgctgttggataggttgtttgcgaca

SEQ ID NO: 42578 - DNA, 1045 bp, Homo sapiens
cctgagtagctgcaattacagatgcctaccaccatgcctggctaatttttgtatttttagtagagacgtggtttcaccatgttggccaggctggtctcgaactcctgaggacaagttattttaactaatctctgagcctcagtttgctcatcttataaagggaataattgttgtcttgtgtacttcatgagtttttgagaggtccaaattaagtaataaatgtggtagactttgaaaacactaaactgccccataggcagtttaaaaaacgttaagtaaatctgtgatgaatacttttgaaagcaaagattcactttctaattagttttatataaagcaagctgttcttacaggatttgcttcaaagtgggatgtcacttgtgcctgaggacatgatttgagctgagatttttggtactttcaggtcatgcatagtgctactcttgagtggacttgaagagcttatctttccttttgtcttctcaggggctcgttttgatgatggtgctggaggtgacaatgaagtgcagagaacaatgttggaactgatcaatcagcttgatggttttgatcctagaggcaatattaaagtgctgatggccactaacagacctgatactttggatccagcactgatgaggccagggagattggatagaaaaattgaatttagcttgcccgatctagaggtaagaaaaccatttcattttaggaaagggatttttgaagttttttcttcctgtgatttttttccattttaatatttgtcaattttctcatttttagggtcggacccacatatttaagattcacgctcgttcaatgagtgttgaaagagatatcagatttgaactgttagcacgactgtgtccaaatagcactggtaagtagaaagttcttgcttatatttgctggtctgtctgctcaggctgctttaattaagcccgtttattttctttttgtttgaaaggtgctgagattagaagcgtctgcacagaggctggtatgtttgccatcagagcacggcgaaaaattgctaccgaga

SEQ ID NO: 42579 - DNA, 1910 bp, Homo sapiens
ttttagggaccttttgaactctgataatactatagattaatttagtggcagatagttgagtgccttcctatgtaaaagcatcatagtagctattaattttgtcttgttcatcttgcacatactgcttcctaagggaaataactgatgattgtgttggttaacatcgctggagtcagattgtgtggttttttcaaatgtaagcctgtaattggtgtacagtaacctagttgctgtatattagtattaatcgttagctatacagtaatctgtcaaccatttgatctttgaattgtatgtttaaactggcaaatctcatggatgtgatatggttgtaccaaaagacaaatgctgttttattgtgtgattactttgagaataattgtgagaaactggtaattatcatttaaattgatctacagtgatagtggaagttatatgtcaaaggagattttgtcgacatagcttaaaatttcacttacagaagtttaaaattggtacctcttacctcctaaagtaaatagttcattaaggattttgggaaaagcaattctagttcaatccccagctacacacagcaatttcctcatgcttaaatggtttttatgagtgactgatgagctcactatatgtgggttatttttcatttatatataaaatccctttgcagaaaggccccgccctcttttttttttttttttttttttttggagacagggtcttgctctgtcacccagactggagggcagtggcatgattatggctcgctacagccttaatctcccaggctcaagtgatcctcccacctcagcctcccaagtaactgggactacaggtgccatgtcaccatgtctggctaatttaaaacaaatttttttttgtagagatagggtctcactaaacagcccatgctggtctttaactcctgggatcaaacagtcctcccacctcagccttacaatgaagctggaaggtgaaagtgagtgtagtctgtctcatagcaaaggtactggtcccttataggactcattgtatccaccaacctcattcttgacatttcatttttgcctgtattctaaattttttcagagattgtgtgctttttttgaagttcaaggcaggctactctaaaagctcatgtgtgtttgcatactgagtatttttcttattggatatgtggatctattaattccataattcatttttgtgtgtaaagtgcacagacattttctttccttaagcttcaactctctagttgtattatactagtcttcccatttccgggtttttgtttttctatttacattactgtatgaagaggaggaagctgatcttgggatatcgtaagtcttggaattaaaagacaggaaaatgctgtagaagtaaaactgtttaaacttgaaagtatttacatatatatttataattaattttggtcccttgctgattttatgggtttggtaagtacttaggaattaagtctactcttagtttagtcttaagatttttatagtaaatattttaaatacatctgaaatattaagataattattcaaatatactaatagagttgctgttctttcaccatttgcttagtggccaacagtattctgattggaattgattattatcattggactgaataatacaatttttgtatattctaagagacaactaacattaataaataaatatctacactgtgtctacatatcgtactctgagcaaaaagatagatattttgctcattttttcctgagtggcatagaggaactgagactttttttttttttttgtgagacagagtctggctctgtcgcccaggctggagtgcagtggtgtgatctcagctcactgcaacctccgcctcctgtgttcaagccatcctctcacctcaggctcccgagtaggtg

SEQ ID NO: 42580 - DNA, 1027 bp, Homo sapiens
ttatataaaaagggacatactagtaaataaatacctaagtagattattttagattggaaatatcactcagtacttaaaagactttaataatgacttgatttcctttcaatgtttgcctctggtaaataagtataccactaaatatagtatatacctaaaatacaagacttttgtgagtctaacataaaaaacagtgtttcttcaagtagcaattcttatatctgcctgtaatatttagttacatttgaaaatatctatttaggttaattcctgtttcacagattatacagattgtgagttcatacattatgggggaagattaccaaagcgggttaataacatgttaatagtggtttgaattctccaagaaaactagccttgaacttttaaactatgtgtaactgggagagagctaccagattactaattattataagataaaaatatacagtaatagacaattgcacactgcttttcaatatttcaggtattacattacagagacaaggataatgactgttgctgttttctaatttataggattatctatattggttttgttcctgagttgcacctgtataatttttgaaaagactttgagtagatattttataaacatacctgtagccactgttatgtagtgaatttaaattagaaaaattgatgttgaagctaagtatcttttagttgctattgtaaatttgtttaaaaaaaaacttcattagttttttctactaattgagttagggaatattaactctttaataactgaacaatattaatggaagaaaaagagaactccttcaacagtatacctagatttacctgttatagaaaatgacaactactgtacagtaatcaaatttttacaaataacatagtttcccttacatacagatgcaaacagtagagtagaattggttcagatcctggtttcatctcttaagtggagtagccttgattaagttatttttaaaccatgtgttgctggaggagagctaccagattactaattattataatatga

SEQ ID NO: 42581 - DNA, 1033 bp, Homo sapiens
cactcaagccccgggagtttgatgctatagttagctatgctcacaccactgcactccagcttgggtgacagagtaacgccttctctcttcaaaaaaaagaaacaggcgaggcatggtggcacatgcctgtaatctcagcactttgcgagccaaggtgggcagatcacctggggtcgggagcttgagaccagcctggccaacatggcaatacctggtctctactaaaaataaaaaaacttaccgggcatggtggcacgtgcctgtaatcccggctactacgaggctgagacacgagaatcacttgaacccgggaggtggagcttgtagtgagctgagatacatcactgcactccagcctgggtgacagagcaagactctgtctcaaaaaaaaaggctgcgaaattttttttttttttaaagaaaggctgcagagaattaagaattacttttgttgatagtgtaattgatagattcatcaaagtcttttattttcacaggtcattgtatcagatgaacctaatgatggttgatgtaccctgtgttctgtacctcataaaaaatgaaggcaaatcattaagacacttggctctgtagttgaaggaactcaaggaaaaaaaaaggaaaaaattggggaattatttgttgtaaaagcaagttgctctgtctgtctgtctatctatctatctatctatctatctatctatctatctatctatctatctatctatctgtctgtctgtctatttgagatggagttttgctcttgttgcccaggctggagtgcaatggtgcagtcagctcactgcaacctctgcttcctgggttcaagcgattctcttccctcagcctcccgagtagctgggattataggcatgagccaccatgcctggctaattttgtatttttagtagagtcagggtttcaccatgttggtcaggcttgatctcgaactcctgacctcaggtgatccacctgccttggcctcccaaagtgctaggattacaggcgtgagctaccacgcccagcccgcaag

SEQ ID NO: 42582 - DNA, 1037 bp, Homo sapiens
ttatctacctatcaaccttctacctaagactcttagcatccatggttatttgttgcccagatatataacctcttaagggttgcagtttagttatttttctaatttatttattccttctgcattttttagctgttggggaatttctaaaagaagcagtcagcacctaagtattggcttatgtattaacaagagaatatacttacattttagttttagagctgagttgcatgttagaatccccttttatgcatttcagttgttctacttgttggaaacagaattcagagttttgaaaaggtgacttcatctacaaattatggtggttttgaccataccttattgcttatatattgggaataatttcattacctgctactaggttggtgcaaaagtaattgcagtttatttttgaccattttgaaaattttgaacattttgaattcttggagtatgcaatgaatatcttttgggaaatttcccatggataaagagaaaatcttttttggattcagtgattttagaacatatacatacttcctgctgacaggctaaaagaaaaaaagaacatacaaagcagtatatgaatgagtataaaccactatataagctcttcactctctaactgaagagtaagatatcaaaattatgtatgtgaaatctcatttttctatagaatgaacactgcatcatggattatgttttgatacataattatataaacacttctgtaaataattatgaagtataacacttagaaatgtaacacttctgtccttacatttgggaagaaggaaaaagaaattcatgctagttttgctgttggacctcagactgcaaaagttatggctgctactccaaaatatccaagttttgcccacaccttttagtaacatgttttgcagagtttgatctaaatttttaagagtgaatctttgtgctctggccacagttcctgcatgttgctttaataatagtactgtaaatcgttgctaaaacttcacttcttccttctgtgtaatttttaaagaatttaaaaa

SEQ ID NO: 42583 - DNA, 1100 bp, Homo sapiens
tgatttcacaagtttccctgttctatttctgtaagaaggtgtttatgtctataggcttgatcagatttaggttcaatttctttttttttttaataagactattttcatagttagactgttttgtcttatcaggtggcacatgatttctggttgtcttatgatggaagccagtgatagtccttagatccactaatttattaggggttgcaaattagtgatatgttaattctgttgttcattacttatcagctggaatatttttattggaacaaacttctcttttttttttttaagacaggatctcacattgtcgaacaggctacgtgtgaccacagctcactgcagcctcagcctcctgggttcaggtgattctcccatccttccacctcagcttgccaagtagctgggactacaggcatcgccaccatgcctgactagttgtggttttttttttttttgttttttttttttttttgtaggcacagggtttcaccatgttgtccaggctggtctagaactcttgggctcaagcaatcttcccacctcggcctcccaaagtgttgggattacaggcgagagccaccttgcccggccatgtctctatgttaactattcggttctcttaagatatatttcattgaggaaaggctggataaatgcttgttgaatcttagcctttatttactggttttcagaataatgaaaaattaagtatcattgtgacctcatggatttaaaccatagtggatgtcagtctcttgcagttattacccttattgatgcttaaatttcattccatttctggtcagtaggaacctcttcaagctggttatcaagtcctttaaacaacaccctagtggtacttcatggcaaagaagatatctggtgtgacaagatgtctcaggcttatcctgcacttctgtgccccaaattcagagttggctttcaagaccagaattggagagctagtcatgccctttcctactagattggtcactgttcctagtctttttagtagacaaagctaggaagtatgtttcatctgtttctttaagataaaatacatgagtttataccgataattgcaattgaaatttagg

SEQ ID NO: 42584 - DNA, 1100 bp, Homo sapiens
agataaactgtatatttcatatgtacctgttaaggtactttttaaagcttgtacatgaacctttgtataaaaaacaccagtgctctttcgttgtatttttctcatttttgctttttaaaattcctttaaaaaatgtgctgttaagccagtattaggtatctttattttgtaagtgaacattccagctgtttttttctggcagatctgatgctgatttgatgctgtatgatcttttttttttttttagttaaattcatttagtgaatgttctattattttatacatacacattaagtactcagctaagtaatggcactatgaggattttttttttctttcctgtcagcagcagttctgtgaatgcatcttaggtataaaaatgcaatacagatttttatattttggtgtggacatggctcattttgttttaccagttatttgcaagcaaaatgtaatttaatgtatagatgatttctaatgtctcctgacaaactgtaaatactgcatttcttttgcgtatataattgcttacagcttttctcatttgatatatagcattgtacatatgacaagtcttttgcaaaactgtgtgatctttgtgaaagtagtacagtatatgacctttaatttcttttttattttaaatatactgtcacactgaagcactggttgggcattttaattcatgttaataaatcacaattatgtcagttttaccagattgtcctgtacaacttctaagatcgggatctgtgtgtttctacagaagttctagttttcaaatatagattgtaaggagccttcaattttctttagcgactactacctcagcaacaggaggcagcaaggggctgttcctgtggtggtttctgtttgcatttttgcaggagccataggaaactactgaaatgattgtgctgggtaaattaaggatctggcatcatacaaaatgaagccagaccactaatgcattacagtagttcttgaatacaaggtacaacaactgtttgaaaatatgggtagtttgcccaaaacaggaaaatttgtcttgggtgtaaaaactaaagaaaaaaggcattattcctagatctctcagtgaa

SEQ ID NO: 42585 - DNA, 1047 bp, Homo sapiens
gttttgttttttgatacagagtctgtctgtgtcgcccaggctggagtgcagtggtgtgatcttggctcactgcaacctctgcctcttgggttcaagggattctcgtgcctcagcctcccgaatagctgggactacaggcctgtgcccccacgcctggctaatttttgtatttttagtagagacgggatttcgccgtgtttgccaggctagtcttaaactcctggcctcaggtgatgcacctgcctcagcctcccaaagtgctgggatcacaggtgtgagccaccgtgcctggcaaaattattaacttttgaaggcagataaactgcttttatatgttttatattttctttaactccatagtacttagtggcgttgagtaattgttattcttttgttgtaggtgacataaatgttacagttcttattggaagtaaacaagtcagtgaaggtacagataatggtgatctcccttcttatgtgtctgcattcatagaaaaggaagttggaaatgaccttaaatctttaaagaaacttgataaactcatagaacagaggacagtaagtaaaatgcagttagaagaacaggtaagtattgaaactcactgaaataattatcagtggaatacttttaacaatataatataaacataatctattatatatagaattttaaagatatagaacgtgacaaatagtctattatatactgtttaagaggatttaagaacgtacattgtattacctattttacaaattaggtaaaagacaaagttcctactgatatggtttgtcttcaaaacatagtgagacctaacattttacatagattttcatagagtgacttttttttcctttcaatctgtttctagtgaacatacagtgacttttaaattgcttttacaagcaaataatttcatggcatacaaaaatatataccatggtgtaaacaccatcatttcaattttttttttttttttttttttgagacggagttttgctcttgttgcccaggttggagtacaatggcgccatcttggctcactgcaa

SEQ ID NO: 42586 - DNA, 1075 bp, Homo sapiens
actcccctcaactgttctttcagattctgtttgagacatctacccaacctgtccattctgccctttccttttccctagcagaaaaaaatagaagcctagcatgaatttagtagcattgaattcagtctgttgaatagtctatcccacaatcgacaaatttatgtgcagtcatttttaacctcttcattcagcaaaggatcagtcgaaggcagaccttataccccaggttctctctgccacctcagtaaacttgtgtcactcttataattttaccctgtgttcgtcaaccagtcctatcccttcagcatgtgcacatagacaggtcttttccataaaaccttaacaaagaaacaaaaaaacccatgatcttttagcaggtattagttctttcctttgattgtcaggcttcagaaagtaacctttgttatctatctctactttttgtcattcatcttttacccactgtaatcaggtttgtttccctaatgaccacagaaacttttactgaagttccttattgaaccttaaattcagcatgtccaaaactatactgatccattttttagaggcttgtctgtcttggttagataatggcaccactatttgcctgtcacccagacctgaagcctaggagtcctagattccttcttatcatcctctcatcctctatcccatcaccaagtcatctgagttcagcctcaacatctctggtatccatcccatctttcccactcttttttttttttttttttttttgagttggagtttcactcttgttgcccaggctggagtgcaatggcacaatcttggctcactgcaacctccacctcctgggttcgagtgattctcccgcctcaggctcccaagtagctgggattataggcatgtgccaccacgctcggctaattttgtatttttggtagagatggggtttctccatgttggtcaggttggtctcaaactcccaacctcaggtgatctgcccgaaagtggatcttggccttccaaagtgctgggattacaggcgtgagtcactgctcccggcccatctttcccactcttgctgataccatgt

SEQ ID NO: 42587 - DNA, 1047 bp, Homo sapiens
gaattaactgtatgtttattcaatataaaattaggttacatattatttgcatcataattaactctactgagtatctgatacatttgttggaaaaatttattgtgtgtgtatacatacatatgtgtgtgtatattaggtatgcttttgattctttttccttgacttgattatgtcagagatgaattacttactgagccaaagcaactcccagaaaaatactctcttcctgcctccccttctgtcatcctgcccatccaggttatgctgactcctcttcagaagaggttcaggtatcacttcagagggaaccggcagactaatgtgttaagcaaggtgtgttttgccagctcttgtccttggtttttattggtaacaaatgttagagtttctatacctttgctggtttaagttaaaatctgactctcttcacatttctgttttttttctaaagggctacattcctgttttgttactgctgttcatacatataattgaggacttgtgttcatatactgtaggaaaaatggtatttccgctcttgggcatcagatattgctgagttatcattgcaaaacaaagcaaagcaaatagtaagcacttggtatttcttttctttttttttttttgtgagttggagtctcgctctgtcacccaggctggagtgcagtggcacaatctctgctcactgcaacctccacctcccaggttcaagcgattctcctgcctcagcctcccaagtagctgggactacaggcacatgtcaccacactggactaatttttgtaattttagtagagatgggtttcaccatattggtcaggctggtctggaactcctgacctcaggtgatccacctgacttagcctcccaaagtgctgggattacaggagtgagccactgcgcctggcatgtacttggtatttctgctcttaaacctgtataagacatgcgtagtttttgtaatgcagactagcaattttttttttttggaacgaagtttcactcttgttgcccaggctggagcgcaatggtgtgatctcggctcac

SEQ ID NO: 42588 - DNA, 1026 bp, Homo sapiens
aagtggaaatactgtatcaaaaggtatggaaaatttaaatgatagataccacgtttcttaccattcaggatgtacctcagtgagagtgcagatgagatcacatgttttcttgcagcctcaacattccaggcagtgtagacagtgcaaaggtcctgtggtagagggaacctggtgtatcagcaggactgaacagattccctaggggcagagagcagagagccaggtggggagtgaagagggaggcatgggccagaccttgcagggccttgcgattcatcttgagggttttggtccttatcccaagagaaaggagaagccaaagggaatttcatgcaagctgacatgatgagataggcattttgaacaggtacctctggctgctgtacaggcaatggactgggaagatggaaaagtagatgtgaagagcacctggggtagctattttgggagtccaggtgagagatgatggtagcctggactcgggtggaggctggccatggagaggagtggctacatttaaccgttttttaggccacagaactgatggaagctgatgcctaagtgggcttaggtggggactgaggaagaaggcagtgtcctggaagaaagatggaatgggagttatcattgggatgatgagatgtcaaaggagcaggtgatgattggccaaaaaagtgaagatccagaggagatacctgctttagagagcagcctttgcacccttgtctctcatgcccgcagctctatcaaaggcaggctgaccatgggattctgccaccctggccacagctgattggagtgggaaagtacctgagccgtggccataacgtggtctggagtgaaagcctgcccatgaaggggcagtgccaaatggagctgatgagatgtccttcatggagtttgaaggagaacccaagtgagtggcaatgtttggagctggggagtcagaagaaaggccacacaaggagagggcaggaaatggaagtcgtaagttaaagtcacaaggaaacaaggagagaagagaga

SEQ ID NO: 42589 - DNA, 1055 bp, Homo sapiens
gagacagccaaagagctctgagagagagcaagtgtgggcaagaaagaggggacatttgtgtctctgaccatgaacatatgctgagtcacccaactgcaggtccatttttttggtgagactgatataaatgttcttccaaactggccaagctgcaaggtttccaaaagcaaagcttaaggctggacgcagtggctcccacctgtaatcccagcactttgagaggctgaagtgggaggggtttgagaccagcctgggcaatgtagcgagaccccatctctacaaaaaaaatgcaaaaaacaaaacaaaacaaaaacccaaaacaagcaggcacagtggctcacacctgtaatggcagcactttgggagtctgaggcaggtggatcacttgaagtcaggagtttaagaccagcctgaccaacatggtgaaacctgtctctactaaaaatacaaaaattagccaggcatggtggtgtgcacctgtaatcccggctacttgggaggctgaggcacgagagtcacttgaacctgggtggtggaggttgcagtgagctgagatcatgccactgcactccagcctgggcaatagagcaagactctgtctaaaaaaaacccaaaaaacaaaccaaaaccaaaacaaaaacagagcttaaaaagcaagacttgcagaacattaggactaggaggtagctgtggccagggctctgtgtaatgcaaagattatgtctataggacctctgcaggcctgggttttactcctagctgtgtccttactagttatatcatcttgggcaacttatgtaaacccctgagcctcagtttcttcctttgtaaaatgggaataacaatttctgccattcagtactgttgcctagatgagtgataatttgtgtcaaatacctggcacatactagggactcaataaattttaagtacagtaatgtcacttaacaatggagatatgttctgagaaatgtgtcattaggtgattccatcattgagcaaacatcatagagtgtacctacacgaacctagatgcctactacccacctaggata

SEQ ID NO: 42590 - DNA, 1030 bp, Homo sapiens
ctctgctactgtggtatcagctttattccaagtctggcttcctttgttgttgcaaaatgcttgtcagaagaagcctgggtccatctgttaggattaagtttactctgtatgctgtagtagtggctatgacaagatagaagtgtatttctcctccatataaaagaaatccagagataggcagtccagggatggtatgtggctccactatgtcatggacccagacatttaacttgatgctccacgtcctaaggtatggctccttttctcaagttcacctcaaggtccaaaatgactgctagagttccagccattacatctgcattctaggcaggaggaaggggcagaagaaaggcttgcctcttctcttttaaggagactcattggaagtgccacacaatcctttgcttacagcttattggctggcacatagggtagttgccagggagactaggaaataaagtcttttgttccccctcccatcctcagttccttttgcactgtgctaaacaattctaggacttttaacagaactcttcataaaagtcttgaattttattgtatttatttatttttgagatggagtcttactctgttacccaggctagggtgcaatggtgctatcttagcccattgcaacctccacctcccacattcaagtgactgtcctgcctcagcctcctgagtagctgggactccaggcgcgcaccaccacacctggctaatttttcttttttttttcgtagagacaggtttcaccatgttggccatggctggtctcaaactcctgacctcaggtgatctgcctgtctcggcctcccaaagtgctggaattaccagtgtgagctaccatgcctggccaaaaatcttgggttttagatcccttctttatttttttggatcttttctgaatcttctccagtctttcctgattcacaaggggcacagtcataagccaggaaatccctaaacctttatatactttagtttccccatctataaaaagataaaagataattgtagctaccctttt

SEQ ID NO: 42591 - DNA, 1046 bp, Homo sapiens
acaaatgctaaatgtgcattaaatcaaggtatgtaaaagtaaaaccgtccagtttaaaattctactctagaggctgccactgccaaatttgagaaggccctctgcagcccaccaccacaagctggaagttatagtcacagcagaggggagccttcgcctcctttgctctggacaccatctgcagtgactgcggcctccaactgcactgtgggcttggagcagtgagtaggtttcttttgaccttgaagcaactagaccctgagttttttgtttgctttaaataaacttgttcagatggcactcattttatatccttgcaaatgtgtttcttggtcttagaaggactttatatctatctccattatttttcttgttggttgtgatccattatatcaacttatatagatctttcagttctttcaatttgatcaccgattaaattatctcgctcaatgtcattctcagatcttaatacatgtgatgcctctctttgtccaaataattgataagagctttgttaaaggtaggaccaaggacagagtctttgagcacttgtaggggaattaatcaattaatactcctgggctacagtttttcaaccaaatatgaacacacctgattgtattatcattcagtcttgtctataagggcatgaaaaatttggtcaaatgcctttctggccacagcattttcctgattaatccagtaagtttattcaaaaaaggaagtattcaattttattcttggcaaacctatgtgagttcctacataccatcaccttttcttcttagggttcagaaaatatttcttttatggtctgtgcaagaactttgctgtggattgataccaaacttacattttggctgggcttcaagtgactcagaaaggggctgggttcaggctgggatgtctggagcctgtagtggtggcaaggcaaaggccagcagggatagtgaatagaggcctcagtgatgaggtgggtgcgttggttaattgcacaggtgatagggctggctaattagggtagggaattgactagctgtcag

SEQ ID NO: 42592 - DNA, 1047 bp, Homo sapiens
aaccaactgagaaatagttaagacacaaggcagatctcaaatgctgccaagtttacccatcttagcaggacagggatttataattagagctgctcagaaaagcactgccttacgggtggcaaaggacaaaaaaggctttgtccccaacatctccacaggctgcggtttcccagatgggcccttaacagtgtacacaccctctccatcgccagggtcctcaaagccaccgcctctaccaagcaaggttcgacttctacaccacgcccctgacattctctccaggcctcttttgtttctggcccaggctggatgcatcacactgtgaattcctggatgaggaagaacaaatcttgcggagtgttctggaattacagaggagagccataatgggaaaatgtgacaaagcaattcccttctctgacatacacattttacccctgtctctcacctttgtcacgtttccccattttttcaccttctgtgggtttctttttctgtaaaatgaagggattggatctgctggtttcaaactgtgctacctggagccacttgcgggcctggcggggcccagtggaagtggatggggagatggtgagaagggctctcttcaaaaaaagcaggagggggctccaacatagcatttcaaggaaatcaagggatccaaagttaaacaatttgaaaatcacaagtctggacgaagtctcattgttctttccaactgaacactgccggtgtggtgtgcctcacttctcagtctccattcactaacccaaatatccccaaagatgtgcaccaatttttctgtctagcattcatcagagtgctcctgtgtgccaggccctctgctaagcactgggcatacagcagtgaacagaaaccccagggggctcatagaccagttgggaagattggcattaaacaaatgaatatgtaaatccaaatcaagaggtatgaacaccatgaaagacaaaatcatggttgaaagttgagtgggcctggggttggagagatactgccctaagcatctcccctccccacctggcttgc

SEQ ID NO: 42593 - DNA, 1014 bp, Homo sapiens
acaagtctctagggcaggggcaaaatgccaccagtctctttgctaaaacataacaagagtcacctttgctccagttcccaacaagttcctcatctccatctgagaccacctcagcctggatttaattgtccatatcatgaacagcattttggtcaaagccattcaacaagtctctagggagttccaaactttcccacattttcctgtcttcttttaagcccaccaaactgttccaacccctgcctgttacccagttccaaagttgcttccacattttcaggtatctacagcagagccccactctattggtaccaatttactggattagtccattttcatactgctaataaagacatacccgagactgggcaatttacaacagaaagaggtttaatgggcttacagttccacgtggctggggaagcctcacaatcatggcagaaggcaaggaggagcaagtcatgtcttacgtggatggcagcaggcaaagagagagcttgtgcagggaaactcccccttataaagccatcagatctcatgggacttagtcactatcacaagaacagcacaggaaagacttgccaccatgattcaatttcctcctactgggtccctctcacaacatgtgggagttcaagatgagatttgggtggggacacagccaaaccatatcagataccaaccaactcccttgccttccagcttctagttggccaatggggagtcctggaaagagaaggagaggagggtcaggctctctctttgtgagctgggtgcatcccttccctgcctgaagatctccattcccaaaagcagctctctgtcgcaggacctgcttcctccactggcttccctgggcctagtggtggtaagggtgcttcactctcacgagccctgagatattgcaccatctgatgagatttccatatactctgtgagcaccttcttcatagtccctttactgacccctcctagaatgatcctaattcaccagctgcttcctgctgacacccc

SEQ ID NO: 42594 - DNA, 1044 bp, Homo sapiens
gaaaaatggtgatgcattttataaatatctatatagtaacttcctagaaaaggaacagtgaggtggaagatcatgcatatctaaaattttattaaattttgacaaatggcttttttagagtttgttccattttaccttctcaccggaagtctgtgtgagaatgcctcttttcccacacggtctccaacacagtgtgatattctaacatttgtatctttttgaatctggcgagtgaaaagtggcatctcatttcgattttaatttggatttctcttcattttcagagaagttgagtaacttttcatgtttttaagaatcctcctttctcttttctggaagctttgcagatcttttatctttagtgttctaaaaatacattatttcatcctagtgtggggatttatggtcattgactgtgctgggcacttgagtgtgcccttttggtctgaaaacctgtgttttcagaccaaaattttctttgggtctagaaaattcatcctgtattgtttatatttcctcctttttgttttctcttttactgtctctggcactcctttcttttcatctctttattgactttttttgaggtgtttggttttaatttttttaactcttttatttacctttaaaaaaattgtaatggtggatacatgtctttacacatttgtcaaacccatagaatgtacaacaccaatagcaaaccctaatataaactatggactttgaatgataataatgtcagtatagattcagcagttgtaacaaatatgccactccagtggaggatgtttatcttgggggagtctgtgtcatgtgttggggtagaggatatgtggagtatgtctatactttctgattaatgttcctatgagcttaaaactgctctaaaaaattctattttattttttatttttgagacagagtctcattctgttgcccaggctggagtgcagtgtaacagtcatggctcactgcagcctcaacctcccaggctcaagcaatcctccaatcttggcctctcctgagtagctgagactactcatt

SEQ ID NO: 42595 - DNA, 1047 bp, Homo sapiens
tcattaagctattttgagtcttctctgttttgcaataaccgctgtccatacaatggtgttatacctgatttccaaacctgattacatatcagaatcactttgggagcatttatgaattattgagccctacatgcagagatcttgagtcattaaggtctggtgtctcagaaatcttttttaatactatagcttattctgatgcagagccaggcttggaaataatttcaatatttgtgctaattatcttgtaaaattttcttttaaaaaaagtattaggagtaaaacaagtccaaattacagccaataccaaattgggaaacaagatgtttaatttcctagtgtcttagtccttttggggtgctatgacagactgttatagaatgggtggcttaagcagcatacatttatttctcatggtctggacgctgagaagtccaagatcaaggcaccagaagattcggtgtctggtgagggcttgttttcctgtttaacagacagcgtcttctacttgtgttctcacatggtggaaggggcaagggagctcattgggatctcttttataaggacattaatcccattcatgagggctccagcctcatgacctaaccatcttccaaaggctccaccacctaatactatcctgggtgattaggatttcaacagagggattttagagtgatagaaacattcagttgcagtccatcacacctagagactttcatctatactggcatttttctccattgcactagttcatttaaattcagccttattatgttggcataagaaagaatgaataagacctagtatttggtagcacaatagggtgaccatagtcaataataaaattgtatattttaaaataaatgtaattggattttttgtaactcaaaggatagatgcttgagggggcagataccccattctctatgatgtgcatatttcatgttgcatgcctgtatcagaacatctcatgtaccccataaatatacacctactatgtacccacaaaaattaaaaataaaagtaaaaaaaaattaaaatatt

SEQ ID NO: 42596 - DNA, 1099 bp, Homo sapiens
ggctgtattaaaattaaaactttgggccagaggcggtggctcatgcctgtaatcttagcgctttgggaggccaaggtgggtggatcacctgaggtcaggagtttgagaccagcctgaccaacatggtgaaaccctatctctactaaaaatgcaaaaattggctggccatggtggcaggtgcctgtaatcctagctacttgggagactgagccggagaatcacttgaacctgggacgcagaggttgcagtgagctgagattgtgccactgcactccagcctgggtgacagactctgtctcaaaaaaaaaaaaaaattaaacatttatatgtaagagcacaaatatactcaaagacaaaaaactgaggagaatatttataacacatgatagatagcaatactaatttctttgttttattaaaaaaattacaaataaaaagaacaactaatggaaaaattatatacagaaaaatgcaaagaatatgaagagagctcacaaattagaatattcaaatgttggatatacactgtatgataagttgtgaggaaacaagaacttttatccatattggtatatgtctatattggtaaactcttgaaagataattctgtaatatctatcacagtgttgtatgttaaatgcctattaacaattctcctaagaatttaccctatgaatatactcagagcatgtgaaacagtctaaaaatacactatatggtccatccgtacagcggaatatcccactataaagaagaaaataggtctgagtacatctcccagatacatgaggaaagaaaggaacactaggcacagtggtatatatagattgttcacacttgtttaaattttacaggtatacaaaaaaattgttctggaatgcagtaaactaattctcacctttgagaagagggtctattttgtcaaaagtattagaattgttttcatttatcaaattttgtactgtttgaattttttaccgtgtaaattgcttttaattttaaatattttaaattgtttaatgttatattatttggacagatgcttcttaggctaaaaaatcgttattgctattttatcctgtacaaacattaaagtttg

SEQ ID NO: 42597 - DNA, 1065 bp, Homo sapiens
gttaaggtgacaaggcttaagaaagatttagaaagagatcttacatttgaaaattgagttaaaaaaaagcaatttttttttttagaggaaaatagggtgttttccatatgaattttcttatcctttgtgttacttaaatctaagtgaaacattttctcccaagtgtattattggaaacaaaacgtaaatacaaatgtttatttaagctagttagccccaaatttaaaaagtggcattctgaaggcagctactgagaacactctatcagtagtggcaaacaccttcagtttttaacctccaactcctattttgaccaaagtttgtaaactattaccggtgcttccgtgcagtaatatcaccctagcacagacattgcatttagtggaaaaaccttctgatgtccaaagagattgattttaaaggtctcttccaggaaaactacttattttcataaatgaataccttcttttattcttttttttttttttttttttttttgagatgaagtctcactctgtcgcccaggctggagtgcagtggtgggatctggctcactgcaagctctgcctcccgggttcacgccattctccagcctcagcctcccaagtagctgggactacaggcgcctgccgccacgcctggctaatttttttgtatttttagtagagatggggtttccccatgttagccaggatggtctcaatctcctgaccttgtgatctgcccgcgtcggcctcccaaagtgctgggattacaggtgtgagctactgcgcccggtctcctttattcttataactagaaatatgtagcattcagtcattgtatgcatccaagcaatgataaaagtaaatatcgtttaaaaagtgattgagctgcatgtggaaatgtctgttcttcattcttttaggagcaggaatacatatagatataaaaaacatcccatattttaaaaggaattcttagggcttgccaatcttgtagtaaaggttgaattagcagtatatgtcttctacataaaggaaaagagaaaacagtaattgggggaaatttcttgaccatgccttt

SEQ ID NO: 42598 - DNA, 1089 bp, Homo sapiens
ctgtactacataaatcatatttttttccttacaggatcgtttagaaagaggcaacaagaaaagactgtgaactttataaaagacacttgcaatatactgtgtcaaaatgataattttgttatgttagcctctagaaaatttaagttcagaaaaatgcactatgaccggttcgtaatttttttaatgccacacataggttgtattgtaatggcattatcaaaatatttgatgatgtttcagatatattgcaaagtctgtattccagctcttaagaaaaatataagcatgttaaataccatatttacatattgataatgtcattggtatatggtggctgtttaccaataaaaggaaaaaattcattaaccggttgcttccaaaattagaagttttaagttgcatgaaaccattaatagccttgaaagctttgataagttttcagtaataataacctatttaatcagatgatgatgtgtttgaaaatagtgttcaatatcagcaaatttgtacacagggaatgtaaataaggataactgatcagagttatccactgtatttataaggaagagtcggaaaaaacaatgaccttagttttttttaagcctgatgatactatggtttactctaataagatagctatattgataattatatttttgttactgtgcccttgcacattttggtctttttgttaatatttttattaataacacataattagtaaccactctactgtttcaagttaatctagtaatagagcttacatatatttgtataactgctataccactgaactgaatttattttacaacagtgtagaattcttgaaaagttaacgtagaaaatatccaaaaagcagtatttctagaaagtgtccaaaaagcagtatttctttcccttggttgtgagagtaactaattatataaatattacctcaaaaatacatacactggtatcacacagtctttctacaatgtttctgtattctgaaagctaaatattaagtactatttttccattcaaatattcatttagaatttcctttagaagatggcagtgattataatattaatatgatttcatttgttc

SEQ ID NO: 42599 - DNA, 1026 bp, Homo sapiens
taacacagtgaaacctcgtctctactaaaaatacaaaaaattagctgggtgtggtggcgggtgcctgtagtcccagctactcgggaggccgaggcaggagaatggcatgaacctgggaggtggagcttgcagtgagcggagattgcgccactgcactccaacctgggcgacagagtgagactctgtctcaaaaaaaaaaaaaaaaaagaaaaattaattgagtttccttattttgaattttagatcacaccagcttttctaaggtgtaaatgggtgatataggagcctaggaacactcaggtgtaacttataagagcatcctgactttggattatacattcgtattggcagtaattaaatagcagtacactgaagtgtctatcagcttcaaaaacttcttgcatcattgtttgtgtgttaatgtgaatgtgtctctctgtgtgtgtgtgtgtgtgtctgtgtctgtgtataggtgctgtaatttagtcatgtgggtaaagttaaaacttgtgtgcttggctactctgtttaccagttctagggccaaaagagtcgtgagaagcctggctccttggagggatatatttgtctgctcagctttactttaggtaattggattctacctagaattcccatcagactgttgattggttttctgttcttttgtaggagttgagaagattgccatcaactttttaattaggccagagaaattgagcccctttcatcttcatatatcttaagtttattgatattgataaatgcattgtaggaaaggatacatgagaatacgatatggctcctgttgtttgggtaattaatcagggagtggttttaattgacaggatgaaatatgaatatgttaaagtgtctaaatcactcattttagggctaaagaagaggataacttgtttgctaataaaatcgatagaatgctttatgttttcattatgctattggcaatacaatcagtctcttagcataccatttttgtagctagactagaataaatggtgatcaatatct

SEQ ID NO: 42600 - DNA, 1009 bp, Homo sapiens
gaagatagaacatttatatattcctgtagtactgacagaaaacgtgtggtataataatgagggaaaggagcaatctagtttttttcctttattgttttcttagttttaaaaaaattcccagcacatagtatgtcttcatattttttgttgaatatatgagagagatatagatcatgtactatgaaaattctgagaaattttcctcttggtgggtatctgggaaaacttgagcagataccgtctaaacgtgcctaggatttgcagaaaagtggaggaagagaaggtacacagttatgaagatggattcttctgtttacagaaagctttcagtgacagagggagagggagcgtggagggcattgtggccaccaggatctgggatggagtgggtggcatgcaatgggaaggaaggtgataatctttgataaagactgaaaagaatgccaggcagcagagacagcaggaacagatactttccaaaatatctgggatgatgaggaaagggtaaaattgttagtaaattaaaggtttctgggatcaaggggatgtttttaattataaggaagccttgacaatggttgaactaattttcactcccaccaacagtgtataagcacagtgtggcgattcctcacagggctgaagacaaaaataccatttgacccagcaattccattactggatatatacccaaaggaatataaatcattcttttataaagacgcatgcatgcatacattgattgctgcactattcacaatagcaaagacatggactcaaatgcccatcagtgatagactggataaagaaaatgtggtacatatacaccgtggaatactatataaaaacatataaaaaaattaaaaaaaaacaatatcctttgcaggtacatggagttggaggccattatccttagcaaagtaatgcaggaacagaaaaccaaatactgcatattctcacttataagtgggagctaaatgatgagaacgtatggacacatggaggggaa

SEQ ID NO: 42601 - DNA, 1048 bp, Homo sapiens
catgcctgtaatcccagggacaattgcttgagcccgggaggcggaggttgcggtgagctgagatggcgccattgcactccagcttgggcaataagaacgaaactccgtctcaaaaaatgaaaagaaagactatcatttcataagtgctttttgattatttgaagtctgtttatgaatatttgataatttgatctttttaatttcctttaggctttattgaacaactctcattattaccatatggcccatggaaaagattttgcatctagaggaattgaaagtaagtatacttttcatgcttaatgatattaccagactgcttgacttggctcttctgtctaaagacttaaatgtgtctaacgtacgcataatagatgtttagtgaaggaagagtaaaataaataatctaaaaaatgtggagagatttacttaaaaaagaaggcctaaatccagatttctcccagccaagtataaccaagcctaaccctgcaaatccagatttctaccattatatcttctgttcctttgccaactttttcctgaggtttgcctttatgtgtttttgaagagtcagttttcatttcctaaaatctggaaatcactgagaaggctggattcctgagtactatggggagatagaggaaggaaggaaggcccacttaagctgttgatagtagaaaaattagaggagagaaagagtgaggcatagcggaaaaggaagaggacatttcataacgtatcttgtctcctgacatactttttgagctgttttaatcttttgtctccaattattgttgttgttagatacttccagaaaggtagtctcttctgggcaggacctagtcataaccttgggttgttacttttccttcatttgtttctttacagaggtaggtttgaggggctacttaaggcaatccattgggtatagagatgatgtatatgcactaaagcaaatagaatatcatactagttgaaaaatggaatgacgtaaagaaagaagagctaggggtagtcaggagacctgcattgtaggcaaggcttttac

SEQ ID NO: 42602 - DNA, 1047 bp, Homo sapiens
tggactaatttcttcactgctttatttggcagtaattagcattgctgattttcttgcctttgaaacactttgcctaacttctgtgatttcatattcttccatttttacatctgctctttgggctgaattctccatattatgcaagttcccctttcttaggcttccctttaattgttagtatttttgtttttctttttttttttttttgagtccgagtcttgctgtgtcgcccaggctggagtgcagtggcgcgatctcggctcactgcaacttctgcctcccgggttcaagtgattctcctgcctcagcctcccaagtagctgagactacaggcgcccgccagcacgcccggctaatttttgtatttttagtagagacggggtttcaccatattggtcaggctggtctcgaactcctgaccttgtgatgcgcatgatggttcatgtctataatcccagcactttgggaggctgaggcaggcagattgcttaagcccaagagtttgagactagcctgggcaacaatgtgagaacttatctctaaaaaaatgtaaaaaattagttgggcatggtggtgtgtgcctgtagtcccagctactcaggaggttgagatgggagaatcacctgagcctgggagtttgaggctgtagtgagctgggtcatgccagtgcactccatcctgggcaaaagagtgagaccctgtctcaaaaaaaaaaaaaaaccccaaaacaaaaatcagcttttaagttatctttttagtgaataattctttcttctaagaaagctcaagtctttcattttttgagtccttagtataatatatctacatttccatagtacccactaataataatacattgcatttgtttgtctatggctgactttcctataagaccaaagctccttgaaggcaggaccgaatttttaattcctatttgaatctccattgtttttcttaatgtttagtacttaggtctcctagacagcaggtctgttattttgtcatcaacctttggatcctgtctagtccgttaagaaaacttgtaat

SEQ ID NO: 42603 - DNA, 1126 bp, Homo sapiens
cccacacctaatttagggaaggtaaacttttatagttcatttgaattaccagatgattttaatatacattcttgcaaaggatatgttcatggtttttcatatttaatgctgtgaaattatgttcatcttgccagttatgtattgtttaatatataattatttagaagttatactaattgtcaaaatgttaaaataaactagcattcagtttaaattataatttgaatgaaaaagtaaacatttgtcctttgttgagaaaagaaaataggaagccagtttaatattctgcaaacatcagtgatttagtaacctgtttccttttcctcaagacttttgtacttgctgtttccctctgcctagagcaacactcttgccccagttaactgggtagttcattgcctcactccttcaagttttgtgcaaatgtcactcccagtgaggctttccccaaacgtgctatttaaaattgtaatcccagtaatcagtggtcctagttctacttcctgttttatttttcctgtagcactttattctctgttatgaattttacatatttgtctatgtcccctgccagaatataagatccctgagaacagagatttttgctttgtttactaatgtatgcctagaagctaaaatattgcctaccatgtagtagatgttcaacaaatgttgaatgagtaagttaataaatgtatgaagttatacatatttaacacagggtcaattttaaacctcggagcttctcataggaacatactagcgaaagaagaaaatgttttacaataaattattaagatgatttcgtaaacatttgctatagaaacttttatgattattgggtttttttaatttatttgcagggttcagtttggcaaagacttggtgcagatgtgacagcagttgaatttttaggtcatgtaggtggagttggaattgatatggagatatctaaaaactttcaacgcatccttcaaaaacaggggtttaaatttaaattgaatacaaaggttactggtgctaccaagaagtcagatggaaaaattgatgtttcgtaagtatacatcatttgtttttgatgtatcatccctgtctctttaagcaaaacactcaagtttcaaaatca

SEQ ID NO: 42604 - DNA, 1083 bp, Homo sapiens
tagtaagtggtagatatgaattgaaggccctttggctccagagcccaagctcttctgtgtcaccttttctattaagcttttcctgacttttcttcaactgataaagaaacagatttaaggcgtttttaagatctaaaagcttcccctcaacaattgctatcctattagcatgtagtttttgccttggaagcaaatttacttggcttgttattttaaagggtgctggagaaatggtaaatgaagctgctcttgctttggaatatggagcatcctgtgaagatatagctagagtctgtcatgcacatccggtaattattaacaacatatagaattgatggttgcctaaattttcttctgacccacaaatatttggattttaattttaaatttcttcccttgcagaccttatcagaagcttttagagaagcaaatcttgctgcgtcatttggcaaatcaatcaacttttgaattagaagattatatatatttttttctgaaatttcctgggagcttttgtagaagtcacattcctgaacaggatattctcacagctccaagaatttctaggactgaattatgaaacttttggaaggtatttaataggtttggacaaaatggaatactcttatatctatattttacataaatttagtattttgtttcagtgcactaatgtgtaagacaaaaagctacttattgtagcatcctggaatatctccgtcaactcatattttcatgctgttcatgaaagattcaatgcccctgaatttaaatagcttttttctctgatacagaaaagttgaattttacatggctggagctagaatttgatatgtgaacagttgtgtttgaagcacagtgatcaagttatttttaatttggttttcacattggaaacaagtcagtcattcagatatgattcaaatgtctataaaccgaactgatgtaagtaaacggtctctcacttgttttatttaacctctaaattctttcattttaggggtagcatttgtgttgaagaggttttaaagcttccattgttgtctgcaactctgaagggtaattatatagttacccaaatta

SEQ ID NO: 42605 - DNA, 1061 bp, Homo sapiens
caaaagatacaggaaggaaaggtgagattgtagcatatgcaagaagtgagtgaggagaagagaaatggggtgtggggttggaatgcaaatgattctttttagaaactgttcaaatagccatttatggaaatttcatttcaagagattttgttcctttctcttgtgataaaatgtcattatgcaaaatgccctgaagcagagtacttgagaaatttgtgtcctcagtactgcaggaaaccacacaaaccaaaacagaaaagacagctgtctgatattgtggcagtgaacttttctcattgttttgttctctttcccaacctagagagaggtagggaaagttactcttacgtaatgcccgaaaagctacagtaacttccagaaaatttttgaatagtagggagttaaatactgaaattaggtcagtaaatgcaggtgcccccaggcctacggaccagttaggaactgggtgggcaggcaagtattattgcctgagctccaccttctgtcagatcagtggtgacattagattctcataggagcacgaatcctattgggaactgtgcatgcaagggatctaggttgtgcactccttatggaatctaatgcctgatctgagctggaacagtttcatcctgaaaccatccccacccccgagtctggaaaaattgtcttccaggaaactggtccttggtgccaaaaaagttggggaccagtgattcaatggttttaagccccaccccggcgccaccaagtttttaatgttctctttagaaataagcattattgagaaactgaacatgtgtttcagttattacatggcttctgattaaacatttgggttgtgtgagtttttctctgcaaaatatagtgccttcgaatgagaggtgaggggtagttaattcaaaatgagtctcaaagagataagatttggtttcctactacctgttctctgttccaacctgcttgtaaaatattctcaaatggcctgataattactatatgccatgaagaatttaactgactaccgcacagaaataaaagttcaatatgactggtttttg

SEQ ID NO: 42606 - DNA, 1055 bp, Homo sapiens
gccatgttggccacgctggtcttgaactactgacctcaaatgacccacccacctcggcctcccaaaatgctggaattacaggcgtgagccaccatgcccgcccaagaatagaagtttttatctttctcagactttgtgggggagaaaatgagatgggacgtaatggtccagtgtctgaatcagagtccttttattccttgaaaacctatctccacttatttttagcatccatgctaacggagtagtttagatttattaaaggaatcctttaatgttgagttgtaagaatttctgttcatagataacaaatgtacttttctggtaagtgtatatgtaggtgtgttcccattcatgtaatgattgtgtatgcctaccgaagttaacaggttctgggttccttgaatgtcttcatctgcttgtttaattgccttctctgctgcgacctgggccttttctgcttcttccagagcttcctttaccatatctgcagtgactttaacatctgttgcacttttgctgagtaaaaaataatgagacagtatattgttgctgaacatgaaaaaagtactctcagtgttcttttctttaaagaatagccttcctgaaatgacccagagagactcgcataggtccttcttagaagtttcattggttaaagagatactttttactccatgatagatacacaaaataagccccttagatgccatgtctttagataccttgctcttttagcttcttctaacaacatctcagctctggcaatgtcagcagcactatgctgaagaataacctctacttgagaaaggctttcaactcgttcacgtatatcttctgtcaagttctgtaactgctgtggggtgctaggcatctccattttcaatacttcattagcaactgcttcaatgctgtccaaatcagcactatcctctgtgaaaagcaaagatgtccccaaaaagaggtgaaaagaatagatggttcattcattcaaccacttactggtcatctactatggactagcatggtggggttacacaccaagagacactaacttc

SEQ ID NO: 42607 - DNA, 1032 bp, Homo sapiens
cagacaattgagtactactagaatttgttttaggctgggtagtgagggaaaccttcgtggaagatgaggagctgatcagattttaagggataatagaatttgaaagaagaaaggacaattccagatggggagacaggaacggcagagtatgttacgggaaagtatagcagagtgaatctgaacattgtggaaaaccatagagggccagagcttaaagctgagacttaaaggcaatgaaatcttttaattgaggttggacgaatagctcagaaacttgtgaatgcagatatggagatttgatatttcctacaaatgatctagattcaggaaattatagaaagggagaaaattatagaagcaggagaaccggaataatgggttgtcaacaaagccaaggagtttcaaatgtaaaatgtggaagatggtgaaaaaaaaagtttatgaagttaagcttcaaatacgtcagatcctcatttactttcaagctttgcttatgttttaaactattgaacataaaaatggaccccagaggatttattcaaataaaatatgtacttgaatgatggcttccataaaatattacctaagatatccttagcaaatactgttgactccttattagccatgccttttttcttgctaacagaatactgattttttttcaggtacctgcctctaagtcaggtaaaattatcaacccagcattaaatattagtttgtgaattactgtaatcgcatttccattttccagtgacatttatgcattggcatgtgacttattgctggccagtgaggtttataaggatgactgcttaaaggcttctagggaagacttcctcctttttaaaaagatgcaaggaataggtggtctcttcttccattattaatctttatatgatgtctggaactttggcagctaccttgtaaccatgaggagctagaggacaaagctgatatgcttaagatggtagagtagaaagatgaaaagtatgtgggtcgcagacccaggaagctatcctgctactggatatc

SEQ ID NO: 42608 - DNA, 1049 bp, Homo sapiens
gaccttcagcaagtaataggacctcattattactattatggctgctgctgctgctactgctactactactacaaaagcttggatgtaactttaaaatgattacaaactaatcaaagaacattaaagctggaatcaagacaaatcccacattatacaatatataaactctgtaaggacaggaactgttaaatatacctttaacctcatcctctgggacagtgtcatgttgtgatggcatttggtggtgtttggcaactgtgaatcagcgccatgctgggctctatatgggatacaaatgaagaacccctagccttatccatgtggacatctcagtgtagttggtgggctctgcatccctgtctcaccggagctaataagagagtctcttctagttccatatagcactgtgggatgaagtggatacatttgattctgtgatatgcatgccttgccagaggcgctgagcatactaaagcttttacatgtgtttatttttaaaagaaaggaaattcttgttttgcctccttgtttctctaatactgtcctcatttcatgtttttttcttaactgaaagaactctcccctccctgcaagtaatcacagaggccctgcctttaaaaaactttttttagtgtttttatccaaatagagaggtttgtttttttactagtaaagatctcagaattgtaatcgtggttatttaacacagtcttctgttatgtaataagctgctattcaccagtaatagccaattagaaaagaaaatatcctgtacccgctaatcgtaattaccattataaagcaattaatagcagaaactgttgctgaactgtaacataacatcaatcaagctgtctttgccaaggcactgtacaactaattttctcaaatgaaggaggagaagggaaggaaaggaaggtgagagtctgcgggcttatttgaatttctttcaaaccagtttatgaatgacttttgaatgctctttaaatatgcatccactcacaaaggtaagtaatgctaataatgtactgcgacattgagttattttt

SEQ ID NO: 42609 - DNA, 1078 bp, Homo sapiens
tgttcctagggataacatcactattgtaaaacctaagattagtgtttgagatattttccagaccctgcactcagtgggtcagctggtaccaccgtatcaataaactggctcatccggtcttgtggccgccacccagaaactgacttagcgcaagaagacaagttcgactccctacgatttcatctctgacctgaccaatcagctcttaccactttctgattccctatccaccaaattatccttaaaaattccgatccccaaatttggggagattgatttgagtaataataaaactccagtctcctgtacagctggctctgcatgaattaaactctttctccatttcagttcccctgtcttgataaattgattctgggcagtgggcaaaatgaacctattgggtcttgaaactttgaagaaaaggaatgacaagatcaaagtttaatcaggtaacaatgtactggagggggaaagttaagtcaggagtccttgctaaagcaagagttaatgaagaaccacaatagacttcagtaacttgccgttgttttttgtttcgtattttagaattttttaattgacaactaaaagtatgtattatgtacagcatgatgttttgatatatgtattaatatacactgtggaatggctaaaataagctaattaaccttgcatacttaccatttttttgtggtgagaacatttaagatctactcatagcagttttcaagtatacattacagtgttattaataatagttaccctgttgtacagcagatctcctgaactttttcctgactgaaattttgtacctttcgaccaacatctctccaatcttcccctccccctagcccctggtacctatcattcattgtactatctgcttctatgaatgtgaccattttagatttcacatacaaataagatcacacagtatgtgtctttttctctctgtcttatttaacttcgcattctccaggttcattcatgttatcacaaatggcaggatttccttctttcgtaaggctgaatgatactgtattgtgtatatatatgcaccacattttctttatctgttcat

SEQ ID NO: 42610 - DNA, 1028 bp, Homo sapiens
tgatattctattaccttgtaaagtacttgatgtctgtgacccacacctattcgcacactccctccctttttgaaactccctaataaaaacttgctggtttttgcagtttgtggggcatcacagaacctaccgacatgtgatgtctcccccggatgcccggctttaaaatttctctcttttgtactctgtccctttatttctcaagctggccaacgcttcaggaaaatagaaaagaacctacatgaatatcggggcaggttccccgatagttgagagtagtgttttcaggcaccctgccctgataatgttttattttttaacctctgctcctcttgtggggagaggtgaacaaagagatagaaaagcttcctccccaaccctcccaagtggtggaagtcttgctaagaatgttggtgtgagttgcaaaatgagtgtccctctcaccaataaacattaatttttatccaaatcattttgcatcttctaccagtctcccttcttcaagtcggctgtcagcacatcattcccaagttttaaaacctagtgcctcctgttttctttttcaacaaatatcaacttttatgcctacttttctagcttataatttccacccacctttatttctcactaaccttcatattcctcaggtcctttttctttgcatttcttgtttcttcctctcttccaatcatataaatcctgcctagccttcaaaaaccaacttgaggaagaatccacacttggaacttccctctacttgtcagacccagagtgaatttttctcttctcagtttgctgcatgtttatgtgctaaatttaatgatttttaactctaatcccagagatgcctaagatccaaggagcctcattggggatgaaggacagttggcacagatggcacactgaagactccctgtaccctctttaaccaaaaagtttctgctcgtacagattttatataatgggattttatgtgagataatttggagagagttccataacttaaaaaagtgtttgagaaatgttgc

SEQ ID NO: 42611 - DNA, 1061 bp, Homo sapiens
gtaatatctctcatttttaaagacagcttataagagagtgtggtacataacacaaaggaatggattgataaagatatgatatcatgcattagcagcaagtaaggaggatagatttttcaggaatgccacttcaattatcagttttttgtgagactcacccagtcttgtgacataacttctcaatcccatttatgccttttggcctaacttttttacactgatgcacaatatgtgaactggtacattttactgaactacatgtatagcaaagccccattatttatgtttttcttactacattatttaagaagtatacagttaatgaaagttccattgatttgcttatttcctttggattacaactacatttgagatgcaagagggtagcttattgcaattaagaagtagaaaaacaaggctgctgagtggaatactgaactgagaataaagtgcctttgtcaccatagagccccgttgttctttaagcattttgttaaaagagtgaatgaatggagcaggatagcacaatattttttctgtgtgcggtacaagggtagagctgtggttttcttgagtcactgagacagaaagaagaaaaacttaaaaagaaacaaaactcttttctggctaaaaggtactttatacatatatacccgtgatgtcgctaggataaaaataactttgcccaattcctgaaaaggaattctactgggtagaatcaacaaacctggaatctgggggcatacaatataatttaccagtgatatccttgggcctgaaactaaacatctgatagctccctgcttctgtttccttatctgaaaagtagtaatgaagtaccctcatcagatgaaagtgattagacctttatattgaagtgcggtgacaacatatggtgaaatcctgaccatgagatccagtaaaagaaacaaaagatactcagcatttcaggctttgtatagtcagtgagtaaataaacaaagaaacaaaccaaagagtattccctaagaacctagatgtagtgtcttaggaactgggccacctactgaggatagaacgat

SEQ ID NO: 42612 - DNA, 1050 bp, Homo sapiens
agtatttctatagaactgaatatacttgaccatatatgttttaaagcgtattttttaacaccagaaatcttgtctgatttaaatctacaaataaatcaataatttatcatattaaagagggatttgtttttaatccatttattttctcttcctagtatttatttctatcatgaatttataatatttcaaaaagctgcttccacatcgttgttactgttgcattattaacgtagacaccactgattcctctttatgaaattgattaagaaggtatcatgtataaaccagaaacattcataatctatagccaagaaatgtaaccattgcaccattagtttcccacttttttaccaaagttgcttgagaaaggaagtttaaccacattttcatcattaggtagtttgaaactaagaaatgccacacggaaatggggcagcagtcaaaatcttagaatctgcagtgctttgctgacataagagggaaaggagcttcatcagtgttgtattgtcaaccatgtaattcacccatagtatggataggaaatcaagccatttctacaaagaggtccacctcaagtctaccagatggtttgttgctgagtccattttttagtagctcctgaactcattgagagttttctagacaaaaagaatagatttggaaataaccaacttcccggcccatcgtgggggaatctgatggatggatggatagtaccttgggaatgtataagaaagaaatgtctgggtatttctagaaaggttggacatgttaatagctttaatattttggtaggatagttgccaaatattcttattcaacccctgcgtgtctcatctttgctattgcttatgcttgcttataaattgaacaaatgggcttccctagaaactgtcggatgacaaaagatgctacaaagcttaacacctaaaacagagttttctttatagaatgagaatgtaaaaataaaaatttggacggggagcaaaagacttgttttccctgagtctatgtggaaaaatttgttgccttttctcaaataaatttttg

SEQ ID NO: 42613 - DNA, 1100 bp, Homo sapiens
accatttattcccttggtgtgatgattcttagccataggtcacaattgagccttagaaccttaacccagagtgttgcagccttcccccttgcaagtaccccgggaattgctgccattggccagtgtccaagaagaaggcttgaacagctgccctgacaaatgggtttcccccattcaagcaagcaaatgaggggtttgagctgctttgcaatactccctgcctctgggctacaaacactgtttaaaatgataataaagtatcctactctccagcactatgtatttttctttttggagacatgtaaatatctttaggatctttttaatgcaggaggtgggaaatcatccatatgaagagttggtttcagcttttctttctttctttttttttttttttttttggtctattccagacagtaaggattgtatcctggagccgctttccctgccagaaagtccaggtggcaccaccactttagaaggttctccatctgtgccttgtattttctgtgaagaacattttcctgtggctgaacaagacaaacttctgaagcacatgattattgagcataagattgtcatagctgatgtcaagttggttgctgatttccaaaggtaagttctgtttttgtccttaaaagaattaaatttgaccatgtgtggtggctcatgtctgtaatcctagtactttgggaggccaaagtgggaggatcacccgaggccagtagtagttcaagatgccagctctaaaaacaaaatttaaaaattatctaggatcaatggcatgcacctgtagttccagctacttgggaggttgaggcaggagggctgcttgcacccatgagttcgaggctgcagtgagttatggttataccattgcactccagcctgggtgacagaatgagaccctgtctcttaagaaagagaattaaatgtattgtttgttaaaggagtgacataatctatatataaaataattcccatacaaatatgaaaattcatattcattttcaggtttctccttagacttaaaaaaaaaaactttacaactcttttgtacttctgagactttttttttttttttgagatggagttttgct

SEQ ID NO: 42614 - DNA, 1051 bp, Homo sapiens
ggaggtgtgcagggattggttgggaagcgctcaagccccgcccacagagtgacgtcaggtggcggtattgctacttaaggcgtcgtggcctcccctgccccgccttagctcccgcgctagagagaaacatgtatcgttttcgatcacagctcttcacggggatttctgctgccgccaccgcccactcttacccccgccgcttctcgactctgttgttagccgaagactcgcctctcagccgcccgccgcacagacgcacgagtaaaaagtgcagctccatcggctgatcctcgctaagctccgactctgggcggcaccgggcgtcccacgatgccgaagaacaagaagcggaacactccccaccgcggtagcagtgctggcggcggcgggtcaggagcagccgcagcgacggcggcgacagcaggtaaggggtatccccgccgccggcatcccagttgccggccaggctggcgagtcttccatgcttcggcacggtgggagttgtagttctttctctgatgtacacatttgcatttccagggtgcgtggtttggctactgaactacaattcccagcgtgccctgggcgctgctcctcgcgcgatttagatctggcgtgcgaaccggactcttgggcaccggccgtgggggcagggaggaacgggtccttgggcctgagagtgtgtcgggacaggggctgaccgggagctgggcgggaaaggaaccattgtcagagttcctttctcggcggcgatctcgcccgatctctccccgaccacgggtggggaagaacggggagttgagcccgtgccgtcactggccgcctttgacaccctggctccaacatggagctcctgggatgccagacgtccggcgggtttggacgggctcttgcgtcacgcggcctgggccttgcgcggtgggcccggggtgacgcagaggcgctggggaagctttccgtctcgcaggtccacctggccaggcgaaggcgtcggaggcggggggaccactttctcccccctaggctgtgctccttcccctaactggcacct

SEQ ID NO: 42615 - DNA, 1024 bp, Homo sapiens
taattggctgtttttcttagagtcatcaaaaggaacgatgtagccttgcttctgctgcttgcttagcagtagggattatggattgaaaatttcctttaatgcttaggctacttttagattttaacagtgtccaatttttactaggatgatataatgacaataaaatagtgataccaagcagattaatatcacagatatcctcatagtactggaacagactggctaaaacctgggcctgataccaatggtgactttaaagacttaaagctttaataatgcttagaacaacatgagggaattttagtgacaaaatgtggagaaaggggaaatggagaataataaaatctcagattacaaattctatttttatatggattaatttgttaaaacaaatgttctgagaattgaaggcttctgtttatgttgcaagtagatggcttgtgtaagtgttgtgttctgagtatgttttattcgataagctttacctttgtaatcatatactatactcacttttgtttagcccttcccctccccaaacaaaaggcaattatatgattcccagcctcttttcagcataatccagaataagtgaaatctgagttaatgggattaattaattaattaggtgggaagtttgaagacaattatttacattttatgaaatttctgctcctgtgtgcttatttcttggaagctgatttcttttagaagttttcatagtagagtcttcataagaacaaaagaatatagttgtaacagcttaaaaaccaatggaattgtaatgtgttttaaaggctttttgatagagggtaggcttctttagctcatatgtctaagctttctatctttgaattacagttgaagtttaatgatctagtaagcacctgtaaagcatacagaaaggaaacaaggggatagttcaccctttcagaatgctttactgacatagactcataaaaatgattcaataatttaaattatagattatggagctgcaattgtttcagaaattatgtaattcttt

SEQ ID NO: 42616 - DNA, 1045 bp, Homo sapiens
gatagttttacatttaactttctcagaaaccaccaaactcttttccatagctgctgcaccagtttacattctcatcagcaatgtagaaagaaaggttccagtttctccacatcctcactaataattattttaattatagccattctggtgggtgtgaagtgtttaattacattttatagaacctggatattttatcagttttatatccacataattgtttcttgtacggcattttaagttttttttaagaaacattaatatttttacatacttctctcttttgaataatttttttgaagaaatcccctgcataatgtattgccaaattactttccaaagttactcttatattggagacgatatttaaattgtctccagcaatgaatgaaggcatgtagctgttacacaaagatttgacaccattgagttttataatttaaaaaatgtgtttatttaattgatattaaaatggcacttcatcacttttttccttgttctaattgacagccaagtaggactattttctgcattagtcatgatttgtcttttcttggatgaaacaatgttgatgtccatttttcactgttggtttttgaaatcgtctaactttcttggcgttttacaatttgattagtacttttcttaatatggaatagccattaactctttatttatttattttttttgagacggagtctcgttctgttgcccaggctggagtgcagtggcgtgatctcggctcactgcaacctctgcctctcgggttcaaacgattctcctgcctcagcctcccgagtagctgggactacaggcatgtgccaccatgcctggctaattttttgtatttttagtagagacgggatttcaccgtgttagccaggatggtctcaatctcctgacctcgtgattcgcccacctcggcctcccagagtgctgggattacaggtgtgagccaccttgcatggcccctgttaactctttgtttttctccttcattctttgtgtgtgttttataaacatttaaatgtttatagggtcaaattag

SEQ ID NO: 42617 - DNA, 1050 bp, Homo sapiens
atatttaacttaatatcttagacaagagttctgggtacaattttgggatctagttcccctggaaaagctgctgtatttttaatttttaatggaatgtagcttttaaaatcctgtcactggcatcaacaaaaggaattataccatgagaccttatagctgtacttaaaagccattcagttcagctattgggagttcatgatgaattagcatatgccagaaaggttgctaaccttaacatctgagagcagtaacactgattttatctgctgtatgagactttgtgcattttactttgaaataaagatttttttccacactgaaagtgcttctcttctaatagaagaaatattatttatggctttgaggtacagagtccaaaatgactaggccaggtgggcagggagacaaagctttatgtgtatatttacaaacattaaagtagatgaaaagaatgtagcaatacataattgggattaaggtttctgactttcaagaatatttctgcttggcaacatgcagtgtggctcatgcctataatcagcactctggggaggctgaggcgggaggatggcatgagcccagtttgagaccagcctgggcaacatagcgagaccctgtctctaccagaaatttaaaaaatgagtgtggtggtgtgtgcttctactctttatctacttgggtgctgaggcaagagggtaacttgagcccaggaggtcaaagctgcagtgagccgtgattgtgccactccagcctgggtgacgagtgagaccttgtctcaaaagcaaaacaaaaaagaatattgctgcttgtttgcccatgaggtatatttctttcattttatgaaaagcattttgacaacacgttaacatttaataaactttagattaaaatatatagtgcaagcaacatgccatttcaaatccgtagacttgtttctttgatactcttgctgtaggtcgccgtgaggggtagggaagcatatatactgtagggagaagtatcaaaatcatttaaggtcttttttccaaactagtgttcccctcccacatc

SEQ ID NO: 42618 - DNA, 1092 bp, Homo sapiens
ttcatctcagttatctgatgataatcatgatcaccaaacagaagatcatcccttagttaatattttttccatacctaaattagatcttgaagtgtccttaaattttttgttttttggtctattttatctcattttgagcatttattaaatatttgagccatgtttctatactgtttcttgccatgtatgtcacttctaaggttgaagaatgcttgtataactcttgtgtttctttggatattttctaattttttctttggtagtgttttctgagtttggaggatcattattttactttagtaattcataatttcaatagatgaggtgtcccaaaccattattgattttagaattttatgctgagccatcatatatgacaggagttgatgaaatttttctgtaaaggtctctatagtaaatgatataggctttgtggaccattgatctctattgcactttctcaccgccattatactataaaagcagttatggacaatacctaaatgaatgactgtgcctgtgttccagaaaggtttatttatggacacttaaacttaaatttcctataattttcatatttaatggaatattctcttgatttttattcaaccatttaaacatgtaaaaaaaaaaaacccattcttacctcaccattcaaaatcaggcagtgggctagttttaacccatggaccatattttgctacacacatacaaacaccacacaccacacacacacacacacacacacacacacacacacaccccaatggttattcatataaatatagacatatcttttaaatctctgtctctaaaatccatgccacatttcattcacttgcttggaattatgagcttaacattaacatggacttccaaaaattctctcacaagctcttccttgaaatagttcttcccttttcattgcaattaagtctaaagtagtagttctcagagataagaaattatcagtaagtaaataagttgttcagtgcttgacttttggtatcattagtattacaatataaatttggataataaagtacaatgaccagctgaatcttcggagatctagatagtgaaccatgaata

SEQ ID NO: 42619 - DNA, 1027 bp, Homo sapiens
taaaagcagccattatgtttttagtaatttaggattttctgcttttgttaatacattttttggtaagatataatgatttcttcaaagttttaaaacaatttttgtattcaaatctaatagactgatttttaaaactgccattagacctaattattcttggaggatttttcttagaattaaggtgtttgggaatgtattaaaatggggattatttacatgtatttttaaatgtagaacttagaacataagtttaagataacctttttacatacactttcattagcactattagtttagcaacattaagcaatcataatagtttcctagttttgcatcatacatttatctattgagatcatgttaacattgttttgttggtaaatgacagtttctcacagatcagctttattcagaaattatttttgatatgcctgaaagcctatattaatttaaaaatgtttcatttaattgctacatttaatctgctaaatctaggttacatagaatgatgaactatatctagcaatatttgtctgccctgtttttagcggaaaaaaataggccttcacatttaacatatgaaacactcacaaggtaatttcataaaacaataagtaagagaatactaaaacttttaatattttggtgatttttttgaagaaataagcactctgtgttactcatcctaattgcaaactgtgttcagtgggttatacaccaaagtgtcagattttattgttgtcttgtaattttgtttgctccagtaaaagcaggatattacaaagaacatggtcaatgttttgttgtataatatgtgttgaatttattgatgtattttaaaatagattatgtatttgataacatagtttggattcaatgtcattgatgaagttgggagcatttctttttaatcggcatatacattttaattccaaggtcatgtattatgttcatcttcatctttaatgtcatgcattctgtctcatcttcataattcatcctaatagtataaatcaaaataacaaca

SEQ ID NO: 42620 - DNA, 1023 bp, Homo sapiens
taggccatttaaaaataccaacaacttgtaacatgaaaaaaggttaatggattgtttttcatttttaccttttctatgtttttttgccattttatttatactctttactatttttcagattgttaatgttttcatactttttggcatcttgttgtcatgctcattggggtacttgtggtgtggaaaccagaagataatggttctttttctaactttaagattttggacacttttggacatttcttatgattatacattcagtattgattagaggtgcaaagtacttcaagaggttgagtatgggatatcaatggcagaatgatggctttcttcctggtagggggaactacttggccctgatgtatttaaaagcttttgcatttaacattcaaaggaatttttatttcttccataagagctttaagaatttagtagtgagcatttgctgtggcatatggtgcattttaaattttaaaatacttttgaatcctccataagcattcattcactgatatgttggactagtatgatcttagaacacccataaagaatactttagctcttaaaaaaataaggtgtggaacagataggaaagaaactttgttaaataataacatgatttaagtatcagaggattagaagaagaagtaacagccctgttaaggatctgctgtattagagtgctgcattaatgcctgcaatcaatcacacctcccagtatccaggttctcatgaagtcccctcccatagttattctggcttggttatgtgacttgctttggccggtgcgacatcagtgaatgtggtgcaagtggagactttataagtgcttgtacattggagcttatatttttgaaatgctgctgtcaccatttcaggaagccttgtatagcctccttccttaaagattaaagatcacgtggagagacttaccacaagggcccaggtgagctctacccctacctgccccaccagctgaattcagctgcatgagtaagcccatgccagatcagcagaagaacc

SEQ ID NO: 42621 - DNA, 1033 bp, Homo sapiens
cagatcatatgctgttaactgtcaggctgaggtagagtgactgcttttgataaaaggctgtattagaatttttcatctgtgaagctcttatactctaattatctccatcagtatggaagagtccatttgcttcagtaccctacaaattacactttgttaagaccaagtattatgctgagtaaaattggggggaccttgatttttgttgaccatctaaaaatggaaattctttgtaacttcctcatgcccccttatgcccatgcacacatgcacatacatacttcaaaaacaatatctaagtgacctctttgtaaaaggttaccgggacaatgttagtgattttttttacctcattcacttcactagaatattataactacattagtcgagcctgctgcaaggaatgtgcaaaaaaaaaagaaaaacatatgaaaagagaaatgtgtaaaaaaaggataactgtagtttcaaacaagaattgccaagattccattgctgattatggaagtgaggacttttccctgtttacttgtaaatagtagcacataaaaaatttgtctgttttgagatcctcaaactaaatatccacatacacattctcataaaaaggactgaaattgtgaaaattctttgtacaaagctgtatgagttgcacagtgaagaaatcattcacatagggtagttatattagtctttttttgtaactatctccatggtcatatgttagcattatctaatacctgaaggatgaggactaggtgaaaagacatattaaatatttcacattgtttatgtatggaaagcaagctcattactttctaaaataaaacttgccagttttcttggttagtgtcactatgtagttgttagtctttattgttatgtcttcttggaaaagcaaaaaaacgctttgttaaactaatattaaattataatttaccatgggcaaaactcatccttgctttccttaaaattacctactaaaacatattaaaatcaataaagtttacattttaataaactaatatcgtat

SEQ ID NO: 42622 - DNA, 1069 bp, Homo sapiens
ttttgaaacagagtctcacactgtcgcctgggctggagggcaatgacgcaatctcggctcactgcaacctctgcctcccgggttcacatgattctcctgcctcagcctcccgagtagctgggattacaggtgcataagaccacacccggctaattttttgtattttttgtagagatggggtttcactatgttggccagactggtctcgaactcctgacctcatgatccacctgcctcatccttccgaagtgctgggattacaggcgtgagccaccatgcccggccaagcctattttaatcatgagaaaaacatcagacagatctcagttgagggacattttacaaaatacctgaccagtactcctcaaaactgtcaaggtcatcaaaaagtttgagaaactgtcacagccagggggagtctaaggacacaaaatgacaaaatgtaacatggtatcctggatggtatcttggaacagaaaaagggacattaggtaaaaactaaggaaatacgaacaaagtgtgaacttcagttaatttttttaaagttaattttagcatttttcttgtatcagtaggcttagcatggctaacattgggtatatgttgtagttttacatttaacattgggtatatgttgtatatatatacaacaggggttacagggggcagggacttatgataatgttgaataacaaaaatagctaacactatgcagagcatactatagaccaggtactttaaaaaatatatgccttaaattacttatttttaaaatcaactttttggtaggtattactattttcatgttagagcggaaaaaaatgaatgtttaagtaactttaagtagcaatacccatcctctgggcctgtagttttaactgctaggctttaccgagttattcttggactcagagaatagttgttttcggggaggttgcagggaacagttcccctcttaccaggttcaacttctgcccagatctatagggtataaaacataataaaaaaggtttcttttatatatatattacattacatgaggttggaaagtttatttccttagattgta

SEQ ID NO: 42623 - DNA, 1037 bp, Homo sapiens
ctttatataacaacagagaaacagagtattacaagaaactcttgctagagcctctcaagaaaaggtgtgatttcccaaaacggacctcaaactaaagttcctctatttggtgacttaggaaatttatatatgttaataaagtatttgtgaaaaattagattcttagctggtctgaaggggatgaacggaatggtgaagctgatgagtcacagtaagttaacagatgtgccaggatgctgatcccttccaccctcagggtgctaaagaatcctggggcagccagagcctttagtcaattgtcactgctgcaaggtaacccaagttgctctccaaataccatcacttcctttgtgtgtggcggcatgaataaagtttggaggcaccaccacagcagtagtggctgcatttagaatgttaactgtaacagcctagttacctgccagtgcatggcacatccctacttaggatgccatgggctacaggtataaaataacggactactctactgtggattaaattacagaattttaataaaatttgcaaagaaggaaacacttgggttatttcttagtaatctcaattgatggttcatagtcaggtacaggttggactttttgttctgttctttccccgctgctcactgctatgcctcagtaatctttaaacaatttttagaaatgttttaaagaattagattgttttttttttagactgagtctcgctctgtcgccaggctggagtgcaattgcaggatctcggctcactgcaacctccgtcttcaggtttcaagcgattctcctgcctcagcctcctgagtagctgggattacaggtgcccaccaccacgtccagccagtttttgtgtttttagtagagacaggggtttcatcacattggccaggctaatctcgaactcctgacctcgtgatccacccgccttggcctcccaaagtgctgggattacaggcgtgagccactgcacctggctagatttttttctattttgagtttacagttttaagcttaggaagcacaaat

SEQ ID NO: 42624 - DNA, 1032 bp, Homo sapiens
gcagtagttgagatattcaacactttattataaaacagactcagggttagatgattttgcccatctgcaggctaatgttaagtgtctgagcatgttaaaagtaggctaggctaagctatgattttcggtagattaggtgtattcagcaacgataccttcaaattacgatggctttagcaggatgtaaacccattgtaggtcaaggagtatctgtatttttatttaattttctttgtggtttatggtatatagttcaccagtttgaaacagtatatttacaaattaaactatatagtttattttgctcatctttttactgtctctaatgtaaagcagtttgagcaatcagataaaccttttacttatctgattgtgtgacatttaaattttaatagtcgttagtattacattggatgactttttcattttacatatgtaaatatgagcatcatcttcagttcttaattcctaagtatttaaacctcaagcagtttgtcacaaattttctgatagtagatcttctaaccatgttgagtattattttcttaaataccaaaatattttctgacatattaaaatattaactatagagtttaaattatgatatattatgtaaattattaaactaagacccttaaaattattatttttcacctgagggagccatgctggttcagaagtgttcagagttctgaacatgtttatacttatatgtagccaaatattttacatggaaagagtgatcaatgaacaggcagcaaaatattaggttatttattgtttattttgagtacaacagtaacatgatacaacagagctcttaaaatgagtgttatcaaaaggatgatagtattaagaaaagaacactttttattatccactgaacgctattaatgttcaaattgactcttctgttagttgccttgttggagcaatctgagctgctaaaaggactcttaaacatgagttggtctccttaaaattctttgaactactgggatggcagcattagattaaagcagggaattgagc

SEQ ID NO: 42625 - DNA, 1049 bp, Homo sapiens
atttgtaggcattttctttcataggccattctgatttgtagctctttcttttcacagcagtattaaataccaaaccttctctgatatggaagttcattagagatatgtctttgatggcagccctttcctggcttcagtttcaaataccttgatgtaaagcttaagaagccattgtgttgtaagccctccttgatgtgccttatttagatctgcatagtaaatcaaggaaagtaaataacaaggcagcagatggaagcatggagataagaccagtgaacaattgtatttgtattttgttatgatgttgacaggagctaaaattcactaatctagttcaactgatctgcatttcaaagaaatctcatttagcagcaacttgaaggtttgtaggataaagttcttttattgcagcttttattgcattctttgctaatttatctggtcaagatttagccttgcttacttaaagctgcaagcatgttacaaggagtcttaaatactatgaaagcattaatgtctagactatgaactgaaggtaattacatatccagccttgaatagggtacatttagaaaatactgttgtccaaactcaattgtcagggcaatatagataaggtgggttttttttttccacctctcctgcctatttgctctgagatttttttccacatcataaacaagctaataaacaatcatcaactactcagaaattattcaaaaaataagtgtaagtacatctcctttaagtatgaatccattgatgctgatacttgttgtgcctttttgagaatggaagattattagttttatagttttgatacccttatttgactctacagttaaaaatgtgtaaatatataagtgaaatggttaatgtgaacttcaaagtgttataaaaagcattgtctgtggacaacttatacaaagaatattggtatgttctacttttgattaaatatattatttaatggaaattagtatttcaaaatgtgttcaaagagattaaatactatatgtgtatatttatatataaactgaatagtgagt

SEQ ID NO: 42626 - DNA, 1047 bp, Homo sapiens
agaatattcaagtgaagatacttaagagtcagtggaagacagctgagcaaaagaggatgaaaaattgcatttactagatgttttaaagtgctaaaagtcaatagcaaatattttgtcaaaatataagtgtgttgtatagcaaaatatatttactgattgttcaaaactcaaaccagacttttatttggaaaacatgttgtacttggttgtcaggtcgcaggctagcccatccatttaaccctcgtgttaaaaaagaagggagtggtccatgtcctttacagagcttgcaagtattatttgttggtatttattttttttttaatatgaacttagttgttaaatcttaaaaattggactctgtctcactctctctctcatgcacacacataatgatttaccagtctgtctgggaaattccgatttggcaagactaaacctacattcctacaaagcagtaatggcagtaattttatgggtcttaaaaaaacacctctttagagactttgccatagtaccatgaaactttcctttgtcctgcgccttgcctaattaatatttttgtctttaggtattttattttgtgacccttatgttgtatgtgatatttatcatattattctttctggtgattgttgccttgaaacctaacgactacatgcaaaaatttttgtagtcaaaataagttgggattacaaatgagagaccagtaactgatcacttattctagtgggtttagattcagtctgttttatgttgccttggagttttccgcagatgttcactccttccataactgttggttgtttccttggtctgagagcaatcctatcagatttacattcagaaaaacaaataacaaaaagacttgggttgggtgtgtagtatggattcaagagagttaagaatgaaggataagggaccagaaaggagattgtataaccagtaggtactttgaatgtgaaggttaggggagggttgtggactggatgtatatgttcgagaatcatttgcaacaagtagttgttgattcaagaaaaagaatacaaa

SEQ ID NO: 42627 - DNA, 1048 bp, Homo sapiens
gctttcagggtcattctccaattattttgtacaataatttctggcttttctccatccatactcatctccttatcaaatggtcactgggctgcaccttgattttccttaccaaacatgcttttccattctttacatgatcaggctaggaattttccacatctttgtgttctttcttatttaattataaactccatctttaaattatttctctcatctcatattttaatatatggaattaaaagaagctatgcagtaccatgaaatactgagctgcttagataattcttcagccagatatcctagttcattgcttttaagttctgccctccataaagtcctagtacacagacattcagccaaatttgttgctactttataacaaggatagatctgtctcagatttcagtaccttgctcctcatttccatctgagtctttactgtccgtatttctaccagcattctggtcacaaccacttatctctaggcagattcagatttttccctacaactcttcttctgagctgacaaaagaattgcccttaatgctttattcatgtaaatacagactttcctatagcattcatttcaaaactgttccagcctgtaactagtacctggttccaaagtcacgtgtacatttttaggtatttgttatagtaacaaccccattcgtgataccagtttttgtcttagtctgtcttgtgctgctgtaacagaatatcacagactgagtaatttataatgaatagaaatttattgactcacagttcttgaggctcaaaatattaatatcagggtgccaacctctcacaagggctttcttgcagcatcatcacatggcagaatggtttagagagagcgaaagagggggctaaactcacccttttttaatagtatcagtcccacccatgaaagcagagccctcatggcctaatcacctcttaaaggtctctcctcttaatactattacaatggcaattacatttcaacatgagttttggaatggacaacatgcaaacgatagcaatagtttcactagactgacag

SEQ ID NO: 42628 - DNA, 1028 bp, Homo sapiens
ctctcttcaacttagtagctggaaagataagtccttcatcccagaagtgtgtttgggcaacatatcacagcatccactacacttagaatagttagaacccatggccaagcttggtggcatgcatatgtcatcctggcagtttgggaggccaaggtgggtggatcgcttgactccaagagtttgagaatagattagaacctaaagtaccataaaaaggctatcccagtcctggtccaaaccacccgtctttccaggactacaattagagacacatctttgctctttctatttccatccttgccctcatctagtcaagtctccccaggacagacaaagcaagctgtgaaatgtaaaccagatagtctcaataccctgcctaaaaacttccagtggctttcaactgaaagaaagaaaatccaaattcattactgtggtcactagtctctgcttgacctaactcttatctatgtctgcaacattatttttgctacttttcacctcacatattatgtttctgacctgttgacctcctgtcagtttctcaaacatgccaggttatctcctggttgagggcatttgcacatcctgagtcctcagccaggcaagcacacctcctcactttctctgtgactgctttcttcttattatttagatcaaatccccatagaggccttccacgacaattccattttatgcagacctccagtagtcttcatctgtcatgtcactgtattttccttcatgatcttattacaaactgtaattatcttgcttatttaattgtttctatatttcctctcttcctctgttggaatgaaagctccatgagtcattttcccactttatacctctttctagaatagatctttgataagtttcattatttgttactaaatgaaggttttgagctatcttacatgacctacctgtttgacttatttttaatattacagctttattaaaacataattcacttagcataaaattcaccattttaaagtgtatgactcagtgttattttactatat

SEQ ID NO: 42629 - DNA, 1099 bp, Homo sapiens
tctgctagcttgtagggtttctattgaaaggtccacttttagtctgatgggcttacctttgtaggtcacctggtctttctttctggctgcccgtaacattttttctttccttttgatcttggagaatctgatgcttatgtgtcttggggttgattttctcatggagtgtcttactggggttctctgcatttcctgaattcaatgttggcctgtcttgttaggttggggaagttctccttgatggcatcctgaagtatgtttttcaactttgtttcattctccctgtctctttcaggtaccgcaatcactctctttacataatcccatagttctcagaggttttgttcactccttttcattcttttttctctagtgtgtgcctgtcttatttcagaaagagtttacaagctctgagattctttcctctgctgtctgttctgctgttgatacttgtgattgcattatgaagttctcatcttgtgtttttcagctccatcaggtcagttatgttcttctccatactggctattttggctgttggctgctgtattgttttatcatgattcttagcttctttgcattgtgttacaacatgcttcttttgctcagtaaagtttgttattagccaccttagcaagcctacttctgtcaattcatccatcttagccttagcccacttctgtgccccctgctggagaggtgttatggtcatttggaggagaacaggcactctggcttttgagttttaagtgtttttgcatcgattctttctcatctttgtgggcttatctacctttgatgtttgaggttgctgacttcaaagatggggtttttgaatggggtcttgaagtcttttttgttgttggtcttcttgttttatgcctgattttcttttaacagtcaggtcactctaccatagggctgctgcagtttgctgggggtttgctccagaccccagttgcctcagtttttcctttacctggaggtattaccagtgatggctgcgaaacaggaaagatggcagccaaatttttgccctggaagctgtatgtcccagggaagtactgacttgttacctgcctgaatacaactgtaggag

SEQ ID NO: 42630 - DNA, 1049 bp, Homo sapiens
aaatacaaaatgacatctctctgcccacacgttctcaaattcatgggttagatacatatattgttagagtagtagatgtggccctcagctttacccccagaaaaattattctttgcactacatccctgttcaccaagcagcagtaattacaaggcagttcttaaatataggtctggcttatggcagtagcatgtgcaaaaaatgcccctgggccatatgaaaataatagttttacacagtgggagagactcttcagagctatgtagtacttaaagacagaaagctcatcaagaaagccacattctttatttctagacataataagcagaaatgaaattgatatgagaaagaagatagaataaaaacaagtaaaaaataatctaagttaaggaaagtccaatgagtgtcaagcactgaatagattaactatgaaagaatagtcttcacttgtctggcagaattgcagtgtggttctattatgtgctgtttaaattgcatatattggacactgtcaatcattaaggatagttagtattatttatcccaaacagccacatttctatagcaacagtatacatgtttatgcaattacgtattattatatcaaatcatgcttgatatattttggtaccagctgccgtcctgaactcctttacaagttttatatatatttactgcctaatggaggaccctgcagtctcctccccaaaccagctactattttagcctgagttcaggcaagaaacatatgaagtgaaagactaacttaatattcagcattgcaactgaacccaaacaactgaagtctcaattcattttagtttaaaagctactagttttcgaaaaagattaattatactaactttcataagtagattgtatactaatcaaaattataattttataaaatttttcaaatacaaaagattatataaaattttaattatatgttgatttaaaccatttcagtgataaaaatttattatccaattgtaaggagatcataaggtcgatttcaacaacagtaaagaaagtggaaacagttcttt

SEQ ID NO: 42631 - DNA, 1034 bp, Homo sapiens
cagaaagaaacaactaacaaaatgataatagtaagttctccctttcaatacttattttaaatttaaattaattaaactgttcaagaaaaatacatagaatagccagatggataaaaacaatagccaactataaattatctacaagagactcactttagacgtaaggacacacacagactttaagtgaaagggtaggaaatgatatttcacataaatcatgacaaaaagagacagcaaaggtagatatacttatatcaaccagatagactttaagtcaagctgtcatagaaaaaaagagaaactttatataatgataaaagagtaaattcatcatgaagatataactattataaatatatatttgtataaatatatatatttaatatccaatgttagagcacctaaatatatgatgcaaacattgccagaactgaaaagagaaatagacagtaatacagtagtaggaaatttcagtactcactttcaatagtggatagaacattcaacataagatcaataaggaaaaagaggacttgaaccgcactgtatgggcctaaagacaaacattccatccaagagcagaatagtatacattcttctcaagcacacatggaacattcttcagatagatcatgtgttaggtcataaaacaagtttgcaaatgtaagaagattgaaataataccaaatatcttttctgaccatttcattatgaaactagaaatcaataaaaaaaggaaaattggaaaattcactaatatatggaaattaagcaacatattcttgaacaaccattgcatcacagaaaatggaaagaaatgagaaaaatctcttgagattaaaaaaaacaaaaacacaacatgccaagacttatggaatgtcacaaaagcaataccaagagagaagtttatagcaattaacacctacattgaagaaaaaagaaaaatcccaaataatgaacttgactctacaccgtaagaaaccagaagaagaagaaaaaataagccaatgctagaagaaggaaggaaatcatga

SEQ ID NO: 42632 - DNA, 1051 bp, Homo sapiens
tgggaaacatagattagaaatctgttttagggctcttgaaccacgtgctcaggcctgctcccacactgtggagtgtacttccattttcagtaaatctctgcttttgttgcttcattctttccttgcttttttttttgtttgttttttaaaaaaattattgtattctattttaggcagggctcagagcctcacacctctaatctcagcactttgggagactgaggcaagcggattacttgaggccaagagtttgagaccagcctgggcaacatggtgaaacaccctgtctactaaaaatacaaaaaattacccaggtgtggtggtgggtgcctgtggtgcaagctgccccagagactgaggcacaagaattgcttgaacccaggaggcagaggttatagtgaacaaagatgctgtcactgcacttcagcctgggcagcggcagagcgagactgcatctcaaacaaacaaacaaactaacaaacacacacacaaacaaaaaatcaatttttatctctggaaacaaagttgctaacaatccacaaacttttgacatatgtattttttgttaaccaattatcactgttttgtgcattatatttgtagatgtggtaaagagagaagtggtagttaaactatgaaatgcagatgtgctgtttgtgaatagagacagaaacaatctcaactcactggtgtattctattcccaagacagaacttgacctatatctaccatctgctaagattttaacactttttttttttcttcctaatctgaaatattttttccttaggaaattgtgattagttttaaaactctacacaaacatgaattgttatttcactgcatataaagttttgagaaattcatcatagatacagcttggttgtattagaagaaagaaaatatctttggctgtaattaggatgaaaaatagaaataagatgagtacttctatattttaagagttaaatgccttggcgaagtggctcacgcctgcagtcccaaagatttgggaggctgagatgggcagatcatctgagattgggaattc

SEQ ID NO: 42633 - DNA, 1054 bp, Homo sapiens
catactcacttttgaagttgaggaagctgtatctatatatccaacttaacatgtgcaatatccaacattatgtgaaagaaatagagggatagttatgttatatcatagccttttgcctgacacttaggatatgaatattgttagtggttcatttgcttggcattttagttccctcattgctttttcaatttatctcagattattcatagagctgaagatgccgtgtatcaagagttttgtaactgaaagactttttttgttttcatgtttataagacttgtacatgtgtttgtgaatgtttgtgcacttttaaatcttctaagtgtataaaatttattcaattaaaaagaacagaaaaaaatttttaagttccaaagttttttttccttgcgtatttcattttctgaaatacatttgtacgaaactgtactaaagagttattgtagaagaaattgtcaaaattagtcaagaacaaatatgagctatatagaaataggatataaaggtgattgttctctgacattagaaggtgatataaagatgatttgaaaacttattgaacatttctacacagttacagtgacatgatggatttgaaatactggaagtggaagccaaagtttcttccagtcatataaaatgatatacagtatctttgtatgtatgatattcagaaacaagctaattggagagactataaagaatattcttaaagttaagcactttttttttctaaagctaaaataccactttgaataagagcagttttcaaagagccctttaatcagtttatttaacaaatacttatctagctaaatctgggctagcagtaaagtagtgaaccaaacaaaatcatcaaacttaaaatcttggacttatttcatttaataatgtacttttctaatgagacccccaaaatttaaagcagatctagagtcttttttagttgcaacttttaaatcattaagccaaggaaacataagataaaagaagtaatatttattaatttattgtccagacactttacagggccttttatatgttgtttctcact

SEQ ID NO: 42634 - DNA, 1173 bp, Homo sapiens
ttgtgatgatttttttttctttctctttttgtgacacttaagtgtatgaatcagtagtctcagataatttaataaacaacacaaatgaatggatttgccagagtacactttagaatcctaagtttggaaaatagcagtaaaccttagcttacccaaagatagtattaattttgagcattttattcactaatcaagattatgtgttcacataagaacaaccttttctgaaaagtatcctgtggagttttttttttctttttgaataagactgttaggtttagtcaaagaataattacaatatatgtgttttacatatcatgtgaaataattaggggaaggaagaaaaatgttagagtgaccttagcatcttgaatcctgtgaacttacaatagcatataatgccgcaataacatatattgacacatatgatttgtgaaatacaaagatctgagcccttgcatgaagatattttgaacatctgatgcagagaaatgaagatctcttatatgattgctaggtcagatgaaaagtaaacatttatagaggacagatcaataaaagaattttataagaaaatttctgaacttgctgattaaaggcagtatctctcttcaaccttataaagattctgtcacattaatctttctcttataatttatcttgtagtttctccaaatttaagataatttctatctgtgcccctcttaaatgtgtatagttaattttttaaaaattttgctaaaacatttcatttgtttcacaggtgatgatttatgcttactttttagttatatccactatatgcatttttttttttcctgtcaagctgccctttatttcagggagagggcagggcagggggctcagtctttcttggcagcgactttcctcatggcgcccagaacgtttctcagctcctcctgcttcctcttggcgtggatgtgtccccacccttttctcgatgaaacttgagggcccgtttgtccttggagaccttcagtgactccatggcgcgcagctcctatggggcgaacccacacacctctgaatcatgtcccacgcaaacttggtgtgcttggtcaggcgcccgtggtggcggctgtgcctgggcttgctcacgttcttggtcaccttgtggcccttgttgaggcccactgtcataggggtagccca

SEQ ID NO: 42635 - DNA, 1050 bp, Homo sapiens
gatttagaatttttgtcacttaaagctataaatattctaactaatatactcattttaatcattatttgaggagttggaccctcaccagactttcacattacagggatttctatttgcataatgcagggtgggtttagggaagaggattgaggagctttaatagggaaaacagggatggaagtttatctcccaagagttcagaaaggttattaaaatgaatcaaaaagtggtttctttgtcttttgtcttctgaaaatgatttaaggaaatcaaaggattacacagtactcatttacactttcaggttgacatagatattccttgcaatttctgtgacattttcttacaggaaggcttattccaattcttccagcagctacccttacacacactcacacacacacacgtacacacactcacacacacacacaactttacttttggtgggatttttgataggaaatggaaaagagatttaagctactagctttttcttatctgaagatagctgcttctctggttcttattgttatactttaggcaattagatatatagattccatatttccttacatcacagatgacgattcaatctatataaccataggaaagggaactggttaagttagagtatataaaacaatagaataacaaataatatttagataaatgaataatgcaggtgcgaagcactatttaaataacatattttgtccttaaaatatgtatttatttattggaaaattattatttgcaaaaatatcagtgattatttctgggagatagaggtatataaaagattttcattttcctatttatacatttaatgattttctatattatttcaactttgttcatcaaacccatttttttcctgaaacaagaaaaaatattaaaataaaatagaaaaagttcttattctcaactggttgcaattctctgagtagtacactactataggtataattaaccagatgcctcattcctcaagcattcttagtaataacgatttaatatatcttttcttgtgtttctgctcagaattttaat

SEQ ID NO: 42636 - DNA, 1051 bp, Homo sapiens
taaatcttatcctaggaggaaaaacatgctacattattgaaaacttcaaaagttttctgtcccttacttctctgaaagaactattaaaagatcaggatcagtgcaggttggaagaactgaagaacgtatggaagatatatttcatgaagaaaaaaatgttaggatactgcaggttcctttctaccacaaaacgaaacagtctgcaagccagtatttggtggggagaaaatagataattctcggaggaataataatatttctaaattacaaaaaataaactgccagtgactccatgcctcatattatttggggaaagaataatagtaataatgacaaatattttagggtaattccaaagccctccctttccctggaagagaaaagattattcatttgaagaattgttaaccagctggtaacttccatttcgtttagtttggagaaggaggaatttttagaacgaaaaagcttaataaaccacatctacttttacttctttgctactgctaggtttccctcacttaatttttttcagtgactgtaattaagttctcctcaggcttctgtgattagaggttattttcaccattcaaaaaataagcagccacatttatgaggccaagtgtgggtggctcacgcctgtaatcccagcacatcggaaggccgaggcgggccgatcatttgagaccaggagttcgagatcagcctggctaaaatggtgaaaccccatctctactaaaaatacaaaaattagtcagtcatggtggcacatgcctagagtgcagcacgttggaaggctaaggtgggcagatcatttgaggccaggagtttgagaccagcttggccaacatggtgaaacccccgtctctagtaaacatacaaaaattagctgggtgtggtggcacatgcctgtagtcccagccattcaggaggctgaggcaggagaattgcttgaacccagtaggcatagggtgcattgagccaagatcacaccactgccctccagcttgggtgaccgagtgagactccatctcaattaaaaaaaaaaaaa

SEQ ID NO: 42637 - DNA, 1107 bp, Homo sapiens
atttgaagttactttactttagagtgaggacgatttgttgtgacaagaaatataaaacaatttttttatttcttttttaacaaatagggatactgaaaatacaatttttgcaacagtttccattaaaataatatgttgcaatactttagttgaattgtatagttttcttaaaatatttgagtaaaaataagcaatagtgaaattggatgtgtccaaaataagacattattttaaaattgtgtagactggtgacagcctattaaagtaagcaaattccttatgtggcatgagggaaatcattttatgattttgatagttgtatattttggtgaataatcttgtaatgtatcattaggtctgaagttatttactgttattctatacccaacttacaattatttagtctccataagcttaaactaaaacttctttcaaggtagtggttaacagttgttttcaaagcaaatgctaagtctgcaaaggcattccttaatgctttttctttctttcttttctggcagtaagaacttgatttgtgttcatgttctgaatttctttagtgttcctagtatggctgttgaaatctatactttatatgatctcattgtactgcctgcatttcattaatggccgattctgtttagggcttagggagtgaaatatttttcatatgacactacgcaaaatgagtacagtacaccagctgcaaaaaccacaaaccatctgattttgtggcttttgagggtgtgaatagttcaattcttaaagtacagcttatatctgtattataccatatggaagtgggactactgtagacttatgacaaatgtcaaaaatattaaattctcatcagtagccttatttcaaataaagatgagtaatatacttattaagagttattttgtgttatatttgacctagaatcacattatacctttttaatatttggctgcatagttatagtttttatagttttcacaaacagcaatttacattttattcacaaagataattgattactcatagatttataataattttttaatgatttttaaacatactgtattgtactcctattatgcaattttaagcaattatgatgtagac

SEQ ID NO: 42638 - DNA, 1007 bp, Homo sapiens
agttttatagcaagaattgttatggatatttaattatctttagcaacattggtaagtcaaatacatttaaaaatgattaataatagattagatcttaataattagatcccaattacagaaatgtaactttttttcttaatatggatgacatctaagctcaccaagctcaccattctttgaccttttcttttttatcctttactgtctttcctctaccttcattaattgattcatctttctttcctatgcttctcttcttcaaggtttgtttcctttttcccctcttgttgtctactttgttcaaattcgtctcccatagatttttagtcatatttcctcatctcatcaagaatgatggtattcttatgcatttatatcttcgtttttcccaatttttctattttttttaaactttccattctgtagctctgtaccagctgtttctggttcttctggaaagaacactcgtcttatagaaagaacactgtccaggatccaaaagacataaggttgagtgtagttctggcccagctttcttatctgtaaaactgtaagattaaaagaggccagactgaatttcctcacagctttaaaattctataaagtatgcttaggtgtttggaactttggatgaaattgttagctttggaagagagagatgcttttgcaagggtcaaactaagtaacaataccctaccctgcagcagcttccagccccaagtcagatcagccatcagtgcgtgggtatcagcttatgagtattcaacaccttgcctcgtttttttctcaaagcaaaatgggccaaatgggctcatgatggattccagaatcttgtggtaatataaggacataaatatagttcaaagctagacttttaagattctattttcaaacaatatctagagaattattgttatatgtcatgtagaataagatactattgtagaggcagtttcagacattgttcctgtcccatcaatgcttgtgactttactatgttttttttt

SEQ ID NO: 42639 - DNA, 1035 bp, Homo sapiens
ttgataacatctcaagtccttctcttcactttttgcattgtcattaattcagaatgttttaaacattattaaaaacttgtttgcaaagtgttatgaaagcaaagtaaaagcccactccaaaaaagcagctaagtggcttatggaatgcattttttcccctagacttgattgctagttcttgataaagattgaaaagtaacctagaatgggctgtgtaatgtgaataatacttctgggtcattaattatttcttttagttacaaagattcgctataggaacaatgcctaaagatctgaatgagcccagagtcaaaaatgctgaaagggaacttggataaaggtggaaaaaaggttcaaaaataaaattcaaacaatgttgatatgatgaaactatggtggccagggagggggtaaggagtggaacagtagtgtttaaagaaagagacaaatgtaaaaaatacaatgaacttacagttaaaggttaataaaaaattgagattcataatcatgagaaaagtatcaaggacagcaaacgtaagactgatgtaagcttacaaaaatggcaatgaaaatataagcagatatttttgagctatgttcaaatcaaaagaacaatgaataaccttaatgcttaggacaaatgttgtgatactcacagattatggtcacaaagttgaattccggttctaagtcctttcttctctgtcaaggatagtgagctacagttggtagaaaaaaaacaaaaagcaaaaaacaaaaacatgtttcagatgaatactatgctaaataagcaacagtgagacagaatgccatgctaaacaacttatggttatccaagaacaaaagtgggtgatgcctgaaatatgaaaaatggaaagaatttaaacactggagatgagctcaaggggcatattttttaaagtagggaagctggatacttaagcagaacttccatattggtctagtggttttgataattaaatagaaggtttgtgagccttcagaagtggtggcattaatagaaaccaaaatgtt

SEQ ID NO: 42640 - DNA, 1030 bp, Homo sapiens
ttctcccaaaggaaaacacatgattgctcttggggaatggctggaaatcagatttaaccttttatttaggttttttggaggactgaggagatttggccaaataagtgtatgctttttacaacgtgtctaacagccaaaattttggctaagatgtgaatatgcaagaaaagttagcaagctcaatagacacacaaaacaacttttgatgggaagaacagaaaaagggtataaacattgtagaatttatgaaaatattcacagtaaaaaaattcttataaattattacaagatttactatttcttaatgaaatcctggcatggtttcttatgcaatagacaaggtaaattaattaatttaaaatccattagttagcatattgctgttgaaaacaatagtagaaagggaggggttatggaggaattagagccctatcagaacaataaaagattttgaaatttagaaagacctattgcaataggattgcttcctcgcaccattcattttcaactgtatttttcaagtttatcttaaggtttcagtcatagagttcccaatattatatcctcatattttaatatataacttgacagagaaaggtgcaagattaatgtcattgatataccaagtgagttacaccaacacttgcaaaggtttaggtttggccaactggttagtaaaatctctttagtcatatttatttcactttaacttctttggagagtttcccacaattattaaggcaggtgtccttctcacactcttatcagatttggcttgtgggcctttgcctctcaaagctgaattgtaaaatgagccccacctttaggctagttgtaaccacatatttcaatcctgttatatttctggtaaaaaaaaaatggtctaaaatggcagtttgtgccatctgaaaattcactaagtaagttgacaaggaacttatctctttttttttttttagtctctgagagttttgcattttaaaatcatagaccttctcagaaagtagattgttgaattgtgaagctcctg

SEQ ID NO: 42641 - DNA, 1063 bp, Homo sapiens
tatttcaataaacccaggtgcctccaatctgccttctgattcttctgtaagaactcataatgactttcttctaaattggaataacagtgtgtttcctagagctctaactgaaagactagtaattaaaataaaactgacaaatgataatgtaaaatttttctgtctaaatgcattaaattgtaatgctaaacacacactcttctcagttgcttttatcaactggctatatttttcctgcattttgcctgtattattaaatgctaagttacagaatacatctatgctaactgactgtgcatataaaggcaattgttataggtatatgtatgtcaagtatatgcatgtatatacatatgtagtatgtcaaattttgataatctatgtgtattaaatatatactttatgacatactgttattggcattttctattgtttggcagcaatagtgaattcatccaaaataggtggatttcattttacataggacaagaaatacttgcaaacagcaagtttaggtttgaaatttgacggaaaggtttatgccatgttttgatattctgatgtgtgctaacatttaaaacagtttaaaatagttacatgttgtgtgttaatacaggtgtttttggagtaggtctgcttcatagtcacttgttttatacacacttgatgccagagtataaattaccctacatccctcacagttatttatccttatagcatacttgctatttagatcagaccatggtatgagtgtgactcatgctaacattagtggaagctaagtataaaaatgtttattctaatgcctaaaataaagttcaatctcaagaataacgtataaactattttgaaactatgccgtcaaaaaacctctgtgacaggtcgcttacatacacatagacacacacacacacacacacacacacacacacaccccagaaaggacaaaagcagtttcctgaccagattctaaaactccattcaacacaatcatgtggttacattaaaattctggccttaccattgcatccacctgctaggctcatgttggacttttgcacta

SEQ ID NO: 42642 - DNA, 1026 bp, Homo sapiens
ttatagaaaccataatttcaatgattagcatctggatgaaagctgaatttgtattgctttccttggtaaatgactattcaaggcttttttcttccccctcttctaaagatgctgtctctgtaattggcagagagggacatcttgataatggaagtgtgaaggtgtaacgtgtgttaattgatacttcttaatcacttttaggtattaagtcatgatgcaggaatctgcgacagagacaataagcaacagttcaatgaatcaaaatggaatgagcactctaagcagccaattagatgctggcagcagagatggaagatcaagtggtgacaccagctctgaagtaagcacagtagaactgctgcatctgcaacaacagcaggtaagttttgttttcctcagtgcttccttaaaacaaataagcttgttttattgaatatgaaaaatgtattcatagcaaactgagcatgttgtgttaagctaaaagatgctgagaatttattattatttggaacatgattgaaggatgagtaaagagataagattttcatattagttacgtcataccagtaccagagtacccttcaggtgtcaggatattaattaagctcacaggatgatttttggaaggtctgtaaagctttgtaacaaatattttatagcttctagtttactatcttacattgtgctgcagaacgtgatacttagttttccaccagagggccacattacttgatacttgcttatacaatgaatttcttcaagtctgagctaaggtgaaaaggaccacaaggacttttcaaaagacagatgcttgcctgcgttagctgcaaatattagctattaattagttgaaatctgctgagagattgtaaatcatgtaaacactacgatctgttgcttttcttgaaattcattccaagatattttgaatatacatctttcaataacattaaagagcactttttgtgttctcctaagtgtctcataaaatgcaatattctctttaaatctggaaatgttaacaac

SEQ ID NO: 42643 - DNA, 1046 bp, Homo sapiens
agcatattcattgtgcctgtcttgcatgaaagcatttactgaagaaatatgacaagaacatgttcagctaatgaggtcgaatggttgttacattaaatttaggcggtgttttctattaggttttatttatctgtatttgcattcaatcctttcacatttgttatctctcgcccaattccagggatggggcgccttttctcatttcacagccaattgttactgtgcgctgactctgtaagttgctggtgaatgtaaaagtgactgcaattaacctgactttgttgcttgaggagaatttgagatgagaaatctgacagcaaatgacaggcatttttctgggtttagcacagaagaaagtctaagtaacattgcaaagagaggcattagggagtaggtacctgcaaattaagtggctgacactgtctattgagaatttagatagtaacggctggaatttttatgttaagttcacattattttatattcatagcaagcttccttttgagcatttcctttgtgactgtgcatgatctcatttattgtaatttgtattttttggttgatcagaagatggctgtaattgtaatttttattaaagcacattcttaacatgtaagaatgcatatatttagatgaaaacaattttatttttgagaatggattatgtgaacttagattttaatatgataacagcctacccctaattctcagagatataatgtgaaatggtggaaaactttgagcaataatactcatggcaggtgagtattttttttaaataatacagttcaatatcagtatacttatcttgtcatttatttctgttgaactgaaggaaagaagtctgactgtacagtcataattctgtcttgcattaactggctagctatgcttttagcaatagttatttttactttccaaagcctgttggttatgtagtttgaattacaatctttgccttcaaaagcacactctatacaactacctcctgctagtagatagtacccacacagtatgcaacatttattgtatttgtcaggtgttta

SEQ ID NO: 42644 - DNA, 1775 bp, Homo sapiens
ataacaagtgttgacaagaacatggagaaacaggaactctcattagttttagtgggatgtaaaatggtgcaaccactttagaaaatagtttggctgtatcttaacaattaagcctccactatgttactcagtaattataatcctatgtatctatgcaagaggaatggaaacacttatttacatatatttataaaggatatatagcagcattacttataatagcaaaaaactggaaataccacaaatgtacattaattggtgaacaggtattacaaaacaaatattattcaggaataaaaaggaatgaagcactgatatatgccacaatatacatgaactttaaaaacattttgctaagtgagcccagccagatattttataattctatttgtatgaagctttcagaaaaggcaaactgatgtaaacagaaagattagtggttacctggggccggaggtaagaaggagcagtatctgcaaacgggcaagagggatttttttttttttttgagtgatggaaaatgttctaaaattggactgcagtaatgattgcacaactctgtaaatttacttaaaacactgaattgtacattgaaaatgggtgaattctgtttttaagacagggagagtctcactcctgttgcccaggctggagatcagaggtgcaatcatagctcactgcagcctcaatttcctgggctcaggtgattctcccacctcagcctcctgagtagctgggactacaggcacatgccatcatgcctggctatcatatttttagtagagatggggtttcaccgtgttgctgaggttggcctcaaactcctgggctcaagtgatccacctgtctggacctctggacctcccgagttgttgtgattacagacgtcagcagccatgtccagccaaagcgggtgaattttatggtatgtaagttgtacctcaatacagctgtttatataaagagagagaggccaaaaaaatggtgacataattccattgtattttttaatgtcatccagatcaaagatagaattgacacttctttgcatgcagcaagtggcaatctatgtgagtgagttaaaacagagtaagaggaaactccaattccaagtgtaaaggattattccaagtaagaatatcagaagagcaaagaactgcctttatggtagtcctttggcttcaacccacagttcatacccacatccttatggtaggtcagatgatgaaatgcacattgtgtgatcattaaaggacatatgctctcctgtgccctgaaacttttcaaaatgttttcaaataaatcaggcattttatgtgcaaacactcagtatataacatatgtactgtctctacaatatttaaagataactcttacagatctgtactaataaaatagtaaagaataaaattaattttgtctcacgttatgcattctttaattttaaaaaagaatacaaaaaaggcacatgcgatttattctattagtcctgacatatcttgactttgatacaaatatgcatctcttctcacttgtactgacaatcacttccttttctgaacagtttttttttaaagttttattttaggttcaggggtacatgtgcaggtttgttatatgggtaaattgtgtgtcacggcgttttagtgtaccgattatttcatcacctggctaataagcatagtaccctatagatagttttttagttctcagccttctcccaccctctatctcaagtaggcctggtgtctgttgttcccaactttgtccatatg

SEQ ID NO: 42645 - DNA, 1028 bp, Homo sapiens
ttccattttactgttgatgggcatttaggttgattccatgtctttgctattctgaatggtgctgagatgaatatatgcatgcatgtttctttatggcagaatgatttatattcctctgggtatatacccaataatggtattgctggatcaaatggcaattctattttaagttctttgagaaattgccaaactgctttccacaatggctgaactaatttacattgccaccatacattttttactcacgttttaaatcctaagctagaatgtaagatgtttgaggccaatgctaaaacatatgtcatctgcctttgtatcctcaaaagaacctagtgtcactataaatgcaagtgattagtgatcactgtatgtataatagatgccgaattatgtcaaataaacatgagaagttatctgtgccttactcttgactctcggtttccacagtcctttttgaaatctcaccaagacacagacaaaggctgaaaaacataggacacttaatctgcatgtggattttaagggctggctgaacatggaatgacattcagaagtactgtgtcaagttgagcttctcaagttcttgaaatcaccacaagtgatttccacaaccacaagtgtggtggtgatttttatagcacttggttgtaaagcctcactcttagttttctgctaagccatgttagtaatacttcgtcctcaagattggacttatcctttctttctcactagtacagctttattaattggtatatgaattgttttccaaaagaattactgtttttatgccattgtgcaagtactgacttctctatgatgcattaaattatactaacagcatgtataagtcctagactgagaacaaggactcaaaaatatttatataatgtttattttaagattgatgactgtatatttcaaattctgtataacagttttaaaatcaggaaaatagatatttaattaatttgttctatatagttaatatgtactgcatgattacagttaacattttaaaagttcaaaga

SEQ ID NO: 42646 - DNA, 1083 bp, Homo sapiens
aatcatattaaataattaaaatgtatatttatgactttttgaacttaatgtctctgttcatgtaaaacacaagttggtttaattttttaaagatacacgtataattttgatacaaagatatttttaaatgagaaaagcttactcttaaaacaatgttatttcttaaaatgctttgaaataatatctgataaaaggtttcaggatttgttttataatcatcaactaatgttttttatagtgtacatattgagagtaaataaaattggaaaacattaataatcaaaaattacctattttcccagcagaacctgggaagcattttaatgcttgttctttcaagtgataatgtgctgtcagggaaataacagactcttgaaatggcctcttgacacatgtatattttcatgaaattctagatctagaaaggcggtaggatagagagcaaatatattggtgttaaagtgcacatatttcggtgtgaattttgctttaaccaatcatcagctgttgaccttgggctagtaacttatcttctctaatcctcaaattattgtttgatgaaatgaggatcatactgtctactccatgtggatgggggaattaaacaactataaatgtctgatacttcctggggcacacacactcattaaatgattatagtttgttcttgtccttatcagaaagaaagtaagtccctccgtctcatccttccttcacttattcattcattttacttggccttagtatattggactatatgaaaatatagtgcttgcccgctttgagcttacaactcagtgatggagaaagtacatcatttacctagcacagtatttggcttatggtagctgcttaatacataaaagtaaatagtaagtaattacaagttgtaataagtgctctacagaaaaataataagatgttatgagaaaggactgcagagagcaccagattgagaaagtgacaattaagctaagatagaaggatgattaagagctagccaggagcaaaattgtagaagggttgtatttgagtgatgacagctgttagatgacaactaattttttatgccgaataatacat

SEQ ID NO: 42647 - DNA, 1033 bp, Homo sapiens
ttcctagtctcttttattcagaaaaaaaagatgccttattacttatgatacattttaaattgtcaccatgacgcagaaaacagaatttgattttatatatatatgcacacacacatagacacatgtatatacacatatacatgtaaatatatgtatatatacatatacattcatatatacatatataaacatatatacatgtatacatatgtatatgcatatgtgtgtatacgtatatacatgtgtgtacatatatacatatgtgtgtgcatatatacatatgtgcatgtatatacatatacacgtatatatgtgtatgtatgtatacgtatatatatacgtatacatacatacacatgcacaaccgtatattaccttttgatatcaaggatcttagacccaacagtgggaaattgctctaaagagttgacagtgatcattaaagaatcattgtagacattagtcagtctcccaataaacagtaaaatgctgatgaaacacttaactcccagtattctcgagctctggataatgaatgtggtttaaaattaatttaaccagatctaataacaaaaactaaaaccctctaaagtatttcatgtcttgtggataaatctcttatgtgttgctagaaacaaccttttattccaaatctaattttctttccaactctgaggatatgttgatatagattattttaactcaacaagtttgaggtagtacactaacctgagtcattatgtgtatataaaattgcaatcatcccatttccttttggagttttatagataagcttcttacttgccctcctgccccctcatgtacatattttaaattatctgtatacatttttaaaagttattataaataattatatagagaagtaatttggttatattttaatttattttttcaaaagctcaaagtacatttaaatctatacttaaacctagccagtcctgagaaacaactttgagtcacaataaataagagtttaagaaataataaggatcagttccgaattacagtgaca

SEQ ID NO: 42648 - DNA, 1030 bp, Homo sapiens
attatgttttattgttttagaggtcttaaattttttttaaatagtttataaaagttaatcagtgtgaacagatacttatttctgaacttttaagcaaacatataatctgaatatttaggtgaggtatttcagggtaaatgtttaaatctgtacatttaggtatccttgaaaattaagttgaaatctagacaatattacacttgctgtgtagtattgatgaaaatagtaataatcatgctaataacaataagaagaataaggaggaggataatatctaatatgtattgaacaccctacatttttgggattattctgagtactttacatgtactcacttatttaatcatctcataaccctttgagatgagtactgttcacttacaaaatttacagaaataggtaatgaactatgaagatggaaataagtaatgatgtgtataactgataaataaattttccaagttgagaaagctaataagtggtggagctgtaatacaaacatgtatggtataacttcagagccctaatcttaccctttacacggaagtcctaaagacatagtctcctcatttgcaaaatggagtcaatactactacaataactcttgctgccatggctcctgctactacttttcatgagatagcaatgtagaattaataataaaacatattttgaaccatacaaatgtaaacggaccctttatcaaacatgtctgtattagttctcacactgctaataaagacatacccgagactgggtaatttataaagtaaaggaggtttaatggactcacagttccacatggctggggaggcctcacaatcatggtggaaggcaaaggggaagcaagacatatcttacatggtggcaggcaagagcacatgtgcaggggaactcctatttataaaattatcaaatctcatgagacttattcactattacaagaagaggatgggaaaaacccacccccatgacttacttacccccaccagtttctcccacaacacttggggattatggaagctataat

SEQ ID NO: 42649 - DNA, 1049 bp, Homo sapiens
aaaagtttttaaaaaatatttattaagctcattattatgtttctttattaaaaaaaaaaaaaaaaaaaaaaagggccggacgcagtggctcacgcctctaatcccagaactttgggaggccaagacggatggatcacgaggtcaggaattcgagatcagcctggccaacgtggcgaaactatgtctctactaaaaatacaaaaattagctgggcgtggaggcacgcgcctgtaatcccagatactcgggaggccgaggcaggagaatcacttgaacccaggaggcagaggttgcagtgggctgagatgcgccattgcactccagtctgggcgacagggtgagactctgtctcaaaaaaaaaaaacaaaaaaaaaaacacaacaaacaaaacccctcaaactgtaactctcttttattttagtcttcacagaagtaatcaaaacaattgtttgcactcatggctatggttttccccattaattccctagtaactctctgcaaactacttctacttcagtaccctataggaactgatatctgataggtcacatacaaatcagatcaacatgaacttttcaacaaatcttgacctttttgagtttttgatgtttgaagatagtatcattcatcctgtcctctcacaattttttaatatataacaactttattgagatataatttatgtatcacaaaacctacccttttaatgtatacaattcagggagtttttagcatattcactaggttgttcaactatcaccactgtttaattccagaacattctcatcaccctaaaaagaaaccccattctcattagcagtcactttccattctatcttacgtctgggcccttgtaaccactaatctatttttttttttttttttgtctctttaggtatatctattccaggcatattatacaaatggaatgatacagtatatgatttttgttactgactttttttatttagcataatgttttcaaggtttatccatgttgtagcaggtatcaatattccattcacttttatggacaaatattctattaa

SEQ ID NO: 42650 - DNA, 1076 bp, Homo sapiens
tctcctttaatatcctccccatcctcaccagcacacacacactatgtggaattaattattcccttccatatattacttatatgtcttgttaatgcatctattcttatatgtatcacaccgaatcataattactataagcttcttgagggccaagactgtgccttattcatcttcacatttccactatctggcccatcataggttttccataaatttgttgagtctatagaccagtgtttgtatataactctatcaagcccctcttttctcctaggctccagatgtgttttttcacttgcttactggggcatctcaacctagatcaacatgttacaaagtgaagttatttgtttttccttacccagtccaatgttttcatcagcttttcctgacgccattgtgtagactccagccattaagcccttctgatctgttagtgtcgtattcctctgccctaatcatgtaaaaattgccctgttcttcaaccccagcatgtcacaaaaggcttttcgtagactggtgctatgcaccatcatacacctgatacattacaaccatgacttaatccttactgctctccaaacatactatttatttgttcatttattcattccttcattcattcacaaatgaataggttgttttacatatgccaggcattttgcagggcatcattaactatgcaaactttgataccaacttgtttttgttcctgcttctcatctgtttagaaggtcattccaacaccccttatctgattggcaaactcctatacatactttgaggcccctaatccctggagtcttctctgatgcatcaaaaagaaaaaaaaaatccctcctcacacaagtgaatatccagaattgcatttttattttattatcccaaatatactagttacaaagatagattataccatattttattacagttatctgattacttctctagctcaatcgcagactctaaatcttttcatgtcagagattgcattttattcatgtttataacttcacttcttaccacaatgcttgacacatggtagatgctaaataaaattcttgccaaattgaatt

SEQ ID NO: 42651 - DNA, 1051 bp, Homo sapiens
tttaaaaaaagagagagaaaaatgtagaaaagtattttaataatttttttacattaaaaagattatcatgctaagagtggcaggtatttatttttcttcattactgagactaacactagagtaataggtgctgttttaacatgagaaaaatcagaatacttgtaaggtggaccctcatactagcaaaggtatctaagagtacgttttatgacaaatatttataactactgttctttgttctatttgaaaatagccttatttctagtgattaacaaaacaatatgtgctttcaaaaataatccaggcaatacagaaaactatgaagaattgaaattcacttgaacttcaacctcccactgatactgttaacacatattttacattgatgttatcagaatttgtgcgtacattcatgagggatcatcaagccaggctagaaatgtatgtagtttcatattttgtagctatttttaaatgtgagattgatgtttagggtatagcttactttaggaccatggaaaagcaagaacatcttttaaatgacctgctggtattcccttcatgctttataataaaggtaagagataagcctctgtgctatttgggagaggcactgggttcaaggtttgactccaccatttactgactgtatgaccttcaggagggcaattcggttctatcgcctcattgcctttttctgtcaactgggaagacgtgactcaagctctaaaattttgttatctcaatgctttattatagtaaaagagtataccttctcagtaacatatatttacaaaaaattatccttttttatgtgttatatgccaaaagttttaactttgataatgagttagttttccccttatcagcaaaaacaagaagaagcaagattattttaaaagttggaagtttattactcatttattcaggttaaaatattctgatactcgaagaaaaagtgaaatttgttgttggatataatacaatgtccatattcattacatacgttattccattatgttccacatacccctatgacatgccagcttat

SEQ ID NO: 42652 - DNA, 1030 bp, Homo sapiens
cccccctaaggagtaaagcatacagtaaaagagatgctggtactttgtgaatttggaaaaaaattataatatgatagtgtttttctttacatataatagatattgcagtgaatcttcatgcttcattcattgaatcaagttctaatccaaaaatacattccaatggaaaagaccaccaaaaagtaattaaagggtttgcctcatccacaaactctgaggacatccatggtcagttcttctatgaaagcataataccctatataagcacagcatttattgatgctgataagctttctgattaagttcacaacaaatgcacttcagaattattttgaatagttttttctagtttattgcttaaaagtatatctctataagaatatcagatacagtgagatttctattaagaaaaaattagtaactttaaagatcttttgtattgttttttgaaaaaactgtaaaacaagctaaatgctatataatacatctactctgttactatgctgttttattctgcctactatattattttcctttttttagtaattttatttttcatttcttgaaattaatatgtaaaatacagtttttacattaagcaagaaagacttttgcttgaaaattaataaatctctacattaaattcttgggctcaaaccctgttttcatacattgttggacaatgagtcaaggtggaaaatctaaggttgttctgtgctcagtgtcttgatttgaaatattcagaatatagacttactcagagattggaagctggtttaatatgttgtgccagccatcctgaaagccatttcagtagattctgtaccctggcatttgttttagaaataattgcatgcaaatgtagttttacatctgtactatgtctcttaatcctaaccaggcattttccattagatgtagtctgaaaatcgcattaagacaaatatatatcatctgtgaaattatgctctgaatgctctaaataggaaagaaaggggcaatattcatgttaaatataataagaagtatt

SEQ ID NO: 42653 - DNA, 1033 bp, Homo sapiens
gccaacaccttcaattggagtcacacccctgtgtatctaattatgcactggtgccaaataaggttagcaagagtagcacaaggctgttgacaaaataatttagatgaaaatgtatttgttgaattctggcagcaaaatacaacttgaacaatttccccccagtcttcatctgctagcatcaggtgacatacttcttcctaagaaacagagggaaaaggatattttggaagccatttttcctgtttgaattaatgttgctcttatcttcaagaaaatggcatgtagtcatgtaaagcatatacaatccatttcttaaacataacctctgaacttcatagatgtatttgaaaagaattatttataagatgtaatatttacatgcatcaaaccactacaaatactccctgacacccttaacacatccctccttgcttttcttcttttctggtatagttataatttcccttgtgtatcttatgaatggggatcatcctttcatatcatacatgaagtctaaggatgtgttgtcacatggtctattcaaatgcagtgtaatccttttgcccttcagacaaaatctttgaaatgtctaatgctacttaggtaaaaaatgacattccatgtcatttatcaataaataatcactttgcttttacagataaaaatgcaaactatacatttgagtatatagagtagttttcaatgcaaatggtacaattcaacaggttttaacagatattatggaggttggttgcatagtcttagatacattttagtggcaataatttttatataataatgcataaccacagcagtttatttaaataaattattgtgattgttctcacatgacatggtaggacaggatttatgttcatttgtactggttacaattgattacaagtcagaggtttgctttttcaaaattattgatgattacattttaagaacaaataacatcccatacaccaaaattgcagtgtcatttaaatatataggagtatttatgattcttagcttacaagtgggaagt

SEQ ID NO: 42654 - DNA, 1027 bp, Homo sapiens
cagttccactggtgcatctttgtctttttgtcacaatcactttcctcatttatgtcattaagttcaccttcactaaattcctctggttgtgtacgtagtcttcaacggtggcagtgtcaacattcccattgtcagctctttattctatagcttgatttaccttctatttgaatttcacattcagcattatcactttttgtttctttgctgcattttcatcgtggttggccaatttcctcttttgattctccgttttgtaaaatgtcacataggtttatcacttggagacaaggagacaacacaactatattacttgctgtctgtgcatgaactaacagttgctcagtgatcagtcaccaaaaactttgaaagaagtgacatgattggttattgatcatgatgcatatctgttgtgtatgtagtgatttatggactaaagatctagcagtgaagtttatactttattcaattattcatagttaacatgctatggtaactaaaatttgaactgtgttgttgggagacttagattatttagctacaccattgcaactgaaattcttgtatattactgtctatatctacaaaatgattgagctttgaatggtaaaactgatttcaaaaaattccatgttttggtatttttcatattaactttaataaatttacattactttttaaacaaataaattctgttaaaaattggtatttaaaatgcagaaaatgcatcagttcttgatgggagtgaaggtaacagaatcgtaagtgaattttaaaatatattttaatattttaatgttaacattgtacatacatgtatatatatccttaattgaaaccatttgtaaaggaagattacttttgtaaactttttctacaattaactatgttatatatgtagtcagtaaaccttattgaacaccaggttcattgaagatgaaagacgcccagtaactgctaagaggttttttcaatttgtgttttttttttgtttttgaggtagagtcttgttctgtgactcaggctg

SEQ ID NO: 42655 - DNA, 1122 bp, Homo sapiens
ttcttgccttttttcagttgacctcttcactgcaaagttggccaaactctgtttgttgcttacttagtaaaattttggtgtatctacatgtttttcagacattcaatccacgtcaaggaagagccagtgattgcagaggatgaagactgcccaatgtccttagtgacaacagctaatcacagtccagaattagaagacgacagagagattgaagaagagcctttatctgaagatctggaatgagaactgacttgtgaaacctcagcgtgaagggacatatcactgaccttcataaccactccacaaccatgaatatttgacaaatttttactgtgactatttattaagcatggataaaggagacagccctaaaggaacttactaagccagccctttgggattcagtaccaacaggcaaattgcttgttttcttcttcttcttcttctttttttttttttttttagaaaaaaagacaaaaactgattttcttgaaaaaaaaaaatgaactgttctttctataatggctttgcccatttaaaaaatgtggctcttaagggttcatgaaatgactgaatatgaggatacatgtcctgtagaaagcaaatgcgcctcatatactgccaaaaatagtgttagtttcattaatgtgaattttccagcattcagtagttgtaatgttagaaacaattgctggtcaagttcaacttgttgctattgtttttaatttgcacaggagtagtatcagaaattagtgtcactgcttgtatctagctgaattttaaacaacagaacattagttttttatgttggtgccaccaactgtaaatgacataagttagttattacaaaacacagtaattagactgttgcaaccatctaaaaccttaggcttccagtctgtgctgttagtgttaagatgtaaagtgcaatcctaagctaacattatctgtgcaagcaccatagaaacatttgcatatctgcatagatcttacaactgtactctttacctccttgtgataaagctttgtctacctgcaaacacagtcaaaggctacagctgcaaaccaaagccaactctaaccatggccaagagctcaaggacagaagcagccacatgcttt

SEQ ID NO: 42656 - DNA, 1039 bp, Homo sapiens
cattcagctctgtagaccccacatccctcagcccagggccatgcacatagtttcccccaaatacatttatgttaattgttgaataaatgaaagtctttaccttttgactacatttagcgtctctgtaggagactgacagctttcaattagttaagctgtggtaatttgtttaaaatgtggattgactatctttgcttctcttaaggagctaattttctcagtccgcagttcatgcatattaaaagatgtttttattagtaatattaacaatgttattaccatagctttttacagttaatgaagtttttcatatattgctctaacctgggctatcagcagctcaagcatatgggatgagtatcactattatttatctataagactgagctcagaaaagtcaagcaactgacctggggccatgcagctaatatcttgatttttcagcatacacccttaaccctagagtgattctcaaatggagagtggggtagagataagggtagggaagggactttgtgatgtatgtggtcctctagagagtgttagaatcataggagaggagacagttgttccaagttataaccttattccaagctcccaattctagtccactttcctagttgaaaattactgctcttttaccactagtattaataagactgcattctgcccttgtgttggcaagagaaaagttggaaaaattgcagtatactatactccttcagaacttcatctttgttgtgctaaattcaaaacagttcttgggcttaatacataaatattatatatatatacacacacacatatatatatatacacacacacatatatatacacacatatatatatatatttgacatcttagaaaaaaggcatttttattctttaataccatttacttattgcctcctggagaacttggtctcattccaatggataggtagagaatcagcatatgccatttttaatgtgcggtaaatatgcattttccttctgcagcaagacaaaatcttgataactgaaaccaatgatatgaggt

SEQ ID NO: 42657 - DNA, 1019 bp, Homo sapiens
ttttaatgtttagcctacagcctagtgcctggcttatacaagttcagaaaaaagtgagttaggagtgtcaactggagaactagacttgttctttattactccatagacattgtggttgaaagggcaggaatggctgaaattcttaagggagagaatgtgaaggaataaaaggaagggcaaatatttgagctaaaagaaatgcaaaaagagacccagcagagggaggacagttactcagagatcctacttcccagccccatcaagttttctcactattccgtatgggtttcaaacaactacatattcttgaatcctgaaggtgggaaaagaaattagaaaggtaaaattgaaattgagttgtttgctgttacaatactgtttcaacagtattgtaaaatcttacattaattttttcccataaaaagcttttccgttttgcctataattgtagaagtactacagtagtattttagtggaaagataataataggagctcatgatatgaccataaagttataatcagagcttccagaaacaaattttctgtgactttggaaagatatgtcactgcattcctcaaaatacttaatttgcttggatgatgttttgttttgttatgttctgttttctcaggcgcagtgccttccatcccatgttacaataatggtgtgggcgaaaggtttagaattctgctttccaatgcaatatttgctagttctttggaaaataggacttcaagaaatgtcactgctcagccaacacattaaattgaaaaatagtaatacaatgaggagtgtgtgtatggagagtaggcatgatcagagttgactatatcaaagtataaatcattctgcacatataaatcattaatttttgtttacttgaaatatttaaattagctgtctttttttaaaaaataaagcaattatccatcagaagtatttataaatagtaagtgtttctgtagggccaaaagtaaacatttaagtgccttatcttaaagtttaggaaaataagtt

SEQ ID NO: 42658 - DNA, 1004 bp, Homo sapiens
acctttggtgactaaaaagcctttctcaaatccctactcctacgtcattccatgagcatttattgagtttgaatggaggggattgatagggccttaggattctgagttccaagtctctgacttgtgttttggatcacaaattgattaaaatcgatagcatcttatattttatgttcataaggcccttaattgaatttaatcatagcttttacacatagtatagtataagaagtaaaaacaaacatagctaagcaaacagctaaagagaagaaaatataagtaaagaaaccactgcataatgcagacaaatgggaaacagtaggttaattttaaaatatatttaaagtaaatttatgctttagtatgctctactcatcattgaattactatcacaaaggcttgaaaaggttaaagcttaatctataataaaaaggagttttgattaattgtgataatcttttacacagtgattctgatcatttttgatcacatgggcttctttgagaatctgacaagagttatttccacccgcaaagttttaaaaacagacaacaagatcctgttagcactgtgttattcttttttttttttctttatactttaagttctaggatacatgtgcacaacgtgcaggtttgttacatatgtctacatgtgccatgttggtgtgctgcacccattaactcatcatttacattaggtatatctcctaatgctatccctcccctctgcctgccccacgacaggccccagtgtgtgatgtttcccttcctgtgtccaagtgttctcattgttcaattcccacctatgagtgagaacatgcagtgtttggttttttgtccttgaaatagtttgctgaaaatgatggtttccagattcatccatgtccctacaaaggacatgaactcatccttttttatggctgcatagtattccatggtgtatatgtgccacattttcttaatctagtctgtcactgatgggcatttgggttggttccaagt

SEQ ID NO: 42659 - DNA, 1033 bp, Homo sapiens
aagtgcctggagaattgttgtgtatgatcccagtcctgtgaatattgtcagtatcagtcagccttcttttagtgtgtttgtttcctcccatgctgccataaagaccttatgtcctaggtgacctggccaaccctgtgcatctctgcagtaggctaatatcagtgactgaaaacactggatgtgaccaaggtgttattttactcatcatcatcatcatcatcatcatcttttacagaatcacccagtgggtacattatggtttaagttttgttagcaagacaaaactgatttattttcatttgttacttgcacaatgtataagccaaggacaaatgaaaagagatgaagctgaaatgtgaattgtgaaataaacacagttgggaaaataaaattagaaaatatattaagcatttgggagagattttttgggttatttttaccccaatatgaattttcattaaaactagacgatttacttgcatgtatttttgtcctagccataaatggtattgttaccaacttgagtgaactgttgcacattgatcctttctgggaaaatgtgtttaagatctaaagtagattttattatccagaaattatattcacctttgttattatttaaacttcttatattagaaatatttcaactggccaactgaaaatagccagcactgaataggttcaagtaaagtatagtttctagcttctggagaaaataaatagataataattgaaatatggaaaaaataggttattatttttaaatcttctgctgtagccaaacacaaggttactaattctctctgggcagacttatgcttcactcctctgcaaattctgtttcttagagttgccttcttggttcattctttcaagtgtttgagctgtggtcagagccttttacaaacctccttaggttaaaatagaatggtccgatgtccgtgtggtaatcagagtaaatggaacataggtaggtggagaggtgtggttttcctagaataaatattttgctatcatcttcactgctgtcaca

SEQ ID NO: 42660 - DNA, 1055 bp, Homo sapiens
tttctttggggcagaaattagctagtgactctttggaagacaagagctcccatttgacacgctagtcctctgccccaaaagaacagtagagcaggagccagatgctgagttttaggtctggtttgctattgagtagctgtgcaaccaggagcaaattatccctcctctctggattctattttcctgatctcttacatgagggagatgcctagtcctgtccagaataagaatatgtgggagactttaaaagagcagcagttcatgaaataccaccagctctagtaattctaataaataaaatgatagctattttaagaatatattgatgaaaagtgtcaaactctgtaaaagtatttgaagatcttattctgagccaaatatgagtgatcaatggcctatgacacagccctgaggagactctgagaacatgtgcccaaggtggtcaggctacaacttggttttatacatattacagacatccgtcaatacatgaaagatgtacattgcttcagtctggaaagacaggaccactggaggtggggggcggtccttccaggtcatgggcagattcacagattttctgattggtgattagttgaaagccttattatctaaagacctgaaatccaaaaaaaggaatgtctgggttatgataagggggcttgtaaggaccaaggttttatcatgtagatgaagcctcctggtagcaggtgtcagagagaatagattgtcaatgtttcttatcagagtctgttctgtcagtcttaggtctctgtgtttctgctaatgctggtcagctgtgaagcagcgcccacccacccccagctccccatttcctatcatggcctgaactagtttttcaggctcactttggaatgaccttggccaagaggtggggtccattcagatgcttcatgggtttataattttatttttgatttacaaagataaaaagttggtaggagaaaacaacttgcccctttgcaaagttgactttgtaagtcagtagcgagctactccaaagccttagtgtaaaaactgctgactcatggagg

SEQ ID NO: 42661 - DNA, 1028 bp, Homo sapiens
ggttcccagaggctcaataccagcaccatgagccgcagcacgcaaggcaaacacagccggaggtgagcacatacctgcttcgcaccccatgcgcctaaccacaaggttccctccctccaggaaggccgttgtcttccctgggacgacttgccagctctgaggcatgacagtacgggcccccagaagggtgaccaggaggccctcctcgtcccagctgccggcgtcgccgcccactgcagggcccgggctgtgactcgtggggacggttccctgcgccccggcgggggaggtgggcggggaggggcggcggggcgccggggcggggctcgggacggccgggctgggagctggagcccacagcgggaagcggccgccgcccgggcctcgcagggctaggcgaggcgagggggggcggggccgggcgctacgggaaggggaggccgcgcggaccgggagccgcaccgcgccagccgggctgcagcggccgcgcaccaaggctgcgatggggctggagacggagaaggcggacgtacagctcttcatggacgacgactcctacagccaccacagcggcctcgagtacgccgaccccgagaagttcgcggactcggaccaggaccgggatccccaccggctcaactcgcatctcaaggtgaagcccggggcgggcgggcccaagtccccgctgaggccgggaggtgcgggcgcccctcagccccgccctaacccgtcccaccattgctaccgggtcggccccgcagggtctgagacccgcacccttccccggtcccacccgtcaccaggccgcccgcgtagccaggaattcttagccaggttcctgtgcgcccaccgtgaccctaagagaagaggcggacgccctggcacgtccttccctcctgcttcccccgcccaaagcgctcccggttcccggggcgtcaggttggctgacagttcggggtccctgcgtcctgtctcctcagctgggcttcgaggatgtgatcgcagagccggtgactacgcactccttt

SEQ ID NO: 42662 - DNA, 1066 bp, Homo sapiens
aggggttctgctttctttgttcccctaagagacctgactgctgttccagggggcaaaaccacgtaggtgggctagagtttaggggcttcggaaactgaagagacgtggccacggcgaggacgaaactagaatggggcttgtctttttagggggttgcttctgatggccacctgtatgacttaggagggagaggggcgctgggacagtgggtgatgtgtgactgttacggcccagcaagttttaaagctgggatctgactcagcccttacaaaagggatccggtcatcctcgtcccaccgtgatgcagctggcaaggtttgagccgagctgtttccttgttcccagccttgctttatctgtgttatgttggggtccttccaaggggcaggtgtttctgtgaaagtctgaattcatttctggcaatcacgcggggcttgtgatccatcaattttccatcgtaccttatctctttctggggcttgtggtggacatctatcttattaggtgaaatagattataaccagaggctgagcgatgtggccagtcgtagtgctgacccgataattaaagcaccagtgaaagtactttccctgactattgtcaatgcagaatttactccgaagtacggtttcccattcatatctttcatgttttaaaagagccatttgctaatttggcagttggagagggctccaatggctcacgcatgaatagttgcccagtgtattttaccttatcacagttttatgttcaaaggagccctcgggcagaatgaaatattgtcaactctcttaggcaaaataatcaagatactttaattgctatgttaagatggtccatgaatgtgagaggattgtaagaactgacgttggaggcaatatagactatctggaccctctcttgaattttaagaagactgttcacattctgtagctttgggtgggggtttattctgtcgctttcatcagccagacacatgcacattgccatgcaaatggattcagaaaaacattatattcccttacagctaaactattatagctgactaatgaattttttctgcatg
